United States Patent 7,745,391 (HUMAN THROMBOSPONDIN POLYPEPTIDE) - sequence listing, part 200

SEQ ID NO: 472308 - DNA, 622 bp, Homo sapiens
tgacaagggtgtcaagggttaaggatggagttcttgggtgataacattgctatgcaaggagagtttgctgcaacattttataactcaagagctgctggcccaaggctatgctgttgcaaaatatttggatccatctcacattgtggtgatgagaacacaatgagcctgcaccgcgctggttgcccatggggtggctgtgaggacgaacggtcggcgaggctccacagtccaggcggaagaccgtcgtccaagcaggaggaagaggaggaggtggcccaattgttggccgacttccccctagctgccggcgcggcgcccgcctcgcccaggttggccattaggcagcctgtccgctcgccaccgcctggccgtgtgccgccgctgccttccccagccgcagccatgaagctgacccaccgcatgctgcttcgaagcttctgtatcgccaacgtgttctgcgaaaactcgggacaagattaactgcttcgatttcagccctaaaagcgaggtgatcaccttgagcagcaacgacgactccatcgtgctctctgactgccaggagggcaaaccaaaaccctgttcagtaagaaatacggtgtggcctcatcagataaactcctgc

SEQ ID NO: 472309 - DNA, 894 bp, Homo sapiens
tctcctcactttggaaacttcttgctggcatttcctgtgtcttaaagaccatgggcactcattgtccagaggagggaggtaacagaaacatttcaaggctttacaaagctgccctcccatacaggagttatgcagggctttgcgttactacaactctgagggtcgagagggtccaaatcaaggtgtcttttaaacctcagctctcgtcagaccccattctgagttacaatcaccaaatggtacactcggaaaataatctcccatggatggagctaagatgcattaatctggccctggagactctggcgtgtttgacaatacatttcaaactgggtctcagaggtcctgcatttggagatgaggccagagatggccataagaagatgtcagagtttactgctggctgccaggttctttctccaccatgcttcgttggacggcaaatatttgagctgctttatgaggatctgggacattgcagagtcttcaaattcacagcaagctgcccccacgtgagagttaattactcataccaggccctgtttgcagcgctggctgtggaaatggttcccaatcctcagtcacgtctaagctgtgaggaattccctttcctctacagttctgcaagtgaaatttggaaggcaaagttgaggcagcagccatttttgtgttcggaaggtgggtataggtaccaggtgtgctctagagacatagtacagtgggatggactgcggagcagccgccacaactccagccgattagaagaaactgctgactcatgcaaaagtctgaggcaagtttctgcagtaaaggaagaggcgcactggagatattagaaggcaggcaacattgacttctctatccagtgctgacgcccccttcacatttcccgag

SEQ ID NO: 472310 - DNA, 871 bp, Homo sapiens
ctttttttttttttttttttttagaaaggccacccatcgtctgggatgtgaggagcgcctctgcctggccgccccgtctgggaagtgaggagcacctctgcccggctgccctgtctgggaagtgaggagcgcctctgcccggcagccccgtctgggaggtgaggagcgcctctgcccggccgcccatcgtctgggatgtgaggagcgcctctgcccggccgccccatctgggaagtgaggagcgcctctgcctggccgccccgtctgggaagtgaggagcgcctctgcctggccactgtgcaaccttccaagtgtgaagtgacagcctttctgcaggtgtacctaacagctccaaagagacagcgaccatcgagaacgggccatgatgacgatggcggtcatgctaggagaagactcagatcatcaaggagtaagaactcagcaagaaatccagacccctttaatgcaaagatctctgactctttcatttccaactcctgagcaccggcataaaggaagggggacctggtcctctatgcccttactcactgaatatcctcagagtgtaactggacagctttgcagaggtctctgtggctatctgggcactgtaaaagcctatgttttccatctccaggttgctgagctgcggggagtaggactgggtgaagctcagtcgcttttgccatttcggatgagtcacgaaactccaggggaagagttactgactcccccagaaccccattcaccatcaatggggttgagctgctttgtgaaactagattccctgtgaacacagaaggaaaaggctacaaaatgtccctgacaattgtccctccccacaagtctcccagtcagtcatagctcccct

SEQ ID NO: 472311 - DNA, 1376 bp, Homo sapiens
aatctagaaaggggtgtcttcagcttatcttccaacatctctggacctccaatctcttcctccgccctgagtgcttttcccgacattatgttctctcgtgccaccagcctgccagacattgcaaagacagcagtacccactgaggcatccagcccagctcaggccctgccaccccagtaccaaagcatcattgtcaggcaagggatacagaacacagtgctctcaccagcatccttggctccactgctccctgccagagactcagacctggtcctttcctttgcagactgcagcttgggggacacccagcacggagagaagctgaggcggaactgcactatctaccggccctggttctccccctacagctacttcgtgtgtgcagacaaagagagccagctggaggcctatgacttcccagaggtgcagcaggatgagggcaagtgggacaactgcctttctgaggacatggctgagaacatctgttcgtcctcttcctccccagagaacacttgccctcgagaagccaccaagaaatccaggcatggcctggactccatcacatcccaggacatcctaatggcttccaggtggcacccagcacagcagaatggctacaagtgcgtggcctgctgccgcatgtaccccaccctggacttcctcaagagccacatcaagaggggcttcagggagggcttcagctgcaaggtgtactaccgcaagctcaaagccctctggagcaaggagcagaaggcccggctgggagacaggctctcctccggcagctgccaggccttcaatagtcctgctgaacaccttaggcaaattggcggtgaagcctacttatgtctctagagagatgccaataaagttagtcacagccttctgtccagtctgaggtcaccccgcacagcctgctgtccttcccagaacccggctctcatcacctttggctaatggttgcctagcaacaccaggcacacaccctcccctttctctcttttaaaaataaagacaatacttgaagtttgggaaaatcatctaagatagaggttctcaaaggtgcccagctggcagtaccagcaacccctgggaactctcaggccctcctcagacctactgaatcagaaactatgggtctggggctggcggtctatgtcctaaccagccctccaggtgactctgatgcagctcagctgtgagaagcactgctctaggattctggcctctgcttggtccctatgtggtcagtccttgccccaccctgggaagaaggggctggatgccctttcctatttgcatggagaagaatctctgcagttttaaaggcttctttgacggtagatcttctgaggggggaatgtggaggaaaatac

SEQ ID NO: 472312 - DNA, 626 bp, Homo sapiens
tgctaacaccaagataacagagatgttagaattatctgagaaagattttgagagagccatcacaacaatgcttccacgagcagctacaaaaacttttaaaacaaatgaaaaagcagagtgtcagcaaagaaaaagaaataaccaaatagagatattagaactgaaaaatataatagctaaaataaactcagtagatggactccacaccttcataaacattgctaactgcgttaaattaaaagtgcagaaaaaggaatggacgtgggatgagagcaagatgctggtgatgcaggaccccatctacagcagtcggaccaagggaagccctttcattctgcagtgttgcccctccattctgcagaggaatcttaccatcgtgctgctgtacaggagatgtgcttaaaggaattccgtccattaccacagagcttgtattgaaagactctggaaggggtcaaaggcacaaagggtcataaaaaaaatcagggaatgaggtataccccgttctttgcttatgatatatacatgtctcttttgctctctgtgtggtttataagtgatggggtgacatctgcaccttctgtactgtttctgtaaggttgagtgttttctcttccttcagcctc

SEQ ID NO: 472313 - DNA, 643 bp, Homo sapiens
agcagcttcagaaaggagatgagagctgggagtgcagcagaggcagggacctttacgttatgcctatttctgggggccctgtcctttcctgcggccttgcctgcgctagctaataggaagtttgcagattttttctcccatcctgtggattgtctcttcactttgttgattgtttcctttgctgtgcagaaactttttcaacttgatgtgatcccatttgtctatttttgctttggttgcctgtgctcatggggtattactcaagaaatctttgcccggtccaatgtcctggagatgtttgcttctcccccacagtacgtaggaagcctggacgtgccaaggcccaacagcagggtggagatcgtggctgccatgcgccggatacgggtgagtggccagaggtggactgtgtggagcggggagtcaagtgccttagctgctggcccttctagtgctattgttgaatctgggatgaagcatggaaaaacattttataaaccataaagtgctatttatattcattggtatcatttttatgccttcctttgggtttcaaagcatttcataaatgcagataaataccctgagagatactgagctgcctcatctagccccttttaatagctagcgcctttttttcagg

SEQ ID NO: 472314 - DNA, 1025 bp, Homo sapiens
acctcaccacctttcctttctgctcacacctttcaagtttaggttctggagaggttctcaggggagtaggcacatggcctgggcctacgggcttcttggttctcacagggcgccgagtgggagagtcttggctgtgagggtagtaaaggcaattctgattcaggcacaactcttaggagtggaagtctttggcccccgagcagagagaacttggttgcaggaggacaagtcctttgttgggaccctcatcattttctggcccaaggatacgaaaccacgggacagaggtctgagctcagacaggtcttggcaagcctggctcatttcacttctaatcctctgtggccaggcccctggagattacagaggctgccttcggccagtgaatggcacagcacggctgctcagagaggtggaaaatcctgaggcccctccagcactgtttcaagaaaaacgctctgagtggtgtggagaggggccagctggtgatgtcaagagatttataaaagagattacaggaccttttaagggagtgaggcagttgttaatgatggaaaactgctaaagctggatctggatgagacctgaacacttaatttgctagttgtcctgaaatgcctgtaatttttagaaaacatattgtgcctctccctttgtgtggagttcaaaagacaatattagagcatggtgagaacctgttatgctaatcaaagtctggggtaactgaaattgagctctcaggacacataaaactcaaagtgggagatcttgaacctgggagggaaaattaaggtccaaacacacctggttgcactgtgcatctgtacttttcttttcttctctcctttcctctcctcttcttgcttgctttttaaaagcacactagtggagggtccagagcaagctttatgtttttaagcaactacaaaactacctaaaagtttttcaccaacaaagagagatctgaaaataacattaatttatattgcatttataaggttttccgtagtctttttacagccctc

SEQ ID NO: 472315 - DNA, 619 bp, Homo sapiens
cagccgaaggcgctaaccgatcgcgctacagaaacgggcggcgcggctcacagccctgagcgaggcaggtcttttttccgcgctagcacttgcctagatctggagcaggactcagcttccagcagaagaggctgagaaagggagagcagaagaggatgcaggaacgaagggtcttcggggaatccaaaatggatgctctctgtgatttcgggggttccgttgattttgtgttgaccggtctgagaaatgaagagaaagagtacaaagagaaaaattttactgctgggccgccaggggtgacatcacatattggcaggttccatgatgcccacctgagccacaaaaccagcaagtttttattagggattctaaaaggggagggggtgtacaaacagggagtccctgtccctatatgtctcccaagacagggcagcctgaacactgatccacttagcgattgcgcagtgtcaatctggccccacacagctgtggctagccactaccagtcagtactaccctttggttcttcttgcccgtgggcactgcagcctctgtgggaccttagtactaagagtcagagaatatcagggagagcaggtgggcagtaacaggttacatt

SEQ ID NO: 472316 - DNA, 638 bp, Homo sapiens
caggatgattaacacatgatctgtgctgctgccatagttggtatttttctgtcatgtaaaaggtctgccaatctagatattctggacaggctgcctggtacggtccatggtgggcttgctgctgaggtccttgagaaggctggcctggtacctgagggactaagtggtattcattgtggaggacctgtgactggttccatgagggtggccctggtgccttggtctgtgaaggctgacttggaacctggatctatgggggcaaatctaaagtctgagaccacaagcactaacttggcactggctctgaaggctggaaaatccaagatcaagatgctggcaggttcagtgtctggcgagggctctcttgttgggtccttacatggcagaagtggggaggacaaaaaaggacctaagctatttaactccagtattttaataagggatgagtgggtaatggataaggagaaatctcagatgacttcttgatttctgtattaactaatggtccaccaagacacagaatataggaggacttgaaagtcagtgtggaatggaaaaaaatgtttagttttgaattgttatgtttctccatacaacagacttcttaaaatgtggcttattttggtcaatagtacatt

SEQ ID NO: 472317 - DNA, 544 bp, Homo sapiens
tcagttgcttctctgcttaccgttcagccacttgtatccttgatgctcagctgcttgtattgctccgccagctggagtcgtttatgggcacagggtaggggtagagcaggccaaaaaggcaacacttgggtggaaaagcgggaggcttcatatgattcacatgaagacactggatctaagacactggggttcttagctccagaaaaatttcccatcttcaaaataaggcatggaaggaacaccaatgctgaattcaatatgacgcatacagggtgggtcaatggatatctgaatggtaatcaatttggcctaacgactgaaggtcctttgcctaatatgctcttctgggttgagcatcccaaatctaaaaagctccaaaacccaaaatttttggacactgactggaccctcaaaggaaatggtcattgaagcatttcagatttcagattcatagatttggaatgctcaactaatcttgtaggcatactttattcttttttattcttttttcttttatctcttctgactgtgtattttcaaataa

SEQ ID NO: 472318 - DNA, 1205 bp, Homo sapiens
gctggcagccggcgccgcgatggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctggaccaccgcggcctgcgcggcttccagcgcaaccggctgctcgaggccatcgtgcagcggtaccagcagggccgcggggccgtgccggggacgtctgcagccgcggcggtggccatctgccagctgtgcgaccgcaccccgccagagccagcagccacgctctgcgagcagtgcgacgtcctctactgctctgcctgccagctcaagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatggagaactacagcatgtactgcgtgagctgtcgaaccccggtgtgttatctgtgcctggaggagggccggcacgccaagcacgaggtgaagccgctgggggccatgtggaagcagcacaagcaacttatggctggcaatgtgtccttgtatctgatactgcgagaaagagaggagccatcaaaatctgatgaggaaacttgagaagaaggggtttgctaaacttgtacagcaagttgtgaaatgattttgcaaaaaaacaagt

SEQ ID NO: 472319 - DNA, 582 bp, Homo sapiens
gttttagttctggaggagtttgtttttttgtctctcggccttgcttagtgcctccaaacatctttaaatcgaaatgatggtaatggacatttttgtcttttcactgcagcaatttgccaaaatcatcatggacatgtttctaagagttgatgccctcattggcttctgctccagaattattccagggcttatgtggcagggtggtgacttcacatgccataatgacactggtggcgagcccatctgtggagagaaatttcatgacgagaacttcatcctgaagcctacaggtcctggcatctttttcacggcaaatgctggacccaacacaaacggttcccagtttttcatctgcactgccaagactgagtggctggatggcaagcatgtggtctctggcaaggtgaaagaagaaactgaatattgtggaggccatggagcgctttgggtccaggaaaggcaagaccagcaaggaggtcactattgctgactgtggacaacgctaataagtttgacttgtgttttatcttaaccaccagaccattccttctgtagctcaggagagcaccccccaccccattt

SEQ ID NO: 472320 - DNA, 718 bp, Homo sapiens
ggggatcctggagaggagctgaaagcggacttcctctcttcactgattgaggttgtgaacaaaaggatcatgaagactcctgcagcaggattgaataaaaccagtgtcagctttgttcttcctcattttatccttttaaaacttatttttaattgcaagataagccagggctattgcagaaaaatcagcaaaactcagcataaagaagaagaagaaaaaattctcttcttttccctgccacctggcaataatcagtataaacattttgatgtccattggagggtcacagaaagaatcaagttgcataggtacacctcagtgcagacacaaggaagaactgaatcgaccaacaccttcttgtatttccatgaatttttccttaggtccaacaacaccagacaaaaatccaacatcactgacattttaggaagggacttaccttattcacattccagccagattaccagcaccctaacccctgctttgtcccactttcccactgattctgctcctaccaaagtcattgatgacctatgtttagctgagaaacctggacccccaccacatgaaagatgtggcctgctggcacagagacttcagatgatggaaaactgggttcttcttgaggggcctggaggaggctacacccagaagccagacctaacgcatcttcttactgaccccaaatttttaagcaaagcttttcttccttaaccaa

SEQ ID NO: 472321 - DNA, 487 bp, Homo sapiens
tactacttcaggcaacccccaacaaaatggtgaatggtgtgaaagttagaggagaggactttaagggacgcttcagggcaaatgacatctcagagcttgtcctgcctcaaggcaagggagctgggcttttgtaccacccacaaaacatctactggctgccctgggggaggaaggaagacataaagggcatgcgggggaaggctgctctagcacccaatgtggactctctaaagttacaggtacggctcgtggtagcaaagctggtagaagcagggctttgggggctgcagccacagacaggacctaaggggacctggacagagcacaagggtgatattgtaagaattagtgcatctgtgtcacatagtgaaaaaaagaatgatctaaatggctgcctttggtatcctctttggggaaaagcatctttgaaagcattcacagaaaagcccacaagatgggtaagaccctgagaatggctatgtcagca

SEQ ID NO: 472322 - DNA, 470 bp, Homo sapiens
ttccttcaaagacactgttaggagaaactgcagaggttctccatgaggaacctgctcctgcagcaagcttctgcctggtcatccaggtgtttccatacatcttctgaactctatgaaaaggttaccaaaccccagttcttgacttgtgtgtactcacaggctcaacaccacatggaagctgccatggtttggggcttgcaccctctgaagccacagccagagctctatgttggacccttcagccatagctggagcagcttagatgcaggacaccaagtctgctggagtttgctggaggtccactccagaccctgtttcacttggtatcaccagcagaggctgcaaaacagcaaagattgctgccttctccttcctctggaagcttcatcccagagggtcacccaccagatgccagccagtgctcctctgtatgaagtgtttgtcaacccctgctgagagtcatctcccag

SEQ ID NO: 472323 - DNA, 678 bp, Homo sapiens
ccacccccacaccaccaccactcagttcctggtactttgttatggcagccctagcaaatgactacactgatcctcacctgacactaccttctgttaattgttctttggcttcaagcactgaagccaaaggcaggatgccgctaccctatggaaacacagcagaaaaacaacacacgctccttacccttcacttttcaggagaagtaaactggatagccaccccggagcactactcttctgctataagctactacatcattgccaaaagaatttctgaactaaattttatatgtatttcggagataggtagttttggtgctttaaatgcagagctgggtaccaggttcatgaaagacaaagtgataaaggcaagaaaagaatgtcaggaaagaatgacaactgtaattgtaatgacaaatgtaactggtcctatatacactcataccttttacactgagttcctcacatacacattatctcaaagcatcactttgaggcaggaaagaaaaaaaagtctctgaaattttgtgaaattactgtggagaaaaacttgaaataaggcagatccgggtgtctttaacaagataaaaacaagaaaaattagggtaaaatatatacctaacctaacaggtataaagggacaaaagaagttgtaaccagtttggatgtttacctgtg

SEQ ID NO: 472324 - DNA, 1430 bp, Homo sapiens
ctctctcacatgtctctgtactctgttccctttctcatcttccttgtctttgtatctctggggttggcagaggctgaagagtccagtctcattggcttagaggtcatgtctctcccagaaggaacctgtcagcccttcatgcagcatgagaagctagagctgagactgggtcccattgggatatgttgtgggacagaggctggagagcccagtctcactggcttagagggtgtgcatctcccaggaggaacataccagcccttcatgcagcatgagggtctagagctgaaactgggcccctttgggatctactgtgggaaagaatatgaggttcccaacttgcaatttaaaataatgtgggtagccaaggctacaccaagagagtggcatttaagaaacctagaggaagtgagggtgagtgctacacatatagctggtggaaaggtatttcacgtacagaaaacagcaggtattaaggctctgatatcagagcatacttgaacttctcaaagatggtcatgaagaccattgttgttggacataaagggtgaggtattgtcttagtctgttctcatgctgctgataaagacatacccaaaactgggaaatttacaaaagaaagaggtttaatggatttacagttccacatggctggggaggcctcataatcatggtagaaggcaaagaggagcaagtcacgtcttacatggatagcagcaggcaaagagagagagcttgtgcaggggaactcctctttataaaaccatcacatctcgtaatacttattcactatcacaagaacagcatgggaaagacttgcccccatgattcaattaccttccactgggtccctcccacaacacatgagaattcaagatgagatttgggtggggacacagcaaaagcatatcaagtattaagagaggaagtgaaaggagaacctcatagtcaattatatgtacttcactcttatgggtaagaagtgaaattattgaggacttcaggtggaggaaatatgtaatcttacatataattctgttgctgtcttgaaaataatctaaaactgacctaatgcagaagtacatagactggttatgaaatgattctaataattcaggcaagaggtgatggtgatggaccagagtagaagcagtgcaggtaggcacaatggtcagattctaactttattttgaaagtagaactttagctaaataaatctagtaaatcactgtcttcgtcgtaccaaagattttttaaaagcctactccaatagttttcatgtggttaactgtatgggtcctactgatgggacaagtcctagaattaaaaaaaaaaaaaaaaaaaaaaaagaaaaaaagaaaaagggagaaatgccttttttaagactatgagaacagaattactttatgctatttagagaagcttggaag

SEQ ID NO: 472325 - DNA, 529 bp, Homo sapiens
ttgttttgtgatatccgttatgactgatgaaaacatgatggtggcacataaagttaacagcctattggatgcatactcaggcctgttaagtaatgaatccatgatcctggctgtgaactccagctttgtggatcccttactgcagtttgaatctcagttgaagataatagagtcatcctttggaatgctagttgtcatgccaagtcttgacaaagtaaaagaaatggggagcagttatgagtacattgaggacatggagaatgtgactcagcaggtgataatctttagggtcctcctcttcactctttttagttataacagtcagggcactaatctataccactggactccttgtgctaaagaaaatgctgagcattctatcttcatgggtactactgtacctaaagaaggcctaacaacaattcaaaaccctatttttcacaactgagacctcacttcattttttaatgtcccaaccagagacagaagactgcactgcatgtcttgtggtcttcaactttgcattcct

SEQ ID NO: 472326 - DNA, 857 bp, Homo sapiens
acccccaggcctgcagccgtctccaggtgggtggaaagcctcagcatgcacataacacccatgctggcccatggggaagtggacccaggcactgaggagattagtggtgggaaggatttgaatcaaggtctggctgaccctcctatcccacctcccacagatcctgacttgagtctgagtggcatcctggctcagagcttttctctaagattgggaagttctccagatgatatcccgaagtgtgttttccaacttgtttccattctcactgtcactttcagtcaggcccctcttcaaaaggtctgctggagtttgttggaggtgcactccagacccagtttgcctggttatcaccagcagaggctgcagaacagcaaagattgctgcctgctctttcctctggaagattcattccagagcggcacctgccagatgccagtcggagctctcctgtatgatgtgtctcttgacccctgctgggagcagagctcgatcactgttctcttcagagctggcaggcaggaacatttaaatctgctgaagctgtgcacacagctgcctcttcccccaggtgctctgtcacagggagatgagagttttatctacaagcccctgactggggtttctgcctttctttcagaaatgccctgcccagagaggaggaatctagagaggcagtctggctacagtggctttgcagagctgtgattttctagtttatttgcatagagttatttatagtattctctgatagtagtttgtatttctgcaggatcagtggtgatatcccctttatcattttttattgcgtctatttgattcttctctcatttcttctttattagtcttgctagcag

SEQ ID NO: 472327 - DNA, 702 bp, Homo sapiens
gagcagccgggcaccgaagaagagctcttgtaaagcaggcctaatggtgagaaaatttctcagcatttgcttgtctgcccctctgctgcaggtctgctggagtttgctggaggtccactgcagaccctgtttgcctgggtatcaccagcagaggctgcagaagagcaaagattgctgcctgttcttttgcctggaagcttcattccagaggggcacccaccagacgccagccagagctctcctgtatgaagtgtctgttgacccctactgggagatgtctcccagtcaggaggcacggggagctggcagacaggaatgtttaagtctgctgaagctttgcccacctccacttcttcccccaggtgctctgtcccagggagataggagttttatctataagcccctgactgctgcctttttttcagagatgccctgcccagagaggaggaatctagagaggcggtctgggtactcgtggctttgcagagctgtggtgggctctgcccagtttgaacttcctggtggcttttacactgtgaggggaaaaccgcctactcaagcctcagtaatggtggacatccctcccccgaccgagttcaagtgtcccaggtcaacttcagactgctgtgctggcagtgagaatttcaagccagtggatattagcttgctgggctctgagggatggcatccactgggctagac

SEQ ID NO: 472328 - DNA, 3138 bp, Homo sapiens
gcctgtcttttggataaaagccattttaattgggcacagtgtcattagtggctccatgaccctactggatttcacaagagcaaccatcttaaaaggttatccactagagcatattcctaatgaagcgaagaaggagaaggagaaggagagagaaggagaaggagaaaggagaagaagagggaagaggaggaaaaaagaagaaggagaaagaggagaaggaaaagcagaagaaggagaagaagaagaagaaaggaagaagaagaagaagatgattagcatttttcatatgaaaggatgtccttctgtacctgcaatttccttgtgttatgtaaatcaccagaaaaccctggctgttcctgggcttatggataaacaggcatataaagaacttgaaatatgttctgagaataatgaaaatgataaggtggtgaaaaatattcataacagtatttgggtcaatagcctctgtggagctcccagtcaacagccatcttcaacccccagaactgtgaaagaagccctcaaaggatccgagcacacagccgtagagtaaaaagttaagttgttttttggagatccttctcttttaatgtaggcatttgtcactgtaaaatttccttgtagtactgcttttgctgtatcccataagttattgtatattgtatgcttattttcatttgtctcaaggtattttctgatttccctttgatttcttctttgacatattggttattttaaaaactgttgtttcatttccacatttttgtgatttttttttcaatttttcttcagctattgatttctagtttcatttcattgtggttggaaaatatactttgtgtgacttgaagtttcttaaatttgttaagacttgttttatgacctagcttgatctatcttggagaattttctgtgtgcactttagaaaaatgtatattctacattgttgggttaaatggtccataaatatctattaggtccacttttgtctactgtgttgttcaatcattgttcctttgttgcttttctgtctgcttgttctatttattattgaaagtggggtattaaagtctcttaatatcattgtattgctgtctattttacccttcaggtctgtcagtgtttgctttatctatttaggtgctctgattttgtagcatatatatttataattgttatacctttccggtggattaattcttttattactacataatattctctttttctcttgtgacagttttttacttaaagtctgtcttttcttaaataagtaagaccatccctgttcttttttggttatcattcacattggaataactttttccatccctttactttcagtgtatgtgtgtccttaaatctaaagtgagtctcttatagacaacacatagttgattttgttttttgttaatctatttagccactctctgtcttttggttggggagtttaatccatctacatctaaagcaattattgatatggttagttttatgattgctgttttgcttattattttctatttgtcttgtagttcttttgcctctcttttcttcttgccatttttctttgtgttttattgatgtttttgtattgatatactttgattctgttatcatttacttttctgtaacttctacagatattttctttgtggttactatggggcttacctaaaatatcttataatagtctatttgaagtttataacatgtaaacttcaattacatacaaacacttgacacttttactccgtctctatgctttatgttactgatgcagtcatttatagctacttatattgtgtatctattcacatatttttaagttatagtatagtatatattatatagtatatataatagtatatattatatagtatacataatagtatatattatatagtatacataatagtatatattataatatacataattgtatatatcatatagtatacattatagtatatatcatatagtatacattatagtatatatcatatagtatacattatatagtatatatcatatagtatacattatagtatatatcatatagtatacattatagtatatatcatatagtatacgtaatagtatatatcatatagtatacgtaatagtatatatcatatagtatacgtaatagtatatatcatatagtatacgtaatagtatatatcatatagtatacgtaatagtatatatcatatagtatacgtaatagtatatatcatatagtatacgtaatagtatatatcatatagtatacgtaatagtatatatcatatagtatacgtaatagtatatatcatatagtatatattatatagtatatatcatatagtatatattatatagtatatatcatatagtatatattatatagtatatatcatatagtatatattatatagtatatatcatatagtatatataatagtatatatcatatagtatatataatagtatatatcatatagtatatatactatactatattatatatagtatacataatatagttatatattatataatatagtatatatttttcttttaaattatattttagaattaaaagtgatttatccaccaccattacagtaatatagtattttatttgtctatgtatttgcgtttaccaatgagttttacactttcttatgttattgtgtttctgtttagcattctttcaagtcaaagaactccatctagcatttcttataaggcaaatctagtaataacaaattccctcaacctttgtttatctgagaaagtctttacctagtcttcatttttgaaggatagttttgccattatagtattttttgataggaattttaatctttcagcatttttaatgtcatttcatgcccttctgacctgcaaggtttctgctgcaaaaatttactgatagtcttgtaagggttcccttgtgtgcgacaaatcacttttctcctgctgctttcaaaattctttcttagtctttgatttatgtcaatttgaataccttagtgtggatggttttttcttcttaatttttccttatgtgtaatcaaaatgtatcagtgtggatttctttgggttccttgatctggatattcatttccttcctcagatttggaatgtttt

SEQ ID NO: 472329 - DNA, 888 bp, Homo sapiens
aggacagtggctgccagaaactatcaaccccctctgctgcaggtctgctggagtttgatgcaggtctattccagaccctgtttacctggttaccactagtggaggctgcagatcagcaaagattgctgcctgatccttcctctggaagcttcatcccagagcagcacctgccagatgccagcaggagctctcctgtattcggtgtctgttgatccctcctgggaggtgtctcctggagaggagagtaggcattctgcctttagcagagctcgagcactgtgctggaagatttgctgctctcttcagagctggcaggcaggaatgtttaagtctgctgaagctgcacccacagctgccccttcccccaggtgctctgacccagggagatgggagttttatctaaaagcccctgacttgggctgctgcctttctttcagagatgccctgcccagtgaggaggaatctagagaggcagtctggctacagcagctttgcagcactgtggtgggtcttacccagtccgaacttcctggtggctttgtttacactgtgaggggaaaaccacctactcgagcctcagtaatggtggacgcccctccccacaccaagctcgagcatcccaggttgacttcagactgctgtgctggcagtgagaatttcaagccagtagatcttagcttgttgggctctgtgagggtgggatctgctgagcaaatccatttggctccctggcttcagccctttttccaggggagtgaagagttctatcttactggggtaccaggtgccactggggcatgaaaaaaactcctgcagctagctcagtgtctggccaaatggccgcccggttttgtgcttgaaacccagggtcctggtggtgtaggcacc

SEQ ID NO: 472330 - DNA, 746 bp, Homo sapiens
ggataggaaaaataactaagaggccaattagtcctacaatggcctcaatgttttccaataagtctctcaatgtaaataaaaagctagaagtgatgattaaccattgtgaggaaggtatgttgaaagccaaggagctaatgtacttggtgactttaagtggaagccaattctcatttatcattatgaaaatcctagagcccttaggaatctactctgcctgtgctctagaaatgaggcacaacaaagccttgatgacagtatatctgtttacagcatggtttactgaatattttaaacccactgttgagagctactgctcagaagaaaagatacctttcaaaacattactgctcattgccaaagcaccgggtcacccaagaattcttatgaaacagtgtaagctgattaatatgtttatacccattaacaaagcatccattcttcagcccatggatgaaggagtaattttactttcaactcttattatttaagaaatacacttcataaggctatagctgtcacaggcaatgattcctctgatggacttgtgcaaagtaaactgaaaccttctcaaaaagattcaccattctagatgtcactaggaacatttgtgattcatggaaggacgtcaaaatatcaatattaactgaagtttgaaagaagttaatgccaattgtcatggattattttgagagcattcaagatatcattggagggagtaactgcagaccaagagagacagaatt

SEQ ID NO: 472331 - DNA, 3896 bp, Homo sapiens
cctgtctgaggcactgtgcttaggtgtagtttgtgactatgcaaaaagaagcaaatttaccaattatcctgactaatgtgcaggaaatcatgaatctcctcagagatttctgcacatttgaatacttcctcttgcccttgaaatcaaaaagaaatggcagctctagaacaccaataaatcacagcttctcaagaagtagaaatattttggagggctcagaagtagacaggaagatatgggaaagtttagaacttcctagagacttattaaatggttttgaccaaaatgctgatagtgataagaacactgaagtccaggttgaggtgttctcagatggagataaggaacttactgggaacaggaatttcagtgggtctatggaaataaatggatgttcaggcagaagtctgctacatgggtggagccctcatggaggacctctgctagggcaatgcagaggggaaatgcagcttgcacatgtgcttggaaatgttgcaggaactcaacaccagcctgtgaaagcagctgcaggggctgtacactgcagacccacagtggtagagctacccaaggccatgggagcccactacttccatcagtgtgccctgaatgtgagagatgaattctgtccaggaaacttcacatttgaccaaaattgttacaaagttcagctggaagtttccttctttctttgttctttcctcaattccactcgcagccctccccaaggaccctgcgagacaaagttcaaaatggcttccctgtggactgagagcactcacagggcttttcctcctgcttcctctacccctatattttgctcgcatctctaaattcatttgcgcttcagggagagatgtatggaaaaatttgatgctaatgtgaaaaacagtttatcaatgtggaaacagttgtaaattagaaatcagatgacctgaaatcatgtcacctatcggctaaatcaacaagattgtctaaaattttgatattttatggttttttagatataaatatttaatgacaaaacaaaatctcaaccaaaatttctgtagaatatcgctgttatatatagttaactaaatacatttgcactatttgacacatattatctattggacatttgttattttattttttgtcatgaaaactaaaaatacatgagaaaatatagatatttcaatgattaataaactcagagggattttggtgtcttcactcatgatcaaaaagtaacatctatgcatatggacaagattaaaaattcttgaacctgatgtaggttaaatccagaatagcttcaaagaagatttattagtttttaatatgttcataaaatcaaagtattcattatgattttatgcttttaaagacaagcatctttataatttaaatatattatttgattaatgtctatcttttttagtggaattaaagcttcatgacaacagattttatgcctccttcaaaaatcattatcttaggcctatgatgatgtacataataaaatacattaattaaactgataaagtaaaatcacagagaacaatttagttatagaaggccttatattttacagactctaatttactaaaactttactacattaaaatattgcattatgattttatattaccttaatctttctaggaaataaatacacatattttattatgtcatttgataacaacctaggaacttaagactaaatatcatttttcattttaaagttactaaacctgaatttatagatggtaatttttattttccccaggttcatatttggttagtggcaaagtgttgactaacctagaatccttgaatcttttgcactattctaaagtttgcacttgagttaatatggctaaatcaagtgagagaacgaatagaataagaactcagtttgagccgtatattgggaattcccacattgaaaactgacaattagattacttactcaaaatatatataaatttataaaacattcatgatggttattaagtgttatgtggaatttatatagatttacttgattacatgatgaaacccccgtctattactagtttgttaagcattcttatatgaatagctattgattgtaacaaattgctgcttcttcatcttgtgaaatgattatcaaaattctattaatgggatgaataacactatttactttttatataataaaccagactttattccctggaatacatcgaatttagtcatatgttaacatttttatatattgcagaattcatttagttaacattgtatagaattttatgtctatattaatgaataaatttgaccaataaatttctttctttaatatctttaccatgtttatgcgtgttatattcacaaaatattgttttgcaatactaatagcaaataaaatacacttacagataaaagtcattactgggggtaaaagattatctcacaaatgttattgctaattaacaggaaaaatactgtatttctataaatctaaatatataacctgaaaatacattaagcatagtgacagaacaaaaggaaaaagaagcaaattcacaaaataggagatgaaatattgttctcttaataactaacagaaacaggctaaaatttattaactatataaaagagttgaaatatataaaaattgtaaaacatgaaaataaaaatagatgaaaatacaaattatatttatattcatagaacttcactgagctgttatcaggaattttattttctgtatactttacattcataagacattattattgcattatagaagccgtttagatttgtctatacatttatttcttcattactcttcattgttttctgaatatctgtgccattttctgtctcaagactgccatttgttacattgttcagcacagttattttggtgaaaatatctcggattttttcacaaaatttatgcttttaattttcattttcagaaggggagcatgtttgccacaaatagattctacattagcagttattttctgttgatatctacagatgcaattccatagtcttgtggctctgaatttttttctggagaaccgatccagctgtgaatcttatttttgcttactctaataacatatgtgtatcctaccctcatctggttgctcttaaaatttacccattaatgtccagtgtttctgatttgccctaatatgcgttgatttacattcatggtgattttgatttatggaattttttaaacctgtggctttaggcctttttgcaaacattgcttctactgtcttttccttctgtctgtattctcatttttggattcaattataatatgttagatctttttaccatgtttcctacatattttatgttatttttaaatttcccaatcattttttttctctgtgtgtaaaaatattttaaacttttagattaaaaatctacattccaatgtttatactaaatattaaaccagttttgtacatttgtgtttgaacataagtgaagctaaaataggcacagtattcatgcacatgaaagtatgcaagaagcaatgtatttcagtatctgtctaaataaaatattcaataataatttttcaataggttttgtacagcaataaagaactctcaggattctaaaagtcttacagtgaatacctaaaaactagtgtgttgcctgttttatattagtctaaggaatcaaaaaaagtatatttttcaagaagcttgtgaaacgatacaagccagatcaaaactaagtacatattatagagaattcaaatacacaagataggttcataaagccctccaaattggtagtacattggatacaataaatttagtaagctattaacatattaatcatcaaaataaactgaggttaatggggaaatcaaaattttaatacaagagttc

SEQ ID NO: 472332 - DNA, 1053 bp, Homo sapiens
aaccacactaggtcagctgctctcgccatggctgaaaagggccaacatagagcttgggccatggcttcagagggtgcaagcctcaagccttggcagcttccacttggcgttgagcctggcagtgtggaagggaaacatggggtcggagccccacacagagtccctacgggggcactgcctactgaagctgtgagaagaggaccatcatccaccagcgcccagaatggtagatccaccagtagcttgcactgtgcacctggaaaagccacagacactcaatgccagtccatgagagcagtcgggaggagggctgtgccctgcaaagccacaggggtggagctgcccaagaccatgggaacctacctcttgcatcagtatgacctggatgaagtaactaacctgcttttgactttacagactctccggggcatgtcagccccacccatcataggcccagaggcctaagagaaaaaagtgcataaggaagggatatggctgaaatctccaactgtgccatctgtgtttacttcattgattaggttccttatttttaaacatttgtgtgtgtgtgtagcaaggattgtgtgtgtgttatttttattattattatttttgccttcttggtggattggcccttgaacatttatatctgaaaatacagttagtactgaaatctacttttccttatattaatataagccattgcagcttgcttttgattatatgtttgacattgtttcctttttatgtatttttatatttgaagtggattttgtgtagatagtatttatgttttcctcgttttttgtttattttctgtctttctaaatagaatgcaggctcaataaaagcaggaaggttttttcggttttccactagaacagtactttacaatcggtgagcgataaaatacttgctgaataaatataattcaatagcttcttcataaattaaactaattaatattttaaagcatttagaacactgcttggaacataagaagtatttaataatataagcactacaatttaatgtaatggtatctgaaaataa

SEQ ID NO: 472333 - DNA, 655 bp, Homo sapiens
ctcctcaagcgccgccaaattgggagcccaggcagaggaggcacccagagcgagtgagggctcactttgaatatagcatgccactctctcggccagcatggtttgtactcagaaattcactgaaagctgtactgtgactgtgttgaatgtgatatgtgcctttcctcttgttactttgagcattattcatggtgctctctctgacactgtggcaccagcagggctctttaacatggtgtcctcatggttcagagcactgagtatccaccaagatccatacaccattggctgtgatcagtgcccctctctttgttctcaatttatcccagatgtttcagctcttctggtactcccaatgattcccatgggacagaaccagagtgggcttccagtgaagattcccaagccacttcggaaatcaaatgtcaaccactatttccctcatctcattttggcaactgtgggtcctgggaacttttctgtaagtggtataatgccaccttggggaagggatcacgcagtctgaaatgaacatttcccttactggccatggcttcttttaattctgtgggccacgggccccctggaattctggtatattcagactggtattcttgtctctgaattgtttctagttgtattcttgtaaagggag

SEQ ID NO: 472334 - DNA, 760 bp, Homo sapiens
aaaaacaaaaggaaaactttaccatcttgaagggaggtgtggagggagaggcgcgagcgggaaccggggctgcgtgcggcgcttgcgggccagctggagttccgggtggccgtgggcttggtgggccccgcactcggagcagccagccagccctgctggccccgggcaatgaggggcttagcacccaggccagtggctgcggagggtgtactgggtcccccagcagtgccagcccaccagcgctgcgctcaatttctctccgggccttagctgccttcccgcggggcagggctcaggacctgcagcccgctatgcctgagcctcccacccactccatgggctcctgtgaggaccgagcctccccgatgagcaccaccccctgctccgcggtgtccactcccatcgaccacccaagggctgaggaatgcgagcgtacggcgcaggactggcaggcagttccacctgcagcgctggtgcgggatccactaggtgaagccagctgggctcctgagtctggtggggacctcagggattgtaaacgcaccaatcagtgccctgacaaaacaggccactcggctctaccagtcagcaggatgtgggtggggccagataagagaataaaagcaggctgccgagccagcattggcaacctgctcgggtccccttccacactgtggaagctttgttctttcactctttgcaataaatcttgctactgctcactctttgggtccacgctgcttttatgagctgtaacact

SEQ ID NO: 472335 - DNA, 1560 bp, Homo sapiens
gtacatgacgttagcactaaatccttgcctgtgctctagaagggaagctatacatctgtaagctgcaggagtgatgtggcaggatgaagatgtcctcagtgggctgaatgtactgattcagatactggaccctttttccaatccccagtcctctcatattaagcaacaatgtgttgtccgctttcatgctgctgataaagacatatccgagactgggaaatttacaaaagaaagaagtttaactgggcttacagtgccacagggctggggaaacatcacaatcatggcagaaggcaaggaggagcaagtcccatcttatgtgaatggcagcaggcaaaaagacctgcccctgtctacccctcatgagagggagcatgtgagccaacaagtgcaggaactggagcgagtgcttttgggcactggcaggaaaaaaactccatttacttggctcactgttctcaaccccttgtgggaggggacgtataggctatgggtatgggatccaactgaccgcttttgggcgcaggtgggagcaaactccatgcgggcctgcagcagtgtccagtgaatctaagcaacagaggtatagcatatactataacagcagaatgagaataatgtcccaacatccaaactagttcacaggataaaaataagaaagagtgttcaaaaaattaatacacttaaaatgtaagaaataaaagatttttaacaagtataatttggatacatattttagcaaacctaaatgatatgtatgctatgtaaacaaaaaggacaaataaagattgaaaaatgatcaaaacaagaccaggaaagtattaacaagaaacattttttcaaagtctattgtgctttgttaatattagactaaatacattttgaaacaaaaaaaaccttatacactatggtagattgaaaatatctccatgatactttataactcttcacaattggtaacagtttattctcctatccctggaccaaggtcctaacaaaggaggtgacaaaaagtggttggattttgtgctaaatataaagttagagccaatgggaactcattacagattatatgttgtgtgtgaaagaaggatatgagccaaagatgactcaaagatttatgactagaacaattagaaaaatgaaatcgccaataaaggaaaaccaatctaagattagaagtgctaaggaaggaaaaaacaattttagaatatttaaaatgttatctaatataaattatctttaaatattctaatttgcaaataactacagagccaaaaagtaagcataatttataaagcataatagaaaaaaggaaaggaatcatgaaatatatcaattattacctattagaatcaataccaaaagttatttatttaaataaatatgaattacttaaattccctttataaaagatgaagtttctcaaataagcttaaaatatatactatgtacaagaaaaactgacgataaaaatgcacagggagactgaaaatgcataaagtatgtcaaaataaagtaaacaaaaagcagaatattaatattaaagtgagaatccag

SEQ ID NO: 472336 - DNA, 764 bp, Homo sapiens
gacatacaatttacccacgaccagctacccatgtagcatgatctatttattgagggtggtggagctggtaccaaatatatggggaaattattgttctcattcattgattcacaccaaagtcatctcctttaaaaacattcgaagtgaagctgcaaacgctgatgcaggagatatagcaagttatccagaagatttggctaaggttgttgatgaatgtggctacactgaacaacagattttcagtgtagatgaaacagcagtgttttgggagaaattcaagcagaataaaaagacagatggtctagaagaagttagaggcccatttttaaaagtactggctgacaagcaaggatatgacttaagagaccgaaaggcatggttggaagatgcagtgcttatgcttgcttgggacaaagcaatatcatcccaacaagacaagtattggaggaaagcatttccaaaagacatactctatctcagaaaaagatttaatgatgtcaccaattaaagtgtgaatgcccaataagactacacttattgctcttttcccatggtaaatttggatatttaaaaggaatttaaaaagtactctccaatggtcttagtctattctgtgctgctataacagaatacctgtgattgggtaatttataagtaacagaaatttatttctcacagttctggaggctgggaagtccaagatcaagaggatgcatctggtgagcgccttcttgctgcttcagaacattgcagaaaatatcaca

SEQ ID NO: 472337 - DNA, 759 bp, Homo sapiens
agtgcagccttcggtctgtggttgaagacctgagggcccttggcaaaccactggtgcttaccaggaagcatgactaggaggcctcaggaaacttacaatcatgacagaagaagctcagaaactaaaccccaactactttagcaaccagtccaataagccaaaccacaaccttttcagcaacaagtctagggacccaaaccacaactgtggcaataaatggcccagcagtgtgaggacttggtcagcgactgctaacttctctctttttgctccaacttccaacttaggacctgccagccttcaggctgggtccggagtctacatcatcggtcctctggctctcaggcctttgaactacaccacaggcttttctggcctgctggaaaaaactgcagctggcgaggtcacagagcagccaaggcacttcatgatttggggtcaggacatagaaagaaagggtgagggagaagacctcgggctgctgaataaaggagagcaggttgggagacaggcaagtgagagacaggagtttgagagcagtgaattagcagaagacttggaactgaaagaaagggaaagtgaaagtgctggaaataaagttatgtgtgggattttaaccaatcaacatattacaacaaactgaatatagaagcagatataacgaataaactgtttatgattaagctggaagaacttgctttctaggtttgctgcccagctgtcattctggaattgcacagaattcttaatgggaggatg

SEQ ID NO: 472338 - DNA, 743 bp, Homo sapiens
atcaacccatcaaacgaaaaaaacaacaacagcctaaaagacaaggttgatgtggaggagaaaaaaaaggaactatgtacctgtggttcatggtattgatggttctttatagggctccacagttttcagggaggttggtgacagaagtggaagaagaggaggaggtaggaaaagaggcaggggaggcaggcctccttgttgtgcaactaaaagactggcagctggtgttcatcttttctcttccaggtttgagagttagcagctttatagattatggcagtcctaatcataaactccacagtatttgcacaaaaatcttggagaacatcacagacataccgatatgtgatgttactcccggaggcccagctgtaaaattcctctttgaactctttctctttatttctcagaccagccaacacttagggaaaatagaaagaacctacgttgaaatattggggaatggttcccctgataactttgtgtactcccatggtgttaatcagggcttatggtattgcactaagcaggatgaaaaattttatttagagtatgctgcccacgagtcccacgttatagactggctcactgaaagactcaaacacttccttcagtcaaatattcccaactgttatttctaacaattccttgttccttggtagctttattatgttgggcttttgttttcaaattctgcatattgatttataactagctgttatttctagctgtgtgatcttaaa

SEQ ID NO: 472339 - DNA, 833 bp, Homo sapiens
tggcccgccgctgccataaagatgtactgcattttaaatatgtcattccactctctcctggcctggaaggtttccactgagaagtctgctgccagatgtatttcagctcctttaaagagtctcactccatggccactactgctacaggtttatggcacttactactcgactaccactgatgtccacttaaggcctaagggctcttcagacattctggtgaatgctgccaggcctgagtctcccccttcagggaagtggactcccatctggcccagggtaggtccagaaatgccatccaggacccaagcctggaattgggaatcccaggagcctggctggtgctctataccccgtggctgtgctggtgcccaagctgcagagcaaagtcccctttactcttccctctcctttcctcaaacagaatgcatctctccctttggctatcatagctgataatgatgcactggatcatacctgaatccagcattatcctgagtctcacccaaggcctgtggtgataactgcctgggtaccactgatatttactcatggtccaagggctctttagtcagcaggtgatgaatcctgccaggacttggtccttcttttcaaggcagtgggttcccttctgacccaggtcaaataaagatattcaaaacatgctcatctttttaatattaatagctatcatttatcaaattaaagggcattttatggttcaggcactatctaagtaccttaaatgcaataactcatcataacagtcttacaaagcacatcattagccctattttataaataaaagacccaaaggattatgttctgattgtttt

SEQ ID NO: 472340 - DNA, 901 bp, Homo sapiens
ccctcaaacatccaagctgtttgaacaactggaaaaggtcccatggagcccacattcatctgcttaactctaaagtcccagctctcttctctacctggagctctttgctgcctctatggtagctgaacaggagaaacacccaggaagatggtcaccacgctgccccagagcccaggggaccagggggctgctgacggccataatcagggtattcttcctgaaacagtgaagaacaagcttctgccagcaggagttcctgggatgatgccgggcttcccctgcaaccccagtatggaagcagtcactctggaccctagtaaaggagctggtgtagttaagagtttagagggtccttgcaaggtcacagccctgggtggccacccagtgtccctgctggacagcaggactccccgctgcccctcacagctgcatcatcatgtctgcaattcgcagatgttcacaatgatctttggaagaaactgccttcctcagagccaagttctaaccacaccagggatttactctccttatttagaactcctaactcacttttttgggaaccgtccaaatggcattagctacttcagttgataaactttgccttttgactgtttccaaaatatgaccccctcctttaaaagatgaatggccttccctggggatttcttagacaagaggttctgaaggcatttctaagagatactttaagccagtggttctccactttggctgactgaatcactgggaccagaaatttatgtatttggtgctgcactcagatggtattaggtacttccctgcacattaggaaaatctgtaagagcttcattgtatagatgaagaaatggaggctgatagtgaacaggtgccttgcccgagaccttagggtgagaagtgccaa

SEQ ID NO: 472341 - DNA, 1286 bp, Homo sapiens
cttctgccgaatatggattcccaggtcctaaagaaggccctaacccaagccccagtgttaagcttgctaatggggcaagacttttctttatatgtcacaggaaaaacagaaatagctctaggagtccttacacaggtccgagggacgagcttgcaacccatggcatacctgagtaaggaaactgatgtagtggcaaaggaggtctccttgactgatcccaacctcaacttgtatactgatggaagttccttcgtagaaaaaggacttcgaaaagcagggtatgcagtggtcagtgataatggaatacttgaaagtaatctcctcactccaggaactagtgctcagctggcagaactaatagccctcactcgggcactagaattaggagaaggaaaaagggtaaatatatatacagacttgccccctatgaccatctacactgagcaagatttatacaattatgttgtacctaagccccgaaacaaaagagtacccattcttccttttgttatcggagcaggagtgctaggcggactaggtactcgcattggcggtatcacaacccctactcagttctacaaactatttcaagaactaaatggtgacatggaatgggtcactgacttcctggtcaccttgcaagaccaacttaactccctagcaacagtagtccttcaaaatcgaagagctttagactttaggctaatcgccaaaagagggggaacctgtttatttttaggggaagaatgctgttattatgttaatcaatccagaatcgtcaccgagaaagttaaagaaattcgagattgcatacaacatagagcagaggagcttcaaaacactggaccctggggcctcctcagccaatggatgccctggattctccccttcttaggacctctagcagctataatattgttactcctctttggaccctgtatctttaacctccttgttaagcttgtctcttccagaatcgaagctgtgaagctacaaatcattcttcaaatggagccccagaggcagtccataactaaaatctaccgtggatccctggaccagcctgctagcccatgctctgatgttgatgacattgaaggcacccctcctgaggaaatctcaactgcatgacccctactatgccccagttcagcaggaagcagttagagcggtcatcggccaacctctcaacagggttttcctgttgagagagggtactgagagacaggactacctggatttcctaggctgactaagaatccctaagcctagctaggaaggtgacc

SEQ ID NO: 472342 - DNA, 711 bp, Homo sapiens
ggtcagcagcctcaaagactgaaggtggataagcttacaaagatgagaaagaagcaaaacaaaattgctgaaaactcaaaaagccagagtgcctcttctccaaatgactgcaatacctctccagctgagatggatgaactgacagaagtaggcttcagaagcaagacaggccaacattcaaattcaggaaatccagagaactccagtaaaatactccatgagaagatcaaccccaagacacattatcgtcagattctccaaggtcgaaataaaggaaaaaatgttaaaggcagccagagagaaaagccaggtcacctacaagggaagcccatcagactaacagtggacctctcagcagaaaccctacatgccagaagagattgggggccaatattcaacattcttaaagaaaagaatttccaacccagaatttcgtatctttccaaactaggcttcctaagtgaaggtgaaataaaatctttttcagacaagcaaatactgagggaatttgtcaccagcaggcctgccttgccaaagctcctgaaggaaccactaaaaatgaaaaggaaaaaccattaccagccactaaaaaaacgggatacactgaagtacacagaccaatgacactacgaagcaactccattaacaagtctgcaaaataaccagatagcatcatgatgacgggatcaaattcacatataacaatattaa

SEQ ID NO: 472343 - DNA, 691 bp, Homo sapiens
acaaccactgaatggtcttggaagcagatcctacctcaatcaaatcttgagatgactgcggctctagcaggtatcttgggtaaggccttcatctgccttggccaggcctgtggatgtgaagatgtcaagaaccagaatgcttggtttggaacacggaatgcttacttcacacccattttctcttcacttaattcctatttatcctttgaagctcatctgttacatgctacctcttcaaggaagctttccatgactcttaaagtagatcaggcccagttggctcctaatggttcctggaccctggaagaccacattctaggtgagccagctgcaatggcagccccacatggcaaggaccatgacatggatcttgttactgggtacagtgggagtatagcagaggggaggtggaaagacgtcatagatgaaatgatcaaggcaccagcagatttggtgtctggtgagggctgctctctgcctccaagatggcaacatgttgctgcgtcctctggagggcaggaacaccgtgtcctcacatggtagaagggacaggaagggtaacttgccccctcaagcccttttacaaggcactaattcatccatgacagcagagctgtcatggtctatcaccaccaaaaggtcctacctcttaatactgttatattgggggttaagttgcaacatgaatttt

SEQ ID NO: 472344 - DNA, 565 bp, Homo sapiens
gattccacttctgagtatatacctcagagaaactctcacactatgatgtcagctgtgggtttttcacgtatggcctttattatgttgagagccaaaccacatcaagggctgattctgtctgtctttggggccccaggtggcaaatgtgggcagcagtgtcagtgggtccaggtaggtcaatccttggacctccagatgccagcagtgacagcagtgggccaggaaggtgggcagatgtttgggcccctgggcaacatatatggtgtgggcgatgagagtacccagaaggtggcccagtggtggacctaccttcggactcccaggcagcacacactggtggtggtggctgcagcaggctggctattccaggacccaggcccccaggtggcacatccaggaagtttgctaggctctgataaaaacctcagcaggttaggctctggtaaaattgtttctctgaaggacaggtcttattaagaagaacatgtatacatatacaccataaaatataaacatatatcagaagataggaacatataaaataggaacaaatatatcacaaaat

SEQ ID NO: 472345 - DNA, 864 bp, Homo sapiens
gccaactcagagaggtgaagtgatttgcccaaggtcaaagccagcgagcgaggctggcaagaggacaggaacccacatctgccccaggcgtgcctgctcttctggagggcgtgctgtctcttccatagcacttcccagctgccctgaccaccctctggtcaccctaccccagaggcaggcctgagctggcctcatgatccctgatctataccggctcctgcccccaggcatccccccgcctgctgccctaaagcttttacaccagaagttgctccaagaacagcagcttagcctgcatgttccctgcaggtcccataggctagcaaaatacttgaggcaatgggaagaattcagagtttggagtcagaagaagctagaattctgtttggttgccaagaccagttgcttttcctgccattctatgcttccaatccaccccctgcccttctggggcactgccaggggtggaacacagacctctcctggacccatgcagcagccatcgctagacagtccacttttaacgccaaccgcccccgctttgccatttatgcttcctgctgccaggcctttgcctcgcggctctcccctcgatgggtccaaatcttcccattgatcaagacctgttgcaaatgccaccttgtcagcctttgggtgtgggaggttgtcttggtggccaatgcccaaagcaggctgggggatgcgggagaaggctgcagctgctgtcccactgagggggagcagatggtgaacggagtttcttcaccgcctcttcctggtgaggccacagggccctgagatgacatcgctgagcaaacagccaggcacgccccctgcccactccccagctgccccctggagcat

SEQ ID NO: 472346 - DNA, 885 bp, Homo sapiens
gagccacatgtggctgatgaccaccattctgggcagtgccactctagattgtgaggttcttgagggccttatccaatcgtgcattatcctagcacccaggataatacctggcatgtaccagatactcagcagtggagttctgggaagacctcttggaggaggcgaccacaggatgagtaaagtggcccagagaagtgatgccacccaacaagccggtagtagcactgactccaaagcccaggttcattccattgtccgcctgcgtctctccggtggagactcgatagggcagaactatggagctgcaaatccatctgttgtcggcagccatacttatttcaatacacaaagatttgacctcacttcttacaaccttgctcctcactctctggctggctcctgcttggcaaccagagaggccttctctcgccaccccatctacagcagctgcccttgcctgcacatgacccttcacctattcctttcttcacagaacaatgtggacgcaggaaagggcacaggaccaacctctggtcccaaagcctgactccttcataactcatacctcgtctcccagccaggtttctgaatctcattcaccatgctgcccagggaccaaggaagaagtacccagagacacagactgaaaaccaggaagttggatgggacttagagcccttgatcaacccagaacgccatgaccgcaggctgaatcacttcagggtctgcagtgacatcactctgtacaaggctaaaacgtggggcttaggagatgatcaccacaagtagcatcccagcggatgagcccatctgtggatctaatgccttaagtgtgcacagcccagagaaataaaatactactttaaaacgaagtttcacttttct

SEQ ID NO: 472347 - DNA, 1876 bp, Homo sapiens
tggtgcaaaatgagggcttgagaaatgtttgtcttaagaacagaaaaagagaagcaggatgtttatcaccatgagcacatagaagacctcctagacaagcaaagccgggaactgcaggacatggaatgttgcaacaaccaaaagttgcttctagaatatgagaagtaccaggagctgcagctcaagtcccagaggatgcaggaagagtatgaaaaacagctccgggataacgatgagaccaagagccaggccctggaggagctgactgagttttacgaggcaaaactgcaggagaaaaccacccttctggaagaggaagacgtcaggcagcagctgcgggagtttgaagagaccaagaagcagattgaggaagatgaagaccgagaaatccaagatatcaaaaccaagtatgagaaaaagcttcgggatgaaaaggaatcaaacctgcggctcaagggagaaacaggcatcatgaggaagaagttcagcagcctacagaaggagattgaagaacgaaccaatgacatcgagaccctaaaaggagagcagatgaagctgcaaggagtcattaagtctctggagaaggacatccaaggcctcaagcgagagatccaggaaagagacgagactattcaagacaaggagaagcgaatttatgatctgaaaaagaaaaatcaagaactagggaaattcaagtttgtgcttgactacaaaataaaggagctgaagaagcaaatagaacctcgagagaatgagatcagggtgatgaaggaacagattcaggagatggaagctgaactggagaatttccataagcagaacactcaactggagctgaacatcacagaattgtggcagaaactgagagccaccgatcaggagatgcgcagagagagacagaaggagcgagacttggaagcgctggtcaaaaggtttaaaacagacctccacaactgcgtagcctatattcaggaaccgcggctgctgaaggagaaggttcgaggtctctttgagaagtacgtgcagcgagcagacatggtggagatcgcagggctgaacacagacctgcagcaggagtacacccggcagcgggagcacctggagaggaacctggccactctcaagaagaaggtggtcaaggagggcgagctgcaccgcacagactacgtccgcatcatgcaggaaaatgtctctctgatcaaggaaattaatgagctccgcagggagctgaagttcactcggtcccaagtctatgaccttgaagcagctctgaaactgaccaagaaagtccgaccacaagaagtttcagagacaggtcccatctacacatggccttctgggatcctgtccggggcacacacctgctctttgaggaatccatgagggccttcccacactccgacacacacaggtccacagtcccctggctgacatccttgaggttagctaccgttcagaatgcagactcttttagattttagaaagcgaatactttatataacattcccagaggggtctggggcagtgccctaaaatcaaacactttagtatttctgtagtgacatatgaatattcacactaagcttcctgaatttaaaaaagcactctgtttttagatcttcttgcattttagaatagtgaataagggattgtgaacctgtacaattaaaatgaagacaaaaagcaagatgaggagctatttaaaggaagaggggaaataattacataaatattaaatgagtcagttactgcaattatatcctaaagttcctctgaatttctgacggccaaggcaaaaagagaaacaaagaaatatgatcgtttatatcatgctcattgtatggcaaaagggagctttttttctggagaaacaaac

SEQ ID NO: 472348 - DNA, 598 bp, Homo sapiens
cattttgacatatggaggtggggttgagactctgggtggcaagaagacatggactcagcctgcctgcacccaggtgaaataaacagccatgttgctcacacaaagcctctttggtggtctcttcacacagacgcgcatgaaatttggtgccgtgactcggatcgggggacctcccttaggagatcaatcccctgtcctcctgttctttgctctgtgagaaagatccacctacaacctcaggtcctcagaccaaccagcccaagaaacatctcaccaatttcaaatccgagacaaaggagacacgttttatccgtggacccaaaactccagcgccggtcgcggactgggaaggcagccttcccctggtgtttaatcattgcagggacacctctctgattattcatccatgcttcagaggtgtcagaccacgcagggatgcctgccttggtccttcacccttagtggcaagtcccacttttctgggggaggggcaagtaccccaaccccttctgtgtctctaccccttctcggcctttctgggaggcaagaaacccccaaccccttctcctttacccttagtggcaagtcccacttttct

SEQ ID NO: 472349 - DNA, 784 bp, Homo sapiens
taaaccttgcaaacattcaaagcctgtcatatctgcaaagatatgagggatctaggagtcagggtcatgctggcatatccgaccaaaagcaaaagacaaacagctgctgtttgcttctgccaccataaagaaggaagcccaatgccacttaggcctctttgggttctggaggcacacattccacacctagagacaccactgcagtccttccattgggtgacatgcaaagctcccagctctgagtgggacctggagcaggaaagggctctgcagcagatccggactgcacggcaaacagccctgacacttgggccatacactccggcagaacttggtgttggaaatgtcagtgtggaaacagatgggtacagcaaccccaaggacgcgattgccaggaatgagggtttgggttacatcgttcgacctgccaagagaggtccactgggagcccgaggagtacatgctgtggtgccagtggactgcgggagccacgagatacactactcggacctcccttcagtgaagaacttgccactcagctgtggaggtccctggagaaagatggagcttcttgttctgtgagtttcactcatagctccagctctggagttacagggacttgggtttgaatcctcattctgttactttctgtctgtagtggttttgagaatccactccaatgtgttttaaaatgtgcccttaaaatgtgtttgtctttataaaatatgcatttggttaacaatcagttgcacaagtgcttcttgtttatacctcaccatgatgt

SEQ ID NO: 472350 - DNA, 599 bp, Homo sapiens
tcctcacaggattcctgacttattcctgcagtcgttctggagctaaaactcaccatgcaagcctccacatgctgctctgtccatcagaagcgagagatgaccttatcacagacctactaaatgaagcaaaacagagactcagcaaggtggtaaaagatacaaccaggtaccaagtgctgctagatggactggttctccagggtttgtaccagttgctggagcaccgaatgattgttcgttgcaggaaacaagaccttcctctggtaaaggctgcggtgcaaaaggcaatccctatgtacaaaattgccaccaaaaacaatgttgatgtccaaatcgaccaggagtcctacctgcctgaggacatagctggtggagttgagatctataatggtaatcataaaataaaggtttccaaaaccccagaaagccagctggatctcatagcccagcagatgatgctagaagtccagggagccttctttggtgcaaaagccaacaggaaatttttggactaagccttcaggaggtagagcacgttctcagctctcctgctatgatgtggaagattctgatatttgaagaaacgcgaatgtttctgt

SEQ ID NO: 472351 - DNA, 569 bp, Homo sapiens
tccaggtctagaagtaaagcattcatgagcatctcaaaggcctaccttgcatgcttttccaatcacaaactgcccctcctccttaaagatgaagaaaccaaaggcacagaagagttaagcaacttgcataagcaaacaggtctccttaaagtcggggagtaccaggagatcatcaggatggggctgatggagacatcagaaaacagtgaagcaaggccagtagacctggagattgcagcaacagttcccaagagctggggcttcctcacagctgtgtgtgtttgcatcttctggtcccaagagcagccactgctcaggtgttcctggaagacgttagcatcagaatatacgtatgcaaaattaagaagatcagccctcaccaatgagggcttagatgccatctttctctggaaggaaagatgtggaggagggcctggtttagatgaaatgacctgggaaagcatcttaaacaaagcaattcccataacagaatttctcttctccatcaccccataacctattttgccaggatggtacataagtttctgaatcccgttggggtggggaga

SEQ ID NO: 472352 - DNA, 918 bp, Homo sapiens
gcttgcctctttttttgaaaaacccagctggacaatgggcatattcaatggccaaggcctcctctaattgctggcttgggaagaactggagataactcagcaatggagagacaaggagggctcctagggaacaacttggagaccgaggaatcttgctgaatgccagcagaaaatctggaagcagagccagtataattcagcattactgagcccactgagctctccagggaagtataaattgagcacagaagctctgaaatggattctgttgggtacaccccccagacggggtggcggccgggcagaggggctcctcacttcccagacggggcggccgggcagaggcgcccccccacctcccagatggggcggcggctgggcaggggctgccccccacctcccggatggggtggctggccgggcaggtctttttttttttttgagacagtctctctgtcaccccgcctggagtgcagccagtagaggggtggcatgttcactgtatgactctggaagcctgctgtgaggaggagggatggacaggaacagaaaggaatacctcagtgccctttctttctgccttcccatcaagacagtacaacgcctatggaaaaagaaaacaacaacaaaacctcaaccagtatctaggacagagctatgaggacttagattatgggggcagggaggtaggtggcagcagccttagtcaaggaaattcaggggtcaccatttcagccagaagtcaatttaactttgaatatccaagtttggatgcttcctacaaacgggtaaccggaaaggaagctctggaacttcagagagagtttaggcctgcagatatagaatcgagcatctggccagagtttgggaaagtaatagaagccatggatatggccatatttcacaggaaatgaacat

SEQ ID NO: 472353 - DNA, 607 bp, Homo sapiens
agaagcccctgctcaggatgagaatgagggagggagagagccagctaaacttgttgaatggctttgcccaaaatgctgatagcaatatggacaataaagtccaagctgaggtggtctcagatggagatgaggaacttgttgtgaatggctttgcccaaaatgctgatagcgatatgaacaataaagtacaggctgaggtggtctcagatggacatgaggaacttgggaactggagcaaaggtgactcctgttatgttttagtaaagagactggtggcatttttcccttgccctagagatttgtggaactttgaacttgagagaaatgatttaggctatctggcggaagaggtttccaggcagaaaagcattcaagaggcgacctgggtgctgtttaaggcattcagttttatgagagaagcagagcacaaagagcataaagcagagtggaaaatttgcagcctgacaatgtgacagaaaagcaaagcccattttctgaggagaaattcaagctggctgtagaaatttgcataagtaacagggagccgaatgttcatccccaagacaatggggaaaatgtctccaaggcatgtcagaggttttcatgt

SEQ ID NO: 472354 - DNA, 721 bp, Homo sapiens
agaacgagtttttcattggtcctaatatggcttcagaaccggccaatcaagtcaagagtcggtgttgttacgtacgcattgctgaaaacgcaaggtccgcacacggaccaatggaaatgaacgactttcggagccctaatttgcataagaaagccgtcaccaaagcccagaaaaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagc

SEQ ID NO: 472355 - DNA, 3095 bp, Homo sapiens
taagtgattgctttttaatgaccttgtcacctgagctaggaaggcctggggatctgggtggaccccaaagtcaaagctcctctctttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccatgatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccacagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacagatgacttgtaagtcagggttctaccctcactctggattgatctctgttcctccagtctcccatgccaactcacttacacatcactgccagatccatctgcccccagatgctctctggcatgtctgtactcaaaatttgtcaatgactccctactgcccaaccacatgcaccttaaattctttagctagaaatggtcaagatatatgttaa

SEQ ID NO: 472356 - DNA, 1893 bp, Homo sapiens
gcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaac

SEQ ID NO: 472357 - DNA, 622 bp, Homo sapiens
cctatactcagggctgacagacagctggtattcaccatggcaggggctactgtgactgggtctgctcggattggttggtgctgtgctgtgagatggaaaccaattcttcaggtattacccagaggagttggaatgttagatgtgtggtccaactctttctctccccagagagaatatgggaactggaggttttttgcctacttactctgtgctgggctaggggtagagcctgtggtaagtgcttatatgctagttgaaaccaccttttttatactcaatggccctaggcatttacaatgtgccagtgcacaaaaccaggcaagacaaaaaccagtccctggggaaatacctagaaaagatggcacaccacaagctcctgtgggtcagttacacaagctgacccattatttgaagaaagactgcaaagattcggagcaattttccttgggaaaaatgtcatcagagtgatattcagtaagtgtatttcaaagtaaaaattatatttgtaatgcatacttaaacttttatgacacatgtgaaggattgtttggaccattctgaaacttttgtgagtccatgtaaattttaagattattttttctatttgtgaagaaggtcactg

SEQ ID NO: 472358 - DNA, 656 bp, Homo sapiens
tcacccatcttctgcatcagtcatgctgggagctgcagacaggagctgttcctatttggccatcttggaatggagtgtgttgctaggaactcgattgaggaccagaggtccagtcacaagtaccaaccaagccgctagccagctgcttcaggaaaaccaccctcttgctcctgtggtgtccaatgaggatgatcagaatggtcctgggggtgatgctggctcgcagttttctcacgtgccaactgaagggtattttgccatggctcaacagcttttgaggcacgtcttcatggctgagtacttcctcttgtacgtggcctttctagaatacatagcagatcaggaatatgtgccaattcttctgacaagggcaggatttcagctgcaacggggcttccccttcttgggctttttagccctgaggttacccctttccactttgccaccagcattagcctttttggcttcgggcttcttctctttggttcttcttttgccttggaatatcggggaaagtcccaagagtgttctgcatccttgctccttgatctcatctttacgtgaagaagactgtacagcagaagcagcagcagattcagggtggggctgagggtggggaaagtgggtgctgttcttgtttgtgtgatttgaaaaaa

SEQ ID NO: 472359 - DNA, 594 bp, Homo sapiens
ccgtccaaggaggaaaactagtctgggaagtccatgatcaaggtgtcggtaggttccatgtatgctcattggaccgagagcctcagctcccctttgactgttcgctgccctcagttcattgctatattgtcctctccagcatggcagcttgcttcatccagcccagtgagaaagaggaaacgtaaaatcaagatggaaatgaattgtgtgttggactttccaattgaactttcaacccaacagttcctggaaatttctcttaccaaattacttatgatgttgtcaaaatcaataatcaattattttcctattgcatttgatgcgtcagcagcatccaatagtgggatcttactccttggaggccgtgtgggccatgaggttcaccactttgttgctataaccaaattcattgtcataccagaaaatgagcttgagaaagtggtcactgagggcaatgacagccccaggatcaaaggtggaagagtgggtgtcaatggttaagctgaagtagacaacctagtgctcagtgtagcacaggatgcccttgaggggatcctctgatgtctgcttcaccaccttcttgatgttatattt

SEQ ID NO: 472360 - DNA, 616 bp, Homo sapiens
tttcagtccatcctacgacatgctgccaaggggtggccccgggtgatcctgtgtgtgcccatcatgtctttccaggtgtatcttccatttctccctggcgtggtgctctctggtctggtctcattgttccctaaaagtaccctgcagagccacccaggtggagaaaaaggacccaaaagtaccttccaggttaggcttccttgtttttccctccaagcctttccgcccccgtatggtgcatccttgagatggctgactgatcaggcctcctcgcctctttcgctgatcacccctcactgcctgttggagatatgtcctcttccttcctttgcctgtgaaaactgccctggtggtttctcagacccctcagctgcaggtctgttggagtttgctggatatccactccagaccctgtttggctgggtatcaatagtggaggctgcagagcagcaagtattgccacctgatccttcttctggaagctttgtcccagaggggcacccacctgtttaaggtgtctgtcagcccctactgggaggtgttttccagtcaggctacatgggggtcatggacctgctagaagaggcagtctgtctgttctcggatctggaatgcc

SEQ ID NO: 472361 - DNA, 590 bp, Homo sapiens
catcatgagatgaaggacatttcatttacaagaaccgtggaagaaccagggaagccagaaggccaggcagggctgacccccaagagagaagcagttacagtagaagactgcaacttccagggagctgtacagagcagagatgcgcacacgtttaaagcaggacccctgagcatgaggggtgcagtggggatgcagctaacagctgacagcagaagcatccctgattggcctgaccaccaaggaggcactgtgggaagagaaggactgacacagccatggaaccagacccagatcaagaagcagaacctggacagcaccccagaagctgcctttgtgcccatttccactcttgatccttccccccgaggaggcaaccactatcctgactcagcacaaccaaagaaaccattcatgaataagtcagcaccctgaattagtaaagatttagagatctccaatagaaatattggactgtcagtatttagagacaaaaatagcttgattggttacagctggcatttgccttacaggaacatgttttggcaatttgcagcctgcgattgactgaaagcatggctgctatgattggt

SEQ ID NO: 472362 - DNA, 477 bp, Homo sapiens
acaccgagcacaatcctcatcttacccactcctccagtgggggatgctgagatttctcccaggatgcagcaaatccctttccttagactggcccttgccttacaccattcatgccccaggatccctctctgtgggacattggaggaaaatgagtctgttctgaagaagtcctcttatggttcccccttccccactgctcagctcgcgctgctccttgagagtttggatgatgacaggcaggcattgcccatttcccctgaggcttctatcccaacttgtccttattccccccttctttggttttcatttaccaatggcttgtcctttgtgagttgttctcatcccctaaacctgctgactttctttctttcatctgttccctcagttctgggcttccagtgtgtggactcagctcaggctcctgcaggagacacacagagtcaggtctcagctgcaggtcctgggtggcattaaaaa

SEQ ID NO: 472363 - DNA, 818 bp, Homo sapiens
cgtgctagttagcttgtgatacacatgctcacaaaggctggcgcttccttctccagcgaaaagcaaggcgatatatcacttcccgattcaaagcatccaactcatctacctttcatagcagtaactgatgatcatgaaatgtttgttgattgaatggctgaagtatagacagatgcagcttctgtccatgaaaggcatcctgcttgctccttgcactgtgtccagtgaaaactcttgtttctctgtgcagctgcaacacgtttcacatcacaaggagcacaaggcactggcttccatttccaccctgaagctcagcagccccatttgcgtcccatcagctgcctgctccggaatagaggagggaagggctgggcttcagagtttgcttttttttcttggttctgtgaatggaaaaggatcctgtgaagggatccagattgataccttggggtctggtcaccaacgaacacttccttgccgacacatagaagaaggagatgggggtcgcagactctgtacttccaggagaagcccccggaaggtcttagctggctcctgagggggcacatttgctgtgctcattgcactttacctggtgtcatgaagcataaagagcacaaacgtggacaccaagagtctacattaaagtcccactcctttatgtttgtaaatatgggatattgggaagttgctgcacctttttttgctcattttcttcactgaacagcagaaatagaaaaatttcttcttaatagggcttaagggagactcaaatacaacactgtatatgatgttcttttgcaaattgtaaagcaaag

SEQ ID NO: 472364 - DNA, 579 bp, Homo sapiens
tttgaagacctttctttgtaggctcaagggaagtactctcacttctgagctctaccccacagcaaacactcggaccagcagctagaccccgtatgcaatatacttgccactctgctgcaggtctgctggagtttgttggaggttcactccagaccctctttgcctggctatcaccagccaggctgcagaacagcaaagattgctgtctgttccttcctctggaagcttcgtcccagaggggcacctgccagatgccacctggagctctcctgtacgaggtgcctgtcaacccctgctgggatgtatctcccagtcaggatgcacggggagccagcaggcaggaatgtttaagtctgctgaagctgcacagctgccccttgccccaggtgctctgtcccacggagatgggagttttatctataggcccgactggggctgctgcctttctttcagagatgctccgcccagagaggaggaatctggaaaagcagtctggctacagcagctttgccaagctgcggtgtactctgcccagtctgaacttcctggcagctttgtttacactgtgaggggaaaacc

SEQ ID NO: 472365 - DNA, 751 bp, Homo sapiens
ccacttatatgaaatatccagaatgagtagaactagtcacagaaacaaacgttcattgagtgactctgcatcaaccgaatggagtgctggggttactgtattgtgtaactgccttaatttccccagggctaatggaaatgcaaggcacatagtaggtccacaatcagtgtttgtggctgaatggatcggaatctggtgggggagacacatcggatccgtcgtagtttctactgccaggaaacaagtatcccagactttgtggcttaaaacaacacccattccttatctcatggcttctgtgggtcagaagcctgggtacagctcagctggattttctgctcagggcaccaaaggcctcatgttggtagccatatggaaatacacaagcaaaactaaagacaaggagaccatttgggaagctattgcagtcaatggtattgactgtaactccagcttccgggatgtgaaagtttcccacctgcagccactgatctgcatttctggtcacatgggccacccctccccaaaagctgattggcccaggggcactgtcaaaagcactgtatatccttgaacctgctaaatcctcacaacaacttgtcagctgaagggtattatttcagggttgagagtggggtggagacagtgggggatccttacctctaactagggaaggactgaagtctacaaatgtgctttctgagccctcaatggaaatggattggaagctctggcctcgagaatgcagtcc

SEQ ID NO: 472366 - DNA, 776 bp, Homo sapiens
ccactaacaagcttttgcaagagggcaggatttgatggtggagcatgtggcaggaagacacaattcttcactctgtccgctctgctcagctaatggttactggctccacgcctaggtcctcaaaacactgggaccgcaagtgcaagaacgtacctgtccaggctctgaaacaattgtcatgtattcaagagatgaaactgtctagaagaaaagaaactgagcttcattcttcccctgccagtgaggaaccccgagggagtcctgcagaaagccaggcaaacggagccctgctggggggcacagactcagaggatggagctctggcactcagtgttgaaggtggggcctggtgggaggtgattggatcatggcggccgatgtcttatgaccgacttagtaccaaacccttggtgatgatgacggtcagtgaatttgcaaatatcctaaataatatgccacaaaaaagatgtcggattcctgtagctgtgagtgacaatgggtactaattatcccttactcagaaattaaatgagcagatttccccaacccccctcccacttggcaaaaggtctatatgatgtcctagaaaataataaagtgaatgaacccggtatgaaaggcagcgggcagcctcacactgggttctctgccgcttattaataccagcacattgcattaaattagagaagagccttttcacaggagtgctaagcattctgcctggctgccataaattgtactaactaccttgcatttctcctctcattttatctcat

SEQ ID NO: 472367 - DNA, 743 bp, Homo sapiens
aggactgaaaaggccatggagtcctcggggcgcccagccttttcgagctgccaaagacagtggatgtggtttgggagcaacactcttaagccactgggaccagatgaagagcagagtctggctggctgtgttctacggagcatctggattgtcaaaagcatccggcagcttgagggatgtgatggtggggaggagggtcgacatgtggtcttgttgatgggactgttgtgtccttcttcagaggagaaggtggtcaacaatatcttcctgtggcccgagagcctgccatgcgaagcgcaggtgctgaccaaggagacagaggtccccattagtaaagtgccagaatttcatctgagtattgtctgcctgcattgttcacaccaaggttcatgggcgggggatactcagcttagcaccttcaggatgggccccggacttgacgctagagccggagccttggtcctaggattggaagtgggcgcagtagattcaggcagtcatcgaaaacgcaaattaaaacaaccctgagatatcgttgctcgcctatcaggttggcaaaacccctaaagtacaccagctggctcagctggcaagcctgcaggaaaatagcgccctcacctgtggtcggtggaaatgcaaagtgacgtgacccctgtggggggagcaaaatcacatatgcatttaccctttgactcatcactgctacttctagggatgtaccttgaggataaaactgcacaaat

SEQ ID NO: 472368 - DNA, 673 bp, Homo sapiens
gagggtccgcggcttcattcttaaagctatttgtaaactgtcaaggcactgatgggagtgtcttatgctaatgagcagcgcgggaaaccagaggttgcctttggcgccacctgctggttcctgccagtgtctgtcttcatcctgttgggattaggaaataagtcccgctggtctcctacctcattaggagttgagtctgatgttgataaatttgaaattcctcattgtgtaggtgatacatcgaaagtgcatgagattagtaaaatagatgatgaaaacggacaacacaaagctaatcaaaattctttaacaaatgtttactatgtgaacaatttagattactcactaaaagaccagaaatacaatgtgtccaaaccagcagaaggaaacggaggaggagtaatgaaaatcttatcaaccctagtagaagacagaaaaggagagaaacaggaggaggaagcagggaagaagaacgaggagaagggggaggaaaaagaggaagaaaatgaagaggaataaaaaggctagtgaaccgaagcacaaaatatggttgtttcttggtatactctggaaattggtttcagaacctttgcatatgtcagagtccacgtgttcaagtcctgcagttggtcatggagaatgtgggtatgtgaaaagttggccctctgaatac

SEQ ID NO: 472369 - DNA, 766 bp, Homo sapiens
gggctcagaatgggggagtgcatgctgattggtccatgggaggacctggaaaaagcaccatttgattggctaaaagacattgaggaagttctcactctgactgtggactggcagctcggttttcaggctttaaattgtctttggtttgaagtgaaaacaattcaaatttggacccatggaacccaagatgcagttgaatatcagccaagagctcaagagaggctcctgggactcatgggcatgcagctcagtggccagacacattgtgaattgaccatggtagaaggcaatgtccaaatgctacaaacagagcctccatggattgttccttggaagcccgagaaggtctccatgaagccaagacataaatatgaggaagccggccatacacagggactgatcagtggtattatatatggaaaagaattctcacaagtccaaggaaaagaaaatatcactccggagtgtcaaccttttgccaagtttaaccacaagaagaaatttcgcagctgagatattaacttttcaaacaaaggatttatagtgtaaacatggaaacaggtttagctcttagtagtcactgcagggatattcctcaaagaaggacttatttaggtttgacctgttaatattttaatacatgatactagctatttacagaaatgtaatttggttgaatcttattttgttgctagagtttatagtatttctaagtgtggtgtcattagaaagcctctacaaaattttgaaaataaaagaaatgtat

SEQ ID NO: 472370 - DNA, 542 bp, Homo sapiens
gatactgaataaatgcattattatgttgcacaaggagattttattcttcaatagaaacttcattactgctttaaggaattcacagcagtcatcattacccttcttttacacaggaggactcagaaagctagagaagaaacagggagaaatccgggcatggacgcttagtgtgctagagggcaaaggcccacgtggctccgtcatccggggcttttcatatcttacgctgacccgcctgacttctctgatcctcagtttccacatatggatgctaagacaatacattcctccgaggcagatgtggagaattaatctgagaaataacaggatcatactaggggaaaaatcgcctttcctcgtaccctggtctcctcccctcaactgctggccaccccagagacaacttctgtctagtgctccgacatgctgatattgaaagaagaaaagggaaaagggccaggaaggattggttgaaaatttccctaatctgtggatagatgccaacaaccaggtagaagaaccacatagctctccaataaaat

SEQ ID NO: 472371 - DNA, 624 bp, Homo sapiens
gttttataggatttgggtccctgagagacatgggtgatatattacagcttgtaggtggtttggcaagacagatattactcccccttcgcaactctaatcaacttacgtattttaaagcagaggtaaagagcatagcaggtgccaagtcctctaaacaagaaggtatgtctttgaaggatgtctttgaagaattaagtgtgaagggagagcagagtaaaagggagacggacgtggatgaagctggaaaccatcattctcagcaaactaacacaggaacagaaaaccaaacactgcatgttctcactcataagtgggagttgaacaatgagaacgtatggacacagggaagggaacatcacgcattggggcctgttgagaagaagattgatggacataatgattcctatccatctggacaaaaaagggaaaaggctacatttaaaatgtctatagaggaactaaacatatagttctagaaaccagcatttgagcattcaaaagacatagcacaattctatacatgtccttcaaaatttttttaaaattcttttttccttttgtaaaatgtgatcttctaggaagcaggaactgtattttatctatgagtctggcatatatgaagac

SEQ ID NO: 472372 - DNA, 2584 bp, Homo sapiens
gtcattcctccttcttgttatcgtgtgaagaaggacgtgtttgcttccccttccaccatgattctgtggctaaagtgggccaaggtacagcttgggccatcacttcagagggtacaagtcccaagttttggcagctttcacattgtgttcagcccatgggtacacagaagtcaagaattgagggcaatgcagaatgggaaagtggggttgaagcccccacacagggtccctcctggggcactacctggtggagctgtgagaagagggccaccatcctccagaccccagaataatagatccaccaacagcttgcactgtgcatccagaaaagctgcagatactcaacaccagcccatgaagacagatgagagtggggctgtgccctgcaaagccacaggggcagagctgcccaaggccatggatcagcatgacccggatgtgagacatggagtcaaagtatatcattttggagctttaagatttgactgccccactggatttcagacttcctcagggccttgagtgagttctcatgagatctgatggttttacaacgggctttccccccttttgctgggcatttctccttcctgccatcatgtgaagaaggacatgtttgcttccctttctgccatgattgaaatgagctatggatgctgtatgcaatgatggagagagaacaaaatttggacttaggcaaacctgtggaaaaaaaatgatattttggcaaatactggctctatgtccttgcaaaccactaatacttcagcctgagtgccttatttctagaataatgatgataatccttatttatgcaggattgctgcaaggattggagatgaagtagtttacacacagtacatatttgcaaaggtattatttttgttattgtattttaggagctaaagcttattctatttaaccttttataattttattctatcatccatttgggactttcttttcattctgactttttcatagactcttattcctttaaaaaatagaatgactaaaagaaattataactataatattttgcactccagccagagttacaaatattattgtgacaaaaacagcaatgttaccactgatgatttttttaatgaaaaataaagacaaatgttgtaatatgccaagcatttagggaacttgagttgaacagttagattctgcatggtctagcaacctggaatgggaaggatggggcccttcagctgttcactgtaccttaaacttaagtcttatataatcagagaatttcagagaatgtgaatcatggaataacagatggtaataacttgacgacttagccttgtagagaaggaaaaaagtgatggcagctgatcagtgtgtatctagacttgcaatgcaaataagatacaagtaaaactgacaaacttgcatacactgctcttaatttatgccccagaaaagagatttttaatgaacaatcaaaaatccaatagagtgaactcttgattaactgcaaatgtagagcagaaaatatgtggataatgttctttaaaaataaacaacaataaaacttgctatatgaaattgaaaaacatactactctaagaaagcatatacactctcggatgctttcatactcagctttcagaattgaaacctgaagctgtcagattattagttgcttagactctctctctctatatgagaaaaatagtctaagattattactcacagatgtttgtttccatggtttttagtctaccaattcataggcttatgaacttttaatttatattttatctgtgaaatgaatcactgatttcagtgttggtcaccacaaattatcagtgactagaacagtgaaagccttaaaacactggtcagaaaacagggtcatgtttctcacctgtcattaagttgctgtgttgccctgagaaagttttttaatctttttggacttcacttttattattagtgaaatgaagacctcaaagtctctttttacagttcgaaggcttttggttttataacttttaaattattataagagaggtaacaatgcaagatactaataaggatctttaatatttaatcagtgcttatcatgtacaaagcatacttcaatgcatttcacattactaaatgtcttagtccattttgtgctcctgtaacaagatgcctgagacttagtaatttataaacaatagaagtttatttggctcatggttctgaagactgggaagtccaacatggaggggctgcatgtggcgagggctttcttgctgtatttcccatggaagaaggcagaagggcaaaataatctgcatgagaaagaaaagcaaagatggctgaacccttccttttatcagaaacctcttcctacgataattaacatactccctcaataatagcattaatccattcatgaaggcaaagccgtcatgacctaatcacttcttaaaggtctcacctcttaacactgttacattggagaataagcttccaacacatgaactttaggagacacattcaaattttagcactaagtcatttaattatcatccagtctctgtggtaattaccagtcactttattttataaatgc

SEQ ID NO: 472373 - DNA, 549 bp, Homo sapiens
agccagtggatgccatgttagcacagatacagaatgtttccagcatcacagaaagttgcactggacagctctggtctaagatctggttctttatcgggttatctgattcagaaatgtagtaaattatccagtgctgcctgctttggaggggtcaccagtgactcagcagtgggttggtggtggggccaaggccccctggggcctcgcctggaagctgctcactgtacctcaggccgcacgctgggagtcacagcaagtcagcaggccaacctggtgtggtgtgctgagggacagctccaagaccgtgtgtgccagggcggggggtacctctcaccactcaccacaggtcctgcggcctccaccctgacacttcctttttcccatgagctcatccaaaccacgacttgagtgaccacaaaccatggactgtggacatttcccagagctccaggctaatactcaccctcttgatacttgcacctgttcaaggggcctgacttcaccctgcagagaatcccacagaaggttctccatgccccagccccaacc

SEQ ID NO: 472374 - DNA, 1112 bp, Homo sapiens
gcattcttctttctggatgctaaccccaaatccgacactcaatggtgcacctcaggtacctgccaaggatctgtgggcccacatggaaggtgcagggtctgggtccctggatgacgaggtgaggggcagatgggtgaccagggaagggcatgacccagagctgccgggactcatggaggatgggctgtggctaggacttcaggaagggacgggcacagccttgacttcgggcaatggtcccccaatggctcgctgctgcctgcgtccaccctggcccgatggtgggcagacccagcggggctcccgcacctgcagcagcatgctgaggcccaggttgcgatgcttcttctccagctccgagaccgcctgcagcagtgacctgaaccgctcagtggggtcagccagctcgtcctcagggagcccctcctccttctcagcctcctgcaggaaatgctcctcctcctccacaaagaaggcccgcagcttcttgtagtcgtgagctatgaccataccactgcactccagcctgggccaacagagcaaggccttttttaaaaaaaatcaaaaaacagtgcaagatcaccctgacctccattctgcttcttaaaagcaaatgaaattcccaagtgaaagacgccctccccatatcaaataaaatgattttatcatcaaggacgacaggaagtcaaggccgacagaatttggtacagaccttgtgaaaacaactctttcaagcatccccacatcatgtagttgcttttttacaagtggctagtctttgtccaagtcagtatataagtgatttaattttgccactttgagtcttcatttcattataagggagcctgtgctgtataaaacttgtgttaaattaatatgcctggctggacacggtggctcacacctgtaatcccagcactttgggaggccgaggtggttggatcacttgagttgaggacctcaagcaatcctcctacacctcagcctcccaagttgctgggattacaggcatgaaccactgcacctgaccctgttagtttagcttatgtcagtttaattctcccgcccagcctggggccctaaaaggggagaaatagagttctttctcccct

SEQ ID NO: 472375 - DNA, 492 bp, Homo sapiens
agggtctctctgcactatttctatgcaagtgtccagcatgcatctgacagaggacatgctcctcacaacccacaccacttccctgaggaatccagactgggcctggaaggggagtcgggatgagcctggcctcggggggtggctgcctttgcccagcagggtgtcccagcagcgcccagacaccacggcagctcaggcagcccctgtacatgctgtcttgtgtgggcatagtcagggtctgcggctgtgggggattcagcacttcacagggcaggggacctccacaagcccctactgtgcctggggccactgcgacctgctggttctcctggaatcaatgtcggtgcagggctgtgtccagctatccctgaaaggtctgattatctcttctccccactgcatggtcaccctggtaaaaggccagaagtgcctttggggaaggctgggagaaaggtaagaacactaacttatttatttatttatttatttata

SEQ ID NO: 472376 - DNA, 1271 bp, Homo sapiens
attgttggaaagatcagtaatctatgtgtctgtccttacagcaacactacactgtcttgattactgtaaaccactctgggttgctgccatcgctgccaccgtcgtgccagcccctcaggtctccgcgaggccaggtgacgctcaagaatgggagacaagccagtttgggagccgattggatccagcttcaatcaacattactaccagttatttgataacgatagaacgcaactaggcgcaatttacattgatgcttcatgccttacgtgggaagtacgacagttccaggggaaagctgccgctgtggagaagttgtctagccttcccttccagaaaatccagaacagcctcacggcgcaggaccatcagcccacgccagatagctgcattatcggcgtggttgtgggccagcttaaggcggatgaagaccccatcaaggggttccaccagatgttcctattaaagaacatcaacgatggcttttgcgccaatgacatgttcaggtttgccctgcacaatttcggctgacctcctctcagccaggcactaatgctgtttcctcctcccttctcttcccaatactattcctactcctccagatgctccaaatatcatgcacaaataagcagggccgcggcgggagtgggcgcagtgcgctgctgccaccgaggtgttgtgcatgatgtttggacgctagactagttacatatgacaggagaagtttgtgttgtaccagcgcgtgccttggaaaggcttaagtaatgcaaaaggttgtccttagtttttggtttttttgtttgtttgtttttttaaatctactgacaggttgctttagtaacccaaagaagtgaaggagaaagcagctgcctcaccgcccagacattgatttgttcagatgtttcaatgccttatgatacaataaaaccacaaaaatttcctttaaaaattcagtcttctgatctatgaacatggaaaatatctgcatttatgtatgttttcttaaaaatttctaaacaatattttatagttttaagtgctcaagtttaggtcttgcaaatattttgcaaaacttatccgtaagtatttcatgtttttgatgatacaatgaatggtactgtgttttaaatttctgtttatagttgcttgttgctagtacagtttataaacatacaattgatatgtgtatattggccttttatcctgtgatgtttctaaacatccttcttggtaccagtagcttcttaaaagtttcttttggattttctacatag

SEQ ID NO: 472377 - DNA, 669 bp, Homo sapiens
cagctaactggccaccggagaaattgaagctggctgcagaaatttgcataagtaaagaggagctgaatgcccaagacaataaagatgcctcaaaggcattttggtgatgttcaccacagcccctaccatcacaggcctggagacataggagggaagaatgattttgtgggggcaggcccagggccccactgccctgtacaacctcaggacattgctccctggtcccagctgcttcagctccagctgtggctaaaagggccccagataacatcgcagtcaactgctccagagggtggaacccataaatcttggcagcttccacatggtattaagcctgtgggtgcacagagggcaagagttgaggcctgggagcttctgcctggatttcagaggatatatggaaatgcctggatgtccacacagaagcctgctgcaggggcgcagccctcatggagaacctctgctagggcagtgcaaagaggaaatgtagggttggagcccccacacagaatccacactggacactgcctagtggggctaacgactacaggaataagtcaggaaatccaagaggacccatagaccctctgaaggaagcagattgcaggacccaggagacatcccaaataccatggtatgcatggctgagagacccacagatggttcaca

SEQ ID NO: 472378 - DNA, 647 bp, Homo sapiens
ttgaggtggtgtcttctgggaagctgggacaagccaaagaaccgcaggaggagtgcattataagagggatggtggcagaggaaggaaatgaggcctggggggacatctggcaatggaggaacagggtggctaaagcagctctggctcccctggctctgggctctgagacagctccagtggccgtgcctctcttgtacaatcaggtcttcacctcagtggagtccccaccaagagatccagatctttatggcagccatgttgcctcctttcttgggtgtgtctctctgttcttgttgcttttgtctttggttactttccagaccaggatgagtagagtgaccagagtcatcaggggtgtaaagaagaagagaacatttaccaggcaagcaggattagatatggcagtggtgagtgtacccttgtcccataagaaagctggaagttgtggggaggacataagcttccaaaaagagctgagatagcttctattcaataagattttctattttttgtgccaagagtattcatatctttgtcagataattccaatatctgtgtcatctcggtgttgccatctgctgattttttttttcattcaagttgagattttcctggttcttggtgtgatgtgtgattttttaattgta

SEQ ID NO: 472379 - DNA, 649 bp, Homo sapiens
tattgtttgcagctgctgcggattgtttagaatacgttgctatgccccctgcctcaaagaaagaatatgcgaggtttcaacaaaaccactgtggttacacagttcatcctggtgggtttctccagcctgggggagctccagctgctgctttttgtcatctttcttctcctatacttgacaatcctggtggccaatgtgaccatcatggccgttattcgcttcagctggactctccacactcccatgtatggctttctattcatcctttcattttctgagtcctgctacacttttgtcatcatccctcagctgctggtccacctgctctcagacaccaagaccatctccttcatggcctgtgccacccagctgttctttttccttggctttgcttgcaccaactgcctcctcattgctgtgatgggatatgatcgctatgtagcaatttgtcaccctctgagtattgatttctggtttcattccaacgtggcatgagaagatgcttgatataattttgattatttttaatttgttgagacttgttttgtggtctaatatatggtctaccatggagaatattccatgtgctaatgaaaagaacctgtattctgcagcagtcaggtgacctgttctgtaaacatctcttagg

SEQ ID NO: 472380 - DNA, 1326 bp, Homo sapiens
ctagcatacgaccaatttccatacgacagaccctgagaccttctgggctgcctggggtgggcaatatggccaaggaaaagacaacttgggggccactgaaattaattttgcatcaatctctgattttcaacccccatcagcagcaagtttcaagcttcaaagaaatggaagaaatgcaattgacttacattcttggcagatgtcctacaataaacagggcctgtgaacaaaacattccacttccttccctcccgcttcaacccctaaaagatggctatgtaacgatcataacccatgactgccagcagaaaggagtgagagcagccaaggaagaggaaggaaaacatttggatggcacagcccaggaaagaaatggtcttcttctgggacagcaggtcaaccagcatcttgggtacaatgatgaaggtgtagcaaatctcagagcaagagaggatggcaaggaagaagtacatggggatatgaagggccctgtccaggacaatggtggaaatgatgattgcattggtgcccagagtgaacagaaaggatttgagatgatttaaaataggtactattaaggcaagaataaacatattacatagatatgttaacaaattagggcaaagggatattcatttttattattgatccaaaatattttatatgatatcaatactttattgattacatgtacttcaaatattttgtgtgactttgtaaatttcattttcactcagttgaagatgtcttttgatgaacatgtttacctattgtttagctgtcacttataagtaagaacatgtggtatttgacttagacttttgttctctttgactttttaaacaaaagattacttctgtactctttgacttcttgtattttcatatttcgtattcctaggcatagtaattctttctgctgacatacagaaatagaatttatttttgtattaccagctttgtataaggcaatcatgtaaatacatttcatttttaattcttatatttatctgcctattctcatgtaattttgtttttgtatctctgtactgtttatgtatttattaaggtacaattgacagaaattatatatatatatatttcatatccaatgtgaagttttgatatacaaatacatttttcaataattggtacaatcaaactaatcaatatacctgtcacctcacatagttacctttttttcatgtgtgtgtggtgagaatacttactgtcaacaacttttcaagtataaaatacattattgaccgtagtcaacattctgtacattaaaatatctaaagcttatgtatcttataactgaaagttc

SEQ ID NO: 472381 - DNA, 989 bp, Homo sapiens
ttgggaacattttatatgataagtgctctccatggagcaagtcaataagactgtggtgagagagttcgtcgtcctcggcttctcatccctggccaggctgcagcagctgctctttgttatcttcctgctcctctacctgttcactctgggcaccaatgcaatcatcatttccaccattgtgctggacagagcccttcatactcccatgtacttcttccttgccatcctttcttgctctgagatttgctatacctttgtcattgtacccaagatgctggttgacctgctgtcccagaagaagaccatttctttcctgggctgtgccatccaaatgttttccttcctcttctttggctcctctcactccttcctgctggcagccatgggctatgatcgctatatggccatctgtaacccactgcgctactcagtgctcatgggacatggggtgtgtatgggactaatggctgctgcctgtgcctgtggcttcactgtctccctggtcaccacctccctagtatttcatctgcccttccactcctccaaccagctccatcacttcttctgtgacatctcccctgtccttaaactggcatctcagcactccggcttcagtcagctggtcatattcatgcttggtgtatttgccttggtcattcctctgctacttatcctagtctcctacatccgcatcatctctgccattctaaaaatcccttcctccgttggaagatacaagaccttctccacctgtgcctcccatctcattgtggtaactgttcactacagttgtgcctctttcatctacttaaggcccaagactaattacacttcaagccaagacaccctaatatctgtgtcatacaccatccttaccccattgttcaatccaatgatttatagtctgagaaataaggaattcaaatcagccctacgaagaacaatcggccaaactttctatcctcttagttaaagagctattttttaaa

SEQ ID NO: 472382 - DNA, 1290 bp, Homo sapiens
aaattgcccagttgatatgcattggacaaaatctgatatgaaaggttgatggattccagtaaattagactctgggaaagggctgcatattaaccttgtaccaaacaaacaaaatcaaaccctcactattgtggacactagaattggaatgaccaagactgacttgatcaataacctcggtactgtcaccaagtctgggaccaaagcattcatggaagctttgcaggctgatgcagatatctctatgattggccatttcggggttggtttttattctgcttatttggttgccaagaaagtaactgtgatcagcaaacataacaatgatgagcagtacacctgggagtcctcagcagggggatcattcacatttattggatatcccattactctttttgtggagaaggaacatgataaagaagtcagagatgatgaagctgaagaaaaggaagataaagaagaagaaaatgaaaaagaagagaaagagtccgaagacaaacctgaaattgaagatgttggttctgatgaagaagaagaagaaaagaaggatggtgacaaaaagaataagaagattaaggaaaagtacatcgatcaagaaaaactcaacaaaacaaagcccatctggaccagaaatcctgatgatattactaatgaggacatatatggctggacagcaaacatggaaagaatcatgaaagctcaagtcctaagagacaactcaacaatgggttacatggcagcaaagaaacacctggagataaaccctgaccattccattattgagaccttaaggcaaaaggcagaggcagataagtacaagtctgtgcaggatctggtcgtcttgctttacaaaactgctcttttgtcttccggctttggtctggaagatccccagacacatgctaacaggatctacaggatgatcaaacttggtgtgggtattgatgaaaatgaccctactgctgatgatactgctgaagaaatgtcaccccttgaaggagacaacgacacatcatgcatggaagaaacagactaagctccagctgagggaaatatattttcaaggatatttttctttattttttgttaacattaaaaagtctgtatggcatgacaacaactactttaaggggaagataagatttctttctacttctaagtgatgctgtgataccttaagcactaaagcagagctagtaatttttttcttagtttcacattggcttattttaacagatcgaagtaatgtgtgttgcaggatgtgtgaaacatgatgtttactttgtggtct

SEQ ID NO: 472383 - DNA, 1060 bp, Homo sapiens
ctcaaggagagacactcctttgaagcattggagtgtggccagatatgccggctcctagttaagcccactcctcacagctgctctccgggctgcctttacttcatggttcctcagacagtaaatgatggggttgaggagtggaacaatgacagtgtagagaacagataccactttgttggaattgtaggcatacatgagtttgggacgggcataggtgaaaagtgtcatggaatagaagagaattacgacggtcaggtgggaggcacaggtggagaatgccttttggcggccctgagcagaagggatcctgaggatggtggcaaggatagcagctggattacaaatggctacatagcggtcaaaggccatgatagcaagaaggatgtactcagtgcagacaaaggtcacaaaaaagtaaagttgagtcatgcagccattgaaggaaatactcttgtcatgactgaggaagtcaacaagcatcttggggctgatgactgtgacataccacatctccaggaaggagaggtggctcaagaagaagtacatgggcttatgcagctgcccatcactgcagtagatggctgggttgaagaatggtacaatgatagtgtagagcacagagataatcttgttgtggttgaaggtgtacatggcccggggccgtgcataggtgaagagagtggaggagtagtagataacaaccactgccagatgagcggcacaagtggaaaaggctttgtggcgtcccctggacgtagggatcctcaggatggctgcaatgatggcagtgacaattgggaaataaaaagaagcttcatcatggagctgaagaagccactgccccaagaggcagcagcaaggcgagtggccagactggaaggcatgagactagggtaaaggaggggtccacagatggccagggacattcttcttctgatactggatagtagaagggttggacagcttctctaacaagctaagtagatgcctgtggctacttagttcccagtctgtgtcacttgcttcttacatcccaacctctggaacaaggcaaatggta

SEQ ID NO: 472384 - DNA, 1040 bp, Homo sapiens
tgctctgcagagctgtctctgctcacagaaggggaagaaacaagtttcttcttcctctctccctccccctttctctctctctctctctctctctctgggctaaattgtttggctactatgcatgcaggtacttgtgaggacgttcctaaaggtgtccactgggaagatctgatggatttggttgggcccacagaaaggcagtgtggaaatcatcacaatctcgggaagcaggataaggaaaccgaagaggcaggaacctgcagagagttgagcacagagccggggggtcatgatcatttgatagcgaagagggttgcagatggcaacgtatctgtcaatggccatggtgctatagatgatagggttgaaaaagggagcaagaactgcaaacatcagtgcaacagctgtgtccaaaatcggtgggaaagtggcagagaaacgcaggtacatgagggatacactgccatagaacatcagaaagacactaagatgggcggcacaggtagaaaaggccttctggcggccttcaacagagggaatcctcaggattacagtgatgattctgatataagaaaaggcaataatcaggacagagaatacaatggccacagcatggatcacatcctcaatcagaatcatggacgtgtctgtacaggccaagcgcagcacaggttcaaaatcacagaagatctggtggatttggttgggtccacagaagggcagtgtggaaatccatgcaatctctgggagcaacacaagaaagccaaagatgcaggaccccacagagagctgaacacagagcccgggggtcatgatggttgggtagcggagagggttacagatggcaacgtacctatcaatggccatggtggtcaacaaaatcccctctgaatttcccagtgaatggaagaagtacatctgcaagaggcaaccaaccatggagatggtcctctgcctgctgatgaggatggagagcatcttgggaattgtggcagttgtgtaccagatctccagaaatgagaaaatgctgataaaattat

SEQ ID NO: 472385 - DNA, 1085 bp, Homo sapiens
aaaggagaaaaggcttatagatccagtttccatttcccacacatatactgatccaggcaagatcaaagcagacactgaatagtgttcagtggttggatgcctccttcagacctacttcttccactccttgggagcgtctgaatgctaccttcttacagccatggcctatgatagatacctggccatttgtcggcccctccactaccctataattatgaccaccacactctgtgccaagatggctgctgcttgttggacttgtggcttcctgtgtcccatttctgaggtcatccttgcctcccagctcccattttgtgcttacaatgaaatccaacacattttctgtgactttccacctttgctgagcttggcctgcaaggacacatctgctaacattctggtggactttgccattaatgctttcataattcttatcactttcttctttatcatgatttcttatgcaaggatcattggggctgtgctgaagataaaaacagcatcaggaagaaagaaggccttttctacctgtgcctcacatcttgctgtggtcctcatcttctttgggagcatcatcttcatgtatgtgcggctaaagaagagctattccctgacccttgaccgaacacttgctatagtttactccgtactaacaccaatggtcaatccaattatctacagagtcggtcttgatgatatttatgtccccagtgtctccctgtcctcaccctttcagggtcaaagaagagcaaaacaaagaataatggtgaaagccaggtttctggtcattggaaaggacagttgtaaactaaaacatttcaaaaatggagagaactgtcttatgggtcaggaagcttccagtgctgtaaatccaggcagagggttgatgcccatttgtggcgatatggattcctttatgagtgagaagatatgagtttttgctgggctgaatcaaaattagaaacataagtacaaatatgaagtttgatacacatgatttatccttctattttagccttcctttttgtgatatttaaaggttttttctttttatgagctgttggaaatatataatacatttcaga

SEQ ID NO: 472386 - DNA, 1516 bp, Homo sapiens
catcacaccctgaagcgtgttgcgggggtgggagcctgggggagggttctacccatcacctacagataatggtgagtaaatacaagaacaatgttctgctgaaaggattagaagccatcaatgactatcacttcagcataattaattccttactgatcaatgatttaaaacttaattcaacaaggagagacgaatatgacaaaattcagattgccgacttgatggaagaaaagttcccaggtgatgctgcaaaaggaaaaacctcatcaaagaagaggaagcagagaaaagtaggtccaactacacctttagcaaccacagacaagaagttcacagctgaagaaggagaggagactcctatagctcagaaaagaaaaaacccaaccaaagaaaaggctggaaccaaaaggagtaagatatccgaggagcagactcagcctccctgtcctgcaggagccggcatgtccacagccatgggcattccccacctccccagacctcatcatcagctccacccaacacttcctcaactgagacagtccagcaggtgggaggaaaatccaaacaatgtccctgcactcacttctacgtagaagagtttttaatgatattaaggaaatagtattcttataagcttcaaaggaacattcaaaaggattataatacttgtgctaagtaataaagtatttaaagaaattaggatgacagggaagtaatttcatatagtgttcaagagaaagggttttgaataagacaaatctgatttgaatcctgaattcaacactcattagttgattgatattggagaaatagtttcactgatcccctaaaataatggaagtctccacttcatcagcatggttaaaatattaagtgagacaatgcatatttatgcatataagtttacatatatgtaaaatttatataacatatctcactgcctagtacatcatgagaaattaatctatggtaagcactacttttcctatcacggcaaagatattggaaggggatctaagcaatgaaaatgacacatgcaaatgctctaaagtgtgaaactgcactgtgagttctgtacaactaaaattctataaagagtttctatgaagaaactatggaaagatgcagcacagaataaaaattgggggcgggggcaggtggtagagtatagctgtttgtcagaaataaagaaacagaaaattcattgtgaaaaacagataaaacctaaagattttatgcagaagaatgtctgatcacattgacactttagcaaaaaaaaaaaaggtattatggtaacaattctagaagtatgcattagagaggcattaggttagagcagagatatcaattagaagcaatgatgtgcccaagtcagctctcaccagaacacttattgctaagtatttggggagtttatgaactgtttgtaaaatctttggaagtttgaaattagccatagtggaaatatttatgccagcaaaatatgcaaaggctacaaatagatattttctaaaat

SEQ ID NO: 472387 - DNA, 515 bp, Homo sapiens
ggaggtgcttaaccatgagaattccgagaagggctacgagcagagaagtcctacaacaatcctcagattctagtccccgtggaaagggtcgtgttaggacttctctgcgtggggcaatgccgggctttaaagcctgggatgagggcgagtgtgtctattttgagaaggcaggatttggtaatacatgggttgtcaagggaagcttcagtggagtgacagaagtggacattagtgagttcccaagtgaggtcagccatgaaccattcacattagaaaaacagcctctaatcttcacaaaatccatgaaaagtagatattattcccacattagaaatgggaaaactaaggctcagagaattctcagagggaatgctttcaacttttccccattcagtattgtgttggctgtgggtttgtcatagatggcttttgttatattgaggtatgtccattgtaagccagttttgctaagttttaattataaagggatgctggattttgttgaatgctttttc

SEQ ID NO: 472388 - DNA, 536 bp, Homo sapiens
acactgacagttaatagtagaagacacaagtgttggctgggatgtgcaacaatatgattttaaagtgtcttccaatcctcaaggtgacatctgttgaggtttgccaccagtttccagtcccagggcttccttgtggaccgctgtgcctgtgtgcccatacctgtcaggctgatgactgctgctgctattccttgtggctaagccaagaatggatgcagatacatttggtgttctcaccatgttcacaaaaggccatagctttttttcatgtggactgtgaaggcctaggaacgactgtgtgtgctgctttgagaaagttaaccaggttctgggcccagctccaaggagacacttctgactcattggaaaggcagaagagtgcaggagatgggaaagaccttcctaagcaagacacaacacctagagtcgataaaggaaaggaccgataagatttactgcataatttttaaaactgatataattgcagacccatagacaaaatgtaaaaaactctaagtacttattgtaaaatgtaa

SEQ ID NO: 472389 - DNA, 1469 bp, Homo sapiens
gccggctgctaggtgacatctgctgtgttcctgctaacaactatgctgattggaatggacattctcagcaagttacatgctttttcactgttcgatgacagggctaaggcccacagctacaatttagtcaggacattgccctttggctgccgctcagtgcccacaaattcaggatgttggcacagaaacaggtggtgtccatctgggctggtgaaagcacatgatcttctcttaacatgtgatgaagcaggcacccagagcagctcccaaacagcaggctctgtggccgccttcactgctgattccattaccactccaccacaagaggagcaagtaatcaaaggttcaaagaattcttctgtagcctgcagcacctactatgtggcagggtgtgtgcttggtgctgaagatactaagaagaatcataaaaatgctaagaagaagtccaaaagtcaaacatgagaatcactacttattaaactaattgatttgcagacactggggagacatcaatgatctctttgggggaagtacgtgaagagatatgctaagcaaagagaatcatggaaccgctaagagacaggcaactgggagataacttgatttagagtatcttaagcaaacaaataatccaacaacactattttcgttactggtgattcattgaggagggagaaaaggtttaggtttttaagtcagtcagtccaggctctgaattctgccccagttgctagctagctattgattgtgggcaagaaacataaactttatgagcaaatttttcctcatttgtaaacatgaaaataatacacatatcaaagaagtaaatgacagatgtgataagtacttctgaatgtaggaaaaagcaatcctttagtatttcctttatgtatttacatgctctaatatttggtgtatatgtctgtacatgtatgtacaattgttatatccccttgattaattgacatttcaatcattatataatgacctttgtaatctctttttacagtttttaacttaaatactattttgtctgatatgagtgtagctacgccttctacctttttgttttcctttacatagaatatctttttctatccctttactttcagtctgtgtgtatccttaaaggtgagacaagtctctcgtagacagcatatatttgggttttaaaaagttacattctatcattttatgtctttttattgaattatttaatttatttacactcaaggtaactgttcgtagtttgattattatgtgtcttggtgaacctttttatgggtttaatttgttagtttatttgggtgacgccatgaatttctgattatttttaattcttgtgcccttatgttggtgtctgcacatttgaagagacaaccacctcttccagattttacaagaattctttgacagggatagacttttccttatttagtctaacctgtgattttgaatggaccagctgg

SEQ ID NO: 472390 - DNA, 734 bp, Homo sapiens
ctgagctgttgctgacctgcatctctctgggaacaaagaccttgcctgtaacaacacagtataagaagccaaacagtgagtgtctctccactgtgataactgctgctatccccctcagtactcctgaaaacccatggagagtgtgatggagaggcatcttccgggtatcctgctcctcaccactctctcgagaggtgtgacaaggaaggagcaggcagcaatctttgctgttctgcagcgtctactggtgataccccggcaaagaggtctggagtggacctccagcaaactgcagcagacagacctacagaagaggggcctgatggttagaagaaaaactaacaaacaaagccacagcatcaacatcaacattaacatcaaggacccccacacaaaaaccccatccaaaaatcatcatcctcaaagatcaaaggtagataaatccatgaagatgaggaaaaaccaaggcaaaaacactgaaaattccaaaaaccagaatgcctctactcctccaaatgatcgcaaatcctctccaggaagggcacaaaactggatggagaatgagattgacgaattgacagaagtaggcttcggaaggcgggtaataacaaactcctctgagctgaaggagcatgttctaacctaatgcaagaaagccaagaaccttgataaaagattacaggaactgttaactagaataaccagtttagagaggaaaataaatgacctgatgg

SEQ ID NO: 472391 - DNA, 722 bp, Homo sapiens
tgtccttagccagcttggcacatggaggtcctttccaattaatattctcatgcatcaatattcacgtgctgctcttgctcaagaactcccagtacctgcccattacctgaagaatgaagtacaatattttattcagttcaccttcaagttctggatcttactgtgtctagtggagaagaaagttggggaaacaagaagagggcataagaaaaagatccagggcaataggacattcatgttgagttccccagacacaggctctaagacagagattcctatttcagagtttattgggaagtgcccttggcatcaaaacctaagtcctgataccacttacctagacaataaattcctgaaactaaactgtgagcggccccaatatctgataaacaatttgggattttgccaactgttccgctgttacagagaagagcaggcatcttttgctttgatttatgtactaccaagtgatttctcatcccgtgagtacactggaacttttaggcttgaagggtcttagagaactccccagggtccttgcctgaaggcaagataacatttttggtagatgaggaacatactctcaccaacttctttcaatagctacttcaaatatctatcaatctgtaccatctgcgtttctaaccaagaattctcttgttgcattttaaatacatttcctcctagcctttcctgtgaaatgacactaacaaactcttgcc

SEQ ID NO: 472392 - DNA, 1164 bp, Homo sapiens
tacggggacctgggtgtgcagggggctttggagtcagttctctgactggggttgcttctggaaactccctccagctccacagtagcccggggctgaggggggcaacctcagcgatgtcgaccgggcacggagaaggtcctggggctggcctgtggccaggaagcctggctgctgggtcctctaggagctgcccagtgcagagtgtggggagggcgcctggagccctctatctgcaggaacacatcccagtaatgcctgctgcctatgaaaagcctgtgaaacccgttgagaaggatagcctgtggccacacgactccctccaggattctgaaggaacagggagaggctcctgtctggaaagccagggggatgccaaacaggcagaggggctgaaggaaggagcagaagagaacgatcacgctatggaaaagcatgaagaggacctggggaaagctggtgacctgttgctggcctcatgcttccacatgaagatgccaggctgcaaaacggagaagaaggaagcccatgcagagatggcttctgagtgagagcttaggagcagctgcccgggtgcctgtaggcggtcagatttctagatgcacttcctgttcttgggttccgcaagacaccctctggctcttttgcatacattttaagcaactacttctgaagttgggaaatcaggagtagccgctgactctaaagagaaactatatcaatttggaatgtatttgcattatcagtgagtttactggaagtattaaagctggaccatcacttggagatgttgtaaggaaatgtgaacatttggcgaacagacctttaaataaagaaggaagccatgggagtggctgagatctccctgagagaaagtggagagatgttcagaggtaacttcgtttagaaacttttatttaaaaatcacatttagaaactagaaggtgtggggggacccagtaaaggagacagaaagggatttaccagagagttgccggagctacgattgtggtgtcaaagaaccaaagggaggagcaaatgcaagatctcaaccaataaggaagtgtaagcgacgaagggcaggccttggggtgggtcgactcagcagctccaccattttactgagagcccaggtgctttctacctctctgctctgctgtgcttggc

SEQ ID NO: 472393 - DNA, 1744 bp, Homo sapiens
ggcaggttcctccttcactcacatgctctccctctcacctgccaccatgctgtgtgcaaggcagcctccagcaggtggggctgtggagtcgcagaaggctggcagccttgagcggaacgcggcgctgctgccaccctctgatttggatggaataatccctgcgggtgaaatggggctgatgcttcctggaatccaccagaagtatgcaaattgcaccatctctttcagctgcctgcgcctgcattccatcgaggattccgtggtacaggtgcccaacgaccctttgttgacttggccatgggtacctgggcaaaccctcagctcctgcccttccactgacttccgtgcatctccatgcagagccacagggcctgcaggaatcctctcccataatccttcaagggccccacagacctgggaagggagagctgcccccatcttcttcccagtcatgctgccccaggactaacggaatcttcccatttggggcttgtgcaagagctgaactagccctgcctccccccactggttttacccacatcctcttcatctttctcaagggctggtagtgccccttggagtagggggacccgaccttgaagctttctcactatgtcccccaaggccctgaaggggctgttcattgcctttatcggctctagtcatggcggatgttatttattgtcagataaatgtatttccaaacaaaacagaaaacgaacaaataaacacagtgacagagctgtaaaaaaccctgccggctcgcttacttgtagaaaagcctgcacaactaattaacccgggtagacctctgtggtgtttggaaacaagcttggaattaatatcgccgttctcagctgctggaaccagcctctaaatctttattgggtagtagcaagagagagacacagagagttatagagacagtaagaggcgaagatggaaggagatagagtgacagaggaagataaacgcagctagccatctgcctccatacccatccatatcaccttagctatactctggatcctagacagacagatggagaaacagacagattgtgtctcctaagagcgagagataggagaaaacagagcctttgtcaagttcagagtacattttgcttccctatcattgaagtcagagaatcagaggctcctggactggaaggggcttgtgagaggtcatctaattcagtggtttcagaattatttttagcagcaaaaccttttcctgaaatgaaatcatacacagaagtgccgtgtataaagcagatgaaagtggagctgccccatttggagcttgctgctcctccaagcccctcccctctccaagcacagggcaggccctgtgtcttctgggtcttcagggctcaggagagcacagctggaaaattaaagctgcttggcctctggatggcaagcctttgggagtgttcctggttcttctctggattcaggcttagccgaatttgagagtcccccagaaagggggtgtggtagagtggatatgccagttggtgaaggaggtgggttacccaagggaacacctactctcttgccctgaacctgttgggttcttgaactttgatattcactttccctggggatcttttttggcaggagctgaggtactggcttgttgaccttgaggtaaggatggcctctcagctggtgggcttcaagagtcaaccacctgatccagacttcgcctggaggaggcttgtcatagctccacatcaagt

SEQ ID NO: 472394 - DNA, 945 bp, Homo sapiens
ctgatagtttccagcgggccctgatggtgggttggtgtgtggaactgctgcaagctttcttcctcgtggtagatgacatcacggattcatccctcacccactggggacagatctgctggtatcagaagctgggcgtgggtttggatgctgtcaatgatgctatgcttctggaagcatgtatctactgcctgctgaagctctgttgttgggagcagccctattacctgaacctgattgagctcttcctgcagagttcctatcagactgagattgggcagaccctggaccccatcacagcacccccagggcaatgtggatcttcgcagattcaaggaaaagaattacaaattgtcaagtacaagacagttttctactctttctaccttcctatagctgcagccatgcatatggcaggcattgatggtgagaaggcacacaccaatgccaagaagatcctgctggagatgggagagttctttaagattcaggatgatcactttgacctctttggggactccactgtgactgacaaagggcagaaggaggccaagaaggtggtccaggagaaggcactatatgaggagctagatctgctggccgtgttcttgcagtatgaggatgacagttacagccacagccacattatgggtctcattgaacagtatgcaatgcccctgctcccagccatctttctggggctggcgtgcaaaatctacaagcggaaaaatatgtattaagagatggggaaaaaatgtatcattcgcctgccttggaattccttccagctgatgacattctagaaacttttaatgaattaaagccacatttgcctgaagacgtcagcaaagttactgactgttttgaaaataaatatgtacatggtaggataagaaaatacacaatggtgttgctgtttgatcaccagtactgtttctgtcaaatctg

SEQ ID NO: 472395 - DNA, 1899 bp, Homo sapiens
agagcatgccatctatgagaaacgggctctcatcagacactgaatctgctggcacgttgaccttggactttccagcctccagaactgttcccatagaagaaatggtttccagaatgcagaagtggtccatgatgccagatgttgcaggaagagcaaataaggagaaaaagaatcctgcccaggaggcctcccaccccgacataggagggcaccacccacatggcatcagcctgcagctgatttcatattccatgctcatgacatagtaccttataggacatgtcacaactcacgccttccccttatccgccatcggggatagaacagaaagacataagcaccggcatgggcctattccacagccaaggcaggcaatgagctctcaggtacttgcaacaaactcgagtgtgcattcggtccaggaggaagagcccgcacccttttttgttgctgttcagtgttaatccttcggtggaacccaccaggacagcagtctcagtgctgttgtttttgacagggagaacatcccagggcagaaaggaaagcctaaagctacagcctgttcctctagttcttagaacagctggttactgagctctcaggccagacactggatcccggagagcttgtccactgcaacagtgcaacacgctaagggctgtgtggcggcacaggggctctgagctcctgacctgagtcatggggacctgaaggctgacacccagccctatacctacaagctgggtgagacccctggcagttgcctacacccctgctgagacccagtacctccctgtaaaatgggggaaataatgcctgcctcacagggtttcgatgaagggaaacatttggaaaccccttggaggagatctgccacatggcctccagtgaactgtagactcctgcatagccttccaaagttcttcatttggtgaatattatgagaaatgacaccgaggtgactggcacatggtcgaggcagctgcttaggcagcttaagcatgccctgtgaaacatccctgtgggggactccgaccagcccaggcaacgcggatcctgagaacgctcccgggtaggcatctgcccctgtgggatgcctcaccagagcagtgtgtggcaggcccccgtggaggaccaacacagtggctgaacaccgggaaggaacaggatcttggagtctggacatctaaaacttgcacatgtaccacccctagaatttctggtaaaccagcaccagcctgaagatcacgttctcatcaaacggtggaaagaagaaaaactcgagccaacctaggaaggaccccaccttgtgctgctaaccaccaagactgctgtggtcctccgtcgaccaggtgtgggctgcatggtagctcttttccaggattctacagcatggaataataagtcatgccaagctctctctgctatatcccaaagtcaggcaccctgcaggtcagcccccaagggccatccagcttccgtcccccaacactaagttcacttcgtgtttctcacgacagggaggaaacagcattccttggagacctaaagggatgcagtgagcttaagaattttcaagagcttatcaatcagtcagcccttgttcatccccgagtggatgtgtggtggtattgtggtggacctttactgggcactctgccgaataactggaggggcacttgtactttagtccagttgactatccctttcaccctggcatttcatcaaccagaaggaaaaaaaataagacatcataaagtgagagaagcctcctatgggtctttcgactctcatatctatttagacacaattggagtctcacgaggaacagcagatcaatttaaagcttgaaatcaaatagctgcaggatttgagtcaatattttagtaggtgacagtt

SEQ ID NO: 472396 - DNA, 723 bp, Homo sapiens
tgaagagttccttcacatcccttgtacatgaaaatggcaaatgagtccgcagccactcacccctcttcacttgctcaccaggcaaatggcttaatactccctggtctggagagctgtgctccttatgagaatctaatgcctgatgatctaaggtggaacagttttatcctgaaccatcctccagctggcccccgctgtctgtggaaacattgccttcctcaaaaccagtcacttggtgccaaaaaggatggcgactgctgggatagcccatttgtcagcttggaagcttgttctctgggcaattttgtaggaacagggtgggacttggtctcttttgttcactgctatgttcacagcactaataaaggtacctggcatataggaagtcttactcaaaaagcctttgttgatgagcgaatgaatgaatcctttgtgtattactgggtgtatgctcatcatttcatcaactcttcctgagaaagtgatgttggaagggcatagagagaccatctctaccttggacagggaaggatggaatgagtcttgtctgggctctgaccaatgtgcagttaaaatgatttaaataggacaggacaaagcctgctggcacatgggaagagctcttggtccacagtgcctgtgaaggaggccaggttcagaacgtgatgacaacttttgtatttaattaacatggctacagagggatcagcagcataatttaat

SEQ ID NO: 472397 - DNA, 725 bp, Homo sapiens
ctttatgaacacgaaggcaaaacagtggagtccttcattggcttctggatttccgttatattctaatgaaactaatgttcctgaagtcattcagtagtaacagtcatgatagtattcatgtcttctgggaggcctcagggagcttttacttacagggcaagatgaagcggagggagcttttacttacggggcaagatgaagtaggagcaggcacttcacgtggcaagaacaaacgtttattgaagatgaccttagaagagagacgcaaagaatacctaagagactatattcccctgaacagcattctatcatggaaggaggagatgaagggcaagggccaaaatgatggccccactgctgcaggtcagctggagtttcttggaggtccactgcacacccggtttgcctgggtatcaccagcagaggctgcagaacagcaaagattgctgcctgttccttcctctggaagctttgtcccagaagggcacctgccagatgccagccggagctctcctgtatgaggtgtctgtcgaccccggctgggaggtgtcacctagtcaagaggtaaaagggtcagggacccacttgaggaggcagtctgtcccttagcagagtgtgagggctgtgctgggagatccgctgctctctttagagccagcaggcaggaatgtttacttctgctgaagctgcgctcacagccgccccttcccccagggatctcacac

SEQ ID NO: 472398 - DNA, 570 bp, Homo sapiens
ccagcatctaagatggcctccagtgatccttgcctcctggtgaccacatccctgtataatgccctcccatgctgcccatgcattctgcataagcaacagaatactgtagaagtgacaaagaaccatctgagaagcacctcaatattaaaaatggaaaaggaagcaacattttccagcacttatgagttacaagaaaagagaatcaactcagtggaaaatatacataaagaccttggacgttccaaacccatcatttctaatcaagagttctgtttttggtgccatcagaaatttggggctttaaaatataggagagtgaacctatatgcactcaccttcccccatgacctcactgaaataaaagtaaataagcacaggggaaaaaaaaaaccaaaacaaacaaacaaacaaaacatgtagtagggagaggtagaaagcaataaactggaaatttcaacaaatcctaaaataaagtgaaaggggagggttaatggttaaaatgggtagaaaatgccacgggctagaatacacaagataaaatgacaattggaaacttgagagaaacaaaat

SEQ ID NO: 472399 - DNA, 672 bp, Homo sapiens
cagtaagctgtcttccgaaaacttggaaatgagggaaattcgaactcccagcccgctgtgggccagatcatgtattctttggacacagtgagggtgagacaccttcaacaggatggtgaagagctgctgggtgtcagctgggctgccacgattgcctggatactcccaatcaatgtccagcccatcgaagttgtacttcctcagaaactgtatggctgactgcatgaagattggctggagcttccgggatacacaaggccagaaagctggaagtctgagtctaggagagagcaaggaacaccggcagtggaagcatctaccatttactgagtgcctgctaaatgccagagagatgaagcaacttgaccgagatcatccaactcgtaaggtggcagagccaggactcacacctaagtcctttataccatggtcctgctctaccaatgaagcacggcatgagagtgactgtggacagcattcaaaggctaaacattctgctgttggtatcttttggggaaccctctcatgggatacttacccagctgcagcaggagggccagacctaaagacaaaaagatcttggtcagagggtgccagggtcatcctgtctctggctgggaaggggcaagcctatggcagccatggccagtaaatggggaaagggagatgggg

SEQ ID NO: 472400 - DNA, 1349 bp, Homo sapiens
agctggtctggaacatcctctccgacagacagcagctcccttgtcctgggtgagggtggttcagtcaatcacatggtggtgggggagagtctaaggccatggagcagctttttggccaccctccaaccacggaatggaagttcgtgtgcaggtgggccccctccaggcgagtgcagaggcagtgtgaagacgttggcagtgaccagcgctgccccagacagccttgtgctcgtctgtctgctcaccgcagctgctcctacctgtgtcctgtgcacacgcatgctgctcccggttcagttgctggcccaggcccgccagcgccagtacctcgagttctcgctgccccgcagaactcacctgtgggaccagggactaactccaccagtagcggtgcctggcagctattggtgtcccctggccctgtcggccaagcagccgatgctggtggagacagtggcactgctgagaaccacaagctgctggcagttgcacgtccgaccgcacagatccccgtggcgctggaacttcctgagtgggaggagaggcgccttcccgctgggccagcccgcgctggccatcaagatggtcattgccttaacagggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgaggtgacgttctgcttctagaacacctcccttgtttgttagctgggatgcttccaaaaccagaaacttcctggcatcaactttttgcttaccttgaggtgcagtttgtataggaaaggctggataatacttgattcttccctttatttgccaatttctgaagtaattacatgattccctggcatccttcaaggatggggactaatgactttttttttcttcgggtatcattgtaaacgaatagattgaagctacattgaatagaaacacacctgacatgttgatatttttattgatggtcagtttccccatcttggtcagtgactcagctcataagggacccagctggggtctgaaacactgcc

SEQ ID NO: 472401 - DNA, 995 bp, Homo sapiens
ggccctgtctcagttcatcatgctcactgggggaaaccacaatgctggggaaacccagcccttgccttgccccttgtccatacctgtgcagccggagagacacctgcgggtgtgctgatgtcacggttcaagtttttaacctcatgtgggcccatgatactgcccggtcaggtgctggtggtccccgtccacgcttcccattctccaagtatttccctggccatgtcctgggacctgtacacaggtgcccacttcttacaccccaccactgggagtcttcgacagctctcacacagaagaggaatactgtggtcctggaagttgctagacaaacctgttcaggactgaatgaccaagtgccccagaaacatgggttggtgtgggtggtgcccaagcctgacccctgcctgttttctcatacacggttcacgttgcccccagcagaagtggagagtaaggggctcactggctatttctccaaaatgcgttggttggtgtggaattgggtacaacctggtactttctactttggctggctggctgttgagaaatgttggattagttataatagcaacaaaaacatagctgaattcaaaggatgcccgaagggtctgcagaccatatttggagaactgctactctacagacagccttgtatctgtgtacagagacatgagcaagaatgttctgtgttaacaacgtttacactaatagaaattcggaaacaatttaaagttcatcagtagtagaaggggcaaataaattgcagtattcttatataatgaaatagtatatagcagttgaaatgaataagctaaggctgtgtgtatatatgtataaagatcaaaattcagtggggaaaaaaacaagttgcaaaaagaaatgtacagcacggtaccatttatataagcttaaaacgtaaaaaatatttgttgtttatggacgcctacgtatatagtaaataaaaactaaatggaagatagcagctgcctctg

SEQ ID NO: 472402 - DNA, 2250 bp, Homo sapiens
gccgcctaactgcaacttttttttttttttttttgagacggagtctcgctctgccgccccagcgggagtgcagcggcggtgctttttttgtgtagatggttgtttaatttggcgttcctgcagggtgatgtatgggctcctccatcccagacctgagaaacagccctgagggccaaccccagcagacacacatccaggcctgccaaaaaggcatgtggccatgtcccaggcctgcaaaattgccctgtgggccaccctcagtagatatttccctaggccaccaagcagctatgtgcccatggtttgttatgtaggtatacgtgtgccatggtggtttgctgcacctattgacccatcctctaagttccctcccctcaccctccccagccccccaacaggccctgtggagggggtgtgcttcgctggggggaaacccgctcatctgggctgcctggattcctcagaactaccagcaggaaaggctaagtctgctggtctgcagagactgtggccacctctccccctaggggctcaggccctaggagatcagggttttgttcctgagcctctggctggagttggtggagttcctgcaggaaggccctgtccagtgaggaaggatgggtcagggtcaggctaggctagtacttctaaattcaggcaatatttctgtaaaagacagtcatatactgataatttgtcaatgttagcaacaggaatgtcaaatatctcatacatttgccatcacacaaggaatggcctcaacatcaagaatcagcaaggacagaacagatatattcacagaagcaggagatatttttgtctagtagccagtactacatcaatttacaacaaggaccttctatattactgcattcaggattacatcacagacctgacaaaatttctaatcattcttctattaagcaagactatactcataaagcgggcagcagtaaacaccatgggccaatttctgctacacttagaataattccttagaaaatatcttcagataaatatagaaaaaaaatgtaagctagaaactcttgatcttaatgtgcaggactgaaattatggattttagtaccacatactgataaaagcaccaataaagaagagctgtccttgtggaaaattagttgacgtgtaaggttggaatttatatctgcactgtttattctgcttcattgggctatgtgtctgtttttgtgccagaaccatactgttttgattactattgctttataatataatttgaaatcaagaagtatgatttctccaacaatgtttttctttctcttgattgttttgactactctaggtatcttatgattccacaaaaattttagacttttttttctatttttgtaaaaaaaaatgcatttggaattttgataaagattgtgttgaatctgtagatcttttggggtagtatagacattttgacaattttaattcttctaatccataaacactggatctttatggatttttttcaatgtgcaggtgtttcacttccttggttaaatttattcctaggtattttattctttttgaagctttcatgaataggtttgtttctttatttctttttcagatagtttgttattgatgcaagaaatgcaagtgatattttaacattaattttgtattctgaaactttacttaattcatttataagttttgtctacctaaaagagcaacagagagagtggttcttcaaagacatacatttattcaggaacaagcagggaattataatctgggatatgagtgctagaacagatcataggcatattcaaagatgttaggacaaggagaagctattaaggcaaaagggggaagttcatgcaagctgtcttaaagttgatcagtcacagaagcccattgcagggactggtgattactcattggtaacactaattgccgttgggaagatgtcttcatagaagcaatttatctggaattttttgtgctttcagagagttcttataatagttcttaccatgggcatatgtgcctcaggccttcagagagtcttggtaatagttcttatctcagacatacaagcatgaggacccctccttcatgacctgccagctgtgcagccttgggtctaatataagtgactcaattttgccataggcagcttttatattttccccttttgatcaagacctttctctgaaagcattgctgctaaatcaatctgcagttaggttttaattgtccttcagtgctggaatc

SEQ ID NO: 472403 - DNA, 1125 bp, Homo sapiens
gtgacgaagggtgaccggggtttgcttgggtttgggcttctctgagttcccctgctgaactagtgatgacatgtccatctccttgacctctgacgctccacgcctgctcctctggttacgaacccaaatcccaaaggccctagggtctcataacaacacatgcccaaacgtcttgggaactgatgtaaacagtggggccgcagggcagcgaggagaatgtgacacgtctccatcttctggtggccacagccctgtcatgtgtctgggcagctcagccaagaagcatgaagccataatactggtcagtctataccgcagtcaagcaccaaacccagagtcccagatgggccacagggagccagaggagatcatgaaaggccagaaaaacaaagctcaagcttcctggaggctgtgtggccaggacagagagatcagagcagaatatctgccccctgagattaaaggagatgaccaatttaagggatttctccaaaggtctgtggtgaatggtgatggtgacagtgatgattatggtgatgacagtgatggttatggtagtgatgacagtgatgatggtgatggtgatggtggtgtggtgaatggtgatggtgatagtgatggtgatgatgatggtgatggtgatgatggtggtgtggtgaatggtgatggtgatggtgatgatggtagtggtgatgatgatggtgatggtgatgatggtgtggtgaatggtgatggtgatggtgatgatggtagtggtgatgatgatggtgatggtgatgatggtggtgtggtgaatgatgatggtgatgatgatggtgatgatggtagtggtgatgatgatggtgatggtgatgatagtggtggtaagtggtgaatggtgatggtgatggtgatgacggtggtggctcagcagatacaatcttgaatccttattcatcaaagagaaggtcaggagaaatgagcctccctctcccccaacccctgagttagctccatttacagaaacctcatccccctcctgcccccatccacaggcatctgcctctggccaccagtgacaccaggcaccaccagaaacactcagcatcatctctcctccctgaatcctaactgctaaaccagtga

SEQ ID NO: 472404 - DNA, 1653 bp, Homo sapiens
aatttacaacacatccttttatcacagtctggctttctctttgtctctctctctctctctctctttctctctctctctctcctctctcctctctctcctatctctcctctctctcctctctctcctatctctcctctctcctctctttctccctttcctctctctctctcctctctcctctcttctctctcacctctctctcttctctctctcctctctctctcttctctctctctcttcctctaatctatgaacttttgttttttttggtgggagggggagtgtgggggtgctgtggctatccccacaaatgttcccttggctcattttctacctaatgtagagcagccttcttttgacatacacatctgggaaggctactcactttcacgacgagatgccactgctgcctccagcatggtttactgtctaactggtccagaagacatttctcagagaagagacttctctcctgagcctttcagcttcctgctctgtggaccagttactctccaggccaatggagaatcccctttgccaccagcctgggcattcccttcacctctctcctgtgttggagctgttccttcctggcgttcgtgcgctctctctctcctggtgtggtggagcatattgtcgagtagcttcttaagacacgatacttggaagtaagtttgttgaaatttttgtacgtttgaaatatatttatcctggctggtccaaatgcagtggttacaactaactgatcacaaccagttacagatttctttgtttcttctccactcctactgcttcactggactagcctgggggaaaaaaaaaaaaacaacttttcaaagtttcttaataaaaaagaagaaaagaaaaaaataataaaatatatgtatcttatcactacgcatcttgatagtttagctaattgtctattcctagactggaaatactatttctttataatcctgaatgtagttctccactgtcttctgtcttccaaggtagttgctagttactaaacttttgtatgtgacctttttttactctctggaagttctttatattacttctttgttcctggtgtactgaatttcctaaggatgtatcttggtacagtttattttaggggaatgttttttgggcttttactctaaatgcttatgtagtttggttttccaaaatgttataaaattattcatttgataattctgttttattcatttttctctgttatagctttctacaacgtctattagtttgatgttagaattctccattttccttatgttttttctcttcttattcatatctttgtgttttactttcagtgagacttcatcaacttcatgttccagttcttcttttaaatttttaatttttgctatattgtgaatgtataagagttttttcttattctcttcaaattccttttttatagcatccttgactctctggggatattaattattgctttaaggtaagtttttttctgttctttgtttgcttttttttttttcttttttttggagagcttttcttttctctctgctttttctgtgatagacctttctaaaaaatccagactctgctttgcattcatttctaagagtaatacactgaaactctctgtgattgagtgagacttaatactgctgaaat

SEQ ID NO: 472405 - DNA, 715 bp, Homo sapiens
ccaggtgccagtgggcagaaaggagctaagtggaagagagaatgcaatgggcctctttgaccccaagcatgtttctaccccttgactctgaggccaggaatacaatggtggccctcatagctgtggctcttgctctcttggctcttacaactgggccgtgtgaatccataagttgctatgggagcacagaggaaacttctagctcaactgccttgagggctagtaaagtctttctagaggaaagacagaacagtgctactcggagaaataaacaaacaattctctgctttgtggctggcaaggagggcctgaccttcactactcaatggcaaagaaaatgtgatctctcctccctcctaaaggcctccaggttccttttcctagcagactggaaggaggagccaaaggaagcccagaactggctctgggcagggaacctccgccccttcacctacttagctgaaaatctgttagaggcattagaggggcccagggacatccaactgagcgtgggtgtgtgccacagcaaagatttactgaatcggaatctggcttttaataagatctaccggtgattcatatgcatattaaaatttgagaagcacaagcatagagtagtttcaaaaacgtttcttatttatttaaacaacttgacataagtattattagataatctgattgcacattctctggttataacaaacaggaggacaga

SEQ ID NO: 472406 - DNA, 1149 bp, Homo sapiens
ttggtgtcatcatctgtgggatggggcagaggggcaggttgtacagtgatgcagttgcagcagaggtctcagttgatctcacaaggagctttggagctaggatggcccttaaggctgggaagccaaggcctttatgtcctctcattgatcagttactggatgtgggctgcccttgggtgctctctcctctgcagcacaatccagctctttccttgcagagaagagctggcgatgctcatctgtgaggaggtagaagctgacccacaggacgtttccttgggaatgtttgtggagctgtgtaaccttgtggatgccgtgaatgtctctgtgcttcagcctcctcgcctgcaagaagtatggcagattcacatcttgaattatatggtgcccaaccgtattagtgattctgattccctggtgaatatggcaaccagtgaattgggaagtggggacaagtcactgttcctgtcttggccttggaattttgatctggaaaatggggatggggaattgtggatgactaaagatttctgagctgccttccagctctgctgttctgtgatggcccataatatactccaaggaaataccccaaaagagacaaaaggaagtaatttgtatttacttgttcttagaaatgctatttttaaaaattggaagcaacccaaatgcccaaccattggggtttggtttgaaactcacagtctatttgcattctagaatatgatagagctattaagaatgacaaatatgggaacaatgtcaaggcatggacaaatgtgtacatacaaaacaagaagtggcaaaggggctaagtagtatgtattttctgatgacaactatgcaaaacatggacctgtatttgttcaatgaattgatgaagatgagatgcaagttgccgtaggtttgaatatttatcaaatggtttttgcttataataaaaataaaatggattcttttatactcatagatgaacagaactagctacacaatctgcaggcctcaatgcaaaagaaccatgtagggctcctttttcaaaaactaataatttcaaggtggcaattgcagagctgtaagccaagagtgggcccttctgaccatgaggccctgtgcaactgctctgtacatccaagccctagctagagctgt

SEQ ID NO: 472407 - DNA, 1512 bp, Homo sapiens
cctccacctgtgtggagggcatagcagggacatagcgagagtgggatgccataaatgactgaagtcaaggttgtaatggtccagcaacatttgcagaatcctgaaatggtgcacagaatcctgaaatggacaatcacctggaagcactgctgtagagggacttccgcattgagaggggactggagccaactactcccaacacctcctttccagaattccaagtctcaggttctgttcctcctagagaaaccaggagcaaagttccatgggccatgtcctcaaccggaggacaggagcttgggtcagaagggcaagcctagtccgaagcctgagaggccccaggatctgataggggagttcgtttttcatggcttagtgtccaattggtcagttttatttcagattttcatgcaaaatttccttggaataaagaataataatgatgatggtggtgatgatgatgatgatgataagaactccccctgccttggattgtaaatgccctgggtctcaaacctcagctcctttttcatccttggtcatccagcctcaggcttagccagcctggaaccctgactttgaaaaaaaaatcttcctctccttgaatgcctttatcacctgcacctttttccttagcctggagtacttttccttcagctcaaatgccacatcctggggaagctctcaccgacccttaggcagggttagccccccacccactatactcactgctgccctgcccatggtacacaccttttaacacagtttagattcacattttggcactgccatctcaggagctccctgaccttgagcaaacctccctccctggtgactcagtttccccatctgtaaaattgagatcatcataatacccgctcctattgttggggagtttaaatgaagtcacataagtaaagcactaggctctgtacctggcacattttacatgctcaaaaaatgttagctgctatgaatattgttattcagtgaattttggtaaccaattttgggctctgtttcctgcaccttttccctgtcatggctttagcacacacagctcaaatgcatttgcattttcttctcaattgactcttctgacaaggatggcaggttcctgtgacaataagagtagagaagcaacgtcaggaagaggaaaagaaaggagaaaagtggggttttttctaaccatagaaagccttctcaccctgccttatggcactgtgttattaagctgcgatccccaccagtgcctgccgtctttggtcagggagcacagacctctctgagagcatcctagccatcttcctgcacacagcaggatgcagttaggtccccctaccctgcggtccctggagcttgtctgatctcctcatggtgagtgtgccgttcattgccttcttgttgggctgccttctggaccataagcacctcaaaggcatctgcatttgttccccctataacccaagcacccagcagtttctttgcccaaaaactggttgttgattaatc

SEQ ID NO: 472408 - DNA, 783 bp, Homo sapiens
aacttatcaatagatggagggcagagcctggggcccccagatgttgtgcgtggtgccagcagtggcaggtcctgaagggcaggtcctctggtccccagacagcatgtgtgatgttggtggtggcagtagcagcggcaggccaaccctcagaacaccaagcagtgcacacaggcaccagcagtggtggtggcagtctgggtgtgctggaccacagtctcctgggtggtacatgtgggcaggggctggtagcagcaatgtcagtgtagacaggcaagtacccctgcttttaggaggtgcatatgggcacaagcagcatgtggggtggtcctgtccttatactgctagacagcattcacatatactagtggcagcacacagggtgggtctatacccaaaccactgcacagtggatgcaggcccacgcactgactttttcatgagcactcagtagagtccacagataggagttggtgaatgaatattaactcccttttggtgccctcactattctagactggcacactaacccacacttagcctttggaagctcctttaaaatgtgattggtttcttcttccccacttgtattgtggcctacagctttttctcatgtggtttgctacaggttgagtttcctaattaattaatattctagatcatttaaaattttggacaagttcttgttagatctgtttagacaaacattgctttttattgaaatatggctgaaatgttcattattaagagtggagagaatgtcagctgacactttcttgtttgctc

SEQ ID NO: 472409 - DNA, 734 bp, Homo sapiens
ggacgtaaccggcgataatgatgacacctcgctgtctgcggcagtctcgggagagcgtccctccaccgaaggccccagtggggcgcagcagtgttagtctgagctacctgagaaaaacaccaacagataacgccggccctttgtggacagcagtggacaggaataataaattgccagcagataaccgatatttgagtgggaactcacagggggatccaaaccagctgcctatctttctgaatcatgtcagaatgaatgatgcagccaaaataaacaaaaatgtgcctctgatatatgtggattcttgcatgaaattaaagggaccggggcacagagtgtgtctagaaaacaaaaagttctcaaaactcaacaataagataacacacaattcaattaaaaatgaggcacaagatttaaacaaccacttcactaaagaaaagatataaatggcaaatagcacatgtagagttgctcaatattattagtaatagggaaatgcaaattaaatccatgataagatatcactttactactgttagattaacttaaaaaaaaaaacttatgataccaagggctgtccctttacatatttggattaaaaatatgtgggtggtgaatagagttggggtttggggaacaagtaatagagtacagagtgcgatctctagttttttatcattttccccgtttctcccaagttacattccaagttttaaattttccacaagaaagac

SEQ ID NO: 472410 - DNA, 616 bp, Homo sapiens
aagaacccatcactaaaacccttgacggtattccgttctttctaatgatcatggactcgatttgggccaggcagcccagccctgaggacatgcagccactgacatatgctgtggtgatcaggtttcccccaagcatccatggtagatatgaggtctacattcatgccccactctcagcaaaaggtctccatttgggcgcctctgaggtgcctcagagaaagaaccgcccccagaaaggcaggagacctgcgttccgcctgcctgtggtccctggagccttcctgcctcctctgcaccaggaaactcctcaacagaaacgagcagaaagagatcaatgctatcctgaaaaagagccccaaagctccaccgatatgattccaggttttgacaaatgtcacctactcaaggaggccctcagtgtagaccaggagcggacactcactccccttacacactatacttctccttggaaacactcctctcacgggagatccttctccctctccccgctgaacctcattgcttcaggggcagcatctgttcacagcatcctcatagcaagtagtagttctcattaaatgcttattaaataaatctgtagcattactttgtgtcc

SEQ ID NO: 472411 - DNA, 613 bp, Homo sapiens
gaaaggcaggaattagttgtaaggcgaggctcccaagaagcaccagctccactttggtttacagctagagtatgatgaatggaattttcttcacattgactacgaggctgaagtccaagcacttaaggacgaacacaattccatcccgtaatccattagtcacagcctcatcactgacaagcctccactgtgtagagagccagcggtccttgtcatattgcagggtggggcccgcactgaggtaccgttctaggaaggcctggaagcagaggagaaaggccattagggaagaaacagcctgttttaagggcagtactgccaggcggctatccactctcacatctataaagaactttttccaaataaaccagcttagaccagagcccagctcatcacactcaattcccatcagaccctcacaactgagtcattactggggagggaagacttcttggacttcctcactcccctttacctactatccaccaagcgcaagaatagtggtacccacagaggggagggaaaatggggtggctggtgtcagtgtctggctggaagccgtcatggctgcatcactccattcttagggtatatatttttttcatctgtggag

SEQ ID NO: 472412 - DNA, 2238 bp, Homo sapiens
cctgagagtgtagtgggaaccccttaatttgaaaccagctggtcagaagagagggtggtctggggaccccagagcctgtgactggtggactgaggaagaccacttcctagaccagtattgctgccagcaatctagaccagcacagtggcctaacctaatgtccctcaccaaggtggaaatgtttggctgttcaaggctggcttctgcacagcgaggggcactggcacgcacgcacctgtgggactcgcaactggaaaaatgcatgaacagatgtacaccgcgtcctggttccagccctgaagggctccatccgtcctggtgcctgctctgctaccttgctacgaatttgttccggcttccaatgtggctgcagctcctgagtgacgttatccagatccatggattgccaagcctggatggcagctgcgggaacgcctcctaccagccctcccctggcacacaggccgcttgggagtgcgggctgccactgccgccaactacctggagcgcccggagagactgctggctcttcctgcgtattcctgctccctgcttccagtccccggacccctgggaaaggctctgtaggagagggtcctgctgcatctcaaaggccccccctgcagggagcctaaccagcactcctcccccacccccacacgcacttgatggagagatgacatttgatgatgatgtgtgtgtctgtggtgcaggatctgtgctagaaccagacaaacaatgcatcagcaacagcactgccttcgagagcttatagtctagcatagcttctgatctcagacaagttactggacttctctaagcacagctttcctggactgtggacattttttagggggaggtcctggcccagggaagtgaaacaaaaatagaagagacccgtactttccctgaatcaccccctgcttctagcacaactgccctaaccttaacccaggcacttaagaattactttgtttcctaaagcctctgaagggaaatttacaagcctccgtctttaacccttcaaagccctgcatgtgtacctcatctaggaagcttacttccaggattcccgtccacactggcctcccctttccctttgcccctgcacagttttttcctggggccccacagctgtcactgcacagcttgaggcttgtggaggtggtgccatatggtgtggagggcatagtagtgggcaagggggcacatgtgaatccaggtacctcctcttactacctgtgggattctgaccaacttaacctgtctgggcctcttctaagcacctctatgaaaatgggcttaatatttgcacctacctcagagggtctctgtgcagattaaatgagctgcccactgctcagtcaatgtaaattgagtgtgcataaggcaatgagtgcaccctgagaatgggttcatggaagcagatctcaagaagcgccctgcctgatgctctgcacgtaacagctgagagatttctataactgtgtttcaaaagcctgactccccttccacccctggcccaattttcttctgaatcttttcttttggaagagaacaaggaaggacattttccacctccctatacctttacagggaggtgggtggggctgccctgggcctgtggtcacccaccccctcatcctacccccagcctaacaatttttccctggggacctggggcagggaaaggaggctttggaaacaaaagtcaggtgtgtgttcaggctcagactcttacttatgacccaaggtttgccgctcaacttccctgagactcaatatcctcattggaaaatgggaatgttggattgttgggagtgtgattgaagatgagacatgagaaaagatcccgtgaaatctggagcattttacaggcttagcaaccatgactactaaaaaaccttcccgcttacttaccttcaggtcttctgatcccatttgcactccccaaactgaaatcctctttctctctgagatcttcttccaaccctgcctccttccttcctccagccttaatgaattgcttgttcccataggacttggcacagaacggataatttttcttctccctttaggctgccttaatcctttcttttgcctttttgctgccttttacatcttaacatttatgataatctgcccttagtactaatgacagcagagttcttacaatgttcgctgcagcacgctaagagctttacatacattatctcattacatcttcaaagcaaccca

SEQ ID NO: 472413 - DNA, 840 bp, Homo sapiens
aaaggtgaggaagggcacactagctctcctccgactcaatgtccctcaccccctgcgaccaagccttgcccccaggaagctggtgacagagggagaagaatgcaggggtgtaactagccgctcgcatttctcccatctgatcctcacgtttgctttgtgtgcctggtatggcattaatgtctgagggatgagtcgtcacagggactcactcctctttaaaaatggaacttggagtaattcgaacaagagaggagcaggaaaggaggaccctgtagggaaggtgcatgtcgagattggcgagaaagttctactgaatagtgctcaagagaaaataaattctatgcttaaaagtgtgactcaggaatttgacattggttctcctgtgtgtgctgaagagatgggacaaatgtcagccccaaacgacaaagctcaaggtttgtgtgtcaaatacctagacagccagtccatctggttagtcagtttggtggaggaaaagaaattaaactggttagtaaacatcgtctgtagcagtgatgacattgctagcttcttatataatttccttttcaactattcagtcattttacaaacatttgtggggtacctgttatgtctcggcaccatgtctagacgctggggatacaacagtgacaagacagatgttgctcttagccctgtggagctcacagtcctgtgtggccgagtgttagtctctcagctgaaacactgagcatttccagagcggcttaacatttctctcccaggacgtgtttcaactaactgcctgtggctgtcaataaaaagatacagccaagttctaaagatcccaaattgggtttc

SEQ ID NO: 472414 - DNA, 568 bp, Homo sapiens
aatgtatcattttgcaaggctgcatggtgcactgcagaacttcccaaccagtgccacagatgggtagcatgtggcccagaaataatgatgccctcatcccttggagtagcctgggatggcctagcatggtggcgcctcctccgtgtaccccagtgtgccatgatagtgttattttctgtgtcatgacatgcaaaagattggaacataccacagtacctctagttcatagaagtcgctgggctctattctccttccaggccaaaaggggagtagaagtcggagaactgagccccagtatcccctgtcagcccactgtgtccttgggcttgcacgtgcatgtcccacccagctccagggcgttgtgggatgtgggtgagtatgccttgattcctggctaagcccatttcccacatgttctcacatgaaggtggtagctggcactggttgatggcatgcccctgagggcctggcctgagttgagcataactcttttgttacctcattttatactcatgacaaccctacgaggtgtagcatccttcatccctatcttttcaggtctagaagg

SEQ ID NO: 472415 - DNA, 824 bp, Homo sapiens
atgatctgaaagtttgtgattagcaagcctctgcaacccagaccaagccggagccatctggacacgtttagatgaatggaggtgagggaggagtcctggcagcagcttgggaggccgcccagagggaactcctggaggcagctggagtaaacaagtgccgagtggctggtgaaatggatgaactcatcaatggctggttactcactaattcacactgtatgggaatgctgcactccctggttgcagggtcagcctcttccatggaaggattgggcatctgccaggtgacccgtgggagtaacctgcactttctaaacttttctgtggagctggggagggtaaagggagcagcaggcttggcagtccaccaagcgatagggaatcataggatgtccattaatcctgatgacaggctccaaaattgcaaagggattgccctttgccagatcacaaatatctacgcatcattactggatatcgcctaaatcaaatatctcttaaggggttttaaaatgtcagtttctatttctatcacttctatatttatttgatgaaattttattgagattctttttctttctatatttattaatgagattattttcaaaagaagagctttcttttattaactaggactctttagtgaccctgaattttaggttatgggaatttgtgcatatttctccactatttatactgataaggagtttgactatccccctatatatgaaaaaacgttccctattataaataacatgcttataaacatcatttttcataacttttttctttaatcctatttttcatattgtttccttaggata

SEQ ID NO: 472416 - DNA, 967 bp, Homo sapiens
tggggacaccgctgggggtccttgccagagggagagggtgtgggcaatcagagtgacctatttttcaccatgctctttgccatcctcccttttgtgttctccattgcagctgaggagaagacctccaaagctgccagcttcccccagctgcccttggactgccgagggggccccagagacgggccctctaacttgcaaggctccccaggcccctgcctggccagcctgcatcttcctctttccccgggactccctgactccatggagttggccaagaacaagagcaagaagcgtcgtaaccgcacgaccttcagcacattccagctggaggagctggagaaggtcttccagaaaacccactatcctgatgtgtatgcccgggagcagctggccctgcgcacagacctgactgaggcccgggtacaggtctggttccagaaccgcagagccaagtggcggaagcgcgagcgttatgggaagatccaggaggggcggaaccccttcacggctgcctatgacatctctgtgctgccccgtactgacagccaccctcagctgcagaactccctgtgggccagtccaggatctgggagccctggaggcccctgccttgtgtctccagagggcatcccctccccatgcatgtctccatattcccacccccatgggagtgtggctggcttcatgggggtgccagccccttctgcggctcaccctggcatctactccatccatggctttccccccaccctggggggccacagctttgagccttcctcagatggtgactataagtctccaagcctcgtctcgctcagggtaaagcccaaggagccacccggccttctgaactggaccacgtgatcggttgcatggacctgcagaatgagctgcccacctctttttccattcccagtcgctcccagcccacctctgcctccaagccccagatggttctggaggctgc

SEQ ID NO: 472417 - DNA, 699 bp, Homo sapiens
cgatggtggttttgtcgaaaagaaaagggggaaatggtttgaagaagcaacagggttgggaagccacagagagcaatgagcacaggcccaaaggttgagagaagcaacaaacaggaaagggattccccatgggccttgcacagaatcagacgttggcaaacagaatcaagtccagaactaagaattacagtacctgatactctccccgggcctcctctcacccctatacaccttaaaaactgcccatatgtaacatatttaggaacacgaaccattctcagtgtcctcactgccaggaattttctctcagcatctacactttgctttgtaaccctaagccagttccaccatggaaagctgctgggcaccctggatgggacagaccaggaaattgctgatttcaccctgagctccctcaggctgatgacccacctcaactactatgtgcctggcccagggaccactgctgggcacttagcactccccacaggagacagacaaatcatgacaatagcaagtggccatttttcaaaacgaacaggcatacctggcaccatgggagcagagtgtggggttcaaggcagtacactctgctccacatcggggctgactttctgatgacccagagtctactcaggttttatcagcactctggggtccattttatactcagactcaaagtgcatcaggatgcttccc

SEQ ID NO: 472418 - DNA, 557 bp, Homo sapiens
atagaatttagatccatagagcatggcagcattatcttcaacaaccaccaccacccctaccgccaccactgcctccacttcttccattaccatcactaccatcacctcctccaacaccatcatcaccactactttctccatcaccatcatcaccactactttctccatcaccatcaccactactttctccatcaccatcaccactaccacctcctccgtcatcatcatcatcaccatcctccccaacacttcctcaccaccaacatcctaccaccaccaccagcattaccacttccaacatattgccatgattaccatccccaccatcaacactgccattactattactaacatcatcatcatgatcaccaccatcatcaccatcatcatcatccccatcacttccaaagggcctccaaaagaagggaacaccctttctgacctctcctctcagcctccagaaggaggcacccctctggctagtccaattccatggcagcaacgactcccacttgtaagagaggagttctgggagttaaaggccaggccctgagcat

SEQ ID NO: 472419 - DNA, 714 bp, Homo sapiens
tcagtttcagagtttgtcttctttcagctttaagacttttatgcccttatttgaataagcctatatgatggcaaactcaacagggaaggaagaggaaaggaaaaaagcaaatctaaaacaggggatgaataaaatactgtttgctcagtccagctccatgtctatttgcctgtccttcccaccaagaactctaccacttcaatttggggcattttgtgaggaggggggaatccttgagctccccctagagccaaaagaagcacacagggtcctgagcaccacgacagggggctctgaccttattgaggaggagaaagtgatgtgtgagatgagaaatgaacacgatcagctagttaaggatgggactgaagtgaaggaatttccaagtagaagaaatggccttctgcaaagaaacctggtacataagggagcccaggaagtaccagaagctgaaaagaggccagcatggctagaacagaatgcagagaggaagctcacagagagataaggctacagaagagagctgcttggcttcttctataatcatggaagaacttgagcatgattgtcttttcacataaaggggggaaaggggggtgtatgtcttgaatgatgtgtggttcacattgtggccgatccctacaccaagtgcccaggagtggagtcatataactcacaggcaaaatgccagtgggtcgagagtataagaaatct

SEQ ID NO: 472420 - DNA, 834 bp, Homo sapiens
ggcacctctttcttttttttttttttttttttttttttttttttttttgagacggagagctgctctgtctatgagaatatgtggtcttgattactctaagccatgcagaaaacctaacagaaacaacccctcctttacaggagatgcagaaacaccagcatctggtgttcatatgctgctggtgactcactggataaggctgtctggttctggaattcaggattatgaatctctcttttgcataaatattagcgacattctccaaaatcaatgtttttggaatgttactgttctcataatggctgtatcaatttacattctcactaacggtatacaagggttcacttttttccacattctcaccaacacatactatcttttgacttttaacaatagccatcctaacagaaacaataaagaatgtgctggtgaaatagccagcaaagaagtgaaggctcccctctgtaggccatggatgatagtaaaagaagccattagaggacttagcttgctgacagcaatgaagataataggaccctgaaatagaggccaggtggcagcatttctgttaataattattttctagaagtacactggcttttcccaatacaatgatattattttcataactgaccagactatatctgcctacaaatagaggaaggaatatttatatctttcggatattttgagaagctgtatcagaaactgcaagccatatgccatttaaacaagaagacctttccttggccttcacagattacgtgaaaatatgatgctttcacccaaagtttgtgtcttccacatccctgataagttggcaaatgtttccat

SEQ ID NO: 472421 - DNA, 792 bp, Homo sapiens
ctgccacatcctgctctccccagacttctttgggactgtggctccttcctataaggccaagaaagcacagaatttgaagcaggggatgaggttggagaggtgggtaggaaccaactcatatgcggttctgtacaccgtatccggagagcaacagaggatttgaaactgaggagacaggcattaaggtagccagagtgacatttcagataaggcctctgcagccctgtgggattccaggttccctgtggagggaaaacttgcacgggacaagcctggctgcagttaggggttaccttgaagggttcagaaacacagtctgggaaagcttcatggaggaggtgggacatgagcagccctttaaagaagaacgggacctaggtggagaagaggggcagatctcaggcagggaaacagaattgacaaagccaaagaagcagcattatttaggtggtgttcacagaagaagtaggtcagttggcggctgcgaccagacaaggatagagcccttttcctctgctcctttctcatcctcgcctccagccccactccctgtcatccacgggctgtcaggggtgactggctgagaagtgtgccaagaagaagcagcacaatcgggaagggtgggcccctggggagggaaagacagtgtccaaaagcgagagatttccttacaacctggatatcatagggcttccccaagggttaaagcaggggtcagcatacttcttctgtaaagggctttgtgtgaattcactctgcctcaactacacagctctaccattgtggagaaaa

SEQ ID NO: 472422 - DNA, 522 bp, Homo sapiens
gggcagtagatgagatagtaggtagaacagagtgctgagcaaagagcctgctcatggcactcgagggtatgacagccaagaatgctttcagtccacctccactccaagttcctggacacaattcagaagtttcaccttcttccctttcatctcacccactgctgaaggtgggccttcaactccagaccaccaacaaccctgcccccccccccagaagactggccccatcatctccctcagtcctgtcccatctgggtgaagggaaacttgcctcttctttactcaggactgcctgtgaagtttcccgcatcccaaatacaagagccaaacatctagatgcttggaaagaagcatctggaaaacccaagtccatgaataagcaagccatttatctagaggtgaagaaacaggaggaggaggaggagaggatggaagagaaggagaagagaatgtgcttggagaaagaggagaaggagaaagaagcagaaaaatgtggccaatcatccagatatttctaaatac

SEQ ID NO: 472423 - DNA, 541 bp, Homo sapiens
ttgacatgcctcctttttctcatctattctttggaaagctttttttcttttttcttttttttttttacagaaatgggagtctcgccatgttgcccagaaaaatcatttggattcctatccgtccccttcacaattgggctctttttaaaattctatttcaactctgtcctggagcctgttcacctagaggaagcccctacacctttccttccaaacccccttgtagaagtgtgggtcaacagatcaatctgagcagtgcaattgaccctgctctgcccccaggccctcaaacacaggagctgggggtggttgagtttgctccagtgagctatgatcaaggaagagctatggatgtaggagagaaaccgagcacctatgtaaatgacatgagtgtctgtggagaggttgtagactcaccttcaggagccacaaggctcctagatgtgtgaagtagtaggtatgagaagataaggaggggacaaagcagagacagcatcccaagggcattcaaaatagaaaccttcaaagctatgctggccaa

SEQ ID NO: 472424 - DNA, 693 bp, Homo sapiens
gcagttgcgctatctgcattggagcccatctgctgcttttccttggacaatggctgcccgtttagggttgtgacccaggagtcgctgtggttatcaactgcgagagctcaaacggacacatgagaagcagctttgtttagcaaataggaatggctcactagcctgacacaaagaccaaaaactgggggcactgttctcctgaaagactatgcaagtgtgtggaagctgtgtgcctttgggaactggctctctgagggcaggggagatggtgcccccacggccctgctctggcaagccggggctggccatccagcagcattgtggagcagcagcctgggaaggcattgacatttttgcacgtggtgttgatggtggaggtggggagaggtgtcctgtgaagccaacttatgagatcatccttgattatccagttggttctaaatccaataacaatcatcttcataagagacagaagggaagacatagatgggaagcagtagagcatgtgaagatggatgcagagattacagtgatgctgccacaagccaaggaacgtctgatgccaccagaagctggaagaagcaaggaaggatcctcccctagagcctttgcagggagccctgacctgctgacaccttgatttcagacttttggcttccagactttaagataattaatttgttctttaaagtc

SEQ ID NO: 472425 - DNA, 879 bp, Homo sapiens
aggagagatcatagtgtggtctttgaattctgagacctcatcaacacctctatgccttcggtttttcaactgcaaagtgggggaaggactgggctgggactgagttgctggatgccctgcagaacaatggtgtgcacggagggcagtgatcacggagacataggagccaccccaggtccaggaatctgtgatttctcgctgctggacctggaagaaaggggcctggccgcggggacagccggggagcagcaggcccctctgcagcagcagcaggagccccagggacaccccgccggagggcctggcatggcctgcgtgctgtggcctccccagatgccaggcagcgccattcctgagcagggaggtctccaggttcatacagtgcaaagaggcagtttaagccaaagggaggatctgcaaacttctgctgtggcactcaggcgacccctggcaccagggcctgaggcattgtcaggatgcagtttggagatggctgaagccaacccactagcggccagaggccgctccacagcaggatggaacaggaaggggcccgaaagtgtctgaagagtttgctctgcactagatccctgtgaggcgtcttcagtgcatacactcattgggcttcacggttcaccctattttactaatgaggagagtattcgtgttcaattggttcttccaactagacaaaagcaatggttgtcagttcctgagacttccctggggcatgttaaacatagattattggccctgccttctggtgagggtagggcccaagaatttgtgtttctgattagttccaagtgatgctgatcttattggtcaggaacacatccttggagatctatggcaataaggaatatttacagagtggtg

SEQ ID NO: 472426 - DNA, 1062 bp, Homo sapiens
agcaaaagaagaaggaaatactcatgacaatcacagtccctatttctgcagctggtcacgtggtcatagctggtattactgactaccttctactacccattctgtattccctttgccttcagcaatcacctcggcagtttaatggaattgttgtgtctcctggtggcagtgttcctccctctggaactaagagctctaggccagcagaactaaatgttgtgggaacaggaagcaaaaattttactattggatcactaggggtgatgtttttgaccactcaaagaggtccatccacatatctgtcctccaaatttctttgtcaccgattttccaattatgcttcttccaagtccctgaccatccagccaaaccattggctacaacctgtgaatccgcatataatcgcacatctggccatttctccttccttgcaatgtgcacaaccaggtgcactgattgaagttctgcccactgggatattccccttcaccactgtgcttcagggatgtcctagaaagaggccgtactgctacagctgtccactttcgggaatggagaaaaaggcatttgccaagtcaatggctgtataccaggtaccaggaaatgtgtacacctggtacagcagctgcaactggagtcatcacttggttaagcttacaataatctactgtcattctccaagatccatctgtcttctgcacaaactgaatgggagatccctgaatctgaacagggatggagccaatgtgggggttctgccagctgctaagtatgtctatgccaattatgcattctggcactggggaaatgaccacaggatgaatctggggacccactggacccactcggctcttcctccttgtagctcagcaccctgtgaggttgaagaggcggctgctcagctgtggctgaaagtgaggaagctccctttaggggttcagctaaggttttctctcgaaaactttcaagccctgagaagtttgaagagacacaaacaggggaaaggaccctaaagcacactgactgtctttctcttggcatcgacgtcttgtgtgttttttt

SEQ ID NO: 472427 - DNA, 678 bp, Homo sapiens
catcgtggctaagcaggcactgctgggccggagggtgggggtggatgaacaccaacccttcccggacccccacccttcctgggcccccatatacctggtttggaccgcgcgaggccaagcctcccaggaccgcctcaaggtgtgtgctgggatcccacggccctgcgacaagaaacagctgaaggttgtttctgcggccctccaggtggtatgtctgaagcctacaagaaagtttgcctgcctggggtgcctgactcacgaagctggctagaagtagcaggcagtgacagccacctgcaggaggagaggaaggaaaaggccaggatttactcagggaaggaaaagcagctcttaaggccacagaaacaggcagcaaagaacatggagaaaactgacagatacgcagaggtcctcaagacccatggactcctgatgcagaatgtgaggctacagaggcagggtgcctccatgccgccctcctggatttcccctcaccacaggtatatcttcactcgcccactgcgctccagctctccactctcttcaacatttcggtcagatctttgctgtttattcattgtgttggtccttttgtgtgcaggggatgaacgctaggcatcactagccagccatcttacagatatcactcccagaaaaaaaattaaaatgtttcccttt

SEQ ID NO: 472428 - DNA, 1349 bp, Homo sapiens
ccccttcttaaacataagacgagcaaggagactcatggtctggttcttggacttccctaacagcatggcccctaaacgccagtctccactcccacttcaaaagaagaaaccaagaccacctcctgctctgggactggaggagacatcggcctctgcaggcttgccgaagaagggagaaaaagaacagcaagaagcaattgaacacattgatgaagtacaaaatgaaatagacagacttaatgaacaagacagtgaggagattttgaaagtagaacagaaatataacaaactccgccaaccattttttcagaagaggtcagaattgatcgccaaaatcccaaattttggggtaacaacatttgtcaaccatccacaagtgtcttcactgcttggggaggaggacgaagaggcactgcattatttgactaaagttgaagtgacagaatttgaagatattaaatcaggttacagaatagatttttattttgatgaaaatccttactttgaaaataaagttttctccaaagaatttcatctgaatgagagtggtgatccatcttcaaagtccaccaaaatcaaatggaaatctggaaaggatgtgacgaaacgttcaagtcaaacgcagaataaagccagcaggaagaggcagcatgaggaaccagagagcttctttacctggtttactgatcattctgatgcaggtgctgatgagttagaagaggtcatcaaagatgatatttggccaaacccattacagtattacttggttcctgatatggatgatgaagaaggaggagaagatgatgatgatgatgatgatgatggtgatgaaggggaggaagaattagaagatattgatgaaggggatgaggatgaaggtgaagaagatgaagatgatgatgaaggggaggaaggagaggaggatgaaggagaagatgactaatagaacactgatggactccaaccttccttttttaaaattttctccagccctgggagcaagttgcagtctttttttttttctcttgtgctcagtcaccctgttcttcagctctcttttctctactccatggttctcaacttatttggggggaaataccttgagcagaatacaatgggaaaagagtctctacccttttctgttcgaagttcatttttatcccttcctgtctgaacaaaaactgtatggaatcaacaccaccgagctctgtggggaaaaagaaaaacctgctcccttcgctctgctggaagctggaggatgctaggcccctgtatagtagtgcatagaattctagcttttttcctcctttctctgtatattgggttcagagagtacactgtgtctctat

SEQ ID NO: 472429 - DNA, 3268 bp, Homo sapiens
gggccagagggttcaacagtggaagagggacagtgtggcccagccagagacctcccctctcacgccactcagctccttctctctacagtgaggctgggtcagggaggctcagaatcaattgtcccaaactgggactcagaaggacatcctggattcccaccagcctggctgtaggctgtgtctgctgacagcaagtttccgttctgccaccagcttgcatctacttctgcacctcagtttcccacatgtcaaagtactaatgccagcatgttctccaaataccctgccctttggatgccaaagagtggttctgggctctgcatcaaggccagggtggcagggatggagcaggacccagtccagagcttggatcctcccccaaacccaactactgccagcccaggggtcgacctgaatgtagccatgcagatgcctgggccccatgctttctgtggcctgagaaggaaagagaggtctgcagggcctttcctgtacttcaaaggcaccggtcacaccctcaaagcagggtctaggcagagggaagcctggttttcgctgggcagtccaggtctctggtcacacaacaaacactggaacctgagcatagaccggcccaaagggagaccaggattgaagccaggcccccaagcccacccctcacagtcccagctccaggccctggtggcccctgcggggcctaggccaccctgacattcacctaattgtcttcctgctttgatgagtggatccgcagaggcgccgccacggatcaaattaaatgtgagccaagccggcagccccgatgatgggagggaaataccacatttacatagcccagcacaggggcagggagacccaggcccagagtgacagagaccatggacccaggaggaggcaggggaggaagacagaggtggggctgaggtagggtgggcagaggcatcctccccagggtcgctgtcactgttgaataaagggcaggtggggagggaggatcaatacagaaagaggctcttcccacctccaggcaggtgactgcctctctggcaagcccagcccgttggcctagacgtgggaaggtggggcccacagctcccttcaccccagcccagaccccacagctgggctgcagctgcctccctcagcacagccctggcctgaaggctctgggtggtctggaggcatccacctgtagacactgagtctgtgtgtgggacgtgtgtggcactggtgtccaagtcagagtgattgtgccaatggcccctccaccccaaaagcatgttcccaggtgcaaagcactgtcacagcctgcaaactaccctgggaggggagctaggcccacaaaagtgcctgttggctccactgagaagcccttccccatcacccacggggtccagggcggcttttactgggaaaataattagaaatctaattcttatttctcccactctgctaattgtctgtggacaatttgattgtaacagtcgtcactgaagcagaaaaaccaccttatttctgccagacatcctccctgcaattaacactagcaactgctttgctctcttctcacctgcagagacccagggccctgaggttccctcacctttctgcctcccagctctgatgcctggctcaaggcatcttccccagggcacctgcaggtgccatgggatgactcgctgcatgttctgtgaagggggcaggtgtgggcagctcagctcagctcatagaggagccctgagcagcgtcccctgccttcaccccagggctgcgcatgcctggctttggagtcttttatccagtctagagtgcagggatgtggaatctgtgggtagcactctcaatgcaagctgcatccaattttttttttttttggtcttaacttagaagagtatcttttgaacgtaaaaggccaacagtacacacttttgtttcttttgttccatgcaggggtgaccccagtgtcactgtgtatggtggagcaggctatgaatggcacccccgtgttgtgtaatgtagcaggctcaagactgatggccttacttccaaggctgggaaagacccttggggagcaagtaaagtcgtttgatgttatagttaagctcagttagatccccaccccacaccccaccaccccaccatcccaccatctcaccaccccaccaccccacacctggacgctgctgaagctatattcttttctctgtcaagacaatgcgtttaatcctctgttctcactggatgccttttgggggtcacaaactcttctctggctgcccctcctggacctccaaatgacaagttactgagttttccacccttctgcaaacttttccttgttctcatggttttgttccatctctctagtcagaacttcagctgacactcaaggcgtataaggaacactagggacattatctgctcagcacccttcccttctcttgggaatcacagcccatcccagccccctccagccctgtggtcatagtgtgagctgccaggctcttataggaaccccactcctggccacagctgattggcccaagaggggcacatggttgaagccccgccaattaaagttctccaagtttttggactggaaatgcaagagaatgtctttcttttatatcctataatcatatacaaattgagaggatgccattatgaatttttccatatttcctttttcctgtttcaaaggaatttcattgcttttgtgtgtgaatagtttttagattagtacatctttcttttttaatatatggatttctggggtagtcttttccctcttcacaaactatacattatcacatttcttcacatttttaggccaaaggtggccaggtcggccctattgaagagaaaaagtttaagataaaatttgattctgattttcaaaaaaatctaagggactgtggccatgtgtcctggcttggggaagaagcgggtctgcagctgggaaggatgaactggcattggagagactctagaggagctgctctctgggccattcctgtgggttagttccatggattctgtgagccagtaaatccctcttcgtgcctatgggaggctgagtagtgtttctgtcacttaaaaaccagagttctgatcgggttccctgccatatagcctttccatacatttcttccagagtggccagggcaaccctccagagagtgaaggcaaagggcagccaatgaatgttcctcccctggagagagaagtcccataggctaaagtcccatctttaaagatgattcacaaa

SEQ ID NO: 472430 - DNA, 1098 bp, Homo sapiens
tctcttgtgttcagaaattagaggtggttcagtcttagtgggatattagagttgagacaaacaaaaactagagatcaggctggagagaagtggcaagaagccctccgagagtgtgggtctgggatgctttttgtcaaatctgcaggtgcctgggtccgcagtctactcctctgctgggggtggaggggatcccctagatctacattttcacacattcccaggctgtcagagatgggcggggaccgtaggcaatggcagggagcctggcagctgtaggattggggccccatctactcctcttccatcctgagccctttggagacaagccgacctggtttgagccccagctcctgctccttctgctgcttagctctgtgacctttggcaagttgctaaacctctctgagtctcagtttacttatctgcagaatgggggatgccctcttgtggccgcggccccctcgcacgtcgccctgcgcccggggaccggaatccccgacaaggggtggtcagctcagcggcagcactggaccctctacctgcccccgccccccgattgtacggaagtctgcagcgtgtctcaggccacactgcgagttgggggtggccctggccgccagcctggtgtccttgcctggaggaaatgcgagggccgtctgggcccagcatgcccgctggctcgtgagctggccctggaaactagcggctggcgcaagtgggcgttcggcggcactgctggctgccagctgccagccccacaccccacaggcccctgcctggccagccccggtgcactcctgggatgtcccctgcaggcccaagttcaggctaaggccggctgtgccggaggggcacaacacctgagtggagatgagcagcccaggggcgccctgctggcccgcaccctgcccagaccacatgaaggcgaagaggttgctgagattcagacccaatctgctgactcccaaacctgcgtttgatttattgatttagatttgtacaagtttctatacacagcattaatttatatttatttatgcatttagaataagcccaacttgtgtttaaaatctctctgcttcccagattctcagtgag

SEQ ID NO: 472431 - DNA, 1223 bp, Homo sapiens
gacggtgaggggcggtggcccaacggcgggagattcaaacctggaagaaggaggaacatggagaggagagcagcgggcccaggctgggcagcctctggatggaggcctgcctgaaggaggagcttccttccccggtggagctggaggagagccttcggaatggagtgctgctggccaagctaggccactgttttgcaccctccgtggttcccttgaagaagatctacgatgtggagcagctgcggtaccaggcaactggcttacatttccgtcacacagacaacatcaacttttggctatctgcaatagcccacatcggtctgccttcgaccttcttcccagagaccacggacatctatgacaaaaagaacatgccccgggtagtctactgcatccatgctctcagtctcttcctcttccggctgggattggcccctcagatacatgatctatacgggaaagtgaaattcacagctgaggaactcagcaacatggcgtccgaactggccaaatatggcctccagctgcctgccttcagcaagatcgggggcatcttggccaatgagctctcggtggatgaggctgcagtccatgcagctgttcttgccatcaatgaagcagtggagcgaggggtggtggaggacaccctggctgccttgcagaatcccagtgctcttctggagaatctccgagagcctctggcagccgtctaccaagagatgctggcccaggccaagatggagaaggcagccaatgccaggaaccatgatgacagagaaagccaggacatctatgaccactacctaactcaggctgaaatccagggcaatatcaaccatgtcaacgtccatggggctctagaagttgttgatgatgccctggaaagacagagccctgaagccttgctcaaggcccttcaagaccctgccctggccctgcgaggggtgaggagagactttgctgactggtacctggagcagctgaactcagacagagagcagaaggcacaggagctgggcctggtggagcttctggaaaaggaggaagtccaggctggtgtggctgcagccaacacaaagggtgatcaggaacaagccatgctgaggcaaaatgcagtagcctgtggacactaggcctgttacagttgcttgccttagtctggacttgctgtcaggtttagaggttgctcagtaaccatttacctttgtctaacagagctttcc

SEQ ID NO: 472432 - DNA, 2866 bp, Homo sapiens
gcttgggcagccctatgtcttcccccaaccctgaggatgtgccccggaggccagaacctgagccctcaagctccaataagaaaaagaagaaaagaaagtggctgcggcaagaagccagcatccaagccctcaccagggctggccatggggcccttcaggctggccagaaccatgaagccttgaacaacttccagagggccttccttctggcctccaaggccccacaaaccagggatacccctgtgctccaggcctgcgccttcaacctgggggctgcctatgtggagactggggacccagccagaggccttgagctactcctgcgagcccaccctgaagagaaggcacagggcaggcgacacggcgaccaatgtttcaatgtggctttggcctaccatgccctcggcgagctgcctcaagctttggcctggtaccacagggccctgggccactaccagccacagggtgaccagggagaagcctgggcaaaaatgggagcctgctaccaggctctgggacagcctgagctagcagcccactgcctgcaggaagcaagccaggcctatgctcaagagagacagctgcgggccgcagccctggcactgggggctgcggcaggatgtatgctgaagagtgggcggcatcgggtgggggaagttgtgcaggtgctggagaaaagccggaggcttgccgagaggagcactgagaggcgactgctggggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagcgtgagttgatgtagagtattcctggcggtgcctctccttactgcaaatatggcactcccacccccacccgcctgcctccgcttcttatgcccatcccaccatcccgccttcctgttgtcatttctttgaggcctggcacaacctcgcgccacccctgaccctggctgtcccagttcgcaagtccccaacagccctcccatgatttctgcttgtctctcaaggccctggaccattttccctgaacccttctagaactccctcttccttcctgctctcatggctttcctaacttctagaactttgcatcttggaccccagggttttgctgaaagcctactctgtgcccaacacagcgctgggtgctgttggtaaaccccagctcactactcaatagcatctcccacaaagacttgcaactcagggagcagagttctttgctacttgttgagctgacctgaatttaccgatgtctccttttcagtgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggtaaaagaaaaaaggaaaatggatggcaaattccctgtctttctgaatccaaatcttacgattgctaggggcctggcagttctaaaaactgacttcgtggtcaagtagctttggagtcactgactgtctccagacgtccatttttgcacatgagaaatgaggatataatactacagaagaggcatcttacccaaccaatgcaccttacttctctgtgaaacacaggggatgctgggcgcaggcctaggctgtggcctgtagcctgtaggacagctcctgccagcagccacaggaacagtgatgtgatgtaacatttcccaagtacttagctcatgccccaccctattctaggtgcttagctcaggccccaccctattctaggtgcttagctcaggccccaccct

SEQ ID NO: 472433 - DNA, 1449 bp, Homo sapiens
aaatagttagaatgaataaacaaattcaggggagaactggggcctgctcccagagagatacagctacgttgatcaaaactgaatcttcggatgtgatccaccttatcatgcagtacttgaaggagaacggtttacatcgggcattagccaccttgcaggaggagactactgtgtctctgaatgctgtggacagcattgagagttttgtggctgacattaacagtggccattgggatactgtgttgcaggctatacagtctctgaaattgccagacaaaaccctcattgacctctatgaacagattgttctggaattgatagagctccctgtcaaagatgtggaagaagaaaagtttcctacacaactgagcaggcatattaagtttggtcagaaatcacaagtggagtgtgctcgattttctccagatggtcactatttggtcactgggtctgttgatggactcactgaagtatggaactttactactggaaaaatcagaaaggatcttaagtaccaggcccaggataactttatgatgatggatgatgctgtcctctgcatgtgtttcagcagagatacagaaatgttagcaactggggcccaagatggaaaaatcaaggtatggaagattcagagtagacaatatttaaggagatatgagagggcacacagtaagggtgtcacgtgtctaagcttttctaaggatagcagtcagatccttagtgcttcttttgaccagacaattagaattcatggtttaaaatctgggaaaaccctgaaggaattttgtagccattcctcctttgttaacaaagcaacatttacacaagatggacattatattattagtgcatcctctgatggcactgtaaagatctggaatatgaagaccacagaatgttcagatacctttaaatccctgggcagcactgcagggacagatattaccgtcaacagtgtgattctacttcctaaaaatcctgagcactttgtggtgtgcaacagatcaaacacagtggtcatcatgaacatgcaggggcagattgtcagaaacttcagttctggtaaaagagaagccactggcaaactggaaagaactttgacagtgcacgagaaggatgtgattggtattgcacatcaccctcatcagaacctgattgctacctacagtgaagatggactcctaaagctctggaaaccataattcaacttttctttttaaatcagcttgaaagcacgtacttaaatgaaggcatattcatgtaatgtgctttttttttttttgccagcttttctaagcaaatagattgtctgaattagtcacaaggataattttgtgaaaattcatgtttaagtagcaagtacccttccttttcttatatatttttaagatgttaataaactttatacctttctgggaaaaaaaattcagcaaagttgcaggacat

SEQ ID NO: 472434 - DNA, 1560 bp, Homo sapiens
tgggagcatcaccaccagagcatggattaaagtgaagcgcatggagttaaggcaagtctatctcactagggctcattccataaactccccacccttctcagcggagaaccacaagattcccggttcctgtccatggttcaccaattcaacaaatatctataaagcacctttgagtacgatgtcctgtgctacgatgggatctggggagccagcagaggagaacaagacagctagggttgctgatctcggagctgacactctgagcgggatacagatgttcaacaaagaagacactatctataatggtgaccatttccccaaggcccagacacagcccatctcgccggagtggaccatgcactgcagctgcttggctgagggcatcccagccaaccccggcaactggatctcagggttggccttccctgattgggcctacaaagccgagtcgtccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatattactacaataagaggatcctgcataagaccaaaggcaaaaggttcacatacaagttcaacttcagcaagctcatcgtagtcaactatcctttgtgggaagtgcgggcgccgccatccccccacttgctgctgggggcccctgccctgtgtcggccagcgctggtgcccgtgggtgtgcagagtgagctcctgcacagcatgctatttgcccatcaggccatggtggagcagctgacaggacagcagaccccccgagggccaccagagacctctggggataagaaggggagcagcagcagcgtctaccccaatttcatggaagaaggatccatggccttcaccccacccctgagctgctgggggcccaagctctgcacccctgggagtgcagctgaggccatgggtgtggggtgctccagggcctgctgggactcgctgggcctggacttggctctgccccaggcccctgccggctgggcctttgctgccatttggggagcgtccaaggcgagctgcctggtgttgcctccttcactcctcccctcccgccccctctgccctccaactggacctgtctctcggggcccttcttgcctcctctcccgtcagagcagcagctcccaggggcttttaagccagacatcctgctcccaggacctaggagcctcccaggggcctggcattttccagggcttcctctcttggcagggctgggacagggtgcgggacccaggcaagtggggtggggagacactggccttctctgctctgtaatactccactgtgaccatgaataaaatgcccttgcaaactgtcctctggctgaccacccccccctgcagtggacccccatcctcccactgtgctcctcctgcgttctggactggtgtgatgggaaaaggccc

SEQ ID NO: 472435 - DNA, 699 bp, Homo sapiens
ttatcacagctggcttgctgatgcttaagaggccctcacaggtctcttgactactgagggtaaatggactgatggaaacccagcatatgagtctctctgactatggacgttaccaaacacctgtgagacccctgctaggcattgacttcacagagaaggaggcatttgtggctcatagccctgtgactttcctggcagttgttcccccagcagaaacagtccagtgttcaggaaattctgttctatcaagtaaagcaaggaggcccaaaaggctgaggattcaacctgctttgaaatccaacaagccacaggaccagaatctgtatctaatttttgactgtccaggcttccagcccctgcagcctccccctgggaattctgattgtgacaataaaataaaactgctgcatgtaaggtgcttaaaatggatcttacacattgcagggattatcgtcttctcaaggaggtcgggagaggaagaagccaaagacaaggtccaggttcctggttggggccattgcctgagaatgggaacacagaaataggctagaagatgaagataaacgcagcatttgacacaccgagtttgaggcaccagtggagatgtctagtagagagctgaatgcagaatctgatgctaggcagaggatgggggttggagatacagacttgggcattagcagcgtggggatgatcatt

SEQ ID NO: 472436 - DNA, 1515 bp, Homo sapiens
tggcacaccaggagattatatcctgcacctggctcagagggtcctatgcccacggagccttgctctttgctagcacagcagtctgagatcaaactgcaaggtggtttgtgctagctcattgctagcacagcagtctgagatcaaactgcagcgaggctgggggaggggcacccgccattgctcaggcttgagtaggtagacaaagcagctgggaagctcaaactgggtggagcccaccacagctcaaggaggcctgcctgcctctgtaggctccacctctgggggcagggcacagacaaaaaaaagcaataacctctgcagacttaaatgtccttgtctgacagctttgaagagagcagtggttctcccagcatgtagctggagatctgagaatgggcagactgcctcctcaagtgggtccctgacccccgagtagcctaactgggaggcaccccccagtaggggcggactgacacctcacacagccgggtactcctctgagacaaaacttccagaggaacgatcagacagcagcatttgtggttcaccaatatgcgctgttctgcagccaccactgctgatacccaggcaaacagggtctagagtggacctacagtaaactccaacagacctgcagctgagggtcctgactgttagaaggaaaactaacaaacagaaacgacatccacaccaaaaacctatctgtatgtcaccatcatcaaagacaaaaggtagataaaaccacaaagatggggaaaaaacagagcagaaaaactggaaactctaaaaatcagagtgcctctcctcctccaaaggaatgcagctcctcaccagcaatggaacaaagctggatggagaatgactttgacaagttgacagaggaaggcttcagaagatcaaacaactccaagctaaagaaggaagttcgaaccaatggcaaagaagttaaaaactttgaaaaaaaattagatgaatggataactagaataaccaatgcagagaagtccttaaaggacctgatggagctgaaaaccacggcacgagaactacatgacgaatgcacaagcctcagtaaccaatgcaatcaactggaagaaaggttatcagtgatggaagatgaaatgaatgaaatgaaacatgaagagaagtttagagaaaaaagaataaaaagaaatgaacaaagcctccaagaaatatgggactatgtgaaaagacaaaatctatgtctaattggtgtacctgaaagtgacagggagaatggaaacaagttggaaaacactgcaggatattatccaggagaatttccccaatctagcaaggcaggccaacattcaaattcgggaaacacagagaacaccacaaagatactcctcgagaagagcaactccaagacacatgattgtcagatttaccaaagttgaaatgaaggaaaaatgttaagggcagccagagagaaaggtcgggttacctacaaagggaagcccatcagactaactgctgatctcttggcagaaa

SEQ ID NO: 472437 - DNA, 499 bp, Homo sapiens
tgggctccttccattacctggcaataccccacgggatccatggggatgggaaaggagagaggagcagaaaagaggatggagttgaggagtcgggaagagccttccctggctcatcccgttgtcgtcatcaagcaagcctgtgccccttttccaggtcccaaccaggtcaccgtccatcacaccagactgctgaaaatttacccaagagggcagggctccaagagccacagaggacctaaatgtgacctgagagagagcaaaggcctccccagagagctggaccagacagggatgccaggaccagcctacaaccccgggaccctggccgtgagcctgccactgagccagtgcaatgccagcctgacctgtgtgatcagcaaccacgaggaacagaaaactgccacctcagaccttgggggaaatgtgtttaactcaaaaaattgtccagcaagggcaggttctagttctggaggcacccctttcccagaagattgagggt

SEQ ID NO: 472438 - DNA, 621 bp, Homo sapiens
tgagtcgtgagtgaatgtgaagacctggacattactaaaaagaacaaagtcaaggatggcaccaagattttgtggctgcaacaaatggagtaatagagatgacatttattgggatgggaagactgtatgggaagcgtgtttggggagtttgaaagccaagctggagattcctgttatacgtcctagtggagctgactcatgtgattatactgaactgacccagataacccaggataattcacatctcaagacccttaaacttgatgacgtctgcaaagtcccttttgccataaggttatattggcatatggtccaggaattagtgcagagccacaatctcagaaagaaaatgagagtggataatgaagacagatcatctgggtgtaaacctgaggatattccagaatatagaggaaatgaaaatcaaaagcacaatgagttaccagttcacactcactcagaaggcaataatcaaagaaatggacaatagcaagggttgggaaggatatggagatattctcccacattgctggtggaatgtaaaaatggtgaaggtgaaggtggaaaaacggaaatgaagtattgagagggagatggaatataagaagctttctgacagat

SEQ ID NO: 472439 - DNA, 624 bp, Homo sapiens
gctgttctgcagcctccgctgcaaacctgcagcagaggggcctgactgttcgaaggaaaactaacaaacagaaaggaatagcatcaacatcaacaaaatggatgtccacacagaatccccatccaaaggtcaccaacatcaaagccccaagatagataaatccatgaagatgagaaaaaaccagagcaaaaaggctgaaaattccaaaaaccagaatgcctcttctcctccaaaggatcacaactccttgccaacaagggaacacaactggatggagaatgaatttgacaaattgacagaagtaggcttcagaaggtgggtaataataaactcctccaagctaaaggagcatgtactatcccaatgcaaggaagctaagaacatggagaaaagcagcacaggccaacattcaaattcaggaaatacagagaacaacacaaagatactccctgagaagaacaactccaagacacataatcgtcagatcaccaaggttgaaatgaaggaaaaaatgttaagggcagccagagagaaagaagagagtgggggctaatattcaacatgcttaaagagaagaattttcaacccagaattgcatctccaaccaaactaagctttgtaagc

SEQ ID NO: 472440 - DNA, 475 bp, Homo sapiens
accatgactgagcagggctaaagcagggctgcttcagaatctgcaatcagtccaaagttagaagatgtaccaacatgagcacagacagacatatctcccagtgggctcctgggtggctaggaatactctctgcccacaactgggtcccttggcagattgttctggtggcaggaccaaagccaaagagagctatatccagatttactggggcaaagtgttgtttccaggtctgtatccaggaacatgtacagtgagcctgctacctggttgtgaaaacaccctctcaaaacagctctcttcagtcttgggctctcctaaggttttgctgcctttgacctggagtccaatacgctcacaactgtactttggtctgtggaaggctctcaaattcttgttgctgtgggaggatatgagtgggacatcccctactctatattctgctctcaaattttattttacagagagacactaaact

SEQ ID NO: 472441 - DNA, 826 bp, Homo sapiens
tgcccacatgagctccaggcagtgtcctgcctcacagacgcatgtggccaccgagttgcatgccagctgcccctccctggaggagccatttcttttggctgctggggccaggcctatgtcctgccctccccctgaggcccaggagcagtgctggctggcttggaagcccaaagccagaacatccttcctatcttttgcagccaaaagctattttctgtttacctctggaagttcacttccttctgaatactgaaaaaattctactgggatcattgccctacacagaaaagcagacagagttgggagttgaacccaagaacctagaaccccgccaaatgcaagggcctgctgagacaacccagattgtggcttacaccagaaccatcttgcagagccttcccatcatggcccgtgttgttggaggtgatgatgctgcccacgctttccctccagtaggaactttcccatcatggcccgtggttgttggaggtgatgatgctgcccatgctttccctccagtaggaactttcccatcatggcccatggctgttggaagtgacggtgctgcccagagttttctctcgccaacccccccaccttttccctgagagggtgcctccatcctgcaactccaaccacctgctgcttttgacggccaatatcttctgcacaaatttcccctgtgagcaccaaatccaaatgcccaacatcctactggacaatagattttcaaactcaacattccccaactcaactcctcatcctccccctacttctttcccaaatgtattgttcttatctttcttctctccctgactccctgcac

SEQ ID NO: 472442 - DNA, 927 bp, Homo sapiens
ggtttcagtacattgaggtttttagtgcgtatgagatgtcccagtggagatgtctgtccactgggcaactggacatcaggctttggtgctcaggacctatggaatggacaccctgaggctgaagaccctgagaattcccaggagatgcagcagaaaagaagaagctggatgtgggactcactggggaagatctgctccacactgtgcaactgctctctcaaagctttggtttctgtttctacaaaatatatcaatatcatcatcatctctatccagggagcccatttaaaaatcaggtgcagctgcttcgaacttattaagattagtgtcactaaagttggtgttcaacccccaactcagccactgctacatttgactgggaagaagaagaagaagaagaagaagaagaagaagaagaagaagaagaagaagaagaaggaggaggaggaggaggaggaggaggaggaggaggaggaggaggaggaggaggaggaggaggggggcgggacagcccctcttgctggcagtaatcacagccatgagttgactgtccaccacggcggcactagattagtcacatcacctacattagctctgatcctcacaataactctcagaggtgctggggtccccaaacccagagccacagactggtaccagtccttggcttgttaggaactagaccacacagcaggagatgggaccatctagttgcagaaaaacaagctcagggctcccactaactctacattatggtgagttgtgtaactatttcattatgtattataatgtaatcataatagaaataaagtgcacaataaatataataaatataatgtgcttgaatcgtcctgaaaccatccccctcaccaccccagtccatggaaaaattgtctggtgcccaagaagtttgggggccactgcctt

SEQ ID NO: 472443 - DNA, 480 bp, Homo sapiens
tccccaattgcttgtctttatttgagcacccctatatgccaggcactggcaatgcagtggttaacccatttctccatggagcatctgttgaagtggggggaagtaaagaaaagattaaaacaaaatacgtccacttttgcagctatgtggggagagttgatgagccaggcctagctcagtatcgcatgactgctggcctagaacactatgccaaacaatttcctccagcttctcaaaatgcacagttgtccagcgtagaagcagagtatgcaggaggcttggcaactatgcaggttgtgaagccagaggggagtttgagcaccaagttcaagaaggcagtcttgcaagactttcctcgaagcagctcctacagactggctctttcaccttaaacgccatagttttggatacaggcttttctgcacgtactgggggcattggctgttgacacgtgaaatattgaggcagccttgtctatgc

SEQ ID NO: 472444 - DNA, 4966 bp, Homo sapiens
gccgccgccgccgccgcctttgcggccgccgccgccgctggtgggggagacgcggggttggggggggaggagggcgcgcgtggtgccggtggggggcggcggcggcgccccctcctcctcctccgcctcctcctccggcgtcgcgggctcctcggacatggccgcggcggtggcggtggcggccgcgtcccggcggcagtcgtgctacctgtgtgacctgccccgcatgccctgggccatgatctgggacttcaccgaacccgtctgccgcggctgcgtcaactacgagggcgccgaccgcgtcgagttcgtcatcgagacggcgcggcagctcaagcgggcgcacggctgcttcccggagggtcgctccccacccggcgccgcggcctcggccgccgccaagccgccgccgctctccgccaaggacatccttttgcagcagcagcagcagcttggccacggcggccccgaggcggccccgcgcgcgccgcaggccttggagcgctacccgttggcggccgcggccgagaggcccccgcgcctcggctctgacttcggcagcagccgcccggcagcgagcctggcccagccgccgacgccgcagccgccgcccgtgaacggcatcctggtgcccaacggcttctccaagctagaggagccgcccgagctgaatcgccagagcccgaacccgcggcgcggccacgcggtgccgcccaccctggtgccgctcatgaacggctcggccacgccgctgcccaccgcgctcggcctcggcggccgcgctgccgcctccttagccgcggtgtccggaaccgcggccgccagcctgggctccgcgcagcccaccgatctgggcgcccacaagcggccggcatccgtgtcgagcagcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatctgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagatgtactgtctttcatgtggcctcacatttaaagttatgagaacatacacatggtttacaacttttactatatacctttccttggccaccaagtattttaaaagtgtgccaccttttaacctttactttttttaagttgaaggtgatactttttctatatatgatgaaactcatgtcaactgaagtgagtgtaatctcagataccaacattattatattttaaaatcacgctatggaaatatcacctgaattctgtcatttgtcagatttacagtacctttttttctttaacttttagcattaaataaaaataaaattgggagcactgaacattttctgaggccttttttaattttctaaagcaagcttagaatggctattgttttaatcactaatggcaatgtgactaaaggatgtgtgggtttggggttggggtttgcctgaacttcaggagataaaagacatggaacaaaaaggcaactgatggtataaaatagaagtgccagggactgc

SEQ ID NO: 472445 - DNA, 893 bp, Homo sapiens
agaaaggaaaacaaatgcgttagattggaacgcttcgttctgcagcattgggagagagaggtggaagtcactcgtgtccctgccccctcacagtccccctgcccacgtgctcctgggccctggaaggactctttgtgctgagcggcacattatacgggttcaggaggcacagcacagggagccattgggtttttgagccagagaggaaggtgtattcctcagacgcagccaccaggagggcatttctgccaccgttgttttctcaggtccaggtacatcactatcatatggatgcattcatcccacactcctcctcttttctgtctgttcctccacagaagctaatatccctttcctctttcccctgatctccgtccctgtccctgttgtcccgctccacagatacccacagatgaggggagcctgtggaaatccagattccaagtcagcaggtccagggtggggcctgagagtctgtgttttcaacaagcttctgggccacgctggtgctgctggtctgagcactaccctttcagtgggaagcctaggcggtggtataatgatatcattgtctgcaggtctgggactctgggccctggggcagaggcagggcggcaacctgagctgcctggcagagatgtcagaatccgcagagtcaggaggaggaggccatgctcagagatactggacacacttctgtgttttgctgaatccctggaaatcggagtctgaggctgcagtgtgcaagccaagatgtttactggagagtgctttggggtcaacatctgccaggggtgaaggatgcagaattggggaaaaagagaggttgaaccatgaaacaggtgcaacagaggcctcgcccaatccctggggagctctggattgagcatggc

SEQ ID NO: 472446 - DNA, 712 bp, Homo sapiens
cagtgggtcaggacaatgtggctgccacacggtgcagggagggatagtcaccatatgcaggccacattgaccgagatccatgcgcatttgcttcatgttgttcgggatggaaaatcctcatcctttgtccccgaagaaaaatatctgtgaggccatcagtctaagctttaaaggtcatggagggaaaaggtaccagcgccatctaactctgctggaccaaatccgtgaggggaatgaggaattccattacctagtctccagggctctctggcggcttgagcccccagatgctctggtggaggctgtgcgccgctcctccgccctcctcctgcctggctgtcggccgccgctgcctgtgcaggaggctcatcgttatgccagggctgtaggtctgctcaaagcttcccagtcaccagaaacatgttcttctggggctgcctttcccacttggctggcggtgcctgacttgcatatgaaaccggcccttgggggcaacgggacttcaagatagaatggaccctctgtcatcatttttgcatctccaacagccacaacagtgctttatatataacaaatgaccaataaatgcctatcaaatgcattgaataatggagaatgcctttccgtcctttgaatcacagcttaagggattacctcttccaggaagtcttttgggttaatggagggcaccttcacctttcagtataatcct

SEQ ID NO: 472447 - DNA, 564 bp, Homo sapiens
agaaaccacagtggggtctttgtctttttccattctcctcactcccgcggtggctgcagggatgtacaatcacgtatcacaactgcgtgacacacgtccattctgcgccagcatgcactccgggacatgtcaataccacgttgatggaattgtgcctgattcccactcaaatccatccatccctcctggcattggtggggatgttttttccctaacgattgtcttcaccaggatcgtgggttacaaaatggaagctcagtgcttcctgcttcgagttccagtagaacaaacatgcaagagactcctcggcttggaaactcttcaaaccagggaagggctgctgatgtgtccccaggaggggaagggcaggaggagcacagttgtgcaggggggtgtttcacatgcttctctaaagaagagcttcctaaagtgtaaaaaggctggggaaagacacatttcccaaggcctggggccagtgcggggacaaacgcgaggctggcgcacgtgcattgcgggttccgcgcgccatctggtggcttcgggctgacattgggcgcaccatcc

SEQ ID NO: 472448 - DNA, 820 bp, Homo sapiens
ggttatgcaactgcctgtgcattccggaccatgaacgcatgcaagatttgtgcatttaagaagcatcttttcagtgggaggatgcggctgactttgggtgtacggcagcagtcctcaacctttttggcaccagggaccaggtttcgtggaagacaatttttccatggagccgggaaggtgggggtggctgctgatttgataggaggcggagctcaggtggtaagacaatctaaggccgctgctgatttgataggaggcggagctcaggtgataatgcccactcgcctgcagctcaccttctcctgtgcagcctggttcctaacaggtcacggaggggtagcggttcatggcccaggggttagggacccctggtggaattcctgggaagaagaacatcggtggggagtaatgatgctgggtgaagggatgaagggaatgaagttagatttgtaaaagtggagactgagaatgatgtcctgaataatattcaaatgaagacgtgtgatatatgttgacagaaacaatagttttctgcacattttatgttgaaggtaattgatatttactgacatgttaaaagggcttaaaatagaaacatttatgcattttgtcaatgaaaaacggaatgactgaaatatgaaaaaagtcttgcctgtgtaatgtcagataaccttaaagtcagataactttatataaaaataactgtaaatttaaataactaatttttgtcttatccattatgttattatatgtcaagctctttgaagttgggaccctgttttctctattgactaagaggcagatctttgtgtttagtagc

SEQ ID NO: 472449 - DNA, 779 bp, Homo sapiens
ggtgagggctttggaattagatggactgggtctatccagctgtcatgctaggtaacccactctctgagacaactgccatgtggtatgcccacgtcctaaccactgtaccatctgatggcaaggacaaggacaggatagaggaggaatcaacaggctgtggagaaggctccagcatgtccctcttcctcaagagccctcaggctgcaggagagggcagtgtctttgcctggaggtactgtcctgcatataacctgccctcctgtaaaactgtggttcatcctttgcattccaacagccaaatttcagtccacatagaagccaaagaatctggagatgctaacaatctgatgaggaaaaacaccagcaaagaggagtatgcatatttgtctgggttttgtgtgcaggtcattagcagcaccaaaacatcaccagattatgttctttccctggaacctatgctagtcaggagcatgactggggcttcggccgcatgtgaatggtggcagcgttttctgacccaaagtccaggaatccatatggatgatctggaaagggcaagtgggttgggacacgtgaacaaaggaacctgtctgttctacttggtgtttttcaaatctatccaagcatggaatatgttttccttataacgcctgttaactgcattacattttggaaaacgttctatttatatgtggttattttcaaataacagtgtagtgagtttggttctaagtgtcttaattttttttgtaattgttcatattcctttgttttgagga

SEQ ID NO: 472450 - DNA, 1114 bp, Homo sapiens
ctcccttccctctactcccagagcccgcccggcaggaccaccgagcaaggccttggaaaaccagagagattagagcggtgagtcgcgccggtcacgttggacgcctgcgcgttaggagattctggagccagaacagcggaattgccttcgcccgccctgcccctcgcctgcttcagaagcttccaggaactcccgggtcggcgacccagcccgagccgcctggggccccaagggaagctgaacgccctgtgggctcctgggatggttcttcccgttctttgcgccgccttcacccattgaagagcctgtgcccaccctgcccagtcgctctcggggccgcggaggagcttccgctgccatcttcggatcctgtgttccgcacgggggctccaccagggcagggatggtgcagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttccattgtctgtctgttaaataaataaaacccttttcatatatctttaaacttactgttatgtagttttactttatgcactataagctttgtgattcattattacttttatttattacttgcatccctgaaatccatcaaaagcccgggagagacaatcaagtgcttcaggatcaagagctaaacaggggaggacaaagcggggctccttcactaggagtcaagccaaagtcaactgatttggtctccaatggagaacagaactcggttcaccagcgacgtgaggacgcggcccagaggaggcggactttctcttcatggtgccttcagataggaaatctaggattttctttctttccctttgatctacttccaactctccctttctatttcttcaagaactttttcggatccctagctgggaaggacctaaggggccagtgcccttccctactggtccctccttgactgggtgtcttcggagcccaagctcaccctgaacattactgccc

SEQ ID NO: 472451 - DNA, 573 bp, Homo sapiens
tttgctgattgagcggtagagggaggcgatgttcgctgacccaacaaggacagcaggtggagtaggcacagatggaaaactgctgccggtgccctaagcagaaggcaggtggaaaaatcagcactaggacgtcgaagcgatggtaccacagtcaaatcccacgacgtctacactctaccaagcacttgcgcacgctcccccttttccattcagtactcccaagaggggttcggaagaaccccgagtccactgtaagctcaggggagagcgggagccagggaggtgaagtgcgcagactcggcagaggcggcgggcagaaccgcggggggacagtatggcgctgtggggccaggggtaaaccctgctttccggctttctggctgcagataaaggcctcagctggtgcaggaatcaaaagcaaaccaaaagacacgtgggttcgccccaccggtgccctctgcacgggcatcctgggctgtcccattgtctagtcctggtctcccctgcttctccctcctccttttcacgttttcccttttgactcccctgcctctttcccgctcccgccccacc

SEQ ID NO: 472452 - DNA, 1489 bp, Homo sapiens
atatgtccctttgctaattgttcttttgcccatctatcaggatgagcatccaggccccacccagactcctggagctggcagggcagagcctgctgagagaccaggccttgtccatctctgccatggaggagctgcccagggtgctctatctcccactcttcatggaggccttcagcaggagacacttccagactctgacggtgatggttcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgacgagaatttctgggccagatggcctggagcctgggccctgtcctgcttcccagagaccacgagtaagaggcagacagcagaggactgtccaaggatgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccgattaaatatctcagaaagtcattgaaaataatatacctgaatagtattcaagagctggaaattcgcaacatgtcctggtcacgtctgataagaaagcttcgttgttacctgaaggagatgaagaatcttcgcaaactcgttttctccaggtgccatcattacacgtcagataatgaactcgaaggacggttagtcgccaaattcagctctgtgttcctcaggctggaacaccttcagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctggagaaaattgctgcctctctcaaaaccctcatcttggagggctgtcagatccactactcccaactcagtgccatcctgcctggcctgagccgctgctcccagctcaccaccttctactttggcagcaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtatcagcgctggtctttggatgctccttggtacgagtgacttgggcaacatggttggtggtgggagggaggcagaatcctggacaggaagagacaagcaacccactctgggtctttttctctgctgagagctgt

SEQ ID NO: 472453 - DNA, 1345 bp, Homo sapiens
gagcacctccctagcatcaactctctgctctgagggtgaccctctcctcagatccttattagaggaaaaaaggagcagcccctgtcttctgcaagcatgtcaattgtgggaactgagaatgtaggctgtgtggggccacaggacattctcgttcccattgttttagggtggatgagcctccaggccccacctagactcctggagctggctgagcagagtctgctgagagaccgggccttggccatccccaccctggaggagctgcccagggagctctttcccccactgttcatggaggcctttaccaggagatgctgcgagaccctgacaactatggtgcaggcctggcccttcacctgccttcctctagggtccctgatgaagtcatgtaatctagagatctttcgagctgtgctggaggggcttgatgcactgcttgcccagaaggttcgccccaggcggtggaaacttcaagtgttggacttgcggaatgtggatgagaacttctggggcatatggtctggagcttctgcactctccccagaggccctgagtaagagacgaacagcagggaactgtccaaggccgggtgggcagcagcccttgatggtgatcctagacctttgcttcaagaatgggacgctggatgaatgcctcacccacttcttagagtggggcaagcagagaaaaggcttactgcacgtgtgttgcaaggagctgcagatttttggaatagccatccacaggatcatagaggtcctgaacacggtggagctagactgtatccaggaggtgcaagtgtgctgcccgtgggagctgtccattcttataaggttcgccccttacctgggccagatgaggaatctccgcaaacttgttctcttcaacatccatgtctctgcctgcattcccctagacaggaaggagcagtttgtcatccagttcacctctcagttcctcaagctggactacttccagaagctttacatgcactctgtctctttcctcgaaggccacctggaccagctgctcaggcccccttggagacagtcgtaatgaccgaatgcctgctgtcagagtcggacctgaagcatctctcttggtgcccgagcatccgtcagctaaaagagctagacctgaggggcatcacactgacccatttcagtcctgagcccctctcagttctgctggagcaagctgaggccaccctgcagaccctggacttagaggactgtgggatcgtggattcccaactcagcgccatcctgcctgccctgagccgctgctcccagctcagcaccttcagcttctgtgggaacctcatctccatggccgccctggagaa

SEQ ID NO: 472454 - DNA, 1038 bp, Homo sapiens
cccgtacactcatgatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgagggactaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctttcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactattgcagggctatgtac

SEQ ID NO: 472455 - DNA, 1825 bp, Homo sapiens
atccaggatgcataaagagatacctgccttgacagctcagtctgcaggagggaaacagaagctcagaaatattctagagaccctgagcaagtgcctgggggagctttggtattctggtggagattctgtggaacttcggaatctaatcagattcatcaagatgagcatcagggccccacccagactcctggagctggcaaggcagaggctgctgagggaccaggccttggccatctccaccatggaggagctgcccagggagctcttccccacactgttcatggaggccttcagcaggagacgctgtgaaaccctgaaaacaatggtgcaggcctggcctttcacccgcctccctctagggtccctgatgaagtcgcctcatctggagtcattaaaatctgtgctggaaggggttgatgtgctgttgacccaagaggttcgccccaggcagtcaaaacttcaagtgctggacttgaggaatgtggatgagaacttctgcgacatattttctggagctactgcatccttcccggaggctctgagtcagaagcaaacagcagataactgtccagggacaggcaggcagcagccattcatggtgttcatagacctttgtctcaagaacaggacactagatgaatgcctcacccacctcttagagtggggcaagcagagaaaaggcttactgcatgtgtgttgccaggagctgcaggtttttggaatgcccatccacagtatcatagaggtcctgaacatggtggagcttgactgtatccaggaggtggaagtgtgctgcccctgggagctgtccactcttgtgaagtttgccccttacctgggccagatgaggaatctccgcaaacttgttctcttcaacatccgtgcatctgcctgcattcccccagacaacaaggggcagttcattgcccgattcacctctcagttcctcaagctggactatttccagaatctgtctatgcactccgtctctttcctcgaaggccacctggaccagctgctcaggtgtctccaggcctccttggagatggtcgttatgaccgactgcctgctgtcagagtcggacttgaagcatctctcttggtgcccgagcatccgtcaattaaaggagctggacctgaggggtgtcacactgacccatttcagccctgagcccctcacaggtctgctggagcaagttgtggccaccctgcagaccctggacttagaggactgtgggatcatggattcccaactcagcgccatcctgcctgtcctgagccgctgctcccagctcagcaccttcagcttctgtgggaacctcatctccatggctgcccttgagaacctgctgcgccacaccgtcgggctgagcaagctaagcctggagctgtatcctgcccctctggagagttatgacacccagggtgctctctgctgggggagatttgctgaacttggggctgagctgatgaagacactgagggacttaaggcagcccaagatcattgtgttctgcaccgtcccctgccctcgctgtggcatcagggcctcctatgacctggagcccagtcactgcctctgttgaatgcctgccatcagggtggatatatttcaagctttcttctggtcatttcggagctgaaacctaggccatgagtgcatgttaaagggagcacagacccatcgtttcaaatgcctcctcagtgtgaatgggaaaggaatgaggatgcaggaggggcaggactgggggaaaagttgacttggagtggatgggctctttagagacctgtgtcccagagaatcagaaatgggaatctgaattgct

SEQ ID NO: 472456 - DNA, 3234 bp, Homo sapiens
ggctgtgaatccaactggtcctggactttttttggttgatctcaagctgcatgctgggagaacgactactctcttcaaagctgtcagacagggacatttaagtctgcagaggttattgctttcttttgtttgtctgtgccctgcccccagaggtggagtctacagaggcaggcaggcctccttgagctgtgatgggctccacccagttccagcttctgggctgctttgtttacctactcaagtctcggcaatggtgggggcccctcccccagccttgctgccgccttgcagtttgatctcaggctgctgtgctagcaatgagcaaggctccgtgggcacaggaccctccaagccagttcaaactgtcaccatgcaacctggtgtcagtggaagaatgagcctccaggccccatccagactgctggagctggcagggcagagcctgctgaggaaccagttcttgaccatcttcaccctggatgagctgcccagggaggtcttccctctgatgttcatggaggccttcagcatgagacgttttgaggccctgaagctgatggtgcaggcctggcccttcctccgcctccctctgggatccctgatgaagacacctcatctggagaccttgcaagctgtcctgaggggacttgatacactggtggcccagaaggttcgccccaggaggtggaaacttcaagtgctggatttgcgggatgttgatgagaatttctggaccatatggtctggagccagggtcctctcctgctccccagaggccatgagtaagaggcagacagtggaggactgtccaaggatgggagagcgccagcccttgaaggtgttcatagacctctgcctaaaggaaagtacactggatgaatgcctgagctacctttttgggtggatccactacagaagaggcctagtgcacctgtgttgtagtaaggtgcagaattactcaatgcccacttcaagtttcagaaatctattggaaaggatatacccagacagtatccaggagttggaagtctggaaaaagtgctctctcaataaaacgggaaagtttgccccttacctgagccagatgagcaatcttcgtgaactctttttagccttcggttatgagcgtgagttgtacgtgagcgtccagtacctcaagaaccccttgggggcctttatattcagtgatgcttacctaactgatcgggacatggagtgtctgtctcagtacccaagcctcagtcagctaaaggagctgcgtctgattcatatcctaatgtggaccaccaatcttgagccccttggagttctgctggagaaagttgctgctactctcaagaccctcgtcttaaaggactgtcggatccaggacccccaactcagggtcctcctgcctgccctgagccactgttcccagctcaccaccttcaactttcatggaaatgagacctccatgaatgctctgaaagacctgctgcgtcacacacgtgggctgagcaaattcatgaagatgagcatccggactccacccagactcctggagcttgcagggcggagcctgctgagggaccaagctttggccatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggcttgatgcactgcttacccaaggggttcgtcccaggaggtggaaactccaagtgctggatttacaggatgtctgtgagaacttctggatggtttggtctgaagctatggcccatgggtgcttcctcaatgccaagaggaacaaaaaaccagtgcaggactgtccaaggatgagaggacggcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttacccagttcaccactcagttcctcaagctgcgctgcctccaaaagctttatatgaactctgtttctttcctcgaaggccacctggaccagctgctcagctgtctgaagacctcgttaaaagtcctcacaataactaactgtgtgcttttggaatcagacttgaagcatctatcccagtgcccgagtatcagtcaactaaagaccctggacctgagtggcatcagactgaccaattatagtcttgtgcctctccaaattctcctagaaaaagttgcagccacccttgagtacctggatttagatgactgtggcatcatagactcccaagtcaacgccatcctgcctgccctgagccgctgctttgagctcaacaccttcagcttctgtggaaatcccatctgcatggccaccctggagaacctgctgagccacacaatcatactcaaaaacttatgtgtggagctgtatcctgccccccgagagagttatggtgctgatggtactctctgctggagcagatttgctcaaattagggctgagctgatgaacagagtgagggacttaaggcaccccaagaggatcttgttctgtactgactactgccctgactgtggcaacaggtcattttatgacctggaggcagatcaatactgctgttgaatgcctgcctatttggatgggtatgtcaaacgctttcttctggacacttggaaactaaaacctaggtcttaggtacatcctaaagggagcacagaacccatcatttcacacataggctctgaaagtgggaaaggaaagctgatcaagcaggggccggacttgggggaaatgttgccatggattcgatgggactttggggacctgtgtcctgtagattcgaaaatgggaatctgaatgtctagagtggaattcaggcttgagaatacatgagggagttactcttgcatggatgg

SEQ ID NO: 472457 - DNA, 624 bp, Homo sapiens
tgtcgccaaggtagcaatttagtgactatacccatggggaagaaaactactctccatgatgctctaatggtggatacatgtcattatccctttgttaaaatccatagaatatacaaaaccagcaatgatccctcatgtgaactatggacattgggtgataatgatgtgtccctgtggctcattggttgtgatgaatgctctgtgctggtgtgggtgctgatcctgtgggggtgctgtgtattgaagggggaagaagatggcacccgagacatacggattggaaattttgatcttattatgaatgaatccagtccagaaatgcccaccctgccccctgctggctcctggggctctgctctttgggggaatcatgataaaattgtggcagagagtagaagttgagccccattgcatgccctgagttcttgttgcctctctattatcaggaaaaggagggagagaggggatgtgttatgagaaaatctctcatcaatctgacctagctccccaaaaagatgtaacttttaaaatgtcagatggaaatatttaaaaagtgttacatgcctgtatagttttagtattttacttaaagggaatgtggctgtctttactggctacaaccag

SEQ ID NO: 472458 - DNA, 2128 bp, Homo sapiens
agatccttgaggaattgccacactgtcttccacaatggttgaactaatttacactcccaccaacagtgtcaaagcattcctatttctccacatcctttccagcatctgttgtttcctgactttttaatgatcaccattctaactggcctgagatggtatctcactgttgttttgatttgcattagagaagtgcaaatcaaatgaccagttatgatgagcattttttcatatgtctgttggccggataaacgttttatttttgagaattgcctgttagtatccttcacccactttttggcggggttgtttgtttttttcttgtaaatttgtttaagttccttgtaggttctggatattagtcatttctctgatggatatattgcaaaatttttctcccattctataggttgcctgttgactctgatgacagtttcttttgctgtgcaaaagctctttattttaattagatcccatttgtcaattttggcttttgttgccattgcttttggtgttttagccatgaagtctttgctcatgcctatgtcctgaatggtattgcctacgttttcttctatggtttttatggttttaggtcttacatttaaatctttaatccatcttgagttaatttttgtataaggtgaaaggaaggggttcagtttcagttttctgcatatggctagccagttttcccaacaccatttattaaatagggaatcctttccccattggttgtttttgtcaggtttgtcaaggatcagatggttgtagatgtgtggcattatttctgaggcctctgttctgttccattggtctacatatctgttttgataactgtaccatgttgttttggttactgtagccttgtcgtatagtttgaagtcaggtagcatgatgcctccagctttgttctttttgcttaggattgtgttgtgtatacaggttcttttttgcttccatatgaagttttaagtagtttttctaattctgtgaagaaactcaatgataccttgatggggatagcattgaatctataaattactttgggcattatggccattttcacaatattgattcttcctacccatgagcatggaatgtttttccatttgtttgtatcctcttttatttcattgagcagtggtttgtagttcttcttcacatcccttgtaagttgtattcctatgtattttattttattttagcaattgtgaatgggagttcactcatgattggttctctgtttgtctattgttgatgtataggaatgctcgtgatttttgcacattgattttgtatcctgagactttgttgaagttgcttatcagctttaggagattttgggctgagacgatggggttttctaaatatacaatcatgtcatctgcaaacagagacaatttgacttcctctcttcctatttgaatactctatttctttctcttgcctgattgccctggccagaacttccaatactatgttgaataggagtgatctgatgttgaccttagttgaaggtctgggatttgaaaactgctgggattggaatcctggctctcaccttactcccacctacaccagtaggatatatagtccatgggaagcatctgggaacatctatcgtgctcgcatcccttatgccaagagacccaccaaaaaagaaagtcccaagaaacaggaaggaacaccaccagcaagagacctcacactcacagacctcagagatattcatggcctgaggggcacaaaggagagtgtgttgggagcggatccccacttagaaagaagcaagacagtgccccaaggcctggaagatgtcagctgcttcctctgtgctgtgctgtggggaaggccatcaccgttttaacgcctcttgagtctcagatccaagtccccagtttatcagggatgtggctctgtgaaagccagagaacccggtccccagggctgctgccatctctctcctcctcatttactctggcccccatcagctcctctgggccactccctttctggagtccccctggctccatccggcggcagtccagagcagcagctgaggagctccctgctttatgccttgctgtgggcactgaaatagctcagtagaatttggggagaatgtatg

SEQ ID NO: 472459 - DNA, 1142 bp, Homo sapiens
gatggtaatgcctatccaggaggagtcgtggggaccctgcctcatcaaagtgacccttgactcaactgctggaggagacttggatgagagcctggggcatctgagtggggttacatcagcacagagagagattactaaatatgacgtgcagaagccacttggtccagatccttcctgttccccaggaaggcttctggggaacagccttgctatcattaagttcccgctgaccaccaagtctgccatgaagaagacagaagacaacaacacacttgtgttctctgtggatgttaaagccaacaagtatcagattgcaggcatgagccactgtgcctggctgaatattcttaaataataagacaaatattcattataccaggcttttccttttctacctttacaatgagtaagaactttttgcccagttgttgcccaatctgtgtcccggagatgccctttccagtcttttcaagaatggtaggatagggtgtcattaaaatgtgagccatatagaaaaattaatgttgtgtagattttatacatcgtgtgaaaataacttgagtttctctcaagaaagccataaaatgcaagatacgcacaaaggttaattacaaacaaatcgttcagaacaaagagaaagctcagatttatttcattttgcctggagaaaggtagccctgagttctaacacagtgtactgtttaattatagtagccttccaataattttaacatctgatagtgtaaatcttggttctttgcatttccacatatattttaagtaaacttgtcaatttctgcaaaaaaaaaaagcagataaaattttgattgggaatgaattaaattaaaagatcaaattggggagaatttatatttttcactatcaagtcttccagtctatgagaatagtattctgcatgtcttttagtgttctttaatttccctcaataatgtttcatagttttcaatatagagatctcaaacatttttcagtagattaattcctagctatttgaggttttgaagtgatattataaatatctttttaattattttaattcactttttacatttacacacagtaaagtttaaaattttggtgtgcaactgtataagttttgataaagtgcatatagttgtata

SEQ ID NO: 472460 - DNA, 1119 bp, Homo sapiens
tgccatctcaaaagtttttcactggagatttgtcagaatgagcctccagtccccatccagactcctggagctggcaggccagagcctgctgaggaaccagttcttgaccatcttcatcctggacgagctgcccagggaggtcttccctctgatgttcatggaggcctccagcatgagacattttgaggccctgaagctgatggtgcaggcctggcccttcctccgcctccctctgggatccctgatgaagacacctcatctggagaccttgcaagctgtgctgaagggacttgatacactgctggcccagaagcttcgccccaggaggtggaaacttcaagtgctggatttgcgggatgttgatgggaatttctggactatatggtctggagccagggccctctcctgctccccagaggccatgagtaagaggcagacagtggaggactatccaaggacgggagagcaccagcccttgaaggtgttcatagacctctgccaaaaggaaaccttcggttatgacgatgagttatatgtaagcggccaacagcagttcgttcctgacttggactgtccattcctctgcctgtactaccctcagatgctttatataagaaagatcagtaatatcaaagagcacctggagcacctgctcaggtgcctcaagaaccccttgggaacctttatattctgtcatgcttacctagctgatcaggacatggagtgtctgtctcagtacccaagcctcagtcagctaaaggagctgcatctgattcatatcctaatgtggaccaccaatcttgagccccttggagctctgctagagaaagttgctgctactctcgagatcctcacgttaaaggactgtcagatccaggactcccagctcagggtcctcctgcctgccctgagccgctgctcccagctcaccaccttctactttcgcggaaatgagacctccacgaatgctctgaaagacctgctgtgtcacacagactcagaaatggaacctgaagttcttgagtgatgcagaagttaccctcacaaggatggttatgtaaaaatgtcaaaaataaatggaatctgaatggaaactttctggtgtcttccatgattgat

SEQ ID NO: 472461 - DNA, 2243 bp, Homo sapiens
gcaggcactcggcaggctgaggcagattcaggaagatgagcatccggactccacccagactcctggagctggcggggcggagcctgctgagggacgaggccttggccatctccaccctggaggagctgcccacggaactttttcccccattgttcatggaggccttcagcaggagacactgtgaggccctgaagctgatggtgcaggcctggcctttcctccgccttcctctggggtctctgatgaaaaggccttgcccagagaccttccaagctgtgctcgatgggcttgatgcactgcttacccacagggttcgtctcaggaggtggaaacttcaagtgctggatttacaggatgtcagtgagaacttctggatggtttggtctgaagccatggcccgtaggtgcttaccaaatgccatgatgaacagaaaaccagtgcaggactgtccaaggatgagaggacagcagcccttgactgtgttcatagacctttgcctcaagaacaggactctggatgaatacttcacctgcctctttctatgggtcaagcagagggaaggtttagtacacctgtgctgtaagaagctgaaaatgttgggaatgctcttccacaatatcagaaacatcctgaaaacagtcaacctagactgtatccaggaggtggaagtgaattgcaattggacactgcccgtcctggcagagtttaccccatacctcggccagatgaggaatcttcggaagctcgttctctctgacatagattctcgctacatttccccagagcagaagaaggagtttgttacccagttcaccactcagttcctcaagctgcgctgcctccaaaagctttatatgaactctgtttctttcctcgaaggccacctggaccagatgctcagctgtctaaagacctcgttaaacatcctcgcaataactaactgtgtgcttttggaatcagacttgaagcatctgtccaagtacccgagcattggtcaactaaagaccctggacctgagtggcaccagactggccaatttcagccttgtgccgctccaagttctcctagaaaaagttgcagccacccttgagtacctggacttagatgactgtggcatcgtagactcccaagtcaacgccatcctgcctgccctgagccgctgctttgagctcaccaccttcagcttccgtggaaatcccatctccacggccaccctggagaacctgctgtgccacacaatcagactcaacaacttatgcctggagctgtatcctgccccgcgggagagttatgatgttcgtggtatcgtctgccggagcagatttgcccaacttggggctgagctgatggggagagtgagggccttaagggagcccgagaggatcttgttctgtaccgactactgccctcagtgtggcaacaggtcactttacgacctggagagcagatacgtgacctactttgatgtggctacggacagacgctccaacctcctggaacattcaaaaccttcttttgtccctggagggaaaaatggatcccacaccggggccgcaggtggagctgcctgccagtcccgcaccttgcgcctgcactcctcagcccttgggcggtcgatgggactgggtgctgtggagcagggggcggctctcatcggggaggctcaagctgtgcaggagcccatggtcgggggtgctcaggcatggcaggctgcaggtcccaagccctgccccgcagggaggcagctaaggcctggcgagaaattgagtgcagcaccagtgggcctgcactgctgggggacccagtgcaccctccgcagctatggcccaggtgctaagcccctcactgccaggggacagcggggacggccgggccggctggcctctccaagtgcagggcccgagcccacgcccacccgggattcacgctggcccacaagcaccgcacgcagccccggttcccacccacacctctccctccacacctccccgcaagctgagggagccggctcctgcctcggccagcccagagacgggctcccacagtgcagcggcgggctgaagggcccctcaagtgcggccagagtgggcaccgagcccgaggaggccctgagagtgagcgagggctgccagcacgctgtcacctctgagctctatctccactcactgctacctcagccccccgggttcaagtgattctcctgcctaagcctctttgccaaagtgctaagattataggcttga

SEQ ID NO: 472462 - DNA, 1086 bp, Homo sapiens
gagagccgcttccttctcgccgcggccggcgcgggccccccggccatgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaagggatcatctccctgggctttgggtcctaggactggcgggtgtggattacttatgcgtctctgagacagctcagagcccagactggcaccaagctgcttgccttcaaatcctgcctctacttcttactgattgtgtgatctttttgtacccgtttcctcatctgtaaaatggggctgatacagtatccaccttctaggcttgttaggaggattaaaagggcattatttataaaggaccgagaacagtgcctggctcacagtatatactatggaagtaacctcacttctgtgtccccacctgtgacagtagaaggtcagataatggcgaggtcttctccacctgtgtaggctcatttctcatgaaacctctccttgcccaccccaaaggccccaccccgaggtcacttcccc

SEQ ID NO: 472463 - DNA, 2238 bp, Homo sapiens
ggggagatttcaataaagaccctagtgtcaaccaggagtcttgcccccgatccggttcccttctttaagccagttttatggtgtgggggctgagttttcaaggacagaccctattggattctttaaaatgcgtttctttgattcccctgctgcctgcacctgcctctaagccttcttccaaaatctctcccaacagaaccattgttcctcctccatctaaagacaagaccaagatagcgatggtaaaagttaaagacttaaaacaaactttggcaattgagacaggataccaagatgtaaatgcctggttggaatggatcaaatattccgtccacgcgttaaacaaaagcaattgttatgcttgtgcgcacggcaggccagaggcccagattgtcccctttcaactaaggtctttcaactctcacgtccatttagacacaattaaagtcccatggggaataccagatcgatttaaagtccaaaatcaaatagctgcaggatttaagtcaatatgttggtgggtgacaattaataaaaatgtacattggataaactacatctattacaaccaacagcgatttattaactacactagagatgctgttaaaggaatagctgagcaattaggggccactagccagatgggttgggaaaataggatagccctagacatgatattagcagaaagcggaggagtttgcatcataattaaaactcaatgttacaccttcatccaaaacaacaccgcccctaataaaagtataacaaaaggattgcaaggtctgactgctctgtccaatgagttagccagcaattcaggggtaaatgacctctttacaggatggctaaaaaaaggtacttcggtaaacggaaaggaataatagcctcaattcttacttccctcgcgtccgtaataggtgtacttattcttgaagggtgctgtgtcataccatgcatccgtaattaaatgcagaggctcataaaaatggcacttactaaaacctcccttaactatcttccaccttatccagagaagcttcttcttttagaaaatcaagcaaaacaactaagccaagacatgttaaaaaaaaagtttgaaaagaaagctgtaaggaaatacaaggggagggattgttagatatgagttctaaatttcttttcaaaaaatcgatatgtcagtatgttcaattctttgccttctacttttaaacttcctcataaagcaacctttttcaattacctgctccaccctgactcattctgatcacctgctccaccctaactcattccaattatctgctacctgctctgccctgactccctccaaagcactcaccccgtcattctctttaaattagccaatcggaattagtttagcctgtgcagtctaaccctagccaataggggaaggacacagcagcaggggccatgtgtgtcaggaataagaaccccttcccctcccttgtccaagtgtgcactcaccattgttccatctgtaaaggcacaccgttctatagagaagtaacttgccttgctgagaattaaaaagaaaattttatatttgagtgctatttcttttgaggcaccgaaacttcatatataacaagattaacaacaataataaaatagaaccattaacataccagcatcactacttttgcgctttgggggcaattattaagtaaaataaggctggaacacaagcactgcgataccacgactgtcaatctgatcacctaagatggctacaaagtgactaaaaggcagatagcattgacaacgtgaatacgctggacaaaggggtgacccttgagtcctgagactcaaagactttggtgtgctgagagaaagggagcacaacagctcaagatttcatctgctactcagaaagctgagcagggtctcatgcttccagatcccctgtgtttcacttcagctcctttagctaaccgagtctcgctgcccaaggcccatattccttctctcatgagctgctggctctatctggtccaggagggacccccagctgaatgcaattccttattacctcccactcctccatcctgatcaaaaggtcatgtgaccaaccttctagattctagacacatccgggggtgtgggatagaaggcaggtgtccttgaatcatgacctagcctcagcatccctctaaattagttgcatgtaacccaatctcccccacctaggcttcactgtgtttcaatctttttgaataaagc

SEQ ID NO: 472464 - DNA, 742 bp, Homo sapiens
cacagtgttgggggtcagcatgtttgagtgaacatcctggctcccggagaggcagcaaggcatagtgtggtaagggacatgggacctggagttagcctatccaagttcaaatcctggatctggatctaccacttcacagctggaggagttgtggttacttcttgggccctgtgctggttccttttaaagaggagagagaacaaacagcagcaagctggggcagggtcttctgggaactgttataaacccccgatcgctttcagaacaccttataaagtcaacctgtgtgcacacagacgcatgacattgaaaggtccccctggccagatcaccaggaaagctcctcatgttgcaaggccactggccagccggagctcaaataccagtagtatcagctggaccacaattccaaagctgcctgatgatcaacagaatgggctgccctggagtattgagaaacctgtggttagaggtattcaagtagaagcaacagaacaggctgtggtgggaactacagaacggcccccgaattcaatagacaattggcctgggaggatcagagcttccgcagttcttccaggcactatcttatctctcctctcaccccttacatgttggaggtgaattttggctttattgactcagggaggagttaggctacttctcagggcctggaatggtctaaagtaacacctctcagaatctggagatactttttggcccgtggagtacttcatgctgt

SEQ ID NO: 472465 - DNA, 515 bp, Homo sapiens
tatcacactttcctctgctcagctgtgaggaaaactgtctgatgacacttattgaaatggggatcagaaggctccaagttctgatcacaacccagaactacgttacaatcttcatgggacctagttgtgataaccaaaaatgcccatggaagggtgaggaaggagacctgtctttggttaagaaccatcggtctaggattgactgtgtaacccagagaggcaactcagcttcatggagcctcagctttgtgccaggcctttgcccaactgtggttggcagaatactgtccctcaaagatgtccacctcttaatctccagaaactgtgaatatgctactttacatggcagacgagctccgcagaatgtggtcaaggtcatggcctcacttcatatgtgggccagttatgtttactctgtgttaagtgcctggtctatggtcctgatctggccaaccattaaagaggaggatgcatgcaatgcctaacacatagtaggtgcttaagaaatgtgtatc

SEQ ID NO: 472466 - DNA, 720 bp, Homo sapiens
tggaaacacaaccatggaattgtcccagcaggaagagactctggctgcccaaggagtgacatcaagatattggtggaaattccagacaacacctggtttgatctattatttacattcccacgtaatttttacatcttttctggattttaaaattatctctgccaactacccattcctccgctttgctatcaaatgtcgccttgcttatcaagttactccctacaaagtagggaaaacaagtatgtcacagagcagtagccatagacaaaaaacaaacaatagcaaaaaccaaggcaccttctgcctctgggccttgcactggctatttcctgcatctggaatgttctttgctcagatattcctgtttcacaatccactgaagcatccttccataagaattcaaagtcagttatatttggaccaggtacctctgggcccagtgaaggaagacgggcatctaccatctactgatgttaaacttaaccttgagagcttctgggctgagcttatgagtcccgataaaagtctacggatgggaaggaaaggctctctgcctctccagcaaggaaaaatctgcctgctcccctacagacccatgggctgcctggtcttctcatcgtgaaaacccacagataacatgcgggaaagaagatttttttaaaaaggggttagagctgaatgtttttcattggtgactcttcttacctagtgttgtctctg

SEQ ID NO: 472467 - DNA, 682 bp, Homo sapiens
cctccagcaaactccaacagacctgcagctgagggacctgactgttagaaggaaaactaacaaacagaaaggaatagcaccaatatcaacaaaaaggacatccacaccaaaacccaatctgtagttcaccaacatcaaagaccaaaggtagataaaaccacaaagatggggagaaaccagagcagaaaagctgaaaattttaaaacccagagtgcctcttctcctccaaagaatctcagctcctggccagcaatggagcaaagctggacggagaatgactttgacaagctgacagaagtaggcttcacaaggtcggtaataacaaacttctccaagctgaaggaggatgttcaaacccatcgcaaggaaattgaaaaccttgaaaaaagattagataaatggctaactagaacaaacagtgtagagaagaccttaaatgacctgatggagctgaaaatcatggcacaagaactacatgaggcacgcacaagcttcaatagccaattcgatcaagtgggagaaaggaaactctacaagccagaaaagagtgggggccaatattcaacattcttaaagaaaagaattttcaatccagaatttcatatccagccaaactaagcttcataagtgaaggagaaataaaatgctttacaaacaaacgctgagagattttgtcaccacc

SEQ ID NO: 472468 - DNA, 930 bp, Homo sapiens
agtccagtggccgtgctagttgcttttaactggctgacagctgcctggtatttagcacctgagtttgaaggaaaaataggactgaatagcaagtgaaaggggtccgatggtactcatcgcttggcgataggtgatagtcccatctgggttgccaaaatgtgtccggaattggttcctttctgtgagttcttggtctcgctgacttcaagaatgaagccacgtaccctcgtggtgagtgttacagttcttaaagatggtgtgtctggagtttgttccttcagatgttcagatgtgtctggagtttcttccttctggtgggttcatggtcttgctgacttcaggattgaagccacagaccttcgcacatggaaggggacccaagtgggttgctgctgctggctcaggtggccagcttttattcccttatttggccccacccacatcctgctgattggtccattttacagagagctgattggtccattttacagagagccaattggtccatttttacagagtgctgattggtgcacttacaaacctttagctagacacagagcactgactggtgcattcacaatcctttagctagacagaaaagttccccaagtccccacccgacccagaagcccagccagcttcacctctcaaaactactgcagtgatccaggaaaaaaggtgatggtgactcagaccaggatggctgtagtggcaatggggagaaacagttgactacttcataggttttaaagttttctttttggttctctaagataactgagtggacccaggtgatgaggcttaggaattcagctgactggccctgtacctggctctcatggtaacttgtatttaacacttgtcatatggttatgaaataattatttgagtaatttttaaatgtttgtttatcagactgggctgcttttt

SEQ ID NO: 472469 - DNA, 776 bp, Homo sapiens
aagcagctgccgccaccgccgccatgagttgtccggtccagcatttcttctgttgggtacacctcccagacggggtggcggccgggcagaggggctcctcacttcccagaaggggcggccgggcagaggcgccccccacctcctggacggggcggcggccgggcggaggcaccccctgcctccctcccggacggggcggctggccgggcgggggctgccccccggcctccctcccggcccccctgaccaaattcttatgttgttttttttataccaatgcgagaactgactaatgaagaaaatagagacctttgcagcagcccctcctatcacagacccagaggcctaggaggggaggatggttttgtggtccaggcccatgaccctggttaccctgcatggcctcaggacactggtccctgcatcgtagccactccagcttcagccatagctcaaagggcccaggatagtgtggagggtaaacgtggggttggagcaccccccaacagagtccccactgggacactgcctactggagctgtgagaagagtgccatcgtcctccagaccccagaatggaggatccactgacagcttgcaccatgcacctggaaaagctgcaggcattcagcacagctatctcaacactccagccacctcagtcgctctctatcattttcaagactaagctgaagttcattatgcttggtttatgtaactcacatgtcatctattacccattgagagctaaataagttcattccacacacaggggaa

SEQ ID NO: 472470 - DNA, 893 bp, Homo sapiens
agccggcgcatggtgaactcgctgctgttcggggagatggccttggccttcggctgcccgccgggcggcggcggcgggggctgccctggcgggggcggcggcggcggcggggcagggccgggtccgtcgccggtgacggcggcgctgcgggacgacctgggctccaacatccacctcttgaaggggctcaacgtgcgcttccgctgcttcctggctaaggtgcacgagctggagcggcgcaaccggctgctggagaagcagctggagcagcagcagagcgagcgcgagcggcggctgcgctacaagaccttctcccgcgagcaggccgtgcagaccgggcccgagttgctgcggcccccggcgcccggcggcgggcacggcctcagcagtggcgcggcggccggcgccaacgccaatgccgtggccctgggcggcctgccccccggcggcggctcgcacccgcagcactacggccgcctgcccgggaccatctggagctacacgcaggtgcggcgcacgggcggcggcggcgtggagaccgtgcagggccccggcgtgtcgtgggtgcaccccgacggcgtgggcgtgcagatcgacaccatcacgccggagatccgcgcgctctacaacgtgctggccaaggtgaagcgcgagcgcgacgagtataagcggagcttctggcgctggcctggaatgagacggtgctgctgagacaggtggagtgcgggcgtctctcttcccgcccttctgggatgcgtgcacaccttgtcttccatttattttctgaagttaactcaagactcatgttggatttttccaaagcaggtatattcctttcctggggcctcagtttccccgtctgtgaagtgaggttgagggggggctagaattgc

SEQ ID NO: 472471 - DNA, 777 bp, Homo sapiens
ataaatggcttagtgccatccccttggtgatgataactacttggaatgcatgcggactgcacaagtgaagggctcagtcccccaaaactgcctgacttcagacactggtcccaggagatcacccagacttctgaccaattggctacaaatcgagagttctcctgaccccgcctcaggctcaatatttcacttgcatgactcgcagattttaggaaaacacttcatttatgtttgctggcttgttacaaagggtacaactccggaacagccagatggaaggaggtgtctccattgctgcgacttctgtttcagcagaaataagatgatgaaacttcaggggacctgccctgattcccttggagggttttccctgacacgtgagagagtcatttgtaaaccagcagtcagagtgaactaggttgacagaagtcatttcaaaacacgctcctccagtccatgtttaatgttctacttttgagttgttgagggaggagctacagtcagagcaggagaggggctggccttggaattcaaagctggattcaaagcttagctatgccatgaactgtgtgttcttggagaagccctttctcccctatgagcctcagtttccccatcagatggtcttttttggttgtctccatcagctcccctggagcccctttagctccttcctctgcatttaatgcaggatttgtgccgaagcaggtgctccacaagtcatcacggaaagtctgaatatctccagggcccagggcagggctgcccccaccctca

SEQ ID NO: 472472 - DNA, 784 bp, Homo sapiens
gactttagcgctgagtttcacggtgcagcaaccttttactcattcattggagacacaagcttaaacccattttggtggtggtgctggtgagagaatggcaagggcagagggcaggcaggtaacttttgcttcttccaacccaggatctcagcaacctggaatggatgtggctccctcggaagcaaagtcagatagtggcatttattgggtaacctctgtggctcttttgagcctattcttggcatggaccccatgccaggaggggaaggaacagatactccccaagttacctccagccctccattcaaagagctcagtccgaccaggaaacaaggcagccatgggcagcttgctggcagtgcctgaattagttcccgtgaatctcaagcaatcaaacaaaaccaagggcacaggcagaggcctgtggggaccgccaggggggactttgcacgggagcatcaaagtattggggtttgcttcattatcaaggtcatgcttgggaattttgcaaacaacaaggagccctcacagcaaccctgcaaagccagattatgatgctatttttccagacagaaacaaaacagagacaaatctgtcttctgatcctgggttcctctccaccaagaccagcgtttttcaagctgcaggttgtgacccatgagcgggatgtggagtcaatagttggctccacttccggctgcagagttctgaccccaggcagctcccagggctatgagcctccctgtcccctccagcaggagagagaagctctcaccttagcatc

SEQ ID NO: 472473 - DNA, 673 bp, Homo sapiens
cacagtgggtttgtttacaccagcaccaccacaaacacggcctgggcatggagaagccactaagggatgttcaaaaatgaaggtcagagaatccagaacgctgatgttagaagtcaggagaacttggatgtcccagctaaagaagaaagagaaaattcacccttcctctgccttttgttctattcaggccctcaagggattgaaagatgcctattcacattgtttctcaaggtggttgatccagatatctgcagtatacaaccaccttctgttgactacatccatatcggacagctagacaaaggctatttgactgacccccacaccctgcatggattgcacaaatatgctgcagtgaccaccactcagtcatggtgtggctccacaggactcatcccttccatccaaggtgtgctgccctctgctttccgggaccgctttaagaaggaactcaggcttggcattaccatggcagcagatgctgactgcatatttgttccttacctggcctaccccagggattcacctgtctcttagcccaatcaggcagtatcttactaatttccttcgacactaggcttaaatatagagttagcatctttggtggaaataacttattgaaaatgttgttttagagaaaaataagactttctttgccttgactcgtatttac

SEQ ID NO: 472474 - DNA, 1652 bp, Homo sapiens
ggctttggataacaccaagtcctgaggtttgagcctccatgaagtgttacagctctcatttgttcctgctgcccgcagctcgcccgcagctcgcccgcagctcacccgcagctcggcaaacaagagtgtgtggtgcccaatggacgttttgcttaagcaatgtcaaggtaacaggagaaacagcttcttcagaccaagagacagcagaagagtttccaagtgacattaagaaaatcattgagaaaaaaagatatgtgtatgaacaggtttttaatgcagatgaaagacctttaaagcttattacacatgacactctatggaaaggatcatcgatgttatggaagagaaccccaatagagaataacatcatgaaagtctggaagaattacagcattgaatatgccattgttgttatagaaaatgtcatgaaagccatcaatcccaaaacaataaatttctgtccagatgttgtgcatgacataggatttaaaacagagccaatcaaagaaattatgaaaaagattgtggatatggcaaaaaaaataaaagatgataacatgatggaggtgagtgcttccaaatcagtgccaaatgatgaggaagaagatgcagaagaaacagtgccggaaaacaaattcacttcaagcaatcttgcagaagagttctgatttttctaagaatatagtatgtaatacatgaatatagtatataatacatgtaataaatgaattatgtgtctatcaactgtctgtgttattggaaaaattttaaatattatttgccacaacactaaatattatttttcttaaataatgtcttagattattaaattttctatctccccttttttttctgcatggcaaaaccattccttagttttcctaagaaggccttgggggacagcaactcagtaaaaacaactatggcatgtcaaaggttcataattataatggtttatccatgcaaacctaccttcataatttcattcagattgaaatgttcttatttatgtctgcataattatgtaattttctacacagatctaattgcaatcccagacacactttgatcaaatatcaatttatatttagccagaggaaacaaaacattcaaactctataaatcatgagtgctagtatgccatgtgttttagaaataatactggtaaattacgattataaattcaaagcccaataaataaacttcaatatcaatctctgaataatgcaaaatcacctttctttcctaagcaaacaaatgtttctccatcctaggacatcctttaaataaaaaggatgaaaaaacttactataactcccttttagatttcccccctaagagattcatagcatacagttaatttagaggaaatggatagttttctagaaaaatatgaagaaatagaaaattaataatatgtactcattaaataaattgagccaatagtgaaaatatcccaccaagatatttatataaacttgtcccacatattttatactttaattctgccaaacattcaagggatagaaagagaatagaagaaaggatcaatacaacatttactttatatagttactatcttaacaccggattcagggaagaaaagtactagaaaatatatttaaaaagcaatctctgtcattcatgaagac

SEQ ID NO: 472475 - DNA, 699 bp, Homo sapiens
gcaatagatgtgttctacgtgcatgcatgcacacaaacactgatgtccaagacagtttctgaagtaatgagagaagtgttgattctagaatcaagacaagttagcatcattttccaaaaggttcaatattcagcctacagtggttatactgatgaaatatatctggtggccaaagaagaccgttttttggcaccagaagcctatgagcaacctatagccaacatgtgtattccagagattccaggatgcatgagaggaagttcttgggtcctctggagtgaaaaagtgtctgagaatgaatctgctcagagaagaatctcaccaatgtaccatatccatgatgtatcattcccattgatgccatcaatctatcttactcaggtaatcttggataaaggtggatgtgatcgagatcttgcctgcaaagattgtgtgatatgggaagattgtggggatgctatatgggtatccaggagacagacaattaaccgcagaaacaacagccaacatcgtggacttctcagctggctcagcttagacaattctaactgaaaaattaaagacaggcaaacgttccacttgatgggtgccaaaactattgcacccgcgtcagctgcagacaaaagcagagctttcaatggaaattattttttttttattgtactttaagttctaggatacatgtgcacaacgtgcagg

SEQ ID NO: 472476 - DNA, 586 bp, Homo sapiens
gcagataagaaatattaattccatctgcaatcttggtcatggagatagatttgagattgagttcccatctcctcagctgcagcggccaattaaagccttcttccttggcaatacttgtcgtctcagtgattggctttctacgaagcaagtcacacaacctggaccgaagccctggtgttttggttaaagtgagaagtaatgttactttatcaatttctccagggcaccctggagaaacagaactctgtgtggccgccctgcaccgatctggcgagactgaacgcccacatgcagccagtttattactgacagataggcagcaagggacagcagaagccttgcatgcattgcaagcaggtctgtccagactcaggaaagcctcctggggcagatggagtctcagtggggaaccttccacttacactgcagctgaggaaccccggaaagcagcccaactgggttttacatcctggatgccacacggggcaccagactaaagcattgaaagatttcttgttttggaaggggaggatggggtctggaacagagcctgggatatcctgcccattccctcactatctcagga

SEQ ID NO: 472477 - DNA, 578 bp, Homo sapiens
acaccatctccacagagtattggcttaaatcatgtcttccatttccaaaatatcatcaattaagaaagtatctaaacttaaaaagaattcatttcttttcacacacaaaatgttgattgattatttactgtaccggggccatacactagtgaatggaaataaagcaatgaacaagacagcagtagtatctgtcgtctttcagtctataaggtcagtggggtggcgctgcctcttcgtgctgctggtcggcaggtcactttcctgggtacctaatcaggagcctgaagggatgatggcaattcaagagacacttgtctcatgcatcggttggaagtacgtgagagcaagtgcccgtcaagcagacgcatttcaaggctctgctggtatcatctccaaacaactctttgaccaatgctgtatgggactgttccctgaaagctgcctcctctaatagtgatcctgaagacaatggctttgcacacttggcagtctactcagtgtgaagatgatgaggatgaagaccttcacaatgatccacttctacttactgactagtaaatatattttctcttccttac

SEQ ID NO: 472478 - DNA, 1535 bp, Homo sapiens
gtttatggaaaccaggtggcctgaatgccagaaactgcctaactctcctgaccccatgcgaaatatcaaacgtccagacctgctagatattgctgcacaccagagaaggccccatgacagtgtctcgtcaggaataccagggaccccagaagccccagagggagtgtgttacagtgttcttttagcttggctgtccacggacagcttaagtgttaaatacctcagtgggccctctgcctttttgcatgaagtggttgctctctgccagcaagggcaaagggattttattgccaatgaaagtggctctcagtgggaggggagctggaaaagggatggaacaggaagacgatcttcccctggagtccagccatccccagccagactcctctccaaagcaaagcggtcaagctgtccctctgaagtcaagctgcttctctccgacgtcaaaccgcagtccccgacgtccagctgcttttcctcttctccccttctctgttctctgctggtggagcctggggtttttacagaaacagttgaatatcaatatgaaaagaaaatctagacgtagactttacacctttcaaaaaatgagcttagagttgatcatagacctaaaagtaaaatgcaaaactacaatatttgcagatgaaaatctaggagaatgtgaccatggatttggtggaacatcaattattcttacattcggacatttcaaataatgtaatatttcttggagattttgcttgttttttcattcttttttctttatgtttgtattattgggttaatttgaaagccttgtctttgagctctgaaattctttcttctacttggtctagtctattattactactttccactacattttgtaattccctaaatgtgtctttcatttccacaagttctgattggtttttctttaaaatatctatctctttaggaaaggtttcattcatatcctgaattgctttttaaatttcttcatgttggttctcacctttctctggcatctctttaagtaacctaataataaacgttttgaattctttatctagtatttcaaagatttcctcttggtttgcatctattactggggacttagtgtatcttttggggatattatagagccctgttttgtcatattatcagaattgtttttctggtttcttttcattttggtagactatttgttctaaatattcttgcattcattttttatttaactgtgttttttgtttaatttccttccttcttgcttaaggatgtgattttaatggttttagtttattgtagcctaatttgactcttgatgcgttcaggggtgaagactctgtatgggtcccttggttatagagagtcttcgtatgttggctttctcagatgctggttgtggtagcaatgtgctcagtgtgtgagcaatttaatggtctcctccaaggttggaatggcagagatcacttgaagattatcttattaccctgtggtgtgcacttatttattgattattagttcagtctttgggtcagtagggaagg

SEQ ID NO: 472479 - DNA, 961 bp, Homo sapiens
ctcctcttctctctcttctcttctttctctcttttcttttctttgacaggactctcgggacagactgaaggatgcactgtcagcttccctacgtttaaggttttgggactcggactggcttccttgctcctcagcttgcagacggcctttcatgggacttcaccttgctgttggagtcagtactagtctagacccagttgaagcaagtttacagggtgtcaagtccatggaccatggagagattgctaacacagtctttgaagtcagctgtgtgaaaactcaacctaagaccggaagcagccatttccctgctgttccctgtgatagtgaggtggaggttcttgacactcatggccttgaggtactgaccagggcaggtgggcctgcacctggggaggggtgcatgtgttgcaaattagaagaaaatcgtgacactcatggccttgacgtactgaccagtgctggtgggtctgcacttcaggaggggcgcatgtgttgcaaattagaagaaaatcacaaaaagttttggacactgatgtattcacttatcaatacaaatgaaaggctgcttgccagagggcagtaagaaatccctgatattgaaaacaaataaaagtaaatgagcaaataactctaactgaatattgcattaataatataagcccatagtacatttttttcacgtgactttaaaatatgtattttttgactatataggcttagtgaagtgtattctaaagacaaaaagaactgcacagatactttaaattgtatttaatagtttaatctttttaaacttattattttgtgataattgtagctttacctgcaggtcgtaagaaataatacagaaagatgcatcctttactcagctttccccagtggtagtactttgcataactagagtataacgtcacaagcaggaaattgacattgacacaaactattgactgtgttcaga

SEQ ID NO: 472480 - DNA, 766 bp, Homo sapiens
gaaaactacaggccaatatccttgatgaacgtagatgcaaaaattctcaacaaaatactagcaaaacaaatccagcagcatatcaaaaaggtgccgttgctggcagggacacagaggatatatgggaaagcctacatgatcagacagaagcctgctgcagcagcagagccctcacagagaccctctactagggcagtgccaaggggaaatgtggggttggagctcccacacagagtcctcactggagcactgcctactggaactgtaggaagaaggccaccattccccagaccccagaatggtagatccgtcagcagattgcaccatgcatctgaaaaaggtgcaggcactcaactccaagccatgagagcagccacagggcctgcaccctgcaaagccacaggggaaaagctacccaaggccttgggagcccactccttgcactggtgtaccctggatggatatgagtttatcaccagcatctttgagtttttgactttcaattcaaaaatgctgcctgaacttttagactatggagagattaagactacagatggttccctaaaattcagcacattagttttctctaaaaggcctttctgttcaaaagctgtctcaggatttgaaggccatgcttacaagctgcagtggagctaataggttttggcttcgagcaactcagggaccctctgtgggtcttgatttctctgatgtaaaatggaatgtctaggcagcagggtgagtgtggtggtgtaccagtcatgtc

SEQ ID NO: 472481 - DNA, 909 bp, Homo sapiens
ccctactttctgcaaggtagaaaagggcgggtccctgaaaaaatcccaccctcaagtgtgataccacagcccaaagtgaaaacttatatccctgttttcccacacgaatgttgccttttccaaaaccatccatggcctgccccacccctcatcttgtgcccataaaaatcccagaactcagttggcagagaagagaagtcactggacatcagacgctacgaactcaggggccaagaatgtggatgcaaaaggctctcacactaaccctttgctctcgctggtggaaggcagctgcctcacatgaaaaggcagagggtccactgagctgttgtcagttaagttgtccatggatggccaagctaaaagagcactgtaacacttcctctggggcctcaggaggcgcaggtacctcccagatgctgctgcagggctgctacagagttggctcaagccggcacccaaaagcacttgccccaggtcctgcacctgctcacctgtgtcttccctcccatgaggggtggaacacagcaggagttagctagctctgggaaggctagtctttccttgttctgcaaggccctcaaatgctagatcatcgacaatacaaaagagtcagaaaatatagctaatataattgatcctgtgataaatagacgccaaactgacaaatacagaattgaggaaaacccatagcagtctattaagaatgaaccttcccccattctgtagtgtgtgcagaagaatataatggccccatgcatagttgggtacttctgccttgattggtgctcaggccccagctattttaaccaccactatttttgaaccgttggtgcaagttccaacatagcagaagggccaataatgcccagctttgattgtgcacaccccctgcgtgggtcttgaata

SEQ ID NO: 472482 - DNA, 1770 bp, Homo sapiens
tagacctgaatcaggacccagatggccacggctgagctcaggctccccctgacaggtgtgcgggccctggtgagcatcttgcagagctggtacacactcttcacccctactgaggctactagtattgtagctgccacagccgtatcccacaccactatcctgcgcctcagtcttgactatccacagcgggaggaactggctagctgtgctcgcacactggctctacagtgtgctatgaaggatccacagagctgtgccctgtcagcccttacactctgtgagaaagaccacattgcctttgaggcagcctaccagattgccattgatgctgctgctggtggtatgacccattcacagctgttcaccatcgcccgctacatggagctccgtggctacccgctacgtgccttcaagctggcctcattggccatgagccatcttaacctggcctacaaccaggatactcacccagccatcaatgatgtgctctgggcttgtgctctcagccactctctgggcaagaatgagctggcagctctcatccccctggtggtgaagagtgtgcactgtgccacagtgctttcagacatcttacgacgctgcacagtgactgcacctggcctggccggcatcccaggccgccgaagctctggaaagctcatgtccactgacaaagctccattgcgccagttgctggatgccaccatcaatgcctatatcaacactacacactcacgcctaacacacatcagccctcgccactatggagagttcattgagtttctaagcaaggctcgggagaccttcctgctgccccaggatggccacctgcagtttgcccagttcatcgacaacctcaaacagatctacaaaggcaagaaaaagttgatgctgctggtgcgagagcgctttggctgagagagcagatagctcactgccagagcagcctgggttcccaggtagtatcaggtcaggccaagggcactgaaacatttgtccaccctgagagaactctgagcacctgtggatgaggccaaaggaccacagggctaaggatggggaaagtccagctctagtcgataatgcctaccttggcaagcttctgactacagcctactgttcatggaggagctgggccctgcagatcgaccagaaaccccacaacatgccacctcatgcccctatatcctgcgtgtcctgagcattggccctgtctcccttggcaaacacagaacactgttccatctcagggattgcttaaccagagaaacagacacatttgtgggactgtaaatactatatgtgttgctaattattgtaaacttgtaactatttataattctgcttctgatttgatgggcacttgaagtagctgtgggtaggaggatatgcttattttctgaggagactcacaaccatttctcaggtttcccttgcagagtgtttgctggtagcagtggaagagtgggggtgccaaggagaaaaatggccagttaggatcaacccaagtctagtctatgcagaatcccccacctacagacagggcatttatagtccagtgctaaacgtttgttccccatctctgtgcctcctctattcattctctcaccaaacaagcttctaagcaccaatctccctctgccatcagattggctgctttagctccatagttctcttctcgcctcatacttgctttcttcccctgcctttctacctcaagcttcctcgccggcttttgtcacagtctcattgctcgctgacttggaggct

SEQ ID NO: 472483 - DNA, 1171 bp, Homo sapiens
gattttcagtgggccccaactaatgcccgtaggagagcccaatattccaagggtagccaggcccttcggtgggaatctaaggatgccccccaatgggctgccagtctcggcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacagatcagtgcagccgggagttcatgaggtctgaccatctcaagcaacaccagaagactcatcggccgggaccctcagacccacaggccaacaacaacaatggagagcaggacagtcctcctgctgctggtccttagaggtaaccactatactgaattttgattaatcttgccttagctatttattgtttttaccacataatgtatctgttcttaaatatagtgattgattttgtatggttttgaacttacctttattctgtttaggattcatcaaactttttcaatctaaatgtttagtggtcttaataaaatttggaaaaattttgggcattgttttgtcaaattttggggttctcctccaccttctatttctgacacagtctgcctatatgatggagcacttgatattgtccctcagaatatataagggttgtagtgaaatctgaagaaatgtttggggtttttggatgggttgggaatatgttactatttttcatatttaggttaatgaaataaaaactttagtctaaaaatttatgatctagcagattagatctggataatgaacagctgtatgatcttttctttttatagttgttgtacttcatgtaagactctagc

SEQ ID NO: 472484 - DNA, 3026 bp, Homo sapiens
gatgcctcccttggggtccacaatgatgacttctgcatgcactaacatccctgggacagttctcacccaggacttaacaatgcaccctcttaaagcccttgaagacctaagtgagacttattccatgggccagaaagtgacttcctttgatcaggtaaaacacacagcaggctcccagatgacagatgttactgtcaccccaaagtcatcacccactgattgccagaagacaaccatcactgcaagcaacatgacaatctccaatgaaagtagccagctgaacaccccaagcagtgaccagaccctcaatgagagtcagataccagccctgcttggagatcagatgaagaccctcagtgataaccagactctctgtggggaccaggtgaccttcagtagtgaccagaccctcactgatggtcatacagtgacttccggtagcgatgagaccctctctgggggccaaatgacaaccagtctagacctctatggagggcaaatgatgacttccattgataaccagaccctctgtggggagcagatgacgacctccagtggtaaccaggccttctacgggagacagatgacgacctccactggtaaccagaccctctgtggagagcagatgacaacctccactggtaaccaggccctctatggggggcagatgacgacctccgctagtaaccagaccctctgtggagagcagatgacaacctccactagtaaccagaccctctgtggggagcaagtgatgacctccactggtaaccaagccctctgtggagggcagatgacgacctccactggtaaccagaacctctatggggggcagatgatgacctccactggtaaccagaccctctactgggggcagatgatgacctccactggtaaccagaacctctgtggagagcaagtgatgacctccactggtaaccaagccctctgtggagggcagatgacgacctccactggtaaccagaacctctatggggggcagatgatgacctccactggtaaccagaccctctactgggggcagatgatgacctccactggtaaccagaacctctgtggagagcaagtgatgacctccactggtaaccaagccctctgtggagggcagatgacgacctccactggtaaccagaacctctgtggagagcaagtgatgacctccactagtaaccagaccctctgtggagagcagacgacgacctccactagtaaccagaccctctgtggggagcaggtgacgacctccactggtaaccaggccctctacggggggcagatgatgacctccactggtaaccagaccctctactgggggcagatgatgacctccactggtaaccagaacctctgtggagagcagatgacaacctccactggtaaccaggccctctacggggggcagatgacaacctctactagtaaccagaccctctgtggagagcagatgacgacccccactagtaaccagaccctctgtggggagcaggtgacgacctccactggtaaccaggccctctacggggggcagatcacgacctccactagtaaccagaccctctgtggagagcagatgacgacctccactagtaaccagaccctttgtggggagcaggtgacgacctccactggtaaccaggccctctatggggggcagatgatgacctccactggtaaccaggccctctacggggggcagatgacaacctctgctagtaaccagaccctctgtggagagcagatgacaacctccactagtaaccagaccctctgtgaggagcaggtgatgacctccactggtaaccaggccctctgtggagagcagatgacaacctccactggtaaccaggccctctacggggggcagatgacgacctccactagtaaccagaccctctgtggagagcagacgacgacctccactagtaaccagaccctctgtggggagcaggtgacgacctccactggtaaccaggccctctatggggggcagatgatgacctccactggtaaccagaccctctactgggggcagatgatgacctccactggtaaccagaacctctgtggagagcagatgacaacctccactggtaaccaggccctctacggggggcagatgacgacctctactagtaaccagaccctctgtggagagcagatgacgacccccactagtaaccagaccctctgtggggagcaggtgacgacctccactggtaaccaggccctctacagggggcagatcacgacctccactagtaaccagaccctctgtggagagcagatgacgacctccactagtaaccagaccctctgtggggagcaggtgacgacctccactggtaaccaggccctctatggggggcagatgatgacctccactggtaaccagaacctctacggggggcagaatatgacctccactgataaccaggccctctatggaggccagatggcaacatatagtggcaaccagaccctctatggggaccagatgctgactcttcaggtgggcaatatgacaacgctcactgatgaccacagcctttatgggggatatatgatgtcccatcagttctcatcattgccatacccaggattcctatgcttttcaagttcccatttgattcaaggacaactcccaaaacagaagacacagagctgccagttctggaagaatcctgaggtttcaaggccctatgtctgcacttacgaggactgcaagatgtcttattcaaaggcttgccacctccgaacccacatgcgcaagcacaccggggagaagccctatgtatgcgatgtagagggatgtacgtggaaatttgcccgctcagatgagctcaacagacacaagaaaaggcacactggggaaaggccctacctggtaacggcttttatcagcatgctgtgaatccttctagatcttactctgtatttacctgtatgtgtacttttaaaacgtatctatgtaggtgattgagattgatatgtgtatagctcagagg

SEQ ID NO: 472485 - DNA, 895 bp, Homo sapiens
ctgttctcattgtgcagggaagcaattggcattaattagcgaattttaccctcaccagtattaggaggtggattttatcattgttatcatcatgaattttctgctgctttatgagattggtaatctagctaaaggcttttcagtattccttagaggcacagggtttctcttcagtgtgacttctatattccatgagatggcatggtgtagaacactacgtgggctagagtgccggcaatgcagcaacactgctggcgtctcaatgctacagccttctgaggatgggagtagccacagccccagcatctacttctggccccgggcagccaggcaggcagaagtggggcttaagagtgattgctacccacaaagcaccagcagccagtgccacaggctgcagaagcgggacttcagtgtggggccagatgggttgacactggcagcaggggtaggagaatgttcccgtactggagtggcgttgggccaggataacttccccagcttcatggtgctacagatcccttttctgttgttaccttgaagtcttaagaaatatactatctgtccgggtctatttgtacactattcacttagattttcctcagtgttgatactgagagtacgccctaataaactttcaccacgctgatctgtttcagagtctgcttccaaggaactcaactggtggcactcttcttttttcctttttttatttagaatctcatccccacaacaattttctttaaagatctcagttggctttatttgtcattctagaatcaggctctggtatttatattacgctattttcataagttgagaacaattttaactaatatgctctagagctggggtccccaaccctcaggccatggactggtaccagcactttggt

SEQ ID NO: 472486 - DNA, 1237 bp, Homo sapiens
tttgctagtgcatctccagggtgttcgttgtaaggagagatgggcgagtcgaacgcctgcatcttagtttccgctcttgggctgggtgccccaaaagatggaagaacatcccagcatcctcagcattcccaagggtcttctctgactctctgcccccactgcagccaatcccttaagggatttggagtccagaaaggttcccccactttctggcctgtgatagacattcgcagtagctggtttggcaattcagaacctgcctgttctttgatgatatcttcagatagattattccaaggctatgagatcagaacctgtgcgaggagctcttctgggaatggaaataacttacccaaaaggggaagcaagtggcaaggcccagggtgtggcgtccctggggtcccgagcctggcccatgggggccagccaggctgcctcccgcatgcttgctagttgacaggggccaaataaaggcccttttaaaaaaaaacacacaaaacaattttgttccttctgaaagtgatggagcgaaaggcatgtttcatgggtcatcctctgcatgtgtgcgcgtgtgtctgtgtgcgtgtgtgcacacatgcccgtgcagctgtctccccaggtatatgggcatcttatgccacatcgccaatgtcttctacttccgctcttcctggaatagaggcgtttgttagctttggaagtttcccttcaggaagcagaaagagcctaagagaagaagggagaaaagaaccattcgagtaatagatcaggccacccttcatagtatcaccacagcagaccttgtttggattcaatatatagtcgtgtagcatcttgtatttatccttgtatcgcttagtcctaaatataaccaagtaatagatcaagtagctatatttgtttagtgtctaactcccactccaaactgtgagctctttgagtgcaggaccctgtttctcttgttaagtgccataatctcagcacctagcacagtgcctcccacgtagcaggcttgcaggatttgttaaatgagcggcctaaaataatggaattatggagggacagctgcgatgttggaagcccgtgccttcctgagtagaaaatgctgatcaatcagactttcgtctaactagacaatactagaatattcagataattgattcttcattgcctgttggaaatgtagcctgagaggaagacttcaggggttgcagtgaagctagaatattaggcattc

SEQ ID NO: 472487 - DNA, 518 bp, Homo sapiens
cgcctgcctcgtgcattgttcttgctaggagctgcagactagagctaatgcaggtgtctctggcttggactctccagaggatggcactcacttcttctgctggttttggggaggaactgttgcctggctgggggatgggatccagtgaaatcattaattccaccagggaactttgtgactctccaagagtggtcgtcggactacgtctatcaaaaccacctgggaaagctgtaaaaatgaactttcttgagtctcaaaccaagctgactgcatctgaatatctggaagactatggcctggaattagatttttcacaagcatctcaggtgatttttataaatactcaaactctcaccgtgaatgacctgaggagcacatgtatcaacactgcagccctgacctccaagcctagctcctccatgaagagcacccctttagtccagggatgcatacatcagtggtacaattttccctcaaaagttcagaccccaggaagaggcctgtgtaggtcctgaaag

SEQ ID NO: 472488 - DNA, 796 bp, Homo sapiens
aactgccgcctgcgccatggcagcggccactccagacaggccgctgctgcaaataggactgtattacattgcttcagaaaggcaaaaaagcaagttaccggtgaaaagctacggatacaaccgcaaatacaggacagacttggctgtgcacggatggctgggactccacggtggtgctcagttcctgtgcaggtggcctcgctccatcccctccgcacatctgccgggctttctctccactgtaactctcaatgttgtcactacaaggcttaatgtttatttagcgcctactggtgtcaggaacacggaggatgaattagttgccaaaggtcacacagaatttctaaatgctgaatttaaattcaaaccccttggactccactggttcatgctggtaagcaatttagagagagtccctaaccgcagtgaagaaagctgcaatcaagggatcgggtcaggtctttcacaaggctatactgaagatggctgtgaccaacagccatcacagatatatttcaagccgcaggatggcagaaggagggaacaggattttatcctccttctaaagagacttcctggaagtcttacgtaatactgtcacttatatcatggtgagcagaattcctcccttgggaagctgaaaaacagttttaagggaatatgtcaatgtatccgactgaaaataaaggttttgttaatttgagggagaagttgaggatatatcattggtggcaatgaggaaaattgacctcagttgtgcagctacttttaatttttaaaggtatacaaaaatgat

SEQ ID NO: 472489 - DNA, 627 bp, Homo sapiens
gcacagtaaatgtttcttcagaatttcagtagatatgtaagggtatctcatggtggtttctgcacttccctaatggctaatgatgttaaccatgctttcatatgtttattctccttctatattctttttggtgaagtatccaagtctttgcctccacacacctcctttttgtttttgagacaggatctcactctcatcacccagatgaagtttcactgcggcttcgacttcccagcaagctgtaccaggttttttccaacagcagactcagagttccaaagagcagccagagagcaaaccccaatgcacaagaaccttcctaggcctttgtttacatcatgtttgctaatgtcccacgggccaaagacaggaaaaaagaatgttggtgacagtcatcttatttatggaaggctttcaacattactaattagaatgctcttcagaaagttgacttgccaatgacatactgtaaaaacttttcagattagaatcttcatagcaatggaaatatttcctacaaatggaaatatacaaatgtgagctgacttgctgaaaagagatcgcctttaggaataggtcttagatccattgattcttttttaagattttcatcattgacatggagaa

SEQ ID NO: 472490 - DNA, 2332 bp, Homo sapiens
tgattgttatatgagcctcatcacacaaatgaaatacaatgttacttataaaaatgctcactctttttcccattgtaagttaaacacattgctaagaggccatttttcaaaccatcagtggccctgcaactctctaaaaattttcagcatttctcagaaggaacgctcacataaaacatctcagtatgaaaaaaaagactttgaccatgtaaacatgtccaattgtctgctgacattaccaaaagaaactgaattgtacaattttcaaaagtgctcacttaatagtgccagtggtttgatcttgcacatgttaccccttgatacctcctctgccaagccatacttgattacaaagagaaatctgaaccgctgttacagtagcagatgcacaggatgcaaggctgcatctactgaagacagtctcccgaggaagactggaaaaagagcagtgttaactgacatccagaatggaaagaatgagcttcagagaagcaattgagttgagagaataaaaaagatgacatcacttcaaacctttggtcttttttttttttttttttttttttttttttttttttttttttttttttttgctatgtaactgaccacccaaaactcagtggttataaacaactaccattgtatttgctcaggagtccataatctgggcggggctcagtggcaccgttccgttcatcttactggtggttgctcatgtggctgcattcagctggctagttggctgggatctgggctcaattgaacctctctctctcctcccctagaatctcaggggccagccttgattcaaggagtagtgactatacgagtgtgagtataaaagacatggttcactgtgagcaaccaatgtagccaattaccactgacacgcaacaagtcacctgatctgtacactttgatgttatgtttctcatccattaaaagggaaaataataattcctattttatagagatctcacagttaaacgtgataatgaatgtgatgtggttagcacagtgactgacacccagtaaatactctgtaagtggtctctttcatatatcccaaagtatttggaatttgtaacacccagaaatttgtgagtcccttcctacaactgtctacctttcccacaagagcagagtccacagttcacgttagccatcatagaagtcaccccagtacctagtacagaacctggcattgtgtgtttgttgaacgattatgtgatcaaatgaattggtactcactgtctccaaccactcacttctacaacacatagacagattgagctatttcacaagaatttcttatccgcaaattaaaagttatcaaattcaatgtcatgagcaatcatagtagtctggagttcatcttcacctctttttaaatatagtatatgtagcaaattccccaaaaatattttgccagatttccactgcctcaattttaaaactcaggcgcactataagaaatatgtaatccatatgtctctgattcatttttacccagttcatcaaaatgctgtttttgtattaaatgtcaaaacgccttttatgtctttatttatgagccctttaaagttgttatttttaaatgatgctagaacatgttttgcgaaatttaaaatctacaaaggcatttgtaattcaattccaaacatcagcttctgggacagttaattttgtttactcctgggaaaattcctcttttcaaatatggacttttaaggttattttaagtattccacattctcatattcttcatgttaaatgtgctaatgaatggaatcagctgtatgtacacagagagtttggaaaagcaatatgtgccctgctctctctttcaaaggaacaccttgctgtctcggtcatctgattctgcctcaactctataaactggtgtggggaaaataagcctgctatgtgttacctatttttaaggctgaaacaaattgcaaatttttcttctctataattctagatagtgcaagcttctctacatagatatatacatgctcagcttattcctcacatgcaaacttcatcaaatcctcttcctgtctctagagacttcttcctgttctctactattatttaacttttcactatgagatttaaaaataaagacgataatgacctaatggaacctttccataactcaaatttcagtgataaactgattgtgctttgagttaaaattttaaaatatttataataaagcagaatgttagctaaaaataaaaaaatttataaaagtcaaggttatattgtttaaaaatccctatatttgaaatcagagaacctgaaaaccagagtaacatttctgatc

SEQ ID NO: 472491 - DNA, 602 bp, Homo sapiens
cgactggatctgttatttagaatgattagcacactgggagtactggcagcaaagcctttgaaattgataaaaatatgtgctcatgaattaattaacaccgtatggttgttatgtgggttcggaatattcaatataagctcagcttctacaattgatttaagtaggaatcaaatcggagtacgtctacagaggattcagaggggaccaggccttccgcgatgtagtgagtggtgtaagtgtgagaatgggagagaagtatataatagatgctgcctgcccaatcgtaataaaacggtattcgactggctgtcctccgattcatgtgagtgtgagaaatataaagaacttgtgatcaatgttgagtgtaaacagattgggaaagaggccctgagcaatgaatttttcttacaagaaacccttggaggaaaagtaccctgcaaaatatcaagaagtacaaacaacactgtgaagaagaacttctgtgaagaagaactggcagaagacatggaagttctgtagggaaattgcaatagggttgcaaaacagggtcggggagcatgaatgaaacaggcagtcaatgaggatggaagggaagactggaa

SEQ ID NO: 472492 - DNA, 1512 bp, Homo sapiens
gcgactgctgttgccaatactaccattgctgctcataagcaacaaattacatacatccctgaagacgacactccgcttatgagggctatagttcaggcaagggaatatggggatcccgaagcctggcaatttcctgtaattttacaacctccagtacctgccaccccaacagtacaaaatcacccacagcctgttgttgatcctgcccagcaggcggctgaccccgcagctcaacaggatcaagaggctgataatcaagcccctcagcccgaaactcaggctgctcagggaaataatcagcctccgcaattgccggctcctggggcacagccaatacctggcattcccgctgttcaggcggtagttcagcctgaccccatacatccaggcttagcagaagataaacgtttggtgccctatgattgggaaattttagcaaaatcagtcttatctaaatcccaatatttacagttcaggacttggtgggttgatgctgtccaggaacgcattcatcttaatcagggctccaatcctcctgttaacgttacagctgaccagttactgggaatgggtcaatgggctgcaatccgacaccaaactatactaaatgatgaggttgttgaacaactgcaaaaatgttgcttagatgcttgggacaaaattcaagatgatggtaaagtatgcccatctttcacagctgtcagacagggacaacacgaaccctacccagacttcattgctcgtcttccagacgcagcagaaaaggctattcctgatagccacggccaaagacttgttgtagaacttatggtttatgaacaagcaaatccagattgtcaggcggctattcgccccgtcaaaggcaaaattccacttggtggtgatatactcacctcctacgttaaagcctgtgaaggggtgggaggaactctgcatacagcaatgattatggcacaagctatggcctctattctaatgcctggacaattctctggccaatgcttcctatgcggccagaagggacttgcaaaaagaaattgccctcggcgtgcaggtcgcagtcctttacatcaccaacaacaacaacaaaaaacttttcagcaacaagacgccccaccttctactgtatgcccacgatgccaaaagggctttcactgggcatctcaatgccattccagatttgatattgatggcaatcctttacagccttttaaaaatcagggaaacgggatgaggggccggccccaggcccctttaaacaatggggcattcctcaactctcagcccctggcgtccagccagacgggagccttcccagttcaatccattcaacctccaccccaattcccacttcagcgatgtagggaccagccccacaaggtcgatgggtctctccccgtgtgccgcgacgagagagtatagaaataaagacacaagacaaagagataaaagaaacggcagctgggcccgggggaccactaccaccaatgcgtggagaccggtagtggcccc

SEQ ID NO: 472493 - DNA, 615 bp, Homo sapiens
tccgagcctgcagtgccatggtggcgtttgtggccaagagactatgtgcaatcagaaggagggaagagctggcccagcagaatttggtccaggggagcaggcctctctgcagggggcaagggcacggctggagacggaggtcctgcagctgcagctgaggcccccactcttcctgcactgggcagagagccgtgatggggcctcagcaggagtgcatggaggaggacgcctactgtctggacctggaccggaggcttggcaagatgcaggacaactggaagccaaattggagaagttccagcgggagatcctcttccacgaggaaatggctcaggaagtgtggatggccaccgggtccaccaagcgggtgctccaggagctccgggaagaatatgacttcaagaggcagaagccggctcactgggaggccaagttccagcctttctggacagtgctttggctcctagggctccagccacagtctgcagggcctggaagtaccagggggaccgtgagccactaggacccccaggagggaggattttatcattagaaaagatcattttgctcgatcattaaaactgccattagtgcttaagcacaagagacacattc

SEQ ID NO: 472494 - DNA, 613 bp, Homo sapiens
cggcgtcggcggcctgtgcagcaatggccaagatcaaagctcgagatcttcacgggaagaagaaggaggagctgcggaaacagctggatgacctgaaggtggagctgtcccagctgcgcgtcgccaaagtgacaggcggtgcggcctccaagctctctaagatccgagtcgtccacaaatccattgcccattttctcacagttattaaccagactcagaaagaaaacctcaggaaattctacaagggcaagaagtacaagcccctggacctgcggcctaagaagacacgcgccacgcgccaccggctcaacaagcgcgaggagcacctgaagaccaagaagcagcagtggaaggagcggctgtgcctgctgcggaaaaaaagtgacaaggggttatatgccgctgatgttcctgcatcatcatcatcaaatactgtttattaagcttcctccacatcgctgatgttaagggcttgcagattctcttgggtttctcttttcttcctctccctgtactcagcctccaacatcattctaccctcccagctcttaccttagcagttttgtactagtttctgtactaagacttgactactcaatgttatgaagaagaa

SEQ ID NO: 472495 - DNA, 4468 bp, Homo sapiens
gatcgcgggccctgacgccgtggaaacagtacatgaaccacctctgggactgccaatctccagacttctgatgtgcgatttgttctctgagactaggattgtttctagaatgttccaggctcttcctccacctgtcgttcctgacgctctcttgcccagactgtgcatggctggctccagtgctttcttccctcatggcgtcctgaatgtcccctcctcagagacacctccccaaccactctcaggaactctgtttctccacatccttccctggtgcagaagatgcccctttctccacatgaaaatgattgaatggatcaatacttggcccctcggacccctcactaccagctgacagagggctgccaaatcttgagcttggggaatattaggtcctttcagaaaaacctggcattgcgttgtaaagtgatcctgccaatgcctattagtggcataatcctgcaggtatttatgcctgggttcagaacaatcaccagagttgagatctgtatggaacaaagaccttcaagcatgtggaagaggatcagcccagctgagggccagcagcaggaccgcaggccaggacgcaggttctgctctgacatctcatccaaatgtcacttcttagagttttgcttctggaaatggttctcacactcagaacaactagaaagcctagtgaaatataactatatccatttagaggcatcagagagatacccaatcagtgaggaaaacaggtgtgagagagaacggaggcccagagatgatcctggagttagggaccacttttccccagaggcagatgcaaattctgaaagtggaagctgagagactgaaaagctgaatagagttctccacaaatcaaggaactgcgggtttcagagactgctgagtaggagggatcctagtaaataccctaacctatcaagtacctggaagtaagtgtgaaccaatagattagccctcacagggcctgaagcccagcttcaaataatctatctatccttggctgaattaatgtgacctgaaattgctagtgtttctagcctagatgctggccagatgcaaaagtgcaccctctctagaagaatataacagcattcggagcctcaaattatctattttaatatatattatctgatacctatcaagacataatcagtcataaaggaagataagatatgaccaaacaaagagacaataggaaaagcagacccataaggatttcagataataaacagacacaaactttaaaacaaccatgattaatatgtttaagaatataaaatttttgatgaataactggaaattatgcttataaagtataaaaagtaaaccaaatggaaattctaatatggataaatattatgaatgaaattaacatattggataggtttaacatcagattagacacagctgaaaagagaattagtaaacttagaagctaggtcagaaaaaatatatctaagatgaaacaaacaagcaaaaagatgataaatatcaaaaaccaagagataaataggacattgtgaaatgttctaacatagttgtaactggtgtcccaaatgacaggagaaagagaacggggcaaaagtagtacttaaagatatattacttacctgatgagaatcaatggcttgcctgtgtatgtgcatgaatgcaacagctgaagactttagaaataggagcttgatgacataatttccctaccagatttatattcctattcgaagcctgccccagctccttcaatgtgtgtgaccatggttaccacacccacccagggcctcgcccacccagggcctccctcccatccttttcttggtctgtgatgtttgctgtagcaccaatgactactagtgctattcaccaaaaattttggtcctctttccaagtacggtggggatttcacttccttatcccctggaagtcaggatggtcaagtgccttgctttggcaataaaatgcaacagctatatgtgcccattttgggtggaagctttaacactcagtgttcaatataaattaaggtatgttcttgtccttctgcctcagtgtcacaacagagcctccatcagcctagttactggatgatcataagacgccaagagatggagcttccagctaatctgtgaggcctgttaacatgcataagaaatgaacttgggttgttttaacttgtgtcatacttgttgtcacactatgacacaacctatccagacacatgtccctttgacttgctttttcagtctccttgtcaccattcacctcctatttcaatccaaactccaggagacctttgctatcttgctttcttttgggcagcagaatcttcctttccctttagaatcttttctatatctgttcttgtgtcctattcctctttgctgaaggtggtgatgccctttattcccaagaatgtcccttttatctgtttcctttgttccagacagctggcagctttacacagccatgaaagtcttttcagcaaatgactaaaaagcatgtcctagggaaacatctacctccctcatctctctgactatgtgaatcccagccttccctgatttcatcagtacagctcttgttggtgatgagacctctcagcctgagtgctactggaaagtctccccgtgattcagaggcctgcgccccacagggcctcctgtgcttaccacagccacccaccttgccaagagcaactgatttgaaaactgcctgcctgccgcctcatggggaattgctcttaattgtttggtttccatgcgtgtcgtatatccactcccaacgtagaggctttgctttgggtaagaagaaatgcaaatggaagtaggggcattacatccaggattctttctggagacagcctggcccaacctggacttgacagatggtgcttgcccaagtcacaggggtggcaggactgagtcctgggctgcttcagaagaggggatgtcacaaacaagttctgatgaatgttaagcttttacaaaataggattagatccagggtggactccacggggaaaaacatcctcttctttataacgttgaatttattattttaattcaaaacaaaagcactgaaagtgtttctctgggggagtggaaaagattattctgcaagatccaaaaaaaaaattatagaattcagagtttccaaaataagctgaaatttctgaagaatccagactacataacttgtgtcaacagaatttagactctgattatgtaagtagctctttgttttgtggttgcttggtgtttttgtcctttccttttgttctgaagtaaccttggagtcctgggagtcaggactagaccaaggttccaatccaaagcaactgattaaatatcttcatttctttatctgtgaaataccacccattttgttcccctcaattgatttgaaagttcagtatttgatttctcttcttttcatggatatctttgtagaatcgttttttatctatatgcacatgtgaaattgctgatatcagaccattttttaatttacaaaaatggtaagttgatatggttcagcttgatatagtttctcctaatgcaagccaggaactctaacacactttttatctccctcagatacacactttccaatacccacttcctccagctttacctgtatatctgtaatatatacatattatgtgacattttctgcaaatttaggttcacatttgtaataaaagccttttttaaacaaagaatatattttgcttactttttcttactattataccttgtataacacttcttgctctgggattcttgtatcctctaactggaacacattctttggttatttttcaggtagagtctatatatgagaatatcttctaaagatcttatatgactgaaaatgtctttacttcatccccactcttaaatgttcattcggctagatatagaattgcattcacattttttttctcagaacttgaaaagcattcctcctgcctgttctgacttccagctttgccaatgaaggatctgttgctattgcaaagttgtattttctgtttccaagataaccaaatggtctattttcaaagccacatgttcttgtttcataaccacctattcttactttatggatataacaccctcctttatttctttgtgaattttaagtttgctttgcaacaatcctgttctgatcattccattaactttgtgccctcaggtgtaagttcagtttgttatctccttttgtggggcttatttttttcaagcatctggtgattcaaagttgcattctaatccctgtggtcaaggcccttcagttcttcaggagagggagagcttgttcaccactgcccccacctgctccaatgttagcagtagtagcggaaggacagtctggaccactggataaggtacacaggtgcctccatgttcaccgtggtgttgctattcacctggggctctgttctctccatcccagg

SEQ ID NO: 472496 - DNA, 532 bp, Homo sapiens
ctttctttttttttttgagatggacaagataaagtcacaatgtctggcagccaaccaaagatttccaggcatgcgaagaggcagaaaaatatgacccataatgagagagtaatcaatcgtaactgtcccagaactgacaccgatgttagcgttatatctgttacatttagaattatgtttagatgctatcaaaattgcatttcatgtgttcaagaagttaaagtagaaatatgggatgtatttttaaaatacccaaatcaaagttctatagaagaaatgacaaattatgagaagacaaatacactggatggaattaaaggcagattaaacattgcagaaaaaaggtacaacaccaaaagtggaatccataaaataataacatcaaaggaaaacttggacttcatcaaaattaaaacttctgctctacaaaagacactgctgaaagaacagaaagacaagccacaagctggggaagtgttttgcaaagcatctacctgataaaggatttgtatccatcataaataaatatctc

SEQ ID NO: 472497 - DNA, 1378 bp, Homo sapiens
gtctaattcaaaggaaaatgggtagatggtgggaggattagagagtggacgccatgttggaatgcagggatgacctggtgagccttgtgtcacaggctgggtacttcccccggaattcacatgttgaagctctaacccgcagtacccagaatgtgactgtatttggagagagggccttctctccaaatagaaggagagtggatgtctatgctgagcagcatctgctgacaccaaccagaccacttcttctgatgatggtgacagttgctcaggttctcaccaagagcctggggctccctcctgtgggcttccctggcacacttgctgttgtggagtcaagaaggatccagaccaagatccaaccttcacagcaggtcagagttaaaatgtcattactcgagcagcacttactggagcagaacagaactggctgctcactggcccttggccttgctgcccttgctgcggggggaccagagtccagagcctggctgcatattgaaggacaccagccagaaagggcagcagggggaactgcagttcgtaaggtcatcagctccaggggccactactatggccgtggaattggctgttgtcatcccagctcgctgacaggggactgtgcaggctgctgctgtaacctggtggtgggctgtcatcagacggccatagaggatcgccctgaggcttggttgtggaggttgtcaaagcagaaggctggcaatattcccatggcccagaacgtgctgaggcagcatatcactgctttcaacgtgtccctcaccttcattccttttgccctgccctggggccataggtaaagcctttcttgcatagttcaccgaagcctggagatttcaattctatcaatagctatacatgttgtgtgcccagggacacccataatagctaattttccctgcagtgaataggaaatagtctatgttcttgaccttttagactaaatttccttttttgtcacagatccacttaataataccaaagttttaatgaaattattgaatcattaagagagcatttctgagcaactctagaagggctacaccatctgcctgtttgcttaggtactagttaaggattgtcctcgatttggagtttattataaagaatcccactggaactacctgcttgaattaaaatctgatttttatcttttgaccggagggatgaaaacagtctaagacagatttatggcgatagttgcacaacttggtgaagttactgaaaatcactgacttatacactttgaaatgagtgaactttgatttgataatgtttttaaaaagtctgatatgcttaatggtccttcagtttaggaatcacaaacacgagagcataaaataggcataaaattcac

SEQ ID NO: 472498 - DNA, 2576 bp, Homo sapiens
caagtagccacctttccaaaggccgctgggctgtgtggtgggcctgggagccagccgtgcacaaaatggctccctacagcccactggtgacccggctgcagaaagctctgggtgtgcggcaataccatgtggcctcagtcctgtgccaacgggccaagatggcgatgagccactttgagcccaatgagtacatccactatgacctgctagagaagaacattaacattgtttgcaaacgactgaactggcctctgaccctcttggagaagatcgtgtatggacacctggatgacccggccagccaggaaatcgagcagggcaagacacctttcatcagcagtgggctgcccaaggtggccatgccgtccaccatccactgtgaccatctgaaagaggcccagctcggaggcgagaaagacctgcgccaggccaaggacatcaaccaggaagtttataatttcctggcaactgcaggtgccaaatatggcgatgaggaggtacctaagcaagacggccggacagacattgccaatctagctgatgaattccaggatcacttggtgcctgaccctggctgccattatgaccaactaattgaaattaacctcagtgagctgaagccgcacatcaatgggcccttcacccccgaccaggctcaccctgtggcagaagtgggcaaggtggcagagaaggaaggatggcctctggacatccgagtagcagctgtggccaagcaggcactggcccatgacttcaagtgcaagtcccacttcaccatcactccaggctccgagcagatccacgccaccattgagcgggacagctacgcacagattttgaggaatgtgggtggcatcgtcctggccaatgcttgtggcccctgcattggccgctgggacacgaaggacatcaagaaggggaagaagtacacaatcgtcacctcctacaacaggaacttcacgggctgcaatgatgcgaaccctgagacccatgtcttcgtcacgtccccagagattgtcacagccctggccattgtgggaatcctcaagttcaacccagagaccaactacctgatgggcaaagataggaagaagttcaagctagaggctctggatgcagacgaccttccccaagaggagtttgacccagggcaggacccctaccagcaccccccacaggacagcagtggccagcacgtggatgtgagccccactagccagcgcctgcagctcctggaggcttttgacaagtgggatagcaaggacctggaggacccgcagatactcatcaaggtcaaagggaagtgtactactgaccacatctcggctgctggcccctggctcaagttttgtgggcacttggacaacatctccaacaacctgctcactggtgccatcaacattgaaaacagccaggccaactccgtgtgcagtgccaacattgaaaacacccaggagtttggccccgtccctgacactgcccgctactacaagaaacatggcatcaggtgggtggtgatcggggacgagaactcgagccgggagcacgcagtgctggagcctccccacctctggggccaggccatcatcaccaagagctttgccaggatccacaagaccaacccgaagaagcagggcctgctgcccctgacttttgctgacccaggcgactacaacaaggttcaccctgtggacaagctgactattcagggcctgaaggacttcgcccctgacaagcccctgaagtgcatcatcaagcaccccaatgggacccaggagaccatcctcctgaaccacaccttcaatgagatgcggatcaagtggttctgtgccggcagtgccctcaacagaatgaaggagctgcagcagtgagggcagtgcctcccaacacacccccaacctcgccccccagagctggcgtcatgttcaagttcagctccacatgcgccatcagcagatccgatccatccagccatgggttctgattccaagatggtgtgaccagacatgcttcctgctccccgctcagcccacagagtgactgtggttgggggaggttcttaaaataactttttagcccctgccttcctatttttagtgtttggttccaatcttaagcagctccatgcaactgtatttatttttattgacaagactcccatctaaagtttttcccctgcctgaccattttattggtggctgaaggattctagagaacctgttgttcttgtaaggaaaacaagaagccaaaaaaaaaaaaaaaattaaaacggcagattcagcaagctgctgtggggaggtgttaagggcagctgtttgggggatcgcacataacaccacatggctagaatagggtccagggtccagggtatgctgtggggtgaacatgtggggtgagagcagtagacatgtctgcagtgggcacagcaccgagggtattctacctccagagcagtgggatttaagcaggtgattgatatgaagagttttactacttagagggctccagaccccagatgcagagcgttgagcaaatgaggcaccctttgcaaatttgaatgacaagtttaaccacac

SEQ ID NO: 472499 - DNA, 631 bp, Homo sapiens
ttcgcctggttttgatgccctgtttcagtgcatcatctggtaatttcgtgacctgcaatcggcagaagctgcccctgccgtctgtcggggacgctggccacactggccgattgtccagctgctgcgtgttgcctgctgtggccccttgtctggagcagccacgctttgttcccctgggtgacaagagtgaaactccatctcaaaaaaaaaaaaaaaaggacagttataagttatacgtgcatagtttaaaaagtcaattcaaggcctctgggtggagcagagcacagactggttctctcttcccagagcttcctcaccaagagcagggctggaaagccccagagaaggtgaaggagacgtattcagggggaagcaggagctgctgtaaacagccacctgatttgctaagagattcaagtgctttacaatgggactggaaagtccatggtgttcctatagcctccttgtcaggggcaacgacagggccaggagcagaccctgagctgaccagactgaagagatgtcatagagtggaattacataatatgtagcctttcagattggcttctttcacttagtaatatgcatgtaagtttcttccatgtcttctcagagctcaatagctcatttc

SEQ ID NO: 472500 - DNA, 575 bp, Homo sapiens
gcaaaccgacgaagccagtccatgtccacctcacagacttttaaaagaatcagaaactctgggggtggggcccagcaacctgtgattccccaaaccctccagggtgtgactcttctggggtcgcagttgaatgcctgtgtgttcagtgaactcttcccctttggtgggttggaactcagatgtatccgaatcccctgtgagctccgagaattgttcagcttacagctgcctgtacattctttgctcagacccatggagctttgtgttatgcacatacagcttagtattcagccagagcctccattggacccacaggcattaccctctattttaacaaaattaaaatctgagaatgaaacaccagttcattatcatcagtcttcagaagttttgcctcgggcttgcacagaactggcgttcagtgaacattgtggaaagggagtgcaggggaccaccgtgctttgtgcagcacgatatcctcagcacttggtacagtgcctggcacctggcaagggctcaatatagatctgctgtggggtcgggggtgggcagatggttttttctttaaaatgagc

SEQ ID NO: 472501 - DNA, 2264 bp, Homo sapiens
agccactctgcccttccagtgccacagggagcagggaggtgactgctgtgcttggcaggctgataaactactggcacttgcctgcgaggataggctcatgccgaagcatctccttgacggttgccaagggtatgctcctgattggacacatgggctcactggctttgtggcttcctgggaacacatctttaatagtagcctatttggcaccatcctgggccctgcagggggcagtggaaggagcaagggctgtggccagacccaactgggtgaggacctggatctgcatcttcatatctctgaacctcacaggagagtggaccaaagccaagcaccaagcacaaacaagtgagggaatggtacttctgaaaatagttaacccagctattttcatccaggaattcctaattgtcaccttccagggccttctgcagctcctgctgcctgcctggaagatggcttgggctcacaccccggtcctggtcactctgtggggacggtcccgggggaatggcttctgctctggccagcccttggccctgacctcttcttccgctcgcggagcgcctgctgaatcccccgatcgaatgtgagtttctcctcctcagtcagggcatcatattcttcctcatccatgttttggagaccctccttctctttctcaagagctcccttgtgcttgcgttctgtgaggggaacagagacgggaaggtggctgaacagtggcccccaaagatgcccatatcagattactcagaacctgtgaccgtgttgtcttccatagcagagggactctgcagatgtgattaaatttaaggatcttgaggtgggcagattattttggggggcccagtctaattataagggtcctttcgagggatgcaggagagtcagtcagagatagtgatgatgtgatagtaggagcaggggtcagagggctgcaaggaaggggccaggagccaaggagtgcagaaggcctctagaagccagaaaagacaagaaaaaggggctacctaacagccaaaaaaggaacgtggccctgctgagaaaagtccggagcaatgaccaggcatccctcagcagtcatcaagcctccagctgcctcgttttccagaaagttcatttctccataatgatccacttgaaaataattaccacttctcattttccccgttatctttggaatgaaatttctcctggttaaattgtgggctcttctcccctaaatcatctgcatttgaaatgtcctaaggtagcatactgtcatactactattacattaaaatctcatgtttgttaacatgtatgaacatgccaggcactggggaaggcactttacatgattgcttatttaatctccacaacagccctaggagggaggagttatcattcttatctgtgattatcccttaataagtggcagggaaagatgttaggacttctgaccccggaagtgtaagacaatacatttctatgttgtgttaagtaaccaagtttgtggttgctatggtgtaaatgtttgtgccccctcgaaattcctatgttgaaactgaattccccaaggggatggtattaagaagggccttagggaggtgactaggtcacaaggatagagtcctcatggctgggattagtgtccttataagaggcctgagggagcttgtttcaggacttagtgagaagatgctttctgtgaccagaaggtgacactgtttctgttggcaccttgatcttggacttgccagcctccagaactgtgagaaataaatgtctgttgctgataagcgacccaatctatggaattttgttatggcagtctgaaaagactaagacagtggtcatttgtcacagcaatgatagaagactcatataccacccactgacttgactcattatgagcatatgccactaacgggttcatggtgacagggccatttgcacaccaagggaaattccctgccctgccctacggattccaggtctaggcatgtgattcacacttaggacaaaggcaccagctccttcctcacacctccctagcacagcattctcaccgtcatcctcgcaagtttgagctgtggactcagacacctgcatttgagctccttcccggccacttatcaagagataatcacagataagaataaaaacatacggccgttgtagagattaaataagcgatcatgtaaagtgctttccccagtgcctggcatgttcatagatgttcgacaaacatgagattttagtgtaataatagtttgacc

SEQ ID NO: 472502 - DNA, 496 bp, Homo sapiens
taaggaccccatggccagcaagatccaaaccaggaaaggggcagctcttcagagacaggcatggttaacaacaaaccagccctttggaaagacttgcttcaccactgttaccaaccaacggcctgatgcttttcctcagttttgtgatggcccgcccggcaggacgactgagcaggccttggaagaccggagagattggagcgaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattc

SEQ ID NO: 472503 - DNA, 4560 bp, Homo sapiens
cccacagtcaaccttgcagagctcgcatatgaaaagttggccctcaacatatgtgggtttcacccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcataaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgctattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaaaatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtttagtttgctattcgttccagtgccttaatgtggaacgtcatcttatctcatcctttcctttgtcttttcattttgtaaatagtgtcttgttagcatcagaaagatgcccagaaaaaaagtgaataagaatttttggttcatctattacatcatttcatttcattatttcatttcttttcatcatttcatttcatttcctcatttcatcctttcatttcatcatttcatcatttcatctcatttcctcatttcatcctttcatttcatcatttcatcatttcatctcatttcctcatttcatcatttcatttcatccttccatttcatcatttcatcttatcatttcatctcattttatcatttcatttcattctttcatttcatttcatcatttcatctcaacatttcatttcatcatttcacttcatctcatcatttcatctcatcatttcatttcatctcaccatttcatttcatctcatcatttcatttcatctcatcatttcatcttttcatctcatcatttcatcatttcatttcatcttttcatctcatttcatttcatcaattcatcatttcatctcatcatttcatctcatttcatttcacttcatttctttgtttcatttcatcatttcatttcatcacttcatctcgacatttcatttcgtcatttcactttatctcatttcatcttttcatctcatgatttcatttcatctcatttcatttcatctcatttcatttcatctcatcatttcatttcatcttttcatctcatcatttcatcatttcatctcatttcatcatttcatttcatttatttcatcattgcatcatttgacttcatgtcatcatttcatatcatttcatcatttcatgttttcattcaatcatttcatcatttcacttattcatttcatttcatcttttcatttcctcatcatttcatttcatcctttcatcatttcatctcatcatttcatcctttcatttcattatttcatttcataatttcttctcattgttgcattttgtcattccatcatttcatcatttcacttcatctcatcatttcatcatctcacgatttcatctcatttcatctcgtttcatcttttcatctcgtcatttcatttcatctcatcttttcatctcatttcatttgatcatttcatcaattcatcatttcatcatttcatttcattatttcatcatttaatcatttaacttcatttcatcacttcatttcatttcatcatttcatatcatttcttcatttcaccatttgatcttctcatttcatttcatcatttcatcatttcacttcatttcatttcatcatttcatttcctcatttcatttcaccatttcatttcctcatttcatttcatcattccatttcatcatttcattacatttcatcatttcatcatttcacttcatatcatttcatcatttcatctcatgatttcatttcatctcatttcatcatttcacttcattctttcatttcatttcatcatttcatctcaacatttcatttcatttcatcatttcacttcatctcatcatttcatcatctcatgatttcatctcatcatttcatctcatttcatcttttcatctcgtcattacatttcatcatttcatttcatcttttcatctcgtcatttcatttgatcatttcatcaattcatcatttcatcatttcatttcatttcattatttcatcatttaatcatttaacttcatttcctcatttcatttcatttcatcatttcatatcatttcttcatttcaccatttgatcttttcatttcatttcatcattccatttcatttcctcatttcatttcacaatttcatttcatcatttcatttcatcattccatttcatcacatttcatcatttcatcatttcacttcatctcatcatttcatcatctcacgatttcatttcatctcatttcatcttttcatctcgtcatttcatttcatcatttcatttcatctcatcttttcatctcatttcatttgatcatttcatcaattcatcatttcatcatttcatttcattatttcatcatttaatcattcaacttcatttcatcacttcatttcatcatttcatatcatttcttcatttcaccatttgatcttctcatttcatttcatcatttcatcatttcacttcatttcatcatttcatttcatttcctcatttcatttcaccatttcatttcatcatttcatttcatcattccatttcatcatttcattacatttcatcatttcatcatttcacttcatctcatcatttcatcatttcatctcatgatttcatttcatctcatttcatcatttcatttcattctttcatttcatttcatcatttcatctcaacatttcatttcatttcatcatttcatttcatctcatcatttcatcatttcacttcatctcatcatttcatcatctcatgatttcatttcatctcatgatttcatctcatttcatcttttcatctcgtcattacatttcatcatttcatttcatcttttcatctcgtcatttcatttgatcatttcatcaattcatcatttcatttcatttcattatttcatcatttaatcatttaacttcatttcctcatttcatttcatttcatcatttcatatcatttcttcacttcaccgtttgatcttttcatttcatttcatcattccatttcatttcctcatttcatttcacaatttcatttcatcatttcatttcatcattccatttcatcacatttcatcatttcatcatttcacttcatctcatcatatcatctttcattgcattatttcatttcatctcatcatttcatttcatcatttcacttcatctcatcatttcatcacatcatttcatttcatctcatcatttcatttcatcttttcgtctcctcatttcatttaatcatttcgtttcttttcaccttttcatctcatcatttcatttcatcaattcatcatttaatttcattttttcgtcatttcatcattcacttcatttcatttcatcatttcatacatttcctcaattcatcatttcatcttttcatttcatttcatcatttcatcatttcatttcatttcacttcattatttcatttcatttcatttcaccattttatgtcatcatttcatttttcatcattccatttcatcatttcatttcatttcatcatcatttcagctcattatttcatttcttcatttcatcatttcgtttcatttcatcatttcatcatttcatttcatcatttcatcatatcatttcatttcagtgatacatgtatttaattgctaatgc

SEQ ID NO: 472504 - DNA, 880 bp, Homo sapiens
tttgcattggagcctgagagatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccgtggcttccacaatattcacacgttctttcaccttgccaaacgccacatgcttgccatccaaccactcagtcttggcagcgcagatgaaaaactgggaaccatttgtgttgggtccagcatttgccatggacaagatgccagaacctgtatgctttcggatgaggttctcatcatcaaatttctccccatagatggacttgtcaccggtgccattagggcgtgtgaagtcaccaccctgacacataaaccctggaataattctgtgaaagcaggaacccttataacgaaatcctttctctccagtgctcagagcacgaaagttttctgctgtctttggaatcttgtctgcaaacagtttgatggagatgcggcccaagggcttgccatccctggtgatttcaaaaaagacgacggagtgagtccaatgaatatctactcatttgttatacaacaagttcttttaagagaaggatgtagaacaggatattatggcaatatatataaggcattcaatgtacccgtggagagtggcgatcagagaaaaatgatgtcaggaaattatgccaagtgttttgaatcagccaaggataaacaaatgcagactatcatttgatggaggtattataaactgataacatgattcgaagtataagaatggcaaattgtgaagaatgaataaaattacagagataaatagcaa

SEQ ID NO: 472505 - DNA, 785 bp, Homo sapiens
aggggctggaactatgggggtgactgagagtattccaaagccctgtggccaacttactggtgctgagtttgctggaatcatcatcgaatggaatcgaatggaatcaacatcgaatggaattaaatggaatcatcatcgaatggaatcgaatggaatcatcatcgaaaggattctgagggaatcatcgaatggaatcgaacggaattatgcaattgaatcgaatggaatcatcatcaaatggactccaatggaattatcatcgaatggaatggaatcaccatcgaatggaaacgaatggaatcttcgaatggaattgaatgaaattattgaacggaatcaaatagaatcatcattgaacagaatcaaattggatcatcatcgaatagaatctaatgaaatcaacattgaaaggaatctagtggagttatcatctaatggaattgaatggaatcagcaaggaatggaatcgaatggagaaattgaatggaatccgttggaatcatcatcgtatggaaccgaatgcagtcatcatacaatggaattgaatggaatcaatgaagggacttgaattgtgtcatcattgaatggaatcggatggaatcatcaaatggactcgaatggaatcatcgaatggactctaatggaatcatcatcaaatggaatcaaatggaatcgaattgaatcatcgaatggactctaatggaatcgtcatcgaatggactcgaatggaatcattgaatggactcgaatggaatcatcatcgaatggaatcgagtggaatcttc

SEQ ID NO: 472506 - DNA, 522 bp, Homo sapiens
ctagacccaaaactagccgttggggaacaccgaaatccttggaggagcaacatccgcatgaccctctgtttgcatccctggaatccatggaaagtccaggagagacaatcaagtgctacaggatcaagcccaaacagaacaggactaggcatggcttcctcactaggagccaggccaaagtcatctcctttggtctccaatggaggccagaactcggttcacctgcaacgggaggacctggcccagaagagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgcc

SEQ ID NO: 472507 - DNA, 2157 bp, Homo sapiens
ctattgatacagtggctaggctgctgtcagctccagcaattagccaactccctttgaagtatgtctacccaatgctggctccagtggtggtttctgatccagagcactcccaggagatggaaagcctgagggaggctctgctgtcctctcgatcccaccttcaagagctggaagaggagctggagcaccagaaggtggaaaggcagcagcttttggaagacttgagggagaagcagcaagaggtcttgcatttcagggaggaacgcctttccctccaggaaaacgactccagactgaagcacaagctggttctcctgcagcaacagtgtgaagagaaacagcagctctttgagtccctccagtcagagttacaaatctatgaggcactttatggcaattccaagaaggggctgaaagtactgacgttctaccttggaggaccctatactttagcctacaggactaagaacttcccagccagcgctgaccctggaaacaagcagctgctcctccaaggcttgggtttggatacttctccagtaatgaaggcccctcccaagctggagggtgatgctactgatggctcctttgccaataagcatggccgccatgtcattggccacattgatgactacagtgccctaagacagcagattgtggagggcaagctgctggtgctaggcagcaaaggcattcatgagctttggagcagcaccagtgccctgcaccatgccctagaggagtcggcttccctcctcaccatgttctggagagtggccctgccaagcacccacatccctgtgctgcctggcaaagtgagagaatcgacagaaagggaacttctagaactgagaaccaaagtatccaaacaggagtggctccttcagagcacagctgagcatctgaagatcgccaaccagcagaaagagagcatggagcagttcatcgtcagccagcgtaggttccctgagagggaatgggggaagaaacgggcagtcttcccgatgccccacttgtgctgctgatgagcagtgactggggggcttggggatgttgggagttgaggctgatttgatgtccccaaacctcctgtgccccgagcagttgtggatgcagagggaggggaggacagggggtggatagcaggaaactccaagctgaatggccagagagaaataaatgctttagcattctcatgctaagcaagtagggttaatttctgctgatgatttctactctgtggtgctcttttgttgtttcagtaaccagaacacatgatgttttaaagaaggcaaggactaacctagagttaaggaaactactgcaccagtcagaggcaccaagcctgtccccaacccatcaccatctgttagcagatcttgtaggtgacgcttggcctgctttcgccttccaggagaagatttccagtccacttgtaagatcacaggtcctcagtgggcttcctgctagtttctgttcccatcaccctcccaccccatcagctcctgcccctgtatcttggttcactctcacattgtcctcatctctcctttttactccaatttttcttcgttgatgccaggtcaggagactggagaaatgcaattcagctcactctggaagtcattagacatttgggagtctgcctctgaatgagcttttggtagagggatcttgaggccagttatgtgttctactcttcatgaaaaagtaaaagcaatttgcaacctaataaactgatttcactgcacactcctgggttaagaacagcaatttgattttgatatttctttaagtaacacgacaaaagagatctgttgggtctcatttgtctaaaagagaatttgttaataaataacaactgaaccttcaggggaaaaatgttatatatatatcagacattatctacatttacttaaaacactaagtgtttaatcattccctaggaattgctttgaagaaaaacttgaggtatatgaaatggtttaaaaatcagaaactaaaccttttaacgtggacttcaaagctttgccataagcaattgagcatattcctagaaatgtttctaaaccataacctgagagaatgttgatctccatagtgtgaaaatgacttgggccagtttaacttgcacttttttttttctaaactaattcc

SEQ ID NO: 472508 - DNA, 2857 bp, Homo sapiens
ccctctgaacagctgggggcacaatttctcattgatttctagaatgttcatctctgccttctcgctggacaaagggccggctgataccaccatgctgaccctggggttttgggtcatcagggcctatggccaccttacctgggctgagcttttggacaaggtgctgtgccagtctacacccctcagccagctgttcttggaggtcctgcccctgggacttctctcgttcctgagagtgaaccaggactttatattgcctaaggaacaagagcctgtgcaccaggaagcagacttcactctcaccaagcagagtcgtggcgaggaggacagcacctgcatcgagctctccgcctcccccacccgccagcccaggcggccccagcagcagcgaccagaggagcccctgcagcaacgcaaaggccaggtggacacctccatctacagcctcgacacggccattgtgggcaacaaggacccaccttccatctgtgccaccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatctttgtatgaagagcatcggtggagcccccaccttcaacgtcattgtcaccatgactgccaagacgctaggcctgctgatgggcaaagaaggtatccatggcaatttcatcaacaagtaatgttatgaaatggcctcccaccttcagcgttcccagtactgacctcctttgttccttccactccaccgctccccacagctttgcccgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggattttttatgaataaaaaagattctactaaaaaaaatcaataactgtacatatgtgggcatattgtttgaatctgtattcttttgctttgatatatttatgaatacttacaccattactactgtttttaaattactgtagctttaaaatcaggtttgaaatctagcagagcaagtcctccaacttattgcttcttcaagaccgacttgcttattctaggttctttgattttcaaatacattttgaaactagctttcaaatttctctaaaatctcctactagaaatattaatcagaattgtgttgatgtaatatgctaacaaaattgagtcttccaatcaatgaacatgatatatatttatttagccttctttaatttttctcaccaattgcttttaggggcctcgtacctgcttcattgcatgtattgttaagcatgtaatgattctggctattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatgcactaacggaactactgccacaaccaagatagaggaaattccctatgcccaaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtcttgtaaatactgagtagtattccttcatgtggctataccatgtatgtttgtactttcacttattattggacatttctatcattccacgtttgggctattatgaagaaactatcatgagcatccatacgtagcaggccaggtctcactaacacaggcctccctaaaaactgtttcagtagcgactgagtggttcaattaaatattaagaggaaaaaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttactgggggtctgaagaaactccccaggcctccacagacaagtttattggagatctgaagggactctccaaacctctgtgatttagcaggagacaagataagggcccccagcacctagacccatttagattaagtgaatttaactgaggttccagaggaaggtctttaggactcagacttagttatagattaaaagaagttaatcacttatgtatttagatgaatgcacacttccacatacacatatagcttagaaggtacattagctcaggaaaactttccaattttgagttggtctggtgataatttccaggccgtttccctgtaaccagttgcagaagtcaaaactctcttcctccccagttcatctgtgtctcgttactgagccacgagaaatagcagcccgcccctcaggttggtctggaaacacacatacagatcattgtgcagacacagtgtgtaaattcctaggaatggaatgactgtctatctgatttgtgttatgtttaacctttaagaaactgttagattttaaaggagcataccatttttcattcctacaagtatagacttccagtgcttatttctaaccacatgtgctatttcagcttttaatttatccat

SEQ ID NO: 472509 - DNA, 3229 bp, Homo sapiens
ctctacaggacaaatgacctggccccgcttcacaccttgagctcacagtcatttccgccgggcctgggctagcggacgcgcgcgtgggaaggaccagaacccgtgatgtcctcaccgtgtcaccctcgggccctcagaggtgggatccaccggacagggacctggagtttgcacaggctgcagcccttcgcccagagccagcctagcacctacgcgaatgcagtctaccactgccacaaattatacagtcaagtttcccacatttggggaaactgcaggggtcagcagatccggagtgcaatggataagactcgctctggaaaaaccaccttcgtgaccagggtatctctcctgccagccctgacacacagctgggactctcaggtccgaccagcggtcctgaacccgctcccacggcacgggaactccttcgtggcgaagcagcatgtggcgaagcagcagcccctgcgctggctcatctacatagaagtcgccctatccgtgatgtcaccgacagtgcctttcccagtccccgtctgcctttctgccgctcagccgaccaacccgctgccggagccggcaaggggaagtgacgtctgcctctcccttttttctctcctgcttccctcatctgttctcttccaaagaagctggtccttagcctgtattgcggagcaagctttcggcgaccagctggaccctgggcacccttcttcgaacaatggcttttaattctcagactagaacgtttaggattacaaaagaaactggttcttttcacattcttattcttgtgatgtagcattccgcatatatatatatatatgtatccaactatcctaaaagacactacccttcatcattccatggcattagacatgtataggaccatgcatggtgatctcctccagacaaaagtaaatgctggtgcagaacaggtccaccttccttggtgttgcttgagggatcagaagaaatgccttaacataggtgtgtgggaactatggctgctaagtatgaactcagttacctccagttataagctagtgtgaggttccatggtgtaatgcagaaaaatttaggcaagagctctggaggaccttcctagctcataaaaatgctgtggtcaagtctctccagttttggaagtgtccaaggttaccaagtgttttgagggctcactttggagcctctgaaaaggaggggtcagggcccatggaaggacgattgcctgcaagacagggcctggaggccagggaacccaaggccacagaaatgcccagggatgagtcctggctggagatgccttggctaagctgactgtgcacttccagggctcacaggggtctggccaggagactgagcaaggggaccagggaggttatgcagaggcttctgcacagcaaggcagacattcttcttggagcccccaacccaaatcaggtcttccacctcctcttcctaaagaccctttactgctgtcgttcttttactagaactacaagtttagaggacatggatttcagtgccctcatctggccaaccatcttcagctgccaatgagcaaggtaacctccctccctgccaagacctgactcaggacctttccttaaggagatgtcctgttctttctttcccaccagaactgccctggcccagaccccatttctgtctggtgaccaggacagtcccctcaccagtctcccaggttggggagggcagatcctcctcagctccctgcccctgagagaccccaaccgtcttgtgtggctccggcccacagagtgatatccatggcccatatctctcaaaactctcccctcccactctgaatccaccctctactgcatgctcccctcacagaacagactaatttttgtgtgtgtgtccttgttttgcctacctgtaccccagacagacttttctgtcttagaactacctgtccctctttggacagtgtcttcctggtactacacatgaagatgtcccgctctcccctgctcaaggagagagtgcctgacctgagctgggcccatcagatccagtacttacctggaatacgaaaaagatgaagagagtgaccaaagattacaaaaatctctgaagcttatctacttgagagagagtccctgaagatactggcctctcattcctgctatgtatatccaatgtgactgaactctgaataaaatatacaagttataacaatgtagcaattgacccagcaaacgaggacacaaacgtgttggagggaatttccagtattccaaatatgagaagctgagaaaacaaacaacaaactcaaaaccctaaaaaccggatacgtaagggtagatgtttgttgggtgtggattaaaaatggactttttttgccccaagcaacaaagaggcaccttagaaaatagacaagagacaagaagaagagaagctttaagagatatttggtccaaggaagagactcttcagatggaagaaacaaaagaagaaaaaaagagatatgaaagcctatatattgaagactaccaagtactgcttagagcagttaaagacctttggaatagaaaatgtttcttcttgcatttcaagattgcttttgttttggggggacacactattttttaggaatatgaagttcttcttaggcattcctgtaaaaaaggccacttcttgataggattgtattgaatctgtgggttgctttgagttgtatttttatcttaaccatgttacaacttccaacccatggacacaagatgtctgtccattgatttaggtcttcctgaatctcctcgagcaatgttctgtagttgtctgtgtacaagtacggcaccttcttgaacaaatttattcccaggcatattattcttacaagtgctattataaatgaaatcattgtgtcaattttcttctcagattgttcattgctaacacaactgattgtttactgaaagtttgctgaattcacttattaactctagtagtgtgtgtatgatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggcgtttaaagttttgatgcc

SEQ ID NO: 472510 - DNA, 633 bp, Homo sapiens
ctctctccccgtgaatgcaggtgatcttccgaaacgaggtgacaaatgagttcttgtactacaatgtgagtttcagggtcatcccttcaggcatcatcaaaaccatcgagatggtgaccccagtccggcaagttgcgtcagcctccatcaagttggagaaccctctgccctactcggtgaccttctccacagaatgccagatgcccgacatcgccctgccctcccagtttgtggtgcctgccaactccgagcaacaacgatgttgttggatagtgagaaaaactactgctctagaggctcttgaattctgcgtgtgcatatgtgcatatgtgtcgcaggcactaaatagtaacaacttagaatcagaagatacccttcaagctcatgtctctcttcatggaaacgaagtagaggtatttgttaaatgaaacatgaatacatgaatggtgcctggcacatagtaactactaataattaatctcttgtgcttattaaatgccagccacttgacagattattaaaactcacaccaaccccacaagtgagtgttgtaattattcccatcttaaaatgaaaacttgacactcagctatgttcagtaacctgcctggggtcatggaggtatttggaaat

SEQ ID NO: 472511 - DNA, 592 bp, Homo sapiens
agccttgttcctgggaacctaactgaaccatcagctgtgttacctagcaacactgcttgtggtagaaatgacacccaatctccctgtagtgaatttcacgtgccaggtgcgctccaagcacacgcagaccatcctgctgtcaaaccgcaccaaccagacctggaatctgcaccccatctttgagggcgagcactgggaggggcctgagttcatcaccctggaggcccaccagcaaaacaagccctatgagatcacctacaggccccgcaccatgaacttggagaaccgcaagcaccagggcaccctcttcttccccctcccagatgggaccggctggctgtatgctctgcatgggacttctgagctccccaaagctgtagccaatatctatcgtgaagtgccatgtaagaccccctacactgagcttctgccaatcaccaactggctgaacaagccccagaggacctctagaggatgttgaggggctcgaggagttagagacaaagttccctgatgtgaccaggcatttcctgaacactaagcctctagcgagattctcttttctgtgcttagttacttattccgggtcatc

SEQ ID NO: 472512 - DNA, 960 bp, Homo sapiens
agtcaggtgggatggcgcccctatgaggctgtgtcttatccctcagaacacgggcaccccacagagggtcctgcctcctgtggtctggagccccccttcaaggaagaaacccatgctgtctgcttgcaactccatgatgtttggacacctcagccccgtgaggatccctcatctgagaggcaagtttaaccttcaacttccttcattagatgagcaggtgatcccagccaggctcccgaagatggaggtgagggcagaagagcccaaagaagcaacggaggtgaaagaccaggtagagacccaggggcaggaggacaataaaaggggcccctgtagcaatggggaagcagcctccacctctagtctcctggagactcagggaaacctcacttcctcctggtacaatcccaggcccttggagggaaatgtccacctcaagagcttgatagaaaagaaccagactgacaaggcccaggtgcatgcagtgagtttctactccaaggaccatgaagtcgccagttcacacagccctgctggaggcatcctttcttttgggaagcctgacccacttccaacagtgctccctgccccagttccgggctgctccctgtggccagagaaggcggccttgaaggtgctggagctgccagccacagttcccacaaaagaaaactgtcggagccaccgctgcagctgcaaccgacccctcccctgcaactgaagtgggatagagacgaggggcccccaccggctaagtttccatgtctatctcctgaggccctgttgatcgttcttgtaatttgtaagtcttagagaaaagaagtctgattatccagagtatcagaatcccttccaaaataaaatgtccccattcaatcactcatgaattttgcaaaacactgtttgcaccttttcacctccctctgttcaagacctctcagtgacactttatgctttcct

SEQ ID NO: 472513 - DNA, 3179 bp, Homo sapiens
tgtaaagatgcctcagctcctgagaaatgtcctctgtgtaattgagacattccacaaatatgccagtgaggacagtaacggggcaacactgactggcagagagctgaaacaactcatccagggcgagtttggggacttttttcagccctgtgtccttcatgctgtggaaaaaaattcaaatcttctgaatattgacagtaatggcatcatcagttttgatgaatttgttcttgcaatcttcaacttgttgaacctctgttatcttgacataaaatcattactaagttctgaactaagacaggtgactaaaccagagaaggagaagctagatgatgtggatgttcaggcaaccaccggagatggtcagtggacagtgggaacttcaccaactcaagaaaagaggatgcttccttcaggaatggcatcatcatctcagctcatccctgaagaaagtggagcagttggaaataacagagtggacccatggagagaagccaagactcacaactttccaggagaagcatctgaacacaatgatcctaagaacaaacacctggaaggagatgaacaaagtcaggaagtggctcaagatatacaaacaacagaagacaatgaaggccaacttaagacaaataagccaatggcaggatcaaaaaagaccagcagtcccacagagaggaagggacaagataaggagatctcccaggaaggagatgaaccagccagagagcaaagtgtttccaagataagagaccagtttggagaacaggaaggaaacttggcaacccaaagttcaccaccaaaagaagcaacacaaagaccatgtgaagatcaggaagttagaacagaaaaggaaaaacactctaatatacaagaaccacccctacaaagagaagatgagcccagttcacagcatgctgacctgccagaacaagctgctgccaggtcaccatctcagacacagaaatcaactgattccaaggatgtctgtagaatgtttgacactcaagaaccaggaaaggatgctgaccagacaccagctaaaacaaagaatttgggtgaacctgaggattatggcagaacatctgagacccaagaaaaagaatgtgaaacaaaggacctgccagtccaatatggtagcagaaatggttcagaaacatctgacatgagagatgaaaggaaagagaggagaggtcctgaggcccatggaacagcagggcagaaagaacgtgacagaaaaactcggccactagtcctggaaacccaaacacaggatgggaagtatcaggaactccaaggattatcaaaatcaaaagatgctgaaaaaggttctgagacacaatatctaagctcagaaggaggagatcagactcaccctgaacttgaaggaacagcagtctcaggagaagaggcagaacacaccaaagaaggcacagcagaagcatttgtgaacagcaaaaacgcacctgcagcagaaaggacactgggggcaagagaaagaacacaagatttagcaccacttgagaagcagtctgtaggagaaaatactagggtcaccaagactcatgaccaaccagttgaggaggaggatggttaccagggggaggaccctgagtcaccattcacacagagtgatgaggggtcttctgaaactcccaacagcctggcttcagaggaaggcaatagcagctcagagacaggtgaactgcctgtgcaaggggactcccagagtcaaggggaccaacatggagagtctgtgcaaggaggtcacaataataacccagatacccagaggcagggaacacctggtgagaaaaacagagctctggaggcagtggtaccagcagtcagaggagaggatgtacagctcacagaggaccaggaacagcctgccagaggagaacacaagaatcaaggcccagggaccaaaggcccaggtgcagctgtggagcccaatggacacccagaagcacaggaatccacagcaggagatgaaaatagaaagtccctggaaatagagatcacaggtgccctggatgaagacttcactgaccagctttccctaatgcagctccctggaaagggagatagcagaaatgaattaaaggtccaaggcccaagtagcaaagaagagaaaggaagagcaacagaggcccagaatactctgttagaaagtctagatgaggacaattcagcctccctcaagatacaacttgaaacaaaggaacctgtaacatcagaggaggaagatgaaagtccccaagagctggcaggagaaggtggtgaccaaaaaagtccagccaagaaagagcacaattcttcagtcccctggtcaagtcttgaaaagcagatgcagagagaccaagagccctgttctgtggagaggggtgcagtctattccagtccactataccagtacctacaggagaagatactgcagcaaacaaatgtaacccaagaggagcatcaaaagcaagttcagatagcccaggcatcaggcccagagctttgcagtgtatccctcaccagtgagatctcagattgttctgtctttttcaactacagccaagcatcacaaccatataccaggggacttccacttgatgagagtcctgctggtgcacaggaaacaccagctccccaggccttggaagataagcaaggtcaccctcagagagagaggctggtactacaaagggaggcaagcaccacaaagcaatgaatcattatcatctcaacatgcccccaatttctctcccaatcaccctcaatactcacgtgtacacattcagatgcagattaacaatcttttaaattctcttcctaaatttctacaaaaacaaataataaaatattcagcagtgggggacaccactaaagaaacatctgagcaaacaaatacagtcagtaaaactcctaccaaacaatgctacttccaaatgccaaaatgggctttgtcatgagacagtttatctcaatgtacctgtcattaaaaatggaaaaattccttccatatctttagcaggtgccagtttttccaactgattcattgaatttaaaatagagcagtaggaaattataagactctgcaataatatctcataatcataaaatattaattcatatatatagattactctgcttcatgacatttcctagaagtatttcaagttcatcct

SEQ ID NO: 472514 - DNA, 569 bp, Homo sapiens
ggggcactcctccagccacggccaacatgggtctggctcaggtcgttcttccagccgtggcccatatgagtctcgcttgggtcactcttctgtctttggtcaacatgagtctggctcaggacattcctctgcttacagtcagcatggtagtggctcagggcacttctgtagccaaggacagcatggttctacatcaggacagtcatcaacctttgaccaggagggatctagcacaggccagtcttccagctatggccaccgtggctctggctccagtcagtcttctggctatggccgacatggggctggatctggccagtctcttagccacggccgacacgggtctggttcagggcagtcttccagctacggccaacatgggtctggctcaggacagtcctctggttatagtcagcatggaagtggctcagggcaagatgggtattcttattgcaaaggaggaaaaggtgaaggctctgaaagcaaagatgcagcagcggtagtgtctttacttatcaaaaccatcaagtcctttttcttgggtatatatttaatcagaaaaaaaaaaa

SEQ ID NO: 472515 - DNA, 1562 bp, Homo sapiens
agtcttttccttttgttagttagacctgtaggtttgcagagctcctcctagcagtgtgagcaatgagattttggtggccgcggaaagtaggaacgagagagctggagcacgccccctacctctttggcctctgtggttgctggcgtctcactcaggtttttgggtgccactgtgttcccctcatccagaccctggtacttgcagcggaagccgcctgtggtacacctggtccagctgcagcctcgcaaggagctggtgccggtgccggttcctggagctgcatgccctgccgcagcagctggcgtgcctggctgtgtgcagtggccagaccccacgatcacttgctcacaaaccccttgccactctgtacctggctctgtgcctggcttgcctttggcagccgtgggatccagggtggtagcgtgagccgagtgcagcttgccaggtcgagtgggtggaaccagcccagcaggcatgagcaaaactcaagcagaggtaccaccggctactggggctggtgaagcaacaccccaaaaagtcctgcatcattttaagtggctcatccgggatctgtagatgtgtctttgaggaatcaccgcactgctttacgcaatgattgatttacactcccaccaacactgtgtaagcttgccttttcaccacaacctcatcagcatttgttattcatttattttttttactttttaataatagtcattctgacttgtgtgagatggcatctcattttggttttggtttgcatttctctaatgatttgtgatattgacctttttatcatatgtttgttggctgcatgtatgtcttcttttgaaaagtttctgttcatgtcatttgccaactttttaatgtttttttttttcttgtaaatttgtttaagtactttgtagatgctggatgttagacctttatcagatgtgtagtttacaaaaattttctccccttctgtaggttgtctgtttactctgttgatagtttttatttttatttttatttatttattttttgctgtgcagaagcttttaagtttaatcagatcccatttgtccatgtttgcttttgttgctattgctttttacatcgttgtcatgaaacctttgccggttcctatgtccagcatggtattgcctaagttgtctttcagggtttttatacttttgggttttacagttaagtctaatctgtcttgaattaatttatgtatatggtataaaaaaggggtccagtttcaatcgtttgcatatggctaaccaattatcccagcaccgtttattcaacagggagtcctttcccattgcttgctttgtcagctttgccaaaaatcagatggtacagcttcattttaatataaataagttatattaaatttatttaacattaaaaataataaaatgtttaaaatgttaatgaagaaaataaaatgagtgaataattctagacaagtgatgttaaaacatttattaaaaatggttatttgttccagtatccactaatgaaggattaagtaattcagaactacctttctgctgaagacaagaaaaacc

SEQ ID NO: 472516 - DNA, 912 bp, Homo sapiens
tgcccacagcagaagccatgtacagtacatctggtccagtagcagattcgcatggagccactacctgtgcctggagctgcctgcccagcccgctgcagcagccagcatgtttggctgtgcacagtggctggaccccatactcgctcatctacacacccctcactgctccatgcctgccttgcgctttgcaggtgtgggatctgggccggtagagctacacagtttacactacaagtccccatgtcccagcttcgccattggcctcctgaacctgagcaagtgaatcataaagcctcaggttggaacagtttggagggctcccaaggagacaggaagatgagggaaagtttggaacttcctagagacttgttaaatggttttaaccaaaatgctgatagtgatatggacaatgaagtccagtctgacgtggtttcagatgaagaggaggaacatattgggaactgcagcaaaggcactcttgttatgctttagcaaagagactggtggcattctccccccgccttagagatctgtgaaactttgaacttgaaagagattatttagggtatctggcaaaggaaatttctaagcagcaaaacattcaacaggtgacctggtttcttctgaaagcatagaattatatgcattcacaaggagatgatttgaaatcgaaacttatgtttaaaaggaaagcagagcataaaagtttggaaatttgcagcctgatcacggggtaggaaagaaagacccattttctggggagaaattcaaacctgctgcagaaatctgaaatatactgcagaaacccctgataaacccatcagatttcgtgaggcttattcactaccatgagaacagtatgtgagaaatcgtccgtatgattcaaattatcttacaccgggtccctcccac

SEQ ID NO: 472517 - DNA, 624 bp, Homo sapiens
cttgaccactattttctaggtatggaatttccaagatgttcagatgtgtccagcgtttcttccttccagtgggttcatggtcttgctgacttcaggagtgaagctgcagaccttcgcgaacaaactacacaaggacaggtggaggcaccgagaaccagatcagaagccattccttcagcgacccaaggagagggccttaccgtccccagttaacagccacaacacaactcaagattattttcagacagtatatgtaagcatggatagatttttatgtatgcattttattccaaaattttgctttgctattttcaataaatacttgatatatttaagaagtcatgggttaaggaactctacagcttttgttagctcaactctaaagctcctgcaaaaagaagatggaactgtcacagacaaaggctcctatggagatgtggtatctaaatgtcatgtggtgccatggatggcatcctggaacagaaaaggggcattagaaaataaatactcttagatgctaaatatacatataatcaataattgcagcatttacttgatatatttagatcttttcttcagtccatttacaaatattggccaaataaatctttaaaatggtttatc

SEQ ID NO: 472518 - DNA, 588 bp, Homo sapiens
agggtttatcttctcagacaaatgtggaaagggggacagcagcatgggtcaaggagggaatgttgccactattggagatgggaaagctattttttctggcaaaatgttcatcagagtttacaagtccagcttcatcaggttcctcccaaatgtccccattctaagtttcggggttccatccttttccaatcagtgccctcactttaacagtagacacctggtgaggctgtgcatgcacctttcatttcaggcatttataatttatcgagtacttttaactcctctaagtccaggtaaacaagcaggctccagagctctggaaaaaatcggagctagtgaagcagcactgatgagaaataattgtgacttcttatcccagagcaaaagtattttggtttctgcatctgctttcttatctgttgctgtgggcatcctacgaatcacagaaattcattgaaatggaggagagggatctgtcccatgctgttccaattagggaggtcctgttcccatattctgagaattattgactcaataataaaagcaaaggcaccaaattgcatactagatcttaaagccttcttccag

SEQ ID NO: 472519 - DNA, 530 bp, Homo sapiens
gagagaaagcaaacagtaacaaaagttcttacattgggctgcagatttcaggctgcttttggcttgaagatattcattcagtaaatccttaatcagtgatgactgagtgtcagatcagctcccaaaaactggggctacaacataatttgctagagaccgaagatgtagggatcggcagctacagatatattccttattcacatggagtttgctgtcaaatgaagaaacaggagaaacgacttaataattgcatttctacaggagagctgtggctccaatatcaatgtgtttatattcatttgctcaatcctacagtactgcccaaatggttacagaatttctacaaaaaagggggcagaagctggggagccaagtggtccagctcagcggatcccacccccacagaacctagcaagctacgatccactggcttgaaattctcactgtcagcagagcagtctgaggtccacccgggacactcaagcttggtgcggaggggcatcctcctattgctgaggcttgagtaggcc

SEQ ID NO: 472520 - DNA, 600 bp, Homo sapiens
tctctggaatgtttaagtgtagtagggaagctgatatttgatatggctgaagccattgcagctgctgctgctaccagaactgcaaacaagatgctgctgttgctcctactggccttggcagtcatggcaaggattttggttgtagatatatggaaacctattgcacattttgagcagagaagttacgtgattgattttcagtttaaccagttacactattttctgttaagcacagaaagagtggaattgggaaggcagaacaagttagatgtggccatgaaaaggtgttctcagtggagtgtgaagggaagtgatgtggaccacttctggagctggcccgcaaaatctcctaaaagatcatccacgctctctccctcatttaccaaatgcatagagaacatcaaaagacttcctacaatgttggattctagagggcatcctgcctgcatttcttggctactctcctcacttctcccaatcactccaccaatgcttctgtcctcacatctctgactctttcattctacctccctcttgcaagcatgcttgtgattacattgggcatttacagctgatctaagataacttctacatctccag

SEQ ID NO: 472521 - DNA, 3441 bp, Homo sapiens
cacctttcctacacgcatgggttattcccacatcaacaccaagcctggggccagctggtcaaccaggcaccttgctctcctccgttccctgagctcaggtggcataggcgttgccgtgagctgcggagaaatctccacgcagagtcgcctgttgataaccctccagttaaaacgttcttggcagcgggagcccctcagatgtaaatttccctttcacacgcttgagcttcagccctcctttcttcaaatgaagtcacggactctgatggcactggcttgtcaggcaggacgaccggactgggaaagagaccaggtagaaactagtgacctagtgacgggcgctttcgggggcgctgtgccggtgaggcttaggcaaggggacggggaaccgtggttagatgcagcagcggcgcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcggctgttgtccagctctaatgatgtcctagagcagaagtgtttcttctgatgtctcattttaacaagaggatgatgtctgtgtatgtctctgtgttttagagaggctggcaaatgctgctaagaggatctgaggttcacataaagaggatgaaaattctgaattactttcattgcaaataaaccttaacaattgtgagagttagagagcatacttttcacataagactttggtatgctgcctaaagctacttacataatttgctattcagagaaatgcatttgtttattgaggacccacccggacttaaattggaaaaatgtaacattcagatttttattttatatgtgaaataaatgtgtgattgctgttcttaaaaatttgaaaaaaaaaaaggataacaagaatattaattttgtgacccatagttcatgaactttaaaagtgtttacagcatttaaagtttatttaacaatttaagtatttgagcactatactaattcatatggttacatttgatcaactccttcatgaagccataggctttatatctcctagctgccttttaccttcagaacaaatctggtttatacttagattgctccaaaagttatgcattttaattttatgttgaaaatgtctttcttagataatcacggtgcatatttgcagctaacactttagtatattttatattagtggtaatgcttttattagccatcctgggtgctgccttcttataagagctatgtatgagtaccaactaatatatttctttttttttttttctttttcttacctattaacccactaaaatttctaatctaaaagcaatattcaagttacattttattacagaaattggaaagcaatttgcctgggaagcaaaatgttgatatgattcaggtgattttaacattaaatctaacttgtaacaaaaacggattatataaagataaataaattgagactattatttgcatagcaaagaaagtcaaacatgacccacacatttatgcacatataattaatttcaataaaatgtttatatttattcattttcatctctgctatgtttgcttttagagttttctctttgaaagagtctaaagttttaaaaatacctgtgtatgcaggaatcttcacattttattttgtaagatcaataatgctgctaaataaactggggctaatgtgttcaagtctcataaaaagtgtgttggaacttgaatggacattaaggaacatttaatcttatcactcatgatgatgaagaagttaagaaccagagaggttaaatgattagtgtaatcatacactaactaataacctaaggaactttaaatgcaggtttattaacttcttagctagtgttcattctatattagttacattctattactaagacaggcattgtttgagagggggcctaggaaataagtgaaaggaagagaaagtagtacaaagatgaataaatagtagccagtctttttagagtccattttgttgataactaatactctttattgtagaaaacttttattcccctgctttattttatcctccactccgccgccttcccatgattggagatttcatgtaatttacctttgcagaaaatatcttcagtattcttagacatagtgcggtggctcgcacctgtaatcccagcactttgggaggccgaggcgggcgggcaaatcacgaggtcaggagatggagatcatcctggccaacatggtgaaaacctgtctctactaaaaatacaaaatttttctgggtgtggtggcacgtgcctgtagtcctagctactcaggaggttgaggagaatcgcttgagccagggagtcggaggttgcagtgaaccaagaccttgccactgcactccagcctggcaacagagtgagactctgtctcaaaaaaaaaatatatatatatatatatatgtatatatatatatatatatatatacacacacacacatatatacacatatatatgtgtatatatatatacatatatatacacatatatatacgtgtatatatatatatagtcagtattctttttgtacactcattgagttgctgttccctagactattttccctcatggtatataaactgtcgataatttcaaccacctgcagtgtcatactccgtcatgtcacctgtctgctctactttttaaattccctaaaaatgtagaaataggattgttccaagaggaaagctgtcctctcaaaataagaagtttaattagactctaatacatatctgaaactatacacacagaaacacacacacacaatatgaaagaaacgcagagactaagacaacatcttttaatggaaacattatgtaaaacatacaaacaaaaaaatctcaccacatgttccattagtataaaaatagtttctaatttgaataaaagctacaagacttcaactattttggaaggttcagtgttctggagtagtttgagccataccagtgttttcatatacatcaatatttgtgtgttacatacaagccatttttgttttgaaaatggcaattctaaagtagaatatcaacattaagatctatttggcactaatcatcacttcaaaagggttatcattactggattaaacaagatgaacatagaatcaaatcaaacattttaaaatgtctgcagtgtatgcttttaaaatttaaatttttgcactaatctgaaaaattagtgctttatagaagcatttct

SEQ ID NO: 472522 - DNA, 805 bp, Homo sapiens
cctgaataaaccaatacgttagggatatatgtggaccatagcaattctgattatagttgctaatcaatgtccgggcttatggaccagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggaagaaagtgttccttctctcattattatctaggatgttatctgtgggtttttcatacatgctctttaatacatggaggaagttctttttaattcatagcttggtgagtgttttttacatgaaaatgtgttgattttgtcaaatgcattttatgtctattaagcatgtaatttttattttttaattctatttacatgatttattacattagttgattttaggatgttgcataaactttgcattctttgggctaaatctcatctggtcaatgtgtatatttcttttatatgtggctagatctagtttgccagtagtttgctgaggattggtatgcct

SEQ ID NO: 472523 - DNA, 548 bp, Homo sapiens
ccattgtatcttggaaataaggaaatgaaggcacaaagaagtcaagtgcttttccaatgccagagaagtaagagatcaattcccttgcaaagttatcaaggtgctggcaacaatgcattaggtctcttccttggagataacattcaggaaactgataatgcagaacacaaatattccgtttgtgtttataacgaccttcccttctgtgaccatagacgaaaactgactttcatcaatgttttaagtaactgtgcttacatcagggctttaaggtggttggaaagtaatgcttatccagtagaaatcagtacaatactcgcttgtgctgttgagcaatggcagcaaggtgcaactcccagtcagccaaatgatcacaaggtaagcaatcaatatgccacagtggactgtgttgtcagataggcttccccactgtaggttagtgtaagtgttctgagcacattgaagataagctaggctaagctatgatgttcagcagtgtattaaatacattttcaacttacagtattttcaacttaagatgtgtttat

SEQ ID NO: 472524 - DNA, 987 bp, Homo sapiens
gaaggatcgtatgaatgccccatggaaaattacaatcaaacgtcaactgatttcatcttattggggctgttcccaccatcaaaaattggccttttcctcttcattctctttgttctcattttcctaatggctctaattggaaacctatccatgattcttctcatcttcttggacacccatctccacacacccatgtatttcctgcttagtcagctctccctcattgacctaaattacatctctacgattgttcctaagatggcttctgattttctgtatggaaacaagtctatctccttcattgggtgtgggattcagagtttcttcttcatgacttttgcaggtgcagaagcgctgctcctgacatcaatggcctatgatcgttatgtggccatttgctttcctctccactatcccatccgtatgagcaaaagaatgtatgtgctgatgataacaggatcttggatgataggctccatcaactcttgtgctcacacagtatatgcattccgtatcccatattgcaagtccagagccatcaatcattttttctgtgatgttccagctatgttgacattagcctgtacagacacctgggtctatgagtacacagtgtttttgagcagcaccatctttcttgtgtttcccttcactggcattgcgtgttcctatggctgggttctccttgctgtctaccgcatgcactctgcagaagggaggaaaaaggcctattcgacctgcagcacccacctcactgtagtaactttctactatgcaccctttgcttatacctatctatgtccaagatccctgcgatctctgacagaggacaaggttctggctgttttctacaccatcctcaccccaatgctcaaccccatcatctacagcctgagaaacaaggaggtgatgggggccctgacacgagtgattcagaatatcttctcggtgaaaatgtagacatacgttctgtgttagagtcaaagc

SEQ ID NO: 472525 - DNA, 1601 bp, Homo sapiens
gttgacctcatgtacatctccaccacagtgcccaagatggcagtcagcttcctctcacagagtaagaccattagatttttgggctgtgagattcaaacgtatgtgttcttggcccttggtggaactgaagcccttctccttggttttatgtcttatgatcgctatgtagctatctgtcaccctttacattatcctatgcttatgagcaagaagatctgctgcctcatggttgcatgtgcatgggccagtggttctatcaatgctttcatacatacattgtatgtgtttcagcttccattctgtaggtctcggctcattaaccactttttctgtgaagttccagctctactatcattggtgtgtcaggacacctcccagtatgagtatacagtcctcctgagtggacttattatcttgctactaccattcctagccattctggcttcctatgctcgtgtgcttattgtggtattccagatgagctcaggaaaaggacaggcaaaagctgtttccacttgttcctcccacctgattgtggcaagcctgttctatgcaaccactctctttacctacacaaggccacactccttgcgttccccttcacgggataaggcggtggcagtattttacaccattgtcacacctctactgaacccatttatctacagcctgagaaataaggaagtgacgggggcaaaatcaagactttctgttacagaaagtagaaaggagaaagaggaacaaacgtttgtgtgtaaaaagcatatatgtggtgctttttattcatcgcataaaagcctgaagctaagggctttattcagatgccttgcattttgtaccagcagcaaaagcaccgatgagatctacatggtgatccagggggccagagccatggaatactaggaaccttctacatgatggctgctcctgatgcagattattgctaagactctgagactgagtgcatacaacatgggttggtgttctctgaagcttttgggttaattccgccaggtttttcacttcccggccaactcctatgcagaactatacttcagtcagttactgaatgcttatgttttggtcatgtactacagcattgtaataacctgccagaattaagaaaacctgtgttgccagggaggatgttttatttttttatttccaaaattatttccataattttgaggatttcctcaaaattaatagcattttgtaaacaaagaatctggatctcccctaataatttaataactattccattttatagtctctcatatacattttataaaatttgtaaaacatgacatttgcctgtcaattaacatgtatacgtatgtaactaacctgtacattgtgcacatgtaccctaaaacttaaagtataataataattaaaaacaaacaaacaaaaaacatggtctctgagatcaccttcgctttcatattgtattccatggcaacaatgtaatagttttgtaatagtttttcttgttatgcatcatgaagaatcttggggaaaaacccacaacttgtgtgtatataggatttttccccccttttctttggggttacttcttagaatgcaacttggatcatagt

SEQ ID NO: 472526 - DNA, 686 bp, Homo sapiens
ttagtgttgtcagcctttctgtaagctgcccagcacataggccaaaatgaaggacatgggaaggcctaaagtgaaaatctttttggaaatgctggtattggcttattcctcaccccagacgtctctggagattttgcaggggtcgcccagagatctgctggagtttgctgggggtccgctcgagatcctgtttgcctggttatcaccagcagaggctgcagaacagcaaagattgctgcctgttcgttcctctggaagcgtcgtcccagagaagcacccaccagatgcagctggggctctcctgtatgaggtggcagcggatagttctgtcttgctggcattccaggcgccacttgtgtatggaaaaagactcctgcagctagctcagtgtctgcccaaacggccatccagttttgtgcctgaaacccagggcactggtggcataggcacctgagggaatctcctgattagacctcaaatggacacatcctgtacgtggacagcagagctatggaaaacaagagggatgcatttgtaaccctctgtttacactacaacctaacttcttcagcagctgagtccttgtcaagccaaaaggagtgatagtagaaaattatattcgtacagccaacatttaattgttgacatacagaaaatacttttttttcagttaatttcttaattat

SEQ ID NO: 472527 - DNA, 617 bp, Homo sapiens
aggaaaaccagagacccttgttcacttgtttatctgctgaccttccctccactattccacaccagcctttctacacatgtagcccttcctcttccaaagccttgatactggctactccctccccttgggatgccctccatacccatgctgtgtgacttcctcctttgtttcaggggagagcgcaagtggcagtccctagacctcatgtcaccttctccaggctcaccctgcatggcagttgatcgatttactgcctcaagatggttatgttggaggattccaatagttctactggatgtggagccagaaattgtgtggaatgcctggtgtttctttcagttcttggatgccaatctgagggagcagttgggtgagcacatgaccaatcagcctgagcatttaaggcagttggaggagagtgtgagttatggtcatcattctcctctgtgccaaacaggggctgatggatggtcagggcaaagcacagtgctgtcctcatggttctgggagggtctgcgttgtctgctatccccacataaactgatgaggacctgcactcctgtcctgagttgacacccagccttgaggtcaagaagatgacagatatttggggtaac

SEQ ID NO: 472528 - DNA, 1081 bp, Homo sapiens
tttaatcaataaaattctcctggtaaacctgtgggaacccatgaaaactatcgcctatggtggctgtttggttcacctttacaactcccatgccctgggatccactgagtgcgtcctcccggctgtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgctcatcaagctggcttgtgtgggcaccacgtttaacgaggctgagctttttgtggctagtatccttttccttatagtgcctgtctcattcatcctggtctcctctggctacattgcccacgcagtgttgaggattaagtcagctaccaggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggaggtgaaaggggcattaaagaaagttctagcaaaggctctgggagtaaatattttatgattattaaaaaaaaatttaagtgacactgtgatgaattttttttttggtaaaaagtagcatcttttaataagaggattttttatgggctcttctcacattttcttttgattaaatatttgtacgacattttgcattatgtaaaatactatggaatatatgtctacatacatacatgaaacatatgtctataaagtcgcaacttggccattacccagtagcagtataagattttagtaccaggatgatgctggcctcataaaatgaattagggaggagtctctctttttctgtggtttggaatagtttcagcaggaatggtactggctcctctttgtacctctggtagaattcagctgtgaa

SEQ ID NO: 472529 - DNA, 1510 bp, Homo sapiens
gacagtgacatgaccttcgcatctgtgctgatttaccttcaccaagcaccactgcatgagaggtgcggatccccctggagggatgggattgggcaatgagagttccctaatggatttcatccttctaggcttctcagaccaccctcgtctggaggctgttctctttgtatttgtccttttcttctacctcctgacccttgtgggaaacttcaccataatcatcatctcatatctggatccccctcttcataccccaatgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccactgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttatttgcgaagtaccagctcttctcaagttggcttgtgtggacaccactgtcaatgaattggtgctttttgttgttagtgttctgtttgttgtcattccaccagcactcatctccatctcctatggcttcataactcaagctgtgctgaggatcaaatcagtagaggcaaggcacaaagccttcagcacctgctcctcccaccttacagtggtgattatattctatggcaccataatctacgtgtacctgcaacctagtgacagctatgcccaggaccaagggaagtttatctccctcttctacaccatggtgacccccactttaaatcctatcatctatactttaaggaacaaggatatgaaagaggctctgaggaaacttctctcgggaaaattgtgattcctatggacatgatttgcaaggaattcattataagccaggtagcttattcagcttctatttagtcaaacccatagttctaaatttcacatgaactatattactgctcacttattttctcttcataagggactttttccttttttatgtgtaactaagtaaaatgtttatatgtttatttgagagcataaactattgaaaagagagctgtggatggttgtaaattgtgatcctcaccacaaagcctctattttatgtctgatacttattcccagggattcagaaaaataaattattaagtatttaccatgtatttatctaggttaggagacttttcttcagttttaataaaatgttcagtttcctgccaaacactttacatttacatcgtaatgtccttcattatagctttatgttgaaaataagcaattcctgcatgtgctcgtagttcaaatttattggtcagtaggatattgcataagctatttttaaataacc

SEQ ID NO: 472530 - DNA, 1618 bp, Homo sapiens
gcagcgggaatacacgcaaaatatcagtcagtgagagcccaagccaattgctctaggccccgtggctggctacttatggggcactgtcctgaccagctctgctaagatgctcctggcccctccctccaccccgtccagaggacggacccccagcgccgtggagaggctggaagccgacaaagccaagtatgtcaagacgcaccaggtgatagctaggcgacaggagccagccctgcgtgggagtcctgggccgctcacgccgcacccctgcaacgagctggggccccctgcatcgcccaggacgcccaggccggtccgccggggaagcggcaggcggctgccgaggcctgattccctcatcttctaccgccagaagcgggactgcaaggcttcggtgaacaaagagaacgccaagggccagggtctggtgcggcgcctctttctgggtgccccgcgggacgctgccccgagcagcccggcctccacagagcgacctgcggcttcagggggttgggctgcgccccaggatgccccggaagcggcgggaaagcgggcgctgtgtcccacgtgctcgctgcccctgtcggagaaggagcgcttcttcaactactgcggcctggagcgcgcgctggtggaggtgctgggcgcagagcgcttctccccgcagagctggggagccgacgccagcccgcaggccggaacttcgccgccgcccggctccggggacgccagcgactggacatccagcgacaggggcgtggacagcccgggcggcgcgggcggcggcggcggctcggaggcagcgggctcggcgcgggaccggcgccccccggtgtcggtggtggagcgcaacgcgcgcgtcatccagtggctgtacggctgccagcgcgcccgcggaccgccgcgcgagtccgaggtgtgaccgccgcggctccggactggccccgggactggccccgggcacggaaaaggacacccctcttctggcgcgctgggtgcctttgcgtaagcccttccttctggaactcagtttcgcgtctgaaccttggggaggtggaacaagttgctgccgaaggcccttccctgctcccgcggcgaagggggagggagaggcctcttggtccctgtggagacccggtctggggagtcacgattggggtgggagatgagcaaacctgctgaataaagttaaaacgttatttaaatggggagctgaggaaggagcaaacgggttttcgcggttaaacccgtgggttttggaatgtgtgttcccggctgtgtgatcctgggcaagaacttgacctccctggacgcagcggcacccctcggttattaaggagggaggagtaggggatagaagtatttcaaaatagttgtaatgcgcatggcaaagtgcccagcatatagaaagtgctcaataaacgataactgctgtgacttctaccgaatgagtactaacactgttgtgatctccactggcctccaggtcgatccaaactagagctgggagctgggaataatgcgctttgggagcccgaggaggcgtctgctccagaaatctgggctccaccagatcctaaaaggccccattcccggagttttgctgccccagttgtgg

SEQ ID NO: 472531 - DNA, 847 bp, Homo sapiens
agggcgcttataattttgaactatgaccaatcagacacagatgatggaattcttgcttgtgagatttactgagaattgggtgctcctgaggctgcatgctttgctcttctcactgatctacctcacggctgtgctgatgaatttagtcatcattctcctcatgattctggaccatcgtctccacatggcaatgtactttttcctccgacatttgtccttcttagacctgtgtctcatttctgccacagtccccaaatccatcctcaactctgtcgcctccactgactccatctccttcctggggtgtgtgttgcagctcttcttggtggtactgctggctggatcagagattggcatccttactgccatgtcctatgaccgctatgctgccatctgctgccccctacactgtgaggctgtcatgagcagagggctctgtgtccagttgatggctctgtcctggctcaacagaggggccttgggactcttgtacacagctggaacattctctctgaatttttatggctctgatgagctacatcagttcttctgcgatgtccctgccctactaaagctcacttgttctaaagaacatgccatcattagtgtcagtgtggccattgggtaaaaattatgtcacgtgggtttagcacagaaataataaaagacttactgaataggataggaaggacagcttgacattccttacatcacccctacatcaagcccaggcagcacagtgtggagggagataccctctgtatgaaggaaggaaagtgaagtgaacatccaactttgcaatcagtaccagcaccaggcccttgaataaactctagtgccaggtcag

SEQ ID NO: 472532 - DNA, 1347 bp, Homo sapiens
ttctgattgctagtttgcctctgctgttcattatggtagctatgcccaccttgcctttgatagttgactgcaccacttggcccctgccacctcgggatccaactattccgactgaatttacattttgtagtagagtggctgtggttcccactgttagagctgacatacagagaagagcaagtacaaggctcttcaaagatgcaggtgctgccctcacaaatctattttgcaaagcattggtcagggacaaatatggaaaggctgatggcagtgtggattggggaggagatgttgccactactggggatgggaaagctgtctcttctggcaaagaagattcatcagagtttgcaagctcagggtcctcagctttatcagggtcctcccacacatccccattccaagttgcaggatcccaatatgttccagtcaatgccctcactttaacagtagacacctggcctttggcatttgctattggctgcccactggatgctccggcgattttggtgatggtcggcccccagaaactctggggtttctggcatttggagtggggaccctcggtggctgatacttggggtactccaggttttcagcatctggtattggctgccccctgcttcctccagggcaccaggaagccacgcctaagggatcccctcctagctgctcccactagaaggcctatgccctccctggagcctcctcaggtccccagttctgaggggggtcccgccagtcctctaatgaaaaattccatcccaaggtcatcagacacccctcctctttatccagctaacccaagcatataccctctgatgactgagaaagtaagtccaaccagtaccaccaggagtgggaccccatatcagcccctaaagtcaaagctgtctccattgcaggagtgtccattagaacacatagagaccaaggatattgaaggtgatgacaatgaagccacctcagaagatcaagttcttccgtaccaactgatgttatcagtcactaagaggcacatccaacgaaaaggtctttgtcttagatgagtgcaataattctacactagcacatgttcagataaaattactacagtgtagtcatatattttataagtggtcagctctaagaaaagtgggaaaagaatgaactttcaaaagtagtcatggagtttgtagagttacctaaattgattaacaagattatttttaagaaacatctttaagttttcagttttgtctaattattaaaactcttcttgtcctatttacataaatcattttcccatatttttcttgcttctattttttattattatgtatgcatttttgggaattatagaaactt

SEQ ID NO: 472533 - DNA, 1119 bp, Homo sapiens
ccgactctgcggcccagcccgaaatgctgccgccaaggagcaacggcaccgcgtacccggggcagttagcgctgtaccagcagctggcgcaggggaatgccgtggggggctcggcgggggcaccgccactggggcccgtgcaggtggtcaccgcctgcctgctgaccctactcatcatctggaccttgctgggcaacgtgctggtgtccgcagccatcgtgcggagccgccacctgcgcgccaagatgaccaacgtcttcatcgtgtctctacctgtgtcagacctcttcgtggcgctgctggtcatgtcctggaaggcagtcgccgaggtggccggttactggccctttgaagcgttctgcgacgtctgggtggccttcgacatcatgtgctccaccgcctccatcctgaacctgtgcgtcagcaggtcatcagccctgaatcgaacctacgccatctcttcctcgctcatcagcttctacatccccatggccatcatgatcgtgacctacacgcgcatctaccgcatcgcccaggtgcagatccgcaggatttcctccctggagagggccgcagagcacgtgcagagctgccggagcagcgcaggctgcgcgcccgacaccagcctgcggttttccatcaagaaggagaccgaggttctcaagaccctgtcggtgatcatgggggtcttcgttcactatgccttcaacgccgacttccggaaggtgtttgcccagctgctggggtgcagccacgtctgctcccgcacgccggtggagacggtgaacatcagcaatgagctcatctcctacaaccaagacacggtcttccacaaggaaatcgcagctgcctacatccacatgatgcccaacgccgttccccccggggaccgggaggtggacaacgatgaggagaaggagagtcctttcgatcgcatgtcccagatctatcagacatccccagatggtgaccctgttgcagaacagatgcgatcagttcattgaaaagttcatgtagaataatatcttgaatctttctccatctgaaatctgtagcatgttttagaatcacatggcttttgagaaatcctgttttctgaagggctttgaaatgtgtgaa

SEQ ID NO: 472534 - DNA, 646 bp, Homo sapiens
tctggctttttcagcagaaagaaagaattcactgttcggctggaaacagagaagcggctgcacatggtgggcgagccggtggagttcagatgcatcccggaggctcagaatgttcccgaccgttactttgctgtctcctgggccttcaacagctcgctcatcgccaccatgggccctaacgctgtgcctgtcctcaacagcgaatttgctcaccgggaagccaggggacagcttaacgtggccaaagagagcgacagtgtctttgtgctgaagatctaccacctccgccaggaagatagcgggaaatacaactgccgggtgactgagcgagagaaaaccgtgacgggggaattcattgataaggagagcaagcatcccaagaacatccccatcatagtcctccccctcgctcagcttggagggaaacgaggaatcccagaaagctgtttgctcttgtgtgggaatcaagtcccagaagaagtgggtagatagatgcctgccttgaaatctcacttaaggagagctggtcttttatgggaggattttaaatcataaagtgcattattaaggatttgccatctgggtttttcaggtataaaggctggcatttccctaaatggcttttccctgttgaaattgtgtttct

SEQ ID NO: 472535 - DNA, 800 bp, Homo sapiens
tcacaccgaggagagaaactgcccaagccccagaggtcctttgccctactctgaatccagtccttatgtctaccccctacctttctctgccctgctctgtcccctgggaggagaacctagataaactgcatccttccttggcttcattgccttctggcttccagttgcgttcagccaatagtgagctctagcagggcactgtgatggtaactcttcctgctgttgctggcagaatgttttcattgtctcttgttggtgtcacttactctgtccacacctttgtggacacattaaatgccactcatcgatcccatttgaatgagagagagagacagagagtcctggtggacctgcgaaagtctcatattcttgatgagagacacatagaggaaaaaggtgtggaccgtaagaccagagatgtgtgggaagggaaggaactcagtgaatgcttgtgtggaccactggcgctagtgacatgggagtggctaatgcatcctcttgccgttcccggtgtttgggccctgcctgtgacggtgggaaaagaaaatggccttgctgtgctacaactggggctgcgctgggtgcaagaagctgatgagacttcgaagttgttgcacaggagagaggataagcatttgctgtgacaggccatgtatgcatggatattggacagccaaaatattaaactgaggaaaacacagtagtctgctatgtatccattcccttcacttttcttactaccagtcccctaatttttatggagttatcacacgctcagttagaaaatacgtacgttttaa

SEQ ID NO: 472536 - DNA, 814 bp, Homo sapiens
agataactctcacagtggaggtcaatatggaggctacccactccacattaccttcttttcaaggtcctgtttcccttgcctccataactgttgtgggtattgacggccaggcttctaaacctcttaaaactccccaactctggtgccaacttagaaaacattcttttatgcactcttttttagttatccccacctgcccagttcccttattaggccaagacattttaactaaattatctgcttccctgactattcctggactacagctgcatctcattgccgcccttctccccaacccgaagcctcctttgcatcttcctctcgtatcccccaaccttaacccacaagtatgggacatctctactccctccctggcaaccgatcacatgcccattaccatcccattaaaacctaatcacccttaccccactcaatgccaatatcccatcccacagcatgctttaaaaggattaaaacctgttatcactttcctgttacagcatggccttttgaagcctatatactcttcttaccattcccccattttacctgtcctgaaaccagacaaggcttacaggttagttcagaatctgcgccttatcaaccaaattgttttgcctatccaccccttggtgccaaacccatatactctcctatcctcaatacctgcctctacaacccattattctgttctggttctcaaacatgctttctttactattcctttgcacccttcatcccagcctctctttgctttcacttacactgaccctggcacccattaggctcagcaaattacctgggttgtactgcc

SEQ ID NO: 472537 - DNA, 663 bp, Homo sapiens
tttcaaaccatatgctgtcagtactagggtggactgcgacagtggtccagtcagaagcagcactttggctagacccatctgtgtatcatgcttcatcaggaatgtggggacacccttccttaaatggtgaaggctcagggtctagaggtgcctcaggcaccatggccttatcttgcattaggactacagttcccaagatctcttgcaactctgctgctaagggacttatatccagcgtattccgctgctctaacgcagtcaaaaatgcccatccaactctggcagcaaaggcttattccttcttggtgctctctgcttccagctgctccagagctttctccatgctgacaggggacccatctactgccaccccggtttccaccggagcccatccaagcagcagagctgccaccagaggtgccttctgccatgattgtaagtttcctgaggcctcctcagcaacatggaactgtaagaaaattgaggcccaacaggactagttaccctatatgcctgaacataaaacaacccagaatacaatgtgatccttcgatatccatatgggaagacatatacaataaaaatgacgacaagagcctgacttgaaaatatatactaataaaaaaataaattttaaaagttaaatatgtatgcatttgattt

SEQ ID NO: 472538 - DNA, 1201 bp, Homo sapiens
tttttctcatatgatatgctagtgttctctgtggatatttttattaacgcacatcctcctcacaccttccacagtctcctcacagccagcagctgcccgctttgctctgcatctgcatggcttcagcatcccacagccgggagagatgagctccagtccagacccccctcaccagaggagtgcggataccactgatcagatggaaggctttgatttggaaggcagctgtgtgacaagcaggctgaacatgggcactccttttgctaatcttcttgtggctgcctgtgtccctctgcttgtgacttctgtctccatcttcaaagcgtaccgttccgatctttgcttcccccattcacctttgatttactactacacccactacagggacaggcagaatgaaaagatccagacttcccgtgttagaagcagacctgacagtgcttctaactgtgcctttgcagagacaatcctagtaatactaaaaggctcaagaagaccagacgtccacagcctccgagggccactcaccacattagatatctgcacaaagccagaagttatccccacgctacctgtgaccaagtcttacacgtggctctcagcccccttggctgctcttcttcacttggcatctgaatagcagtggccaatgaatgaagggtcttgtataccatgctaaggacctctcagttctgcatgaatacttgtgactcataggtttgtatgctttgcataacctcatatttcttgaaggttttttttattgtttaaaattctttttcatttttgtttgactgggttaatttgagagacctgttttcaagctccgaagttttttattctgcttgatctggtcttttgttaaactttcaactatatcttgtaattccttcaataaatttttcacttttagaagttctgttattaaaaaatatgtatctctttagtaaatttttattcatatcctgaattgtttttctggtttctttgtgttggtttccaacttttttttggatctcattgagcatccttataattcatattttaaattctgtatttggcatttcagaatattcatttgattaggatccattgctatagagctagtgtgatctgtaggggttgttgtaacaccctgtgttttcatattgccagaattcttacactggttctttctcatttgtggaatctttcatttctt

SEQ ID NO: 472539 - DNA, 634 bp, Homo sapiens
gcgctgtgctgcagctacccagtactcagaagcccgtgggctccaccacggcagtgtgatgaaacgatgggacattgagtgccagacttacttctttttcttcctcatcaaggagaagcctcaggattgtgaaccttctcttcattctggcccagaagaagacagaaaaatgtgggaaagtttggaacttcccagagacttggagggctcagaagacaggaaggtgtgggaaaatttggaacttcctagagacctgttgaatggctttgaccaaaatgctgatagtgatatggacaataaagtccaagctgaggtggtctcagatgaagatgaggaacttgttgggaactggagtaaaggtcactcttgctatgcaaagagactggcagcattttgccccggccccagagaggatgcagagcataaaagtttggaaaatttgcaacctgatgatgtgatagaaaagaaaaccccattctctggagagaaagtcaagcttgctgaagaaatttgcataagtaacaaggaaccaaatgttattcaccaagacaatggagaaaatgtttccagggcatgtcagagaccttcatgacggcccctcccatcacaggactggaggcctaggagggaaaaa

SEQ ID NO: 472540 - DNA, 619 bp, Homo sapiens
ttttggaccaaaccagtgttctctcatgtggttacaatcaagccataggacagggctgctgtcatctgaaggcttgcctggagatggagattctacttccaagatggctcacttctacggctgtaggcagtgggtctcagttcctcgacacctattgacaaagaccctggcttatcatcatgaatttcaagaaatttgtggacacattttaaatggccatagccttgctaaaccaagtttcagcctgaatggttacttccttgggaggtgtaaccctgcctactggtggctggctggaattccaagccagtgggtcttatcctgtgaggtgccatggaagtggggtctgcagactgtcgctgctcagccccccggattcagcatctttcctagggaaccttatttttggcttttagtttttgactcttatattgcataacaaattttaagggctaatgagtgcctgcccacgtccatttccatatggtctaaaaaagtttaattggctatcagtcttttggctctaagtcccgtggccaaaggaaatcccaaagaaacctgaaaaactaactcaaaccatgacaggaaatagggggtcagacatgcttcgccatgctta

SEQ ID NO: 472541 - DNA, 703 bp, Homo sapiens
gtgcctgtgtcccggagacagccagactcaacggagaagatgagttcaactcccacatctccactatcccttgcttccagccaaagtcccaggactgactttcactggacccgtttgggccacatgcccctgcctgagccaatcaccacatccagcctggccagacctggctttcacgaagccccttcaggaagcggttggggtcatcccctccagaaggacatggggaaaaccagaaagtggcaggagggatgcttccttctgaaaaatagggatgcaattaccacaagaggtatcaggtacagggctggcacaaacaagagctatccacggcaccatcatgtaggcgtgcagcaggtccaccatgaagcaacctggctgctccgcaaaacggagtcacagttaattcagtcaatgagaaatatccctctatttgggttcccaccattcaccccaggcctggcacatcccaaatttgcttggtcaaaggcaagcaaattacccgccttttatgctgcacaaaaagctgaaaatattatcttacttctctggctcaagaactttctatgactccctctggctacttatgtggctcccccacccttaatgatagaagccaacattcatgaatccctaaccacatgccagttaccttatggacctgcctcttccaaacagcatagaagaggttggtactcttacc

SEQ ID NO: 472542 - DNA, 522 bp, Homo sapiens
ataacccgtaatagttaaaaacatgacgacacaaaattctgaaggaaaagaagaatggaatatggaagacaagaaaggaagaagcagtgagggaagaagaaaaccaacacagctacttatgtttttaattccctcacattatgaagacatgaagagaaagtttcaagatcttctgtctgaggaaaatgaatccacagctctatctcaggttctagcccagggccccttggaaagttccagggaaaggagcatagcgaggttgggggtggagtttgtagagactggctggctggctgctgacatcttcatgagaacagcaggtaccttggtgcataataacaggccaggttatattctcatccttgccctcataaagatacaggtctacagtctttgaaacctttgggctagataagttgtgaaatttaattacccaattttaggaaggtgagggactcagcagtcaggggagatggcaatgtgatgatgattgagtgtcttagtcttttttgtattgctatg

SEQ ID NO: 472543 - DNA, 706 bp, Homo sapiens
cagcagcatgaagaaaccaggccacgggcagcccagttcccactgttttgggtggccccattactatggcttttctgggcccactatcaccaaacgggcccatatattgcacaaactatcagtctttcctcagaacactctatagaatggggccaatgcctggtaagacacacaccagctgtcagtggtgggctgtctgcatgcacactggcctgctagcatgtgggagccctaccactctaacgagcctcttgtccaggagggccattagtgcctcagatctactcagtacagacccaaggtccttcccacccctgcaagtcacctttcacggctatagttcaaatggtaatgggccttgcccaaaactcaaccacttttgtaaagctaacgaaaggccattaggctatggggaggagaggagcctgagttctgctaaggcacaggcacaagtgacagtcagccattattccagaggttataagatatgcaactcctccaattacttctcatagcaatgtttatgtcaaaattcaaactgcaccaattttaacattaatgatcagaatattctacaagacccgttgttatttaaatgattatttaaaatattttatttgtaagattgagtatttgtccatgtacttggacacattctctctcatgcttgttttattttcaaagccatttgactatcagatctttg

SEQ ID NO: 472544 - DNA, 841 bp, Homo sapiens
agccattacttctcgtgttgacatgagccgtctaaatagacaaatgtgttccaggtcgagttatacacatatggaggctggacaagatgaggaccctatcacagactctgtattcatccctgtggctatatttctggagaagccagatgaatgcaagaactattttatattgatccctgacatttttaaacaaaactgtataaatagaaagtatgcactgacaaacaatgtcaatatcaggtgcacttgtggaagaaataaggacattaaaggtgatactgatgagggttctgaaagaaaagaggaagacagtagtgcaagctattattgttttagagaacatatatatcgttaccataatgttagtagaaatatgaacactaaaggtgctctggtagggtctcagctgaaaatgaggaacatgttatcagagactgaaagaaaaactgttcatgctatgaagtggcaaatacttggctgaattgtgttctagtgatctgtggaaggttcctgatgtcagtgccataaactggttcaggaaattgttataatataggcaaaacttcatactaatgaagaaattattattttcccaaaactgtggtctctaaaaacttgttttatgaacctgggtgctgctgtattgagtgcatatatatttaggttacttagttcttcttgttgagttgatctctttaccattatgtattacccttcccaaagttctttttactatataacattgactgccaatattctaagtcctaagattctaattagtaggtatttcccttcctttcaggtacagaggaaacaattctttagccaaatgtgctattgg

SEQ ID NO: 472545 - DNA, 481 bp, Homo sapiens
tctcatcagcccagtaagcgccaagtaccaagcaacagcagtctgatactgagaaatgacaaaaggtctcggtacagcctctggagtaccccttgagcattctatcagctacctggggataaccatgtctctgcttaccacagctaacactttaatgaacaattcaccaccaaggggcctgaaggtaggtccaggttcaccaagcttctcccccatagtacctaagcatactgtccagagacatgaagcccagtccaatccaccagtggcacctgaattctcctggggtctgagatcaggaccactcaatctgctgctaccaccactactggcaacaacctgcataaactactttaggtctgggcaccagcctgtccaacctgttgcaaccactacacatactcacatgcaccgctttggtcctaggcattgtcccaccactgctactgtcatcacccatgccacattcaattcttaagtg

SEQ ID NO: 472546 - DNA, 1140 bp, Homo sapiens
agcccctcgtccttctgttacttagcacctgtcatggggccaagaatccgagactgggctggtgaccgggctgtgaccacaggcccctcctctccggctggggcccatgtcttcaggttcatgcaggtccagacgggtcaaacaaacacagctcgcccacgcagggaagagggaaatccagactcagacacagagaggaggaggaggaggctgagacgacaaagcagacagtggggtgatgcggccacaagccaaggatgcttggagccaccggtagtggaagacgcaggaagggtgctcctgcagaaccttcagaggcagcgcggccctgcccgcacctccatctgggacgtgggactccagactgcgagggagtggacacccgttgttgaagccctgtgtgggcacccctatcacggcagccctgggattcctcaactgtgccctgtcacctctcaccctgctgctggagaggctcggtttgctcctggaagtcgtgactgtgaaatgtggatgttttgctgtgacgtccattgctactctcatgctggggtcctgctctctctgtccgggttccgtcaccgctgagctggacatcaaggccgaggatcttctcagtgggcagaagtgtgtctctacaaatagtgccaggtccttttcattatcctccctggtccctcccctcccctcccctgccccttcccctccctccctccttctctccctccctccttccatgtctggagaggaccccggcttggagcaggcatgctctgctctgttgtgaggcagatctcgggcctcctcactcaccgtcccactcgccaggagtctggagggcatgcttgggggctctcagttggggtctctcattgggtgccctcgggggctgctgccattgaaagcactctggggtgggaggccggcagtgtttgctaggggtgggagctcagctgggctgccagaaggtgtccccacatgggaacccctggatggggggctcagatggtggctgtcccctgcagagagatggcccaggagagtgacgtgggctgcctgctgctctgcaccggcctggacatggcaaatcactgtgctgtgtccactttccagtgtggggccttgagcactgccaagagg

SEQ ID NO: 472547 - DNA, 671 bp, Homo sapiens
ccttgggagaaaccagtgctgtgttggcttcaagtctgagccagtgaagttccagtggtgatggccatgggcatgattgtgtcacccatcccccagttccaggctgctcagcacatggagagagactgtttgggggaaaataagggaagagaacaagagtctctgcctcacttcaaaagaattcaaaagagctgttttgaggaagaaacatcagacttaatctgcactgtagaccaaatggatctaatagatatttacagaacatttcatccagtagctgcagaatacacatttttctccacagcacatggttcatcatcaaggatataccatattttaagttacaaaacaagtctcaaaacattcaaaaaaattgaaataagcatcttctctgaccacaatggaataaaactacaaatcaatagcaagaagagatttggaaactatatcaacacagtgaaattaaacaatgtgcttctgaatgaccaatgggtctatgaagaaattaaggaaattaaaatacttcgtgcagcaagtgaaaatggaaacacaatatacccaaacctgtggaatacggtgaaagcagtaataaaaaaattttagcagtaagtgcctacatcaaaaaatagaataacttaagcaaagaaactaataatgcatcataaagaatt

SEQ ID NO: 472548 - DNA, 839 bp, Homo sapiens
agtaggggatgggaggtctcacactgacctcaagtttatgtgactttttccacctctgctttcccagacagcccctgctgtgggacttgcacagcagctgtgctgtgttatgggaaactcctcctggaccctggtgccagcaggctagagtggccaactcaaaccacagatatagtggctgcccttccctccaggaactcggtccatctctggctgtctccagcctgctgcctctggccagctggaattccaagccaatgggttttgatgcaaaactcctgggtttccacgcatgccccagtgagccagcgagcattccgccgagactccacacagctctgtgcttcagacccaaggccatggtggctgagctcaccgggggacctcccaatctgcaggttgcaaagatccgtggggaaagcatggtttcccaggcagtcacgcaatcactcaccgcctcccttggctgcgagtgggggctccctagctccgtgccacacctggatgggccatcaccccacttgcttttcctcactccctgtgggcctagtgggcctagtcagtcccaatgcaagaacctggatacctcaactcaaggtgcagaagtcacttgtagttttcattgctctccatgagagccatgggccacagctgcttctaatcggccagcttggccccatctaaagtatgatttcttaatacatgagatgttttaagtacatgacaataatgatatttatcacaaataatattttatctcaatttcatataaaaattgctaacaaatcaattatttttggttaccacaaagctatctggaaatgtaacatctgccattt

SEQ ID NO: 472549 - DNA, 474 bp, Homo sapiens
tggcctctctcctcagcggcacaatggactttagacatcgcgcctgttttgtactctccaagccggacttctctactcgctggcctggcgctgatgcccagaggccccctgtgcttgtggtcgtggccttagacagttccctgccctttactgagcatcataacttcactgaatgctaccagttggattcaaaagtcagcaaactgaaacgtcgaatttcagccagctatcagaaatattgtaatctgacaacaaaagataaacaagggaacatggaagtggcagctattccagaagctgcacctctcagcatgggcacagaaccacagaagtggagccagagtcctctccacatctcctctgggtcggcgttatcattgtcacaatgggtggaggctggaccttgtgaaggcaaaggcatacggtgctttcttgcttctgctgtttggtgactcccttactcattccctctgc

SEQ ID NO: 472550 - DNA, 608 bp, Homo sapiens
ggaagatactatgggactaattccccacggcttaagaagtgaagtgcatctcagtgtccacaaatgcattgttggaggtgggacctggtgggaggtgatcagattacgggggcggatccctcatgaatggtttagcaccatccccttggtgaaacagagaggtcccatgatagacagtctgcaagctggaaatccaggaatgctgactcagtccaagtctgaaagtctcaggatcaaggaagctgatgatgtattaataactctcaatccaatgcagcccctactcaactggacaatgcccgcccacagtgagggtggttcttcactcagtccacagactctcacaccaatctcctctggaaacaccctcacagacacatctggaagtaatgcctcaccagctctccagagctctctagagaaaagaccatttgagaatatggcaagaaagtggctatctgcaagccaaggggaaaggccttaccagaaaccgatactgctagcaccttgatcttggacttttagcctccagactgtgataaaataaacatctgtagttttagccatccagtctgttcatactctgctatttactaacagtgtggcct

SEQ ID NO: 472551 - DNA, 651 bp, Homo sapiens
ttgcaaggtttgaaagaactgcttcaaacggaaagacaaagttcctgccaaagattaggataccatttttgatggtggccatagttaagcctccagaacctatacctttaaaatggttaacagataagccaatttggatagaatcatggctgctaagcaaagagaaactggatgctttagagaaattagttactgaacaattagaaaatgggcacatagctccaacattttccccttggaattctccagttttcataattaagaaaaaatcagctgagctagactgtgaaccgtttgcatttacaattcctgcagtaaacaacctgcagcctgctaagcgttttcattgtttcacagatgggtctagtaatggtaaagcttcttattctggatcaaaagcctgcccaaaggccagatgttaccagcagctgaacagcatctacagaaaccagctgcaaagacagaagcagaacaactggtttggtggagagatccaataacaaaaagttgggaaatagaattcagaagccattcgtgagcattcctaaattatggcaatataattatttgcataatttcaataagaatctgtttttggtaacaggattcaattggagacactgtttgttttatcaaggctttaactcgaac

SEQ ID NO: 472552 - DNA, 478 bp, Homo sapiens
gtaacaccgctactcttcccaacctctggaaactctcactaggacttccagtactatgttgagtaacagtgttggaagtggacattcttgccttgttccagatcttagaagaaaggctttcaggttatctctgttcaggatgatactggctgttggcaagagtcacactgaggaagggcaggttcttggcatcgctcaggaaggaatccaaaagcaagcctgtggtggaagaaagcagctctacaggggcactggcggtgttacagccctgcttctgctcctgcaggacagggagccctccaaatgggcagtaacttccagctgtttccatggcaagggttggggacttcccgtgctgccatggcattggcaaactgtcatggcactggtgggagcatcttctggtgatctgaggcctgaggtgctttcgctgtctctcccagtttcatgcgtgcctcttacctgaaagcccttcaca

SEQ ID NO: 472553 - DNA, 1347 bp, Homo sapiens
tttatcaccataagtgccaccctgacttaaaaccactcagagctaaaaaatcaaggcaaaatggatgctgcggtgacagatgattttcaacaaattctgcctattgaacagctgcgctctactcatgctagcaatgactacgtggaacggcctccagccccctgtaaacaggccctctccagcccttcccttattgtgcaaacccacaagtctgattggtctctggctaccatgcctacttctctcccccgcagtctcagccagtgccatcaactgcagcccttgcctcagcatctgagccaatctagcattgccagctcaatgtcccatagcaccactgcctctgatcaaaggctcttggccagcattacaccctcaccttcaggccaatccatcatccgaacccaacctggagcaggggtccacccaaaggctgatggtgctctgaagggagaagctgagcaatctgcagggcaccctagtgagcacctcttcatctgtgaggaatgtgggcgctgcaagtgcgtcccctgcacagcagctcgccctctcccctcctgctggctgtgcaaccagcgctgcctttgctctgctgagagcctcctcgattatggcacttgtctctgctgtgtcaagggcctcttctaccactgctccactgatgatgaagacaactgtgctgatgagccctgctcttgtgggcctagttcttgctttgtccgctgggcagccatgagcctcatctccctcttcctaccctgcctgtgctgctacctgcctacccgtggatgcctccatctgtgccaacagggctatgatagcctccggcgaccaggctgccgctgcaagaggcacaccaacactgtgtgcagaaagatctcttctggtagtgcacccttccccaaggcccaggaaaagtctgtatgaccttccaacaaggtggatccagagcttttctccttcgagtccccaacagcaaagcataggcctcatctttggagagggggaggagtgataaactagccaaagttagggcctctcttttgttcctgcagtgtcagggggaatgaccaagtacatcctggtgcaggatgccttgttctttctcacagtatctatcccactcctcttcagtctttacaccctgccagctcagcctttatggttgtcatggcaaattcaggtgatatatgggtatgaggtttgaacactgaggactgacagggccagcaacgtggaggtttaggggctccccaatgtaatacctctcgatgcaggctctgatcgtcactctgttttctgctgtgcctttggaagctttcttctaagatggttttcacagactga

SEQ ID NO: 472554 - DNA, 801 bp, Homo sapiens
tgaatgagtgtggattggcgagtgtgaatgagtgtggattgggaagggggaggtgagcccgggatggaaggaaacgcgggggggcagcagcactacagagggtgccagtggtggccaagagcaccgggaggctggggcagggccaggcttggcactgagcgggctccacttcacctgggagagtttcggccctgggagccctgccccactcacagctgggaaaacagacccaggaatgatgcctgtgaccccagctggggccccacaagacgcttcctgccacctgtcctggtccccagccctggacccaggagcccggctgctgcccccctgtggtggtctggggaagcgcacttccacccgctacagcctccagacccctccgtgcactcagggacccacagccaaggcctactgacctcgctggctggcacgtccagggcccaactcccaggacaatgtgtgacccacaagttcgtcctgttctagagaaactgctgggaatagcgctcaagtcctccccaaggtctgatgggcaaggaactcaagcttgagtctcagacacatttctgtgacaaaagacaagaggcccccacgtctctggtgagaggcagcccagccttcagccttcacacacggtgggggagaggctgcggctccagagcctccactcaaccgcctggggcggacgcaaaggcccctctcctgtcgctgagctgttgggggcagcagcttcccagtgcccacccatgccctgctacccaagtccaagggcccctgcacatccctgctcttaggaat

SEQ ID NO: 472555 - DNA, 1283 bp, Homo sapiens
tgttagaagaaactggcctagggcaccacaggagcagttatgcaaatcgcctccaggtgtggctctcattaccttttggcggctggggctgcagaacgccctgatgccacactgggccggattttggaggagcggggaggaacaaacagcctgcgcccttctcttcccccaactacagcttcagtggaaaagaaaaacatctctctggaagagcccccaaaacctcatcacatctggttcccatcggccccgtttggttctaatcatcctgcttcctgctaccgtctctgggtgcccccaacccctgccaagttgtgggaacagcccccaccccttccctcagccttcagcaaatcctgctcagtggggtccctgacagcttcattcagacatggaagactggtgctcaggagcccgcgggtggctgtggtcctggacagcgcagctctagattgaaaggctgtgtcaggggtgggttccaagtgtccccctgcagtcctggggatgcttggggtctatccaggctccagagggtcctgggctcaccatgaatgtgatggatcatctcgctgcccccggatgtttccccagacctttcctctggctgttcccgcagcttgggggcctgtgctttcatagtgcccacacacagcctgccaggtcccacccagacctccaggaaccctgctgtcccctaggcctggttcccctcacctcttggagtgggccttcccgtgcatcaggcactgtgttgggctacctgctccccacctccacctcccaccaaccctccctgggaggtccttggtaaccaggagtaaaccagaggctctgtctgtcctgagagcacagaagcaagacaaagtagtatttacctggaaggcgtttctcttcaaagccacttccagaggccccagggcctcagggacagagctgggatagggtagggtggtggcagcttgggaccggctgggagtgcatctctctctccagggcaggacactgccttcagccctcgcaggtgctgctgtcaggaccaggtgacacgtgatggacagcatttgtcccgaattataactaatcattaccaggttgcacgcactatgcgcaaagctctgccccacctgagtcgggtgtgttaactcccttcatcctcacagaaacccaagagggagctgcttccatggtaatgataattattatcatccccatttcacagatgagaaaactgaggcataaataggttaagtaactctcccaaggtcatacaaccaggaagcagc

SEQ ID NO: 472556 - DNA, 776 bp, Homo sapiens
ttctgccacgagagctcatgtgtaagctgagattggtcataaagaaagaaacatggctttagcacaatgtttgactcagataatagtaccaatactgataagaattgcagatgtgcagatcaaaaagcgcctcagcttgatgtatagtattacaaaaggctatatcaaaagtcaagaagatgccaaacttctaataaaacaaatagctgtctgtgaatcaatatatcagaaactatgtgaaattttggaaaccaacaaacaggatgctgtcaaagaattagtactcatggagcatgagggtcgtgatgttgtcattgctttgaagactaaacaggcaatccggaatgtgattgctaaagctctaaaaaatctcaccttcctttgttcaagaggcattattgataagcatgaagtcattgagataaataaggtacttcttaaaaaattaaaagcactaaataactttccaaaggcaatcccacccccaactcctgacatataccttcacaacatcatttggctggaaggtaaagatgttctcattgacttcttcaagagagaataccaaccttttgatgttatgaggattaggaaaacatctacgtaaaatgcctgacacatataggtgctcaataaatggtcaccattatgacaacagtgtttttaaagaatatttatttgtttttaaaacaactccattaaaaagtgggcaaaatatatgaacagatacttttcaaaagaagacatacatgtggccaataagcatatgaaaaaaa

SEQ ID NO: 472557 - DNA, 521 bp, Homo sapiens
atgactcctttgaatttttttgagctgcatttccctgatgatcaatgacgttgggcacattttcatatacctgtttgccatcttcagcaggtgatgaatcctgccaggactgggtccttcccttcaagacagcagtttctcttctgacccagggtgtgtctagaaatgttgtccaggaactagagcctgaactgggggcctcaaaactctgcccagtgccctattctgctgtggttgagctggtatccaagatgcaggacaaagttctcttcactctcctctcctcaagcagaaggaagaaagtccagacagagaggcagagaaaagatgataagatggctactgatttcacagctgcatgggaacagcaggtaggcaccaatttaggccccactctgatgaggtgggggataggggtagcactcagggctgtgtacacagccttctgtgtgagagtgactatctgagttgcatgcagtgccttgcgttagcagactcaagtttccatgggaacatactat

SEQ ID NO: 472558 - DNA, 833 bp, Homo sapiens
gggggatagcattaggagatataactaatgtaaaggacgagttatgggtgcagcacaccaacatgacacatgtatacatatgaagggaagttcttccctcacgttcattgaaaatgacttgtacaatgatgagcttttctcaaaacagaagcagcaagctgcttcacaccaacgtatacttggcccctctcctgtcaatccatatgtagcagatgcagatagaatctgttggttggcacaagaagctctgttgcacatggctcctatttttaagcctctgttggtatccatgtgcggagaacacggcttgttactgatggactctgaatcactccacaaggaaccaaattcagaaatccatgcaagcagcctaaaaatgaagaactgcttagtgtttttggaaaatactgccccatacactttattgtgggtgtctgtcaacaaccaatcccatcccaagaccaatgacacccagatggaatttatcctctggtaatctgactattggagatctcaccagtttctttgtcaatgatgtgggagatgtttacttctaatgagacaagggacaacagagtggaacagagtgtgaaacaaggtatgctttagtcctttagaaatttagttggggacttttgttttgatgtagctcattgtatttttctcacttgaaataatgtgaaataggctgctgattcgtgttttggtgcagaacattcgatgcgcaggaatgcttaatgatgttaaatagaagttacctattcttaaaaggtaagatcaacagggaagggatgggtcaggaatgattccatagtttttagtctgggaaaatc

SEQ ID NO: 472559 - DNA, 2321 bp, Homo sapiens
cagtaagctttactgcagcccctcatggatgacttttgctagtgcagtgcagaaaggaaatgtgggatcaaagcccccattcagagtccctactggggcaccacctagtggagctttgagaagagggccaccatcctccagaccccagaatggtagatccaccaacaggttgcactgtgtacctggaaaagccgcaggcactcaatgccagcccatgaaagtagcctggagggaggctgtaccctgcaaagccacaggggtggaactgcccaagaccatgggatcccacctcttgtatcagtgtgacctggatgtctgccagtcctctattagtattgtcatgcttccctaccattctttgaaggaaactggggtgtgtctcaggcccatgattagtcaagggcctagttcagccattgctactctgttgatctggcaacacaaggaaaatggggcttcaataagataattggtgtatccctttgtctagttttttgaaaaactctatttggattgtgattaaaagttatttaaatccatggaaaatgtttaaagtcagggaaaacctgacatcttaaaatattgaattatcctgtccaggtatattgtatctcattttttaggtgttctgaagagattttcaaaattctatattttttatggatagattgtacacagttttttgctatttttatttacttatattgttactgcttataataaatattatattttttaaattatattttctaaatgtatgcttagtatatttgtgtatattaattatatatccagaaaacttattaaactcctcaacttatttctggatagatgttccatgagtccttgaaaagactgttttgggtgtttccattatttggtggagtgttctataaatatgagttaaatcaagttgtgtctacttattctatcaattattgagagaatggtaataaaatctctgactttatggatttatttatccttgcagttacatcagtttttacttcagacttcttttgaatttagcacttttatccttttattattccatttgagctcttaggtttgcttattcactcaaatgttttattgctttttataaaatgtatatagtgtacaactttacacaatttgtcttaaagtattaccacataaaaccatattttttaataagaattttaaaataatatagttgtatttcttcactttaagttttcatcctgtgatgtcagatgacacattgatgaacagtttttattttaattacattagaaataggcaatttgcacatcaaagtcatgatttcatggttattgctcaggatagagctaaggaacactaactcaatagacacctgtaaccatggtgttaacctgttccatgaaattgaatgaataaaatgctctgtgcacaatgggttttcaggtatttgaagagttcatcatgactacactgatgggacaatttcaacttaagcgctacgaaattcctgagggaagagagaatcttaaaggattctcagacattaactaaaaacttgaaaatgtatgccaacctgttggcattgtctatttttgagagaaagaaaatactgggaagcaatgtgtttgcaatatagtcccaaggtgcaggcttagttcaataatttaaatctgtgaacgaaaagcagagctctttcttggtacattaattatactttcactagactttaaaatggaggagttatgtagacttctctcctcaattcaacaattttctgagaggtcactgagagctttgtctttcctacagtatttttgagggaaaatgtgttttaataagtaaaattatttctcaagagcttgaggacttgacactgatagaccagagctgaagatgctcagctctgccagaaccttttgcattagttcatatcctcaggagttttggactgacagtgctgaagggtttgaaattgggaaatatattactcaagtttgcccattaaaatattggaggaaaaaagtaccgaagttgcagccagcgtgacgtgcagtatgtgacactggaaaaatgctgtgaatttcaggggttgtctgagcatagaatcatgtgatgtgacaagtgcaggcaatacttttttttgtgaacagctgatttaacaggaagagaaaactccatggaaaagtatcagtgcataaactcctcctttcctaaactcaatgctattaattctttgattcaaagagtcaaattttgtcagaaaaatggaatacactctgacattctctgccaaatggatagacaccaaaaaatgacattaaatgatatttatgttc

SEQ ID NO: 472560 - DNA, 795 bp, Homo sapiens
tttgcagaaaaagatatagtctctctctctgtgctgagctgcctagaactgggggaggggtaagacaagcacccctgtggccaccaccactaggactgccctgggtcagacctgaagccagcatggcactgggtcttgcccaaggcctgtggtggccactgcctagttattgcttatattcactcaaggcccaatggtctacaatcagcagttggcaaatacagccaggcatgcgtccttccagtagtctctccctgtggccaccactgcccaggcccacagcaagtccacctggctactgctggtattcacttgaggcccaagggctctacaatcagcctgtggtgaatactgcccagcatgggtttctcccttcagggcagtgggctctcctctggtccaggccaggcccagaaatgctctccaggagccaaggcttggaatcagggaccttaggatcctgcttggtgtgctacaccactgtggctgagctggtacccaagttgcaagacaaagtcccatttactcttccctctcctttcgtcaagcagaaggtgtctctccccttagtccctacagctggggaatgttctgggtcacccctgaagccagcatggctctgagtctcacccaaggtccgtgtatttgtcattgtcttttttttctatttaaagtcaccttatttaattttattgttaattttgttaacattgaactcacaaccaacagcattataattcatgtctgaatgaaacttacctaacacagtattttctctgtaagacacattaaatc

SEQ ID NO: 472561 - DNA, 685 bp, Homo sapiens
tccttaacccaataacccgtagatggcccaaatacattcaatctgtagcgacaactgctttgctaacagaagaaagtatgaggcaattctgttaaaaaaaaaaaaaaaaaaagattcaacattaaccactaaaaattcccttaacccagcaggtttcctagcaggggatctaaatcttaattactacacaaagggaggaaacttagtattccttggagacctgaagggatgcagtgagcttaagaattttcaagagcttatcaatcagtcagcccttgttcatccccgagtggatgtgtggtggtattgtggtggatctttactggacactctcccaaataactggagtggcacttgtgctttagtccaattggctatccctttcactctggcattttatcaaccagaggaaggaaaaataaaacatcgatgatgctcataaaatgagttagggaggattctattttctattgtttggaatagtttcagaaggaatggtaccagttcctctttatgtgacaagccgcatgctacagacatctgggaagagtgataagactcacagaagtcagaggggagggagaaaaaaaaatagggggtggggtggctaatccataaaaggaaagaaagttttgtcattgggaaatcaaaacttaaagtggggaaggagacaagatgtaacctt

SEQ ID NO: 472562 - DNA, 621 bp, Homo sapiens
agtgtagcatctatattgtagaccatacaacacaaccaaacgttcctaggcactttgaaaaccgatacttaaacagactcaagggatgctatcacccacctcgaataatagctgctttggaatctgttattggcaccagaaaaagaaagagtcctctgaagtcattctaaagccatttttattgtgcattttcaaacaaagaacctcaccaaaagaacttctgttacaaaatcagggtagaaagtcaaactcatctcatctaagagtcaattaccctggcaattttgtgaggcgatgggaaatgagcgttagaggagaggactgtggggaggaggtgggattggcttttaaaatcccctggaaagaagaggcaaaatgttggaaagctttgctcccagatgtccatcagttgattacggttattggtatagttaaaattttcagtgttacacctcttttagaatttatctatcaggttttccagtaataaaaagctccttaataggttatgagtttcctactagattatgtatctcagcacctagaactgtgcctggtttatagtagatgtttagtaaatgtctgtggaataaatcctgtagaatttatctagcattttaa

SEQ ID NO: 472563 - DNA, 672 bp, Homo sapiens
cccagaaacctggcatgctgacaacaggcacctgtgaggttacttgcctcagtctctccttctggcttatgcccctcagtcaaattctttcttccgaggaggcaataattgaggttgctgcagatccatatggattcgtggctggagagtgggtgctccagatgcctcgagatctgctgggatgtggagcagagagggttcccttgctcaaagatctccacacaggacagggtagttcaaaaagctgcctagtggctgcaggggggcttaggcggaagccctgttgctctacgaggggcccttcagaagtcgctgggggcagtaggctcctagtcgtgcttgagagctatggtggcttccgtcgcgtccagggttttatccgtactcatcttgagccggcatctggatgtcatggaagagagcgcagctgccgtgttggctttgcattttcaggaaacgctctgtgccctggcgcttctcctcagccaattcgccaaagtgacccatgccttccagagacacattatcacggtgggaatagaagcccagacagaggcagatgtaggaggcccgcaggtgcaaattgaccaggcggttgatggtagcctcaccctccgtggaataattttgatgaatctgggagctcatggttggttggcaagaaggagctaa

SEQ ID NO: 472564 - DNA, 734 bp, Homo sapiens
gtctttaccagcattccataaaaatggaatcagacaatgttcagatgtgtccagaatttctcccttctggtgggttcgtggtctctctcacttcaggagtgaagctgcagacattcacagcagtggatgggacctggtgctacagagcagggggggtgttgctcatccaggaggctcgggctgcgcgggagcccaccacggggtgggagggctctggcatggcgggctgcaggtcccgagccctgccccacggggaggtgggtgaggcccggccgagaattcgagtgctgcatgggtgggccggcagtgctgggggacccggtgccccctccgcagctgctggcccaggtgctaagccactcactgcctggggctggcggcactggctggctgctccaagtgcagggcctgccaagcctgtgcccaccctgaacgtgcgctggccggccagttccgcagggagccggctccggcctcggccagcccagacaggggatcccacgatgcaggggtgggctgaagcgctcctcaagcacagccagagtggacacggaggtgctgagagcgagcaaaagctgctagcacgttgtcacctctccgtcaggcttgacagtgattgagttttatccagtagaatcttggtgcagatgagcataatgactgggggaataggggagccattgctgggaagacttgtgtccctcagtcaggtttctgtctctctgtttcccagt

SEQ ID NO: 472565 - DNA, 680 bp, Homo sapiens
catctggctccacagggtacccatttatggactacacttgcactttgcagggtttgctcacccttttgggggtacactcaggctttgtgggttacagcataggccctttgagcccttctgactcctccatggttgcaaacaactggttagtcctgggaaagtccaatcccaaaaggacctacatggtgtcacagattagtggatctgtgactggcagccccaacccccctttcgggttgcaagagaaatggttaacatattatggaggcttactgaaagaaattgtaacaagacttcttaccaatgaaaggaggctgaataaagctgtgaccattgccccagattatggggtatataatactgccgttagagagagtgaaataaaccagattgaatgtcaaaacaggaactcaaatattcctaatagttttcaggcgttctggatctctccgcaagacactgaacatgttgcagtgatgagtagatcaaactgtcgaagaacttgataggatggaaatgccttgcttattctgtagcagtgtgtgaatgtaaaataagacaaaatagtttgggacttagcaccaaggaggtactcagtatctgtgtgattggtatcaggagtcacctgagctgggagagagctgagctgccaaatattagaatagccaatcaaagcaaca

SEQ ID NO: 472566 - DNA, 595 bp, Homo sapiens
ctcctgacagctgtttcatcactcaatgatgttcctctctaccttgttcaccctccagttgtttgcatacctcaatcttcctggatgcagggaaccatcacattccccttgtccagatgcagatgcagatgcctgcagcagatgcctcatgcagtacatcttgtctagccacaaccttcagaagcctcatgcagtacatcttgtccagccacaaccttgcatagagcccacacctgtgctggcacctggagctggcctgccctgctgcagcagtgacatgcctggctgtatgcagtggccagaccctgtacttgcttggccacacacctcttgccacactgtgcctagctccaccttggcaggtatggaatctggaacaccttccattataacaaaagcaccctttgaacaatctttctattataatttggaccattattactcataaagatgctactaattggcctacaaattaagcaaaataaaatattttcaaataacgatctgcaaatagtttaaaaaacatattttatatttatttccttaaaagaatcttctaaccttgggatgggcagtcatttcctagtcttcaaag

SEQ ID NO: 472567 - DNA, 731 bp, Homo sapiens
gacattcttaaaatattttaaaaatggaggatgtaaatgtgtcctatacttgtggattaaggtgggggtatacaagaggaagacgtgaaggaggctttgggttgggaataagggtggcaatgagatgtggctgtagtccaggaatggtcagggaagcagataatctggttaaaatgtctcagcctaataaggaaactgcgcaggaggggataactaaaaaggagtgcataaaggaatgttgtccaagttggcaccaaagtggaggagttttaatcggtttagaagcctggccgtcaatacccactaatagttatggagcttactaccctcagcttgtttttgaaatcatcaatttaaaagcaaacacctatcaaggtgtcaataaacccagaaactagtgtaaaggacaactatattaatagaatataaaaatattaagacatgttttatttatgtatttatttattcatttattatattcttgtgaagcaacatatgacacttatgtagagaatatacttaagtgatcaggtccaagttgcaatattccaggtcaataatccccaaaccagctcatttctagttatcaaaaactttaataaagtgtaaaaaaagctttcttttggacttttcaaatattttttatgctacttcattttgtgtcattctaaagcaggaataaacttcagaattttttcagatttagttggataaggatttctatttggact

SEQ ID NO: 472568 - DNA, 1097 bp, Homo sapiens
ctcccacttctccccagttcctgctggcttcatggagtgtgcagccctggctgcgcctccctgctgcagctggcatgatggcagcggttgctacaaatggcctgccactgccatcaactggaagtccaagatcaaagtgttggcagaggctcctgcagcatacacatggcttcactaccaccttgctcctgcagcacaggcagcttctccagcaccaggcctctgatgtgcacccagcagacagcaatgtccccaacatcccttcctccgggtggttttgtaacagaatgcctccactgagacacctctccatgaacagcttttcccagcaccctaaagggcaattctccagcaatttcagagagcaagtttccagcaagagatgtgagaagagggcaggggaaaggagaaatgaaaggcaagaagggggagttgagcaaatcctacttccatttagaaaccagggagtagaaataagctgccaaaaacctggagcctggttaaccacttcctacccaagttctcctaccctcttttcatccccaacctagtaaaaatacttcccacccaaattaaactcagattgatagaaccatgacactcccctctggttcccaacttaaatgaaaacttacagagaagattttccctaaagagctttcaacacttttgcctaaaaagctgaccattgtgtttcccggctcttggcaaacctatataagatacctgagaatgaaaatgattcaaggtgtacttggcttcattttgctgtaggtagaggaaataattatatcttgcatttggaagtggtgtaatttggcagaggatagaaacatttacagataattgaaggaccacctcaccaacaaagatgaaaaagacccaaacaattcttggcaggactgcccagtcagggaaagacatttgaattttgtatgtatgaagataaaggggggtaagattgtctgtgtgcatttgctaaagagcttctttgatcacttgagactccctgaatttccactctgaaggtaaaggtttatatgaatccatcattagaaagagaaataataaaattaactttcatttacctgcattac

SEQ ID NO: 472569 - DNA, 1224 bp, Homo sapiens
agcccaaggtctagtaaaaccatgcaacagccctgcaatactccaattttaggagcacagaaacccagtggacagtggaggttagtgcaagatctcaggattatcaatgaggccgttgtccctctatacccagctgtacctaacccttatactctgctttcccaaataccagaggaagcagagtggtttacagtcctggaccttaaggatgcctttttctgcatccctgtacatcctgactctcaattcttgtttgcctttgaagatcctttgaacccaatgtctcaactcacctggactgttttaccccaagggttcagggatagcccccatctatttggccaggcattagcccaagacttgagtcagttatcatacctggacactcttgtccttcagtatgtggatgatttacttttagctgcctgttcagaaaccttgtgccatcaagccacccaagcactcttaaatttcctcgccacctgtggctacaaggtttccaaagagaaggctcagctctgctcacagcaggttaaatacttaggactaaaattatccaaaggcaccaaggccctcagtgaggaatgtatccagcctatactggcttatcctcatctcaaaaccctaaagcaactaagagagttccttggcataacaggcttctgccgaatatggattcccaggctctattacttgaaaggccagtgctgcaactgtgcacttgtgcaactcttaacccagtcacatttcttccagacaatgaagatagaatataactgtcaacaaataatttctcaaacctatgccactcgaggggaccttctagaggttcccttgactgatcctgacctcaacttgtatactgatggaagttcctttgtagaaaaaggacctcaaaaagcggggtatgcagtgggaacacctatcacacatcaggaagccattaggagattattactggcagtacagaaacctaaagaggtggaagtcttacactgctggggtcatcagaaaggaaagaaaagggaaatagaagggaactgccaagcagatattgaagcaaaaagagctgcaaggcaggaccctccattagaaatgcttatagaaggaaccctactatggggtaatgccctccgggaaacgaagccccagtactcagaagaagaaatagaatggggaacctcatgaggacacagtttcctcccctcaggatggctagccacc

SEQ ID NO: 472570 - DNA, 1840 bp, Homo sapiens
tggatcctggatagcaagaggccggaaagttggggtagcggtaagagggaagaagtcaacaggatgtagaaactgcattctttgattcatgaagatgagcatccggactccacccagactcctggagcttgcggggcggagcctgctgagggaccaagccttggtcatgtccaccctggaggagctgcccacagaacttttccccccactgttcatggaggccttcagcaggagacgctgtgaggccctgaagctgatggtgcaggcctggcccttccgccgcctccctctgaggcctctgataaagatgccttgtctggaggccttccaagctgtgctcgatgggctggatgcactgcttacccaaggggtttgtcccaggaggtggaaacttcaagtgctggatttacaggatgtctgtgagaacttctggatggtttggtctgaagctatggcccgtgggtccttcctcaatgccaagaggaacaaaacaccagtgcaggactgtccaaggatgagaggacagcagcccttgactgtgttcgtagaactttggctcaagaacaggactctggatgaatacctcacctacctccttctatgggtcaagcagaggaaagatttactacacctgtgctgtaagaagctgaaaattttgggaatgcccttccgcaatatcagaagcatcctgaaaatggtgaacctagactgtatccaggaggtggaagtgaattgcaagtgggtactgcccatcctgacacagtttaccccatacctgggccacatgaggaatcttcagaagctcgttctctcccacatggatgtctctcgctacgtttccccagagcagaagaaggagattgttaccaagttcaccactcagttcctcaagctgcactgcctccaaaagctttatatgaactctgtttctttcctcgaaggccacctggaccagctgctcagctgtctgaagacctcgttaaaggtcctcacaataactaactgtgtgcttttggaatcagacttgaagcatctatcccagtgcccgagtatcagtcaactaaagaccctggacctgagtggcatcagactgaccaattacagtcttgtgcctctccaaattctcctagaaaaagttgcagccacccttgagtacttggatttagatgactgtggcatcatagactcccaagtcaacgccatcctgcctgccctgagccgctgctttgagctcaatgccttcagcttctgtggaaatcccatctccatggccaccctggagaacctgctgagccacacaatcatactcaaaaacttatgcgtggaggtgtatcctgccccgcgggagagttatggtgctgatgcacccccacaggatcagcacccacaccagcacagagcattcatcacaaccaatgagccacagggacacatcattatcacccaatgtccatagttcacatgagggatcattgctggttttgtacattctatggattttaacaaagggataatgacatgtatccaccattagagcatcatggagagtagttttctttccctaaaattcctctgtcctcttcccattcatcccattgtgctcccaaccccttgcatccactgggctttctactgtctccttagaaaaatgcaaaagctttttctggaatgtctaacaggatgagtcttttcagattgccttctttcacttgtacaataacgtgcatttaggaatttttcatgtctttttacagctttataatagttcactgactggatggatcagtttgcttatccagtcactgaccgaagggcaacttgctagcttccaagttttggc

SEQ ID NO: 472571 - DNA, 602 bp, Homo sapiens
ggcgggaaccaagcaaaactcaggatgaaatccaaaagtaagcctgtggtggaagaaagcagctctacggaggcattggcggtgttacagccctgcgtcccctctggcagggcagggagccctccggcgaagaggaacccgtgggcctcgggcgatcccggggggccggaccagtgttccccagttgtgggagcagacgcgtgggcgcatcacaggcgagcgaggcctgacgtgccggtgcgggccgcagacagtggcaggtgctgggaggacacgcttggggtcccggcagtgaagcgggttccagaggcccaggagcacgtagccgaggccggtggccctgggcctggagtctgcaggccacgctcctgtcctgctgctgagggacccggttaccaacccgcatgtcactcagtttgcccatctgtcccagtgctaacacacagttctcgggagacgttccccatttccagagtagtagtgtgaaatgcaaactgcatcaccattaagcaattaactgtggaaatgactttaaatagttatagttaaagacaattgacaaggaaatttggttatttctgtggtctacaataacttaataa

SEQ ID NO: 472572 - DNA, 8411 bp, Homo sapiens
ggtccctgagaaccgcgcccagtcctggtccctgagaacggcgttttggttgggagtcggtgttgctggaggctcagtgagggatgtcaatgcgtgtagctagtcatggactggccgtgttgtttccatcatgggacacttgcaatgactataatgacagcagaagtcttcaggaatcctatgtgagggacaaacactcagaagccagctggagtgttctagaatcctatgtgagggacaaacattcagagcccagcagcagtgttctggaatcctatgtgagggacaaactttcagaccctcgtagcagggttctggaatcctatgtgaggggcaaacatttagaccctcgtagcactgttctggaatactatcagtgttctggagtcctatgtgatgaacaaactttcagaccacagcaggagtcttctggaatcctatgtgagggtcaaacattcagaccccagcagtattgttctggaatcctatgtgaggacaaacattcagacccacgtggcagtgttctggaatcccatgtgagggacaaatattcagaccacaacaggagtgctctggaatcctatgtgaggggcaaacattcagaaccttgtagcagtgttctggaatcttatgtgagggagagacatttagaccctcgcagcagtgttctggtatcccatgtgagggacaaacattcagaccctcccagctgtgttctggaattctatgtgagggaaagacattcaaactccagcagcagttttctggaatccgatttgaggggcagacattcagaccccagcagcagtgttctggaatgctatatgggggacaaacattcagaccccagcagcaggcttctggaatcctatgtgggggacaaacattcagacaatggcagcagtgttctggaatcctatgtgagggacaaacactcagagcctcgtagcagtgctctggaatcctatgtgagggacaaacactcagagcctcatagcagtgttctggaatcctatgtgaggaacaaacaatcagaccacagcaaagtgttctggaatcctttcaatgttctggaatcctatgtgagggacaaactttcagaccacaacaggagtgttctggaatcctatttttctggaatgctacgtgacggacaaacattcccaccacagcaggagtgttctggaatcctatgtgagggcaaacattcagatcacagcaggggtgttctggaatgctatgtgagggacaaatattcagacactagcatcaggcttctggaatcctacatgagggacaaatattcagacaacgacagcagtgttctggaatcctatgtgggggacaaacattcagagcctcgtagtgttgtggaatcctatgtgagagacagacatttaggccacagcagcagtgttctggaatcccatgtgagggacaaacattcagatccgaacaggagtgttctggaatcctatgtgagggacaaacatttagaccgtcttagcagtgttctggaatcctatgtgagggacaaacattcatatcctcgtagcattgttatggaatcctatggacattcagacaccagccacagtgttctggaatcatatgtgacagagaaacattcagaccacagcagcagcgttctggaatcctatcagtgttctggaatcctatgtgagggacattcagaatttcatagcagtgttctggaatcctacgtgacggacaaacattcagaccacagcaggagtgttctggaatcctatgtgagggacaaaaattcagaccccagcatgaatcttctggaatcctatgtgagggacaaacattcagactctcatagcagtgttctggaatactgtgtgggggacaaacattcagaccacagcaggagtgttctggaatcctacgtgagggacaaacattcagaccctcgtggcagtgttctggaatcctatgtgagagacaaacattcagaccctcataacagttttccggaatcctatggcaaacattcagatcacagcaggagtgttctggaatgctatgtgagagacaaacattcagacactcgcagcaggcttgtggaatcctacgtgagggacaaatattcagacaacggcagcagtgtactggaatcctatgtgggggacaaacattcagagcctcgtagtgttgtgggatcctatgtgaggggcagacatttagaccacagcagcagtgttctagaatcccatgtgagagacaaacattcagacccgaacaggagtgttctggaatcctatgtgagggacaaatattcagaccctcttagcagtgttctggaatcctatgtgagggacaaacattcatatcctcgtagcagtgtcatggaatcctatgtgagggacaaacattcagaccttcgcagcagtgttctggaatcctattgttctggaatcgtatgtgagggacatacattcagaccctcgcagcagtgttcaggaatcctagatgagggaaaaacattcagacaccagcagaaggcttctggaatcctatgtgaaggacaaagtttcagacaacggcagcagtgttctggattcctatgtcagggacattcagagcctcgcagcagtgttctggaatcctatgtgaagaacaaacaatcagaccacagcaggactgttctggaatcctttggacattcagaccattgcaggaatgttctggaatcctatgtgagggacaaactttcagaccctcgtagcagtgttctggaatcaaatgttgggtacaaacatacagaccccagcagcagtgttctgaagccctatgtgaggaaccaacaatcagaccctcatagcagtgttctggaattctatgttagggataaacattcagactccaacgttgttcttgaatgttatgtgaggaacaaacattcagaccacagcaggagtgtcctggaatgctatggacattcataccacagcctcagtgttctggaatcctatgtgacagacagtcattcagatcacagcaggagtgtcctggaatgctatgtgagggaccaacattcagacccttgtagccgtgttctggaatcctatgtcagggaccaacattcagaccctcgaagcagtgttctggagttctatgtgagagacaaacattcagaccctagtagcagtgttctggaatcctatgtcagggacattcagacaacagacacagtgttctggaattctgtgacagacaaacattccgaccacagcagaaatgttctggaatcctatgtgagggacaaacattcagaacacagcaggaaacccagcagcagtgttctggaagcctatgtgagggagaaaggctcagaatccagcaacactgttctgcaatcctatgggagggacaaacattcacaccagagcaggagtgttctggaatcccatgagaggggaaaacattccgactccagcagcagtgtccttgaatgctatgtgagggacaaacattcagaccacagcaggagtgttctggagtcctatgtgagggagaaacattcagaacacagcaggagacttctggaaaccattgtgaaggacaaacatacagacctttgtagcagtgttctggaattctatgtgaggaaaaaacattcagaacacagcaggagtgttctgaaatcctatgtcagggacaaacattcaaaccacagcaggagtgttctggagtcctatgtgagtgtcaaatattccgacaacagcaggagtgttctggaatcctatgtgagggacaaacattcagaccctcgtagcagtgttctggaatcctatgtgagggaaaatcattcataccctcgtagcagtgttctggaatcctatgtgagggttaaaatctcagaatccaggagcagtgttctggaatcctatgtgagggacaaacattcagtccacagcagcagtgttctggaaagctatgtgagggacaaacattcagaccatagcaggagtgttctggaatcctatgtgagggacaaacattcagaccctggtagcagtgttctggaatcctatgtgagggaaaatcattcataccctcgtagcagtgttctggaatcctatgtgagggttaaaaactcagaatccaggagcagtgctctggaatcctatgtgagggacaaacattcagtccacagcagcagtgttctggaaagctatgtgagggacaaacattcagaccatagcaggagtgttctggaatcctatgtgagggacaaacattcagaccctcatagcagtgttctggaatcctatgtgagggaaaatcattcataccctcgtagcagtgttctggaatcctatgtgagggttaaaatctcagaatccaagagcagtgttctggaatcctatgtgagggacaaacattcagtccacagcagcagtgttctggaaagctatgtgagggacaaacattcagaccatagcaggagtgttatggaattctatgtgagagataaacattcagaccacagcgggagtgttctggaatgctatctgaagaacaaaattcagaacccagcagcagtgttctggaatcctatgagtgttctgaaatcctatgtgatgaacaaacattcagaccatagcaagagtgttctggaatgctatgcgaggtacaaacattcagaccacagcaggagtgtcctggaatcccatgtgaggtacatacattcagaccctcgtagcagtgttcttgaatgctatgtgagggacaaaaattcacaccacagcaggagtgttctggagtcctatgtgatggacaaacattcagaacacagcaggagtgttttgaaatcctatgtgagggacaaatattcagaccacaggagtgttctggaatcctttgtgaaggacaaacgttcagacccttgtagcagtgttcaggaatcctatgtacaaacattcagacaccagcagaagtgtgctggaatactatgtgagggagaacactcagaccctcgtagcagtgttgtggaatcctatgtgaaggacaaacattcataccctcatagcagtatcctggaatcatatgtgtgggacaaacattcaaaccctcataacagtgttctagaatcctatgtgagggaaaaactttcagaccatggcagcagtgttctggaatgctacatgagggagaaacatcctgaccctcctagcagtgttctgcaatcctatgtgagggacagacatttagaccctcgcagctgtgttctggagtcctatgggagggacaaacattcagaccctcgcagcagtgttctggaatcctttggacatacttaccccagccacagtgttctggaatcctatgtgacagacaaacatacaaacaacagcaggagtgttctggaatcctatgtgaggaacaaacattcagaccccagcagcagtgttctggaatcttatgtgagggaaaagcattcataccctcgtaggggtgttctagaatcctatgtgagggaaaagaaactcagaatccaggagcactgctctggaatcctttaccccagcagcagtgttttggaatcttatgtgatgtaccaacattcagacgcttgtagcagtgttctggaatcctatgtaagggacaaacactcagaacccaccaacagtgttctgcaatcctatgtgagggacaaatattcagaccctcgtaggggtgttctggaatcctttttgagggacaaatgctcagaatccagcagctgtgttctggaatcctatgtgagggacaaacattcagaccagtgcagaattgttctggaatcctatgtgagggacaaacattcagactccaacagtagtgttcttgaatgctatgtgagggacaaactttcagaccacagcaggagtgttctggagtcctattcctatgtgagggacaagcactcagaagcccacagcagtgttatggaatcctatgtgagggacaaacatgcagacctcagcagcagtgttctgggatcctatgtgagggacaaacattcagaccccaggagcagtgttcttggatgccatgtgagagacaaatcttcagaccacagcaggaatgtgctcgaatcctatatgaaggacaagcattctgactcttgtagcagttttctggaatcctatgtgagggacaaaccttcagacctcagcagcagtgttctgggatcctatgtgagggacaaacattcagaccccaggagcagtgttcttggatgccatgtgagagacaaatcttcagaccacagcaggaatgtgctccaatcctatgtgaaggacaagcattctgactcttgtagcagttttctggaatcctatgtaagggagaaacattcagaccccagtagcagcgttgtgaaatcttatgtgagggacaaacattcagaccctcctagcagtgttctggaatcctatgtgagggacaaacattcagaccctcctagcagtgttctggaatcctatgtgagggacaaacattcagaccctcatagcagtgttctggaatcctatgtgaggaacaaacattcagacaactgtaggattgttctggaatcctatgtgagggagaaacgttcagaccctcgtaacagtgttctggaatcctatgtgagggacaaacattcagaccagagcaggagtgttctggaatcgcatgtgacgaaaaaactttcagagcacagtaggagtgttctggaatcctacgtgatggacaaacattcagaacccagcagcagtgttctggaatattatgtgaggggcaaaagctcagactccagcagcagtgttcttgaatgctatctcagagacaaacattcagaccacagttggagtgttctggagtcctatgtgagggacaaacattcagatcacagcaggagtgttctgaaatcctatgtgagggacaaacattcagatcacagcaggagtcttctggaatcccttgtgaaggacaaacattcagacacttgtggtagtgttctggaatcctatgtgagggacaagcatgcagaacactgcaggagtgttctgaaatcctatgtgaggaacaaacattcagaccacactaggagtgttatggaaaatcattcataccctcgcagcagtgttctggaatcctatttgagggaaaaaaactcagaatccaggagcaatgttctggaatcctttgtcagggaaaaacattcagtccgcagcagcagtcttctggaatgctatgtgagggacaaacattcagatcgtagcagaattgttctggaatcctatgtgagggacaaacagtcagaccacagcagcagtgttatggaatcctattcctatgtgagtgtgaaacattcagacaacagcaggggtgttctggaatcctatgtgaggaacaaacattcaggccacagtaggagtgttctggaatcctatgtcagggacaaagattcagaccctcataacaatgttctggactcctatgtgagggacaaacattcagaccccagcagcagttttctggaatcctcttgttctggaattttatgtgaggcacattcagaccccagcagcagtgtttttgaatgctatgtgagggacaaacattcagaacccagcaacagtgttcttgaatgctatgtgagggacaaacattcagaacacagcagcagtgttctggaatcctatgtgagggacagacattcacacaacagcaggaatgttctggaatcccttgtgaaggagaaacattcagacccttgtagcagtgttctggaatcctatgcgagcgacagacattcagaacacagcaggagtgttctggagtcctatgtgagggtcaaacattcagaccctcgtaacagtgttctggaatcctatgtgaaggacaaacactcagactcgagcagcagttttctagaatcttatttcaggatcaaatattcggaccctcgtagcagtgttctggaatcctatgtgagggacaaacactcagaacccagcagcagtgttctggaatcctatgtgagggagaaacattcagacaacagcaggagtgtggtggaactgtgtgtgaggaacaagcattcagaccacagtaggagtgttcaggaatcctgtgtgagggacaaacattcagaccctcataacagtgttatagaatcccatatgagggacagacaacctagcagcagtgttctggaatcctatgtgagggtcaaacattcagaccacagcaggagtgttctggaaacctgtgtgaggacaaacattcagaccacagcaggagtgttctccaatcctatttgatggacaaatattcagaccctcgtagcagtgttctggaatcctgtgtgagggacaaaccttcacaccccagcagcagtgttctggaca

SEQ ID NO: 472573 - DNA, 640 bp, Homo sapiens
ctccatgtgggtagcaaagatgtctctatggaacacagatgtttcggggtggcgagaggctctggggagggtgagaaccattgcttgccaacttacctaggtgagcgtgcaagggccagcacattcccagaggactgcgtatctcacgtatataccctgaggcagagccagacctgtgcatcaggggctcgagtccacctggaggaggaacagccccagctgctgcaggtgatcaagatgagaaggcctgtccatgaagatgactctgggcaggaattcactctagggcagctggagttgctgggcctgcagtgggtgggagtgggagaaggcagtgcaggaggaagagagaaagcaagccccaacttcagcattatggtaggagctgagcacagggctgcccaagtaagggccccaactagtagcaacaggagtcaaaaactgctgcaggaacagcagaaagcacatcagagggtggcccagcaggacagattctttccagagacctcagtatacactattaggttgccaagctctgaccaccacgattaggttgccaagctctgaccacgggatgcaatatgaatgaatcaaggcccatggcccagggaaagggcctagaggctgtttctgtcctagc

SEQ ID NO: 472574 - DNA, 583 bp, Homo sapiens
tatagatgcctgcttaaaaccaggggctcccagcctccgtttcttcatatggctctccccagaaatagagacactgttcacttacgtcattgggagattcttcaagattgatggtgttatgaaagactcagaaaccctgcttgtggaggttgaacctgagaagccaattgctggaagtaaccagctcgttagggggtctcctgacctctgcccttcagagcagtgtgggctgatctcttttaggtatgctgtgtttgcaggagtgtccatgctgagaggagaaagtggaggtgatgagaattccctggaggaagatttttttttatccattgtattaatcagtttgcattgctataaagaaatatctgacactaaggaatttataaagaaaagaggtttacttggcttatggttctgcagactctatgcaaagcatagtgccagtatccactcctgtttcttcatctgtcaaatgggttaataatataatttgaaaggttatggggagaactgaaacaaaatgcattaatgactagctctgcttccattccagatgtggaaaacgagaaagagtgacattctt

SEQ ID NO: 472575 - DNA, 598 bp, Homo sapiens
aagatgcactgagaggtacccagtttccatcaacctacaagatggaatctcaaggacaaatgataaagagaccacatcatcggcaatatactgaagtctacttagaatataagctgggtgcaagtacccactcagccactgactgcagcagccatgcagcctggggaggaaccaacactgtgggcagcttgatcttggactccaaacccccagagccgtgtgacaagacatttctgttgctcaagccactgggtctgtgggtctgtggcacctctgaggccactttcagcctgaatgttacccaggcttaccctagagcatctggggactgcgagcttctcagcaacacctttgcctgggagaagagggtccacctagcagtgggccaacctcgatggggtggtacagtagggatcatcctggcatctggccctgcctcctcttcctgggctcttctttctgacctttgaattgggccttgcctctccccttgctcacaagcttcaggggctgtaggctgacccagccttgtgtgccacatttttccttgcctggccccacctgtgctcccacctcagtacagggctcttcccacaga

SEQ ID NO: 472576 - DNA, 641 bp, Homo sapiens
tcgttaacagacgctaattgtcccacagaggtatttgtcagctgatggggtgacatcacccccaccccaaaccacatgcatgagactgccctgattggctgctccttccagcaaagcttggtcatccctggtggactcgtgctcctgggttcattcgtcttggtctccagtggcaggaatcggaggttggcttcccattttcaattcagcatccgggtcacctccttttgtcagcaggcaggaaatgcgaactccttccggcagcaagcacatcatagagactttcccagatcaagcaaaagtggggacagtattgaggatgtagcttctccttccgcacgcactgttgggcctgacctctgcctgcagggctgggacgaggcagaacttgctcttggggcagcgcaagctgttgccaagggtgaacttacctgagtatgtactgaaaacttcagccattattgtagggtgatgttttctcatgtggccaagctcttttatgttgggttgagatttttaacactcaaaacaagtttgaatcttctgtagtgaagttgttcctctctttccagggagaaggaggaagaaagaggtggcagtacgcgggttatgacatcattccagagacatcttatctaaat

SEQ ID NO: 472577 - DNA, 1090 bp, Homo sapiens
gaagagaaacgtccatcaagttctcatgctgagtcagtatgtgtgctacactagtcagtacgtgtctactgtggacaactggatatatcagtgaagaaaacggactcacaaagcaggtaccactggagagaaaaacaacagacgaaacacacaagatggtaaagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcaggatggtggagaaacacaacgcagaattcagaatggtggagaaacacagtgcagaattcaggatgggagtgcgggggcagcaagggctgcccttctacatccgttgcttagaaaagtcctctcagaaaaggggacgttcaagcaaagttgtgaatgaggcaggaaggagggtgtgtggggagctaacattctaggcacacttggaccctcacacagcctcatgaatattactgggcacttctgaaaagggaggctagatggggtttccctacaggtgggcttctagctctgggatctccctccaccccttatttaaagcctaactggtccccccttc

SEQ ID NO: 472578 - DNA, 579 bp, Homo sapiens
cactctcttttcctccttctccggccacatgaaacgtgcctccttccccttcaccttccgccatgattgcaagcttggggtggacacagagatgcatcacccaggctccattctgggagggctttgctgccgagcagcaggaagtgtgttggcagacaggccccggctgaagctccttcagcggcaggcccagcagccaaactgccctgctccaggtctcatcttcccagggcagccacacccagggactgagcaaggcagggggacagaggccactcgctgctgggcgacttgctccagggctcctggactggcactcattaccaaatatagcattgactcatttgcatgccaaggcatggaaaggctgccacgggttttgaaagatgctgtcagagcacttgcattgcctatggaaccagtttgtggtctcagccacaggagctacgaggcaccgagttttggccccaaacacctgactggaatttgaatcttctgttggcatcatagccgctcatcaaacttctcagtggttgatttgaaaatgtctgtgcttggaaaatgtgccaccagcaagca

SEQ ID NO: 472579 - DNA, 1496 bp, Homo sapiens
ctctccgtgttttctctgaattcctcaatggcgcgtgactacagagtcaccagaggaaatgaggcctcccgtggcgtcagcatgttcgtgtggaggaatgtggaaggtcactctgtggccgtgttcccctggtactccatccccttcctgacccctccctgcagccacatgaggcccagcaacctgccagtcactcagtggcctccaaccagagaaaacaacctgccaagttggcagctgttgctcataagcgtccaccagatgatgtcaggcccagtccctcagtgcctgcgcaaggaacaggactcatcttctgagaaggatggacgcagccccaacaaatgggacaaggaccacatccggtggcccatgagtgccggtcatgatcttcagcaagcggcaccaggccctggcagggcgcaccagggtcaccccaaccactataaccggaccatcagccagatgctgagcgagcggtggtacaccctggggcccaatgagacgcagaaataccacgacctggccttccaggtgaaggtggcccacttgcaacaaggaccgaaagaagtccagctcagaggccaagcccacaagccaggggctagcaggattgcagcccaaacactccagagctcggataccaaggagcagcttctgtggggcagaacggctgcacacagtcaggaaacctggctcagcctggcccaagccttctcccacagcggggtacacagcctggacggcagggaaatagaccgtcaggcactacgggaactgacacaggtggtgtctggcactgcatcatactctggcccaaagccttctactcagcatggagctccaggccactttgcagcccctgagggcaacaagggctttggtgggaaggtatttgcacctgtcattccttcctcctttactcctgccgccccttgctggatcctgagcccccagggtcccccgatccacctgcagcttttggcaaagtctatggtcccaccctgtcctcctcctacacatactcggatgcttcctcctcaaccttggcacccacctccttcttactgggcccaggagccttcaaagcccaggagtctggtcaaggcagcagagcgggccccctatgacccctacccctggggatgggggcccagggacgccttccaaggtgacctgtttcctcccaatggatcctgccaccttctggtggagaagccgaggacaggctcagggaaccggagaccgagaaggcgctgtcctcttcactgcacgcgccctggaccagtgccggccctgatcatgcagctcttccaggcccactgcttcttcctgtccactaggccacagttgccctccaggcccactatgcacacatcttcccctccaaggtttgttctgcccctgccctgactcccagccctgtgggggtcctgaccggacctcacctggctcagactcttgacgctgccctggctgccccaccactgcctctgccc

SEQ ID NO: 472580 - DNA, 950 bp, Homo sapiens
attggacccatcgtcattgcctcttgagggagggaaaatctggtgaccctttcactatggttcaggggttcaaagtgaataagtttatgttaaactcatgtgaagagaagcagaggaagggctggggagaaggagcccatgggggaaaagggggtggctgtacaaggagaatttcatgggaaagaatagaaaagtatgcaagggattttaaagaaagtttgctacagtatgagaatgttacttttggctaccagcaaaggccacactactctaaaagactatgtatgccagatggttatatcccagaggccatcaagtcctccaagaagaaactgagctatcagaactctgatggtcctgtggctgactgcactttcccagagtttcacattattcattcccagaaaggtggagaaaacttttggagcaggcttgtagaggagatggtgtccagggagatgggagcaaggtcccaggtggaaggttgactattactggggagaaggataccagattttctgagtttggagggaaggaatcaaaattgctgtggctgtatattatggactgaatgtgtgtgtcctctcttcatgatgatgaaggtgacatttccctcaccttcccttgatgtaatcatcaccttgacttttatgatagacattttcttgctttcatgtataattttaccacctacatatttatccctaagcaaaatagtatagttttgcctgtttttgaaattgacatatatttttaaaattgatatatatacaggactcatcctgtatatcttatgctgctagcaccaagaaaataaacctactcagtaaatgttgattaaataaatatccaaatagctggaaaaaaataaaaattgctcatattaaaaatggataatggtgggtatcaaatgatatttaaatttattatctatacttaaaaaggaatac

SEQ ID NO: 472581 - DNA, 1556 bp, Homo sapiens
gtcgcggggcctcgccgcggcctccagcgccccagtcacggggaatgcagtggtccccgacccctggcgcctctgcgtgtctgggctgggcttcctcgctcgcctgctccacggccccgacgctcctgggccgagccggccggggccccctcatggcggccaagtggttcaaggagttccccctgaacctgaagaccgtgtcggagcgggccaagcccgggggcggcggcggcaaattgcgcaagaactcggaggcgggcggcgctgggccgggtcctggcaagggccgcaagaactcggcggccgagctggggagcggcagggccggcgtcggccccaaggacagccggctgtcccgcgacagcctgcagggtctgattcaggccgccgcgggcaagggccgcaaaaactcccgggccacggaggaggagccccaccggggtgcaaccaagagctcgggctgcagcacctacatcaacaggctcatcaaggtggacactcaggagaagaacgggaagagcaactaccccagcagcagtagctccagctccagctcctcttcctccgcgtcctcttccccttcctccctggggcccgagctggacaagggcaagattattaagcagcaagagacggtcatcattttagaagactatgctgacccttatgatgccaaacggacaaagggtcaaagggatgcagagagagtcggagagaacgacggttacatggaaccatatgatgcacagcaaatgataacagaaattagacgacggggttccaaagatcccctggtgaaggctctccagctgcttgacagtccctgtgaacccgcagacggtggcctgaaatcagagaccttggccaaaagacggagttccaaggacctcctggggaagccgccacagctatacgacactccctacgagcctgcagaaggggggcccagggcagaggggaaggcgcggcccccagacagccggctgcccgagaacgacgagaggcccgcggcagagtacgagcagccatgggagtggaagaaggagcagatcgtgcgggctctgtcagtccagtttgaaggagctgagcgaccttccttcagggaggagacagtgaggcagcaccaccggcagaagagctggacccagaagatcctgaagccagccctctcggaccacagtgagggagagaaagtggacccgggcctgcccctggagaagcagccctggtatcatggtgccatcagccgtgctgaggctgagagtcgactacagccctgcaaagaagctggttacctggttcgaaatagtgagtcagggaacagcaggtactccattgccctaaagatcacctatgggagcccccaagccatgcctttgtatgtgcgctcagactcccatgggtcagcctccagccccagctcacactgataaacgtgacaaaccacatgaggataccaggtccatctcctcccggggcaagccttttttttttagatgacccagatgcccaaagcaataattacatttcaagggtattttttaagagtatttatt

SEQ ID NO: 472582 - DNA, 458 bp, Homo sapiens
gaccgagaatacaatgagaaattccagtatgcgtaactgcatcaagacctccaagtacaatattctcaccttcctgcctgtcaacctctttgagcagttccaggaagttgccaacacttacttcctgttcctcctcattctgcagttgatcccccagatctcttccctgtcctggttcaccaccattgtgcctttggttcttgtcctcaccatcacagctgttaaagatgccactgatgactatttccgccacaagagcgataaccaggtgaataaccgccagtctcaggtgctgatcaatggaatcctccagcaggagcagtggatgaatgtctgtgttggtgatattatcaagctagaaaataaccagtttgtggcgcttattagctcagaataataatatgtgttccttataagactaaccatacagagtgtataagaaaaagtgaatagaggtc

SEQ ID NO: 472583 - DNA, 1411 bp, Homo sapiens
ctccggaagtggctatgcttcctcccgacgggcacctgtgcaggcgccggctgccacccttggctggcgtcacatggagggcggggctggccatggaggcaagaaagagctgttttgctgatgagctgccctcctgtcacacgggccggagtgccaggtccctggatgtgggtgggggaggaggaggactgccctgctgtgccaagctggcccagatccaagttcggctggccggcttcgtgcagttctacatcctcttccggcctcctctcctcttccagctgtcccctccaaaagaccacttgcgcctcccaccccacttcatagcccttctcttccactgggaagcccacagggggcctggctgggccctgggcactggccccttggaagtgcctcaggaagtgcaccagcctccaggaagtgtgctttccagttggggcgctccatggccctgcccctgcaccccttcaggatcctggtcccttggcccagacagccgcacgtccacaggctcccacacggtcaaggccaagcaagggcaggcatgcgtgtgggtgtatgttaacccttgtaagtgattcatgtgtgtgagccagcatgcaaaggtgtaagtgcatacgaatgtagaaaacgagaatgtggatgtgtatatgtgactgcgtgtgtaacggtgcatgtgtgcaaagctgaatgtggcaggtgtctgtgcacacatgtgtgggtcagtaatgaaaatgactgcatgaaggagtgtgcagtttaaatttcacattctaaacacttgtggatttcattcattttactattcaacaaatatttactgaaaatttgtgccagatgctattctttcatcactggttttcagtaatttgaccatgatgtgcctgaatatggttttcttcaggttccttctgctgtggagttcattggggcttcttgaatcggtgggtttatcattttcatcaagtttggaaaagctttagccatcatttcttaaatatctttcccatctccatcctcttcttctggacctccaattacacatatgttagacctcttacgttgtctcacaggtcactgaggctctgatttttttttcccctctgcatttcactttagatagtttctattgctatgactttgaggtcactaatattttcttctacaatgtctaacttgctgttaattccatccattgtatttttcattttggatggtggttgcatttttcaacattagaagtttttgagtctttttagtatttttatttctcacatcatgttcgtgctttcctctatcttcttgaacatgaagagtgtattagtggtagttgttctaaatgtctgctaactctaccatctgtgacatttctgggtctatttctattgatttgttttttttcctggtt

SEQ ID NO: 472584 - DNA, 1177 bp, Homo sapiens
gggctcgtgtctgccacccggaccaggcagagctccccgagaacaaggactatgtctgtgtcctcggcccctgaaacactgcctggccccggtaattgcatctgtgcaatggggcactaccaccatgagcaccgtcatcaccatgaccatgatctctaccactgccaccattactaccgccatcaccatcaccatcatcaccagaccatgatcaccaccctgatgaccaccactatcatcatcaccatcgatagccttattccacacaacaggcgctaccactaccaccatcacaactaccaccatgatcaccaccatcactaccatcagtaccaccaacaccatcacacctgcaccaccatgagcagcattgcaaccaccaccatgatcaccaacatcacaatcaccaccatgattaccaccaccacaaccattgctaccatcactactgccatcattaccatcactactaccactgccatcaccatcaccattactatgacaaccatcactatcatcaccaccgtcaccaccaccacaaccattgctaccatcactactgccatcattaccatcactactaccattgccatcactatcatcattactatgacaatcatcactatcatcaccactgtcaccaccaccaccatcatcaccatggccctgatcaccatcattaccatccccacaatcactagcctcagcacaggcaccagcacccccactatgatcatcaccatcaccaccaccatcaccaccctcatcaacaccatcatcactaccactatcaccaccatcatcaccaccaccatcactaccatcaccaggatgactgtcaccatcattatcactgccatcattaccaccataatcatcaccatctatcactaccactattgttatcaccatcattaccaccattgccacccatatcacatcacaaccactacaatgactaccaccgtcaccaccaaaatcaccactactactatcctgatcaacatccacatcaccatctgctaccactgttgagtcctaattagggaaaaggagtcaggctggcaggagcaggggaaagcagaaagaaaaagcagataagctctaagtctgcctttcttcatggtccaggacatgtagccctcctgagcccaacttctcaccagacacctgcaag

SEQ ID NO: 472585 - DNA, 563 bp, Homo sapiens
tccagggatcaggctggggacccgggtggacatggccacggggcccgagttcaaatgtgtgtgcaaaaaggacacacgaggagcccccgagacaggctgcaaaccccctcctgcctcggttcagcatacaagtgccctcttagcagattctgtccccaatgtgggaacatttgaaatgcccaccttgggggtggtgaagaaccagctcttgctggggtggcacagcgaggactgtgccttggaggagctgctgtgtgaaccacatgcccctggtttcaacaagcaaagggaagccgcccaggctgtcttaaagggcttcccacttctcgccgtccttggctccaccctggatcccatcatccccgtgcctatcgccagcagcagtgctggccttcgattcagaaaccccagagagcagggatcttccacatgacaactggtccccaggggaaaataaacctataaggtcctttcgtactggtcatgtaggaggacaagatggtgttgttgaaggatgatgaaggtggtgatggtgatgactgagaaagatgaggagggagaat

SEQ ID NO: 472586 - DNA, 678 bp, Homo sapiens
acaaaggcttatttctttctgatgatacacgtccagggcaggcagcctcaggacagaaccgtcggagttggaggtgattaaatgccctgacccagaaatcacacatatgattcccacccacaactctctggccagagctagtctcatggccacatctaacttcaatgtggcaagatgtaccatcctcctatgcacccaacagagaacaggcccacactacccgctgggccgagccaccatcatcctggactgtcacagcagcctccgagattctacctttgccctctatggaaagtctccactcagcagccagagggatcttgtcccgagggagttcggcaggcctggccgttctcccaacagccctgtgggaggaatgctgctagagcagctccactggacagatgagcaaattgaggcctgcaggaaaagggaaggctctggctctccctactacatcctgtctgtggggctgggcggctaccccgggacccaggactgccgtctgcccacaccttgcccaagctctgcactctctcttcctggcaactctttctgtccagaagacgggggtcccacaggtctcaggctctgggctgtgccttctggcagccagtagcttccatgaaggcaaaggaaatgcattccttcccatcccaactctaatcaggcccacaa

SEQ ID NO: 472587 - DNA, 489 bp, Homo sapiens
tgctgtagcacaatgctcatgtcccttcttcctgctggaaggtggcctgctcaggcctggaagctggcactagctgtgatcttaacatgcagcacctcctgcccagcgctggcaccaggcagagcctcccccgccctccaccatgtgtggaggctccttgccctcggcctgcccatctgcctcctccttcagctccctggcttggctgcagcagaccagggacagaatgaggcttcagcctgcagctcaggcccaaggggaactggaaagcagaggccttggggggtccctggcagcggggtgcacacaggagtagaagcagagacgtccctccctggaaacgttcaccatcagagcagtaatgtggggaagagcgtcggctttagggccgcggatctaggtttgaatcctggctttaccactttgctgtgtgattttgggcaaatcgcataacctctctgagccccagtgtactcttctgtaaaataa

SEQ ID NO: 472588 - DNA, 927 bp, Homo sapiens
gcgcgtttccaggacaccatggccctgtgtgaggtgctcatgtttgtgggttctcccaacagccctgtgggaggaatgctgctagagcagctccactggacagatgagcaaattgaggcctgcaggaaaagggaagatgagaagactcccgcagcacccccaggtcccaagggcaccctctttatcttcacccacgggggccttctgcacccccagggactcctcaccaagatctgggacccaggggccatgccggaagcccctctgctcccagagggcagcccccgcccctccgctactctgcccggctggtaccacatcctgccgcagccctgcattctgggtcctggcaccaagtgggtgcccagggcagaaagcttgggccaccgcttcctgctcaaccctcctgccccgatgctggcaatgatgttgagaatcgatgtctgtgtgctggcaggggcagcccccaagctcggcatagccacagcctgcggtggcctctgtgccccaggaaccaccctgctgtgcccagttcacatacaccaggatccacagagccccgtgtagacagatagaatgacacactcatagacagagcatggaaatgaattagaggccagctagaaggagactccactcttcagatggaaagtaattccttgataatgcaggctttctggaaacagaaacagtcacactggtaggtgttgccgagcacacaagctagcacacacacacagaaccgcaatcacctttacacagtcccacacacctcaacaacttctacacgggcagaccctgacatgcatgcagacaccccaacacgtggacactctgacatacacacaggcacagccaacattcacatggcaccccgacataaacacgaacgccctcactgacatatggctaccccaacatacacac

SEQ ID NO: 472589 - DNA, 580 bp, Homo sapiens
aggcatatacccaagagaaaagaggacatgtccacacagaaacttgttggatggcttctgttgtttgcaactgagaacaccgactgctctggaaatggtgctgttggtggttatggggatggcaccagtgcgggtggtgaggttggagggaacagtcgtccctgcagccacacacacagtcatgttcacaggctcacgtctgcacgctcaccacgtgtgacaatacacagatggctccctaggaaggacaacacgcggcccctgcgcatctgtccaggctcagccctgattcctgagactgcctgggcattgctccctggatacgcagagggccccggcccccctgtgttcctctgctctgagtgtgtgtgcacacaggctccgactggacctcctgtccccatgtccccttccttgaatggcgtggcagcccctaagagagctgtgctaaagggtggtcatacatccctgacatgtccttgcaagcctcacagaggccaacgagtgctggatacacggctcactgacaacacaacctgaagtctacaactgcccctctctgagcctcagtgtcttttcc

SEQ ID NO: 472590 - DNA, 1254 bp, Homo sapiens
gaaagcctcggagggtggccgtcatgcattgtaaaggacatcagcaagccaccacttctgttgccttaggaaattctcaagcagactcagaagcttacaaagcagcatccacccaataccgagcatcagtcacagccgccttgctccctcaggcacctgatctagtgcctgcttattctaaagaggaaagagactttttccaggcagagggggagcaagcgataaaggaaggaaggatccagttaccagacggaagagtagccgtgccacagctactgggagctgcagctgtgctggctgtgcatgagaccacctatctaggccaagagtcacttgaaaagttgttaggctggtacttctacatttcacgtctgtcggcccttgccaaaacggtaacagagcaaggtgtcacctgccggcagcacaatgttaggcagggtccaactgtcccgcctggcatacaagcttatggatcagccctctttgaagatctccaagtggatttcactgagatgcctaagtgtggaggtaacaagtatctgctaggtctagtgtgtacctactctggatgggtagaggcctatccaacacgaactgaaaaagctcgtgaagtaacccgtgtgcttctccaagatttcatccctagatttggactgcccttacagatcggctcacacaacaggctggtgtttgtggctgactcggtacagaagacacagaagatcaggtgcaccccttctaaaagaacaggatattctccttgtgatcgagtgtggatcaaagactggaatgtagcccctttgcagccgcggtggaaaggaccccagagtgtcatcctgaccacacccaccgccatgaaggtagaaggaattccggcctggatccaccacagccgcctgaaacctgcagcacctgaagcctgggagctgggctatactggatatgtggacacagagcccatgccaagctacctgatcaatgggcaggcagtttttgttattggcaccattaaaacatccttttttcctgctgccggtaaaaacagcataccacagcagccctacagaaaacggccaaactgctatatcagtgcccattcctacatctctttgctggtagggttctccatacctggtcctccagccacacaccaccagagatatcaagcaagtagcagctctggcccatggggaaactgaaagcctctctctactgcctctgcagtagaaatgcccatgctacccttagtgttac

SEQ ID NO: 472591 - DNA, 672 bp, Homo sapiens
acccactccatgggctcctgtgctgcccaagcctccccaacgagcaccaccccctgctccccggcgcccagtcccatcgactacccaagggctgaggagtgcgagcgcatggcacgggactggcaggcacctccacctgcagccccagcgtgggatccactaggtgaagccagctgggctcctgagtctgctgtagcactcactgcgaagatctgcagcttcactcctgagcccagcgagaccacgagcccaccaggaggaacgaacaactccagacttgctgccttaagagctgtaacactcaccgccaaggtctgcagcgaactcaccagaaggaagaaactccgaacacatctgaacatcagaagggacagactccagacacgccaccttaagagctgtaacactcaccgcaaggactgtaaactccatgaggccaattatcccatctgcgttgttcatcacagtaaagccaatacctgactctcagtcgagagggatccagtaagcacttctggaatgttaaaccactgttgtacaaccagaatacattttaaaagcccaggtcacttttcagctctagtaaggaagacattaatgctttataaaagcaactggggtatctcaccacagtgggaaaccacttttaaactgacatcaggaagccttcac

SEQ ID NO: 472592 - DNA, 1197 bp, Homo sapiens
ttctgtttcaggatcccatccaggatgctactttgcattcaaccatctacctctttaggcttctggtatctggcagaagaaatttctaagcagcaaagcattcaaggtatgactcaggtgctgttaaatggtttcagttttaaaagggaaacaaagcataaaagtttggaaattttgcagcctgacagtgtgatagaaaagaaaatcccattttctgaggagaaattcaagccagctgcagaaatttgcataagtaatgaggaacagaatgttaatcaccaagacggtgaggaaaatgtctccagggcatatcagagacctttgcaacagcccctcccatcacaggtctggaggcctaggaggaactggccagaaccagggtccctctgctgtgtacagtctaggaacttggtccgctgcatcccagctgctccaggtgtgaataaaaagggcaaggcactgctgaagggaaatgtgggatgggtgcccacacacaaagtccccactggggtgctgcccagtggcactctgagaagagggccattgtccttcagaccccagaatggtaggtccacagacagcttgcactgtgtgcctggaaaagccacagacactcaatgccagcccatgaaagcagccgggaggaaggctgtaccccacaaagccacagggacagagctgcccaacaccatgggaacccacctcttgcatcagcatgacccggatattaataacattcttatcattgtgtagttgtttactttattactaatgaccctttttcatttatggagcatatttctaaaacttttatggctacccttcatttcttcgggtgtatctttgaataactattcttatctttatgcctgttaacatctttctaattttccatttcctttatttctgtacttcatttgacaatttcttttgattaatctaccacttaacaaatttactcttcaaccacgtgtattcttttgtctacaacattggtttcaaattcattccaatcattctatatatattgccgtttctaggagttacatgcagtactttttctgaaggtactatctaatcatttttatggtatttttttcattacttatgctttgaacccacattttgtctctttaatcatttttaatatagtcattttatattctttgcttaattattctaaaatataaaactttt

SEQ ID NO: 472593 - DNA, 907 bp, Homo sapiens
tgaaccaatcagcatgcacttcctcccctctgaagcccataaaaccccgaacacaggagactggagagactccatgacaacctgccagcagagaggagctacccactccagggtctcctctctgctgaaagctgaacactcctcaagacaccttggtggggcgaaagagctgagctcaccaagccagggctgtgacaccctctttggggctctgtggttcctggtgtctccaacctgccatgcaccattgtgttccccagtgccagccgtggaagatgcttatggtgcgcctggtccagctgcaaccttgcagggagccagtgtccatgctggcacctggagctgcctgtcctgctgcagccagtgtgcctgggtgtgcaccgtggctggatcccatgctcacttgctcacatacccctcaccactctgcttgcctttggcaggcaggggtccgggccaaaggaacagtttcaaagagcaaccatagattgatgtattctcttcccatctactccctcctttgatttttggctatgcctttatatatctattttgttttatttgaaataatgcccatagagataatgaagaaaaacatatattcattctgacatcttgaaagatttttaagttgtttaaaaatgtattatttattaaataataaaattttattataatgttatagttacatcttggctatggtcactatcctaagagtaaggagaaaaagcaactcagaaaccattctaatcaaagaagaagaacttacagtgtatgaaaataattccatccacttgttaatggctttgggagacaaaatgaaatttgcttgaatgctgccttctctttccatttctccctaaacattttaatgcactagacattaaaaaaaatcgtaaatgtactt

SEQ ID NO: 472594 - DNA, 1024 bp, Homo sapiens
gaaaactttgctcataccatcacctctcccttggagagattttcccagctttctgacaaatttagcctttacaaggatgattgttacattttatcatgaatttgtgggcttttgtgaaatttcaacagccactctacccttccaccatctccaccttggccagtcagctgccatcaacattgatgcaagaccctctgccagcaaaaagattatgagtctgaagctgagtgatttttcaggactcagttggacttacacgtgctatttttacccagctgtcagtcagcttctggtatttttctggctgtcggttggagttacagtgatagcctcagaggatctgaatggcagctgctcctgttccttcctgcaggcagtttcccaaacttgctccctcaggtcacactcttgggcctctaagagccctgagccccgatgtggtgctgcccccggggccagcctgactcaccagagggtgcccttggcaacttaattaataccatcacactccttagctatactggctgtttgggatctagcatttcaatgcatttcattcatcttcatagttactttaaaggaatgtgaaaggtattagttggctgctataaaggatgtgtcagagactaagcatgtctttctttgcaaatgccaaagggctgaattttcaatttgagggtttccttccgatcgtgttcatgtgttatgtagattctcaaagttgaagaagaagaaaacaaaatcatagaatcacagaaaataagagaggtggaaaatgttctgcgtcttttttccagttaaaaaaactggtctcacattgtttgaataactcacctctaaaggtttgtaaatgcaccaatcagcactctgtgtctagctaaaggtttgtaaatgcaccaatcagcactctgtaaaaacgcaccaatcagtactgtgtctagctaaatgtttgtaaacacaccaatcagccctctgtaaaaacgcaccaatcagcactctgtaaaatggaccaatcagcaggatg

SEQ ID NO: 472595 - DNA, 616 bp, Homo sapiens
ctcaggctttctttgagaagagttgagttcatgaagactattcttaggaaatagaaagattaagtaactacactgagatcacacagctagtacgtggcagagggggatgcagagctgcctgactcctgacaccagacacctgacaccagcgtccaattgcctaactaggaagctgcaccacttcacatttcatctcctggagaataaaggcggcagtgcaagagattcagggaacggagaaattgcaggggcaactacagacacagaggacaggacacattcccagcagcaggaaatagataggagaaagtccaggcagatggcaaatctgcatcaggggagagtcagcagtgagcaacaggtgtgctggcagagaagacaaatacagcatcaggagccaggttggcagcagacagagtcaatatcagagaaatctgacaacagtagttttggaggccctcattttcacagctacagagcaaatactgataccactctgccattcatgcatacacagggtgaccaataaatgcctgaaatgctttgactttgactgtccaagcaggaggtagaaagaagtaatcaatttcatttagagttgtgagtatcattttgg

SEQ ID NO: 472596 - DNA, 606 bp, Homo sapiens
ccagcagcagatgccagcactatgtttcttgtgcagtctgcagaactaatcgtcctgaagcagcggccagagaagagacaagggcacgagcatcagaacgccatgcctttcttggacgtgcagaaaaggtttggccttaacacagatgggtggttgacaatccaaagtgctgaacagccctacaagattcctgctcgacaccatccttttgaaaaagaatggagagaatgtgcacatggaattggtggtatttggggagagaaagagtgcagaatagaatacgactatttcatagagtgtatactttggcagaaaatgatgagatgtaatggcatatctcaaaaaggagctgctcctaatctgaaacacaaccctgactttaatctcagtcctggaaagaaaagattaaacaaagccacagcagttgactatggctgccaatatgtaacatgtctgttacaccagatgaaaatcccatgatattgtaaggaaaaaaaaagattatttaacatatttatttttgttgtgtcttttcagaatgttttcctatataccctttgccaactgcctttccttagacttagatgccgggacacaggctgtggt

SEQ ID NO: 472597 - DNA, 665 bp, Homo sapiens
cagttgaggaggcagtctatccgttctccaagctcaaacaccatgctgggagaaccaccgctgtcttcagaactgtcagggatgtttaagtttgcagatatttctgctgccttttgttcagctatgccctgcctgcagagttggaggctacagagccagcaggtcttgatgagctgcagtgggctccacccagttcgagcttccctggggctgctttgtttacctactcaagcctcagtaatggcaaatgcccctccccctgccaggctgctgcctcgcaggttgatctcagactgctgtgctagcagtaagcaaggctctgtgggcttgggatctgctgagccatgtgcaggatataatctccttgtgtgccatttgctaagacagttggaaaagcacggtatttgggcaggagtgtccatttttccaggtgccatctctcacggcttcccttgcctaggaaagggaaatcccccgaccccttgcgcttcccggaaagaatatgagctgaatatggtcaacaatgtcatatggagtggagaagtaaaaagaatggaaactgaaaagggctaatgtcttgatatttatcaggtcattaatgacactgactatgaaagaaataagtagaacatttcagtccaaaggaggatttagaagatttaagc

SEQ ID NO: 472598 - DNA, 1327 bp, Homo sapiens
ggaagacaaaggaagaaatgctaaaggactgtaaacacaccagtcactactctgtgaaaacggaccaatcagcgttctgtaaaatggaccaatcagcaggatgtgggcagagacaagagaataaaagctggccaccagagccagcagcagccacacgctcaggtccccttccatgctgtggaagctttgttcttttgctcttcacagtaaatcttgctgctgctcactctttgggtgtgacggacacaccatctttaagagccgtatcactcaccacaaaggtccgcagcttcattcttgaagtcagcgagaccaagaacccaccagaaggaaccaattccggacacactaccaggaggaaaagcagtctgaggacccacaggaaagatgcacatgaaggggatacccgcctagccagccagatcagcccaaccaacccaggtaatcaatggggtaacagatgtcacagccagagtgacgtcacatcctgcatcttttattaatagaattagcaatgtcttgcgaaaatatttactatcactttaattctgggaaaataggaaaaagtaatctctcatttatgtgaatgttaatttgcttacaaaatgagaaggtagtttaactgtgacttaataataacagtgttttatttgtttcattacaacattataaaaacaattttatttggaaaataaaatagattttaaaagattaaatgtaatcactttaatgtaacatttcaaccaatattaactacttccttttctttcccttctgaacctgggtctttatatttaaataaatatatttatatttaaagttaaatataaactatttatatactggtggacattatatagttgattccactttttatccaaactgataatatctgcctttcatttggactgttcacactatttatatataattaatatagggaaggaaatccagaagatgtgcctatatttgacatgagtaaaaaagactccaaagataatttataaaattataaattattaacagtttatcttaaagtataccataattgctcattttgcattccaaagcacatgtaacatcagagtggtcaggctggtatcttctatttagctatagccatgtaaccaatggggtagtgtgttgcttactactgccaaaacccaacaaaacttttctatttttatggaagatatgagaagaggatagcttttgatgagatgtaaataagctgtgtctctggttactatcaaaatgtattaatccattatattaaccaaggcaaatcaagaatttgtaaaaatttgggtgctttgaagagttctat

SEQ ID NO: 472599 - DNA, 559 bp, Homo sapiens
ccaggtgccacctccttgggacattgcagctatatgttgggaaggaaagatgagccatacccttgtgtgaacctgtgcagcagggacactttcagcagggatgcagatgctgagaatagcactggaaaggctgtctctaagtgcatgtacaacagcccccagttgtgtgggagggatcctgtagttcaccaagaacctaccgatcctctgtggctgccagaatcagagcagattctgggttatgtttatggggtatttggtgatgcagcaatacaagggctgagaatccctgggcccgatgccaggtggccagtgagagagagaaagagagagacagagaggaaaaaagaagatcttacagtagccccagggaacccaaaagagataccagagggtgcaagagattgcaagctgctgaaaaaggaactctgcaattccactctaacttggaatttacacatgacaatttaattgcaatatgcaaagatgctgtcttctattgggttccctaaaaagtacatcctggaacctatacttcatttagacggtgccttcagat

SEQ ID NO: 472600 - DNA, 782 bp, Homo sapiens
ggcatagataagagccacccacatactgagttaagatccaacagcaaagagcaagccatggtacttacagctgccaatgtcaaatataattgtgcccaccagattaagggtggatctgccttccacaccccactgactcaaatgcttatctcttttggcaacagccacacaaaaacatacccaggattcatactttatatccctcaatccaatcaagttgacactcagtatttcaccatcgcaactagcatggtgaaacctcctgcattttctcgggtgaatcagcccattcagctggaccttctggtagtaacttggctgaatgtgccgacagtggctgctgacatctggctgtcatggtggccacctcgatatttcttcagtcacgtcctcaggcggtgtgaggaaaatgtgttactgtggaggcaccggaagtcttacccaccactgcttttgcacaatccatgcaacagtcaacaaaatgaaaaagatatgacaaaaggcaagaagagctccaagtatgaaaaatagaacaatggtgttagggttgcctatacattaaaaaaaaaatctgttccaacacagagggaaaacaaacctccaggtacaaagtagatttaactaagacataaagtttgagggatattttcaaacaaagaatcaaccagtatatgtactcattatgcccaacacagagcccccctcaggcaacacagccctctttgtgacttaattaataaacctgattttacttgcctataaatcttaccaggagtaggggg

SEQ ID NO: 472601 - DNA, 637 bp, Homo sapiens
aaactaatagttgtcacagattattcaaattctaaacctttccgggaagaaagaaatgcagagccactgccaatcagaatgatcagctgtgggtggggtggctgtgctgtgaacccaagctgtgggacccttcctggtgaagaccaggatggatgggggtctcatggggaagacagtctggcctcttctccatatgagagacacagaagggctgccaatgggaaggttcagccaggagtgggcctgctggagcagggggtcaggggttcacaggaaagagaaactgggctcctttctgtatggtggctgcaatgtgctggaggtgcgagcaaagcaagcaggttctttgttcctcaacccaagggcagcaaagatggtactactgcagcagcaatggcagagaaagtctgtgggttgtctctgggtattccactccagagaaaagcggagttgccaccaactgaagttatcaacctgacggcagtagggatggggcctgcagcagcacagcaaaggctgcagtcctgttggttacctctgggagcaccaacccagagaaatgctgagctgtgaccagttagtgtgctctgaggggatagattagctgtgcttgggtcctagggcagtggcctttgcc

SEQ ID NO: 472602 - DNA, 626 bp, Homo sapiens
caagtagaagccaaagactatagaagtgacgttagacaaaaagcaaattcgcgcaattttcttattcgagttcaaaatgggtcgtaaagcaggggagacaacttgcaacatcaacaacgcgtttggcccaggaactgctaatgaacgaacctcattggctggaccaagaagaagctccaaagcacttcccaaagccaaacttgcaccagaaaaaggtcatggtcactgtttgcggtctgcggccggtctgatccgctacagctttctgaatccagaggaaactgttacatctgagaagtatgctcagcaaatcgatgagatgcaccaaaaactgcaacacctgcagctggcattgggaaaatgcttccataatcagcaggatgcagaaaatgctttccaagatccagtgccccaaatccccactggtcaaccccaaccagaagccagaggacttggaagctacagtgtggtgtgttcagaccaacctccaggtggaagtgtggaacaaagaatggaaaatggagctgaagtggcaaacagaagtcaaccaaactcagtcaaactcaaccaaacatagtcaaccaaatttacaattcaaagtgtcacttcttggcctgcattgggtt

SEQ ID NO: 472603 - DNA, 705 bp, Homo sapiens
gagttcagaataggtgatgtgaagagccttgagagggtcagggatgggggttgggagaagctttgggattgctgtggaaggaagaaggtgcaagtctcagacactctggaagggtcggggacatagtcagagaactgtctgttcatcccatcctgctgcctttaaatgggtgtggcctgcctgtgcaacaccttccaaagaagtgtatgaacatctcccaggtatcagtttctgtgagattaatcctgctaccctactcaatcttgctaccccagatctccctcctctcactctgtccaccttgaccagtactgagcccctttgtcctgatgacccatttggacacacttctctggtctcccctttgctggacctcacccctgtcatcagccccttccctgaccgtcatctgactcccaggccttccaagggcaaaggagccatggcaacctgcaggccatctcgccacacagctgcctacggtgtcaagagagagcagtgtgaggctacccaaaagggagctgagagccagaggaaaaataagttctagtggtatttacctgtgtttcttaaagggttgtacttttttaaatgggattaatatattaagggtgttcatatatagtactaatatgaatacattagacctgtgcttcttaggaatttcacagaaatttcacaatcattaaggtcacttttctattt

SEQ ID NO: 472604 - DNA, 1051 bp, Homo sapiens
gcccacactcctcagcccttgggtggttgatgggactgggcgccatggagcagggggctgcactcatctgggaggctggggctgcacaggagcccacggagtccccagccctgccccgcgggaaggcagctaaggcccggcgagaaattgagcgcagcggctgtgggccggcactgctgggggacccagcacaccctccgcagccgctggcccgggtgctaagctcctcattgcccagggcggcagggccagccgccgctccgagtgcggggctcgccaagcccacgcccacccggaaatccagctggcccgcaagcgccccgtgcagccccggttgccgctcgcgcctctccctccacacctccctgcaagctgagggagccggctccggccttggccagcccagaaaggggctcccacagtgcagcggcgggctgaggggctcctcaagcgccgccaaagtgggagcccaggcagaggaggcgccgagagcgagtgagggctgtgaggactgccagcatgctgtcacctttcactatcttcactaaaccatattggtgttttatttactaaaaattacacaagcaaagatcattctcttttggtctgagttttaagttttgtatactctatgccaaattttgacaccttatagtatctgtcagtgataagcatgaaattgcttgatcaataaatgcaaagaaaaatgtatcctggcaaatcttcaggcatttctaatgttactttaccaatatttttaaggctcacttatttatcaaagattttacttgagtcacgtaaacacgaaaaagcatttgaatagtctccttttttctgttaaagcacttaagaacttttaattttcttaagccaattaattagagttcttttatatattttcagtagtaaaacactgtgtacacaacacataaatacatagatgtattaagcatgtcaataacagtacatcttatagattcataatatctcattttttcctatcttagatttgcaaactcttgataacctggtttattaccctggcagttgt

SEQ ID NO: 472605 - DNA, 691 bp, Homo sapiens
gcatcacaggctttttggtcaacgatgggccatgtatccaacagtggtcctgcaaaaccttcagaaggtattctggaagaaggcattgtcatcataggagatgacagctccatgcctgtttttgcccctgaagaccttccagtgggacaagaaatggaggtgaaagacagtgatctagatgatcctgaccctggggacatggatgaagctggaaaccatcattctcagcaaactatcacaaggacaaaaaaccaaacaccgcatgttctcactcataggtgggaactgaacaatgcgaacacttggacacagcaagaggaacatcacacactggggcctgtcatagggttagcggggtggggagggatagcattaggagatatacctaatgtaaatgacgagttaatcggtgcagcacaccagcatggcacatgtatacctatgtaacgaacctgcacgttgtgcacatgtaccctagaacttaaagtataattaaaaaaaaatacaaaaaaacacaaaacaaaacaaaacaaacaaaaaaaaagaattacccttaaatataatataaacaaataggctatctccttctgcttcttgggtttaaaagccgtaagaatgtttttccttctatagaaaataaagtagagctcttgctaaaccatttctagggatcataaagtagaatcttgct

SEQ ID NO: 472606 - DNA, 582 bp, Homo sapiens
gcagcacagtgggctctcttctgaacagctgatgctgacttccaacaggaaacactaaccctctaatcatggccctgccacaagaagagagtccaggagacgtatcatttggttctggtctggtgtgtcccagttcccctcaatctgtgctcagggctacaaaggggaaagccatctgtagcaggccctgcctcaggcttcccgtgaagacgtctacctgtgagcagctggataaattcactccacgggaaccttttgtgggttgtactgctcaggcaacttgcagttttctgggggaaagtcagctcacgctacatttatcaccccctgctgctggctacaattcaacccacttcgaaccactgagcagaggtgctgatgggggctctggcattcgaatttcacatcataatggaagtgcagggaagcaaaagacaaatgtatcagggccgctccaggtgtccactaaaaaagaggtcaaaaagtatgacactgggtgatggggactaaatatgagtatatttgcaataataaaaatatacagttgctccccccacaacttttatattttttgcctctggt

SEQ ID NO: 472607 - DNA, 792 bp, Homo sapiens
gctgtgaggactgccagcacgctgtcacctctcaacttggtatggttttatattgggctaacctacaagccagtagatggtgcttatgggcagtgagctgatctgtgaagtacacagtggtctgagttccctgctcagctctggagtggggagaggggtacaggatctctgtgtaggaacggtggggcagctcaggttgctcatccaggcgagtaggtgccccaaatgcctggagatctgcctgagtgtggagcagatagggcctcatcgcaccaagatctcagggcagcaggccaagatcttggagccaaagaggcttcccagctccacatgtaggcacacctctgggtgctcggtgactgctgaaggtattctccctcagcaccctgcagggacacatgcagacaggttccaggtcaccaagctggccctggctgcaagtctcgtttcccgggagaaactgggcccagccaaaaggaacaagcatagccaggccatcaggacagcagtgccagtgagcaacaacagccacggctctgatgagccagtgactgcagcagctctggcagagaaagctgtaaagtaattagtgcatctgaaaatccatttaggcatctagttatatgacatctccagatggggagagcagcattctgattctgaaggacacatattttaagtggattaagaaaggaaattattttaaatgtaggaaggtataattaacctgaggaccctggctgccataagatattgttgaggggaaggactaacggaaactcagaacccatt

SEQ ID NO: 472608 - DNA, 471 bp, Homo sapiens
aggacaggaaatgagaggtgcatgatggtggtgaaggtggtaggaaatggaagttgtgatagagatagtgatagaagcagagatggaagtggaggtggaggtgttagaggtggtggtggaggtggaggaggtgagaagacggaagtggaagtggaggtgttgaaggtggtgctggaggtggaggaggtgatgatggcggtggaggattcctttagaaaatttgatgacatagaaaatcctaaagaaaaaggaaaaacaattacccagaactgctcagaggtcaccactacttacctgtaccatgagcctatagaggagaagatggaatggttgtacatgctgatgttcggtgttggtgaaagaaactctcaaagggacagccaaatatttaaaatcctcaggcatacacattcttattctgacctgcctgtttgctcttcctaagacagaaagttggaatcagtgtttttc

SEQ ID NO: 472609 - DNA, 557 bp, Homo sapiens
gtgtcatttttcccaattcaatatgagacgaagaaccaacaggttcctctgttactgggggtccttgcttccagagctcccaagatggtggcgagccacttccaaaatggcggcaagcttcgtgttctctgacctggggttcttggcctcatggattccaatgaatggaatcttcggccatgtggatgaacccaggcacttagccgtgcaggaacaatggcaagcctttagcccgattggaagtggcagtaggtgcctctctggatcaggagcacagcggacaccctgccggatccggaggaatggaagtcagcggtgggtctgcgacggcggcaaacagcagtggtggacggtgagcgaaagctcagctcaagccgtaacaaacacagaccagaagagtgcagcggcaagatttaatagagtgaaatagagtgaaaacagagctcccacacaaagggaggggacccaaagggggttgtcgttgccggcttgaatgcctgggtttatatccgatcactgtccctcctgctgtgctctcaggcaacagatgattggct

SEQ ID NO: 472610 - DNA, 1710 bp, Homo sapiens
ggacacaagattcccctcagcatccacatcattctgccgatcgatggcctgctggtatctgctggtgcctgttggtgtgctcttcagctcctctacatgtccagctgctcatttagaaaagagaagcaggccattcaagggcgaagagaattccaacagcacaaatgctatgatgattggagaagatgccccgggagcaggaaagacactcatctacagcatggcccgtggtatttcccccaaagttaagtgggaacttcacttcctgtttagaggttgtcagggagcacagagagcattgcagagtctactggactcatggtcaagagacctggtgctcctcaagtgcctccatttgccagtgctgtggctaccacacttgcaggctatttattttacattagaacctagatgcttgttgcctctggcggactccaaagacactatctctccaaaaggctttgaagaatgatctatgaaggacgctacaaaacatctcaagatcaattgctgtaattatcctctgaataattttctgccattattcaggctgtacatattgtacatgaaaggctgtgttcagccaaaccagaagcttgctgggaaaaacattttagctaatatattttataatgggaatgtctttaaacttaaaaatgtggactcttgcaaattgcatggctcctctgtacgggatctaagctgtgacaaaatctgtgttcacaattgtaaaaataaaactaaggtactttctattatttatttgactccatccttcacatctcttcagatatttcacaggaaaaaattgtcacccactttcttttaatcagtctctcaaccccgttgtgtgtctctaacatctgcatttactgtatttgaagaagaggttaaaagatcagaaatgtggaaatgaaccttttagaattccatatttaccttaagaacttaaggtaaatacaaccagagctggttaaaaggtgaaaaaacaaagtcaaacaccaagaaaagtacagattgtaccaggactttttgctgctttcgaaaatttggaattattacttggaaatgtcttcaacaaaagcaataaaaacatgtcagaaatgtaaaacatcagcctgctccccatacctgcttttaaaaattgctgtttgattgactccacagggaacggcagaagcaaggcaatgggccttacacaacgaaacacttaaatatgattgaggaaaggccagggtctgaggctattgcagtgaagaatttattcacagtgtttctaaaggtgtataaggaggcgaggttgtaggaaagggggaaggaaggagaagaagaaatttgttggcaaaggtggagttgggggcatacaagagcaaaatatggagaaaaacattttttaaataaaacaaaatacccttaagtcagattcctttatataaacctttggggacccaataaaaagctatgactaaatgaaagtgttaccaaagcagatggagaataacatcagaaaatcaaatgacacatttaaaagggcaaaacatcaatataacctaaagaactgatcaaatgtgtcattttgaaatgcacaccaaagcaagaagatcatgaaatgcattaaaatggtgaactggggaatggagagtgggcgcttggttgactcccgccatgtagaaaatcagacgttatgtgctagaatacatgaatataaaa

SEQ ID NO: 472611 - DNA, 560 bp, Homo sapiens
catcttcagaagattctgagactttaggaatgaatcattgctgtttagatgcagatttcggggggttgctgatggttgttctagctgaaacggctgttaaatttggacttcatggagtatttgagaagtctaaatttggaacatttggcaaagactggagacttggtcactgctgggcagatgctactggcattgagtgggtagcgaaactagtgcggttcctgaaagtggaccaggagttcaatgtggaatacttttgttctccctttacaatatcacaggaattacataagcaattgtgtaatgcacaaaacaccagaagccgctcagcttcctgccagcagacctatctatacacccccgtaatatttcctttccatcttgcctgcaaatttagtattgaaatatgctgcattttctttcttcaccctactcactcttataccccagtaagctgcacagcacctttctaggcactcttttttcatggctttgagatctgtcttccttttcctactccttatatctggttgttcctcagttgtcttctctgggctttc

SEQ ID NO: 472612 - DNA, 466 bp, Homo sapiens
ctgtttcagtatgctggggggttcgctccagtccctagtcacctcggattttccaggacctggaggtatcaccagtgaaggctgcaaaacagcagagacagcagcctgcccctccctctgggatcttggtcccagggagggaggcccaatgctgctaccgtggctggctggaattccaagcaagtggatcttatcctgtgaggcgccatggaagtggggcctgcagaccgtggctgctcagccccctggattcagcctcttcccagagatatgttacggggatctaacctcctgctttgccagagttgcagctacttttgccaggaagcctgaagagcatgaatatctgaagctcccaggcatctgtgcatgcctgagcagctgctctgctgagactccatgggactctatgtgtcagactgaaggccctggtggaatgggtttcctgacctgacggttgcaaaga

SEQ ID NO: 472613 - DNA, 635 bp, Homo sapiens
cgacacttcttcactatcccatcctagagccaaaaaacaaaagcagggctgcagcagcacatgctttcatgagggcaggggatgataagcttctaaatggtttctcaggttccagtggagcacacagtctgggaacgaggagattgcccaacccgatccactactattggtacttcttgcccaacccaatccaccactattggtacttctcctgggagactgaagttggacttaactaccaggctgctaccattacagctggcaactaccttgcagaccacttggacccagaggaccatcctgccactgacactgctaacttccagaccacgccatctgcccaggggcataagaacccatccaccaggctgaccccttgctgctactactggcatttgagtaagccacctggagggccaagaattagcctgcctgggcccactaacattggtgccagcacacaccactcagggacccaaggaccaacatgcttggcccaccactgccaccactggagcctaaagactagctcacctgccattctagtccccagcaaaacttctccacatcctccattaagccaccaagaaaattacagataccactgacactgtttacagccaaagaaattacat

SEQ ID NO: 472614 - DNA, 592 bp, Homo sapiens
ggctctggagccgtacgtgacagaaatggctcagggaactggtggaggcgtgttcatcacgacggcacgttccatgtctaacggcaagaagctctctgccagtgacctgaccaatggtgtggatgagatactggccacaagctccaacctcagtacaatggctccagggtggagaccccggtgtgagggagggatctctagaagagcatcttgcacaagacagaagatggacaagatgatcttcaggggagcttcccatgctgctatccagtgtgctggtgctgagctgattggcaatcctttccaagatttgcgaaatagactcatcctgtttcgtcttatttctattatcctggacagaggcagcagctcttgtctggaccttggtgcctttgggcatgtgaacaacaaagcagaaagattgcaaggatatgctggggcagtgaggacccctgagtgcccccttcgtctttccagggtctcagaaagactcagaaccatgtgatcttcaagcttgcaagaaggatgaggaaggggtgatggatgcacaggaacctgagagtccaaacaaggaaaatgaagagtaacccta

SEQ ID NO: 472615 - DNA, 572 bp, Homo sapiens
gccagacttgctccgtgaatagccttgtgtttcatgcctattcctcaatcaatcctgggcgaggggattgccatgattaatttaattgacatccctcacccctatccccacactgacactggggtgtggaatgtgaaacatgaagaaaatgtatattctgttaaaaagaaaatgtatcttctggagaaagaagagggtgctgtgtggttcacaacaggctctccccagtgtattgggttcatgaaactgagaaatgcagtcctgggcctcaaggctggaacttgctgctctgttactcactttggattcacaccttcgttcattcattccataagcaatagatatttacggaatgcctgtgcgtggtgtaagggacataacagacatgtggttcctgccgacctggagctttcagtcttaatagtaaccatgtctgcacatccctctgtggggagaagctcagtgcaatccaggaactgtcacagtggagtgcagagcagagatccaggggaggacagcagggattttgagaggttaggcaagggccgaatctcgtagggtttgctcatgtt

SEQ ID NO: 472616 - DNA, 1078 bp, Homo sapiens
tctcgccgtctctgctgtgctgctctgctgctcttctgcttgtggagcctggcatttgaggtttttaagggtacagaatgggggacatgccaacgctggcagagattcatgtgtttactgtacagctcgcccagttaggctctgctactcagcagagcagcaatgtggaattccaaacagctgcaagtataaaagcacattttcaagatatcgatgtggaatcaggggctttggtggtggtctaccaagaagtatacctaatctcatttcagtctacccctaatggcgagcaccgttgctgccaagaactcatgaaactggattcccatttggccccttctgatcagactcttctggacaactttgcctgcttggaaacaggcggcagttatgccacgtcccttggacttgtctatggctgctcagggaagggctgtgtctggtccgtggacctatttcctgctgccagatttaagaagtttgccacagaaaatgaggcctgggcctttgtcaggaaatctgcaagcccagaaggttcagaagggcagaaaaataaacatgtacaagaatcacaaatgaaagccagcaagggactctgtgagccactgaatggagatggagatgaaagtgcagagtcttgtgcaaagcctgtgaagcaaatcatagagccggcacctcgagtgatgaacaaaaaggactttgtggcactggagaagctcagtcaaggcatggacattcagtggatacttgttcctggtcatccagggtgtattggcaatgaagaagctgatagattagcaagaggagctaaacattctgaagactaagcaaagtgaatttattacttgggaaaagttgagccagtggcagttttgctacttttgcttactgaaacacaacttatgagttggccatttttttcttgctatggaaaattagataacaactactgaacaagctcacagatagtaacttggaaatatacttaaaacagaggtacatatgatcgtttactactatttttcttatttccaatagatagaatcactataaatgtcccacattaagatttgtgttc

SEQ ID NO: 472617 - DNA, 979 bp, Homo sapiens
catctgtatatgccacccttcaggcttgtgagagtgtgacaggatgggctacagccattgtacagatgacttacctgatagtgggatgggtacattcatggcaggagagtttcaagaggtcttgggacctgtagccctaattcaagataaagccatggggcctgaggcacccctagaccttgagccatcaccatttagggaagtgcatcccctcattcacaatgaggcatggcacacagatgggtctagtcaaggtgctactgctgcttggactgctcttgctgtccaacctaatactgacaccatatggtttgaaactaggcgtggacaaagtagccagtgggctgaacccagagcaatgtgcatggtgatcaccaaggaggcgatacccataaagtggctagtcaccagcccatgtggggccaagtcatgtggcaagacctataagagggaggatgaccttctctgaccagccaggttgtatattacatcaaattgttgttttaattaccaggtttttactagttgaaaattgactgttattaaaaaaccatagtatattacatgtaaggttgatattttggggagactaggaaatgataataaaaacaaagtaaatttagtattcagatttggaataaggtgcacatgcaaatatatttacacattttggaaataatttataataatcttgtggagaattaccccagactatttgaaatatgattaaatgtggcataggtccacagttatctgaacagttattgtgcaggatcattaacagttggtgacttgattttaaactgttaatttgaaaatgaccttcaagctaggtatgattgatatgggtgacattaatccattaatgttcgcagtgtgacatttatccaagttactgtaatcaaaagacagccaactattagaaagtaaaagggagtgtttttgtaagtacacggaaatgtctttctctgtgtagaaa

SEQ ID NO: 472618 - DNA, 615 bp, Homo sapiens
gctgcaggcgttcaataaccttctcaagacccaggaaggggtaatgtttgaatttgagtccagaaacaaatgcctgtcccaactgaaaagcagtcaagcaggaggaattccctcttattctggggatgttgtcctgtctttccagactgaaccaatgttcatcttgcgtatgttgattaatgtctcatgtctccctagaatgtacgaaagcaaactatgctctgaccaccttgggcacatgtcgtcagaacgccttgagactgtgtcacgggcacgcatcctcaatgctggcaaaatcaactctaaattaactgagacatgcctggagatctgccttagtgtgaaacagacagggccccctgcacctaggtctctgaacaggaagggttggtgggtccgactgccaatctggtctccagggcttgggaaaatcaaagtgctctcctttagcctgagttgcttggatccccagtggaaagggccctctgctgcaggtctgctggatttcgctggagatccactctagaccctgtttgcctgggtatcaccagcagaagctgcagaacagcaaagaatgttgcctatttcttccaatggaagcttcattccagaggg

SEQ ID NO: 472619 - DNA, 820 bp, Homo sapiens
gaggtgattggatcatgggggtgaatctctcaggaatggcttgggccatccccttggtgataacgagcagatcgcggaagctcccacaatcccccgcagcaacggcgctgaagactgaaagttcaaccgaagataaagaacaagaagagaagtccggtgaagatggtgagaaagacacaaaggatgaccagacagagcaggaaccgaatatgcttcttgaatctgaagatgagttacttgtagatgaagaagcagcagcagcagcactgctagaaagtggcagttcagtgggagacgagactgatcttgctaatttaggtgatatggcttccgatggagaaaaggaaccttcaggtactgtgaaaaacgatgcaagtgcttcagcagcagcaaagaaaaagcttaaaaagcgtcgtttcccagggagtatggaaggttttctcactctagatgaggttggtgatgagaaagatttggaacttcaggaacttcgtaaatcgggcatggcatttaaatctggtgacagaaatgatgatggtttggttgaaattaaagtggacaagatggaggaatttaatcaagaaaacgaagcagcattggaaaatggaattaaaaatgtggaaaacacagaaccagatgtaattttacatttctgcattttaaaaacattttggccataatcctagatgcatgcttctatttcatgtacctgcacatgtgacctttgtgaacagaaatttgcatgtataatttgtgtttgcttgtaactttctggttatatactgcttacatctgtggattcaagttactgaagtgaata

SEQ ID NO: 472620 - DNA, 791 bp, Homo sapiens
caagaagagacaaactgggttattagaacacatatatcaaaatgaaacaaggggctgccctcagcctcttccccatccttcctcccttgctcattggtgcccaaagtctggagggggctgagacagcaggggtctggcatgtcagtgccaccctgagcatgtgcacacttgatcaggtcatgatggcacctggacttggctacagctttgcttctcactggagcaggctcctggagccaggggaggccagggagcaggagggagcacttccgagcctgtggggggcagggcaggcttcctgggctcccgatagtgcagggaagcttgggtgcagtgccacaaatgggcagctgcagctgtgcctgggagcctggggctcctgcctctctgacttggtagggggcaggacgcccatgggctccatgggccatgcagccttggacacacctcccctgctgcagcctacatctttgcagccgcggccactgatgggctgccgctgccatcacttgtatctcattttctctaacatttctggttttctttgttaatatcaccattttactatctcagttatggtcccttttggctaatacatcacatgggaattatgtagttttcaaaagtttatgtagacatttcagaaaaaagttcaatctcttgtgtagtgaatgtagtatctaaaataaatagaaaagaaataaatagataaataggttgaagaaaaggtgctttcagagtacaatcttctaaaaatatagaaaacaattgatagatcaagataagcaaaa

SEQ ID NO: 472621 - DNA, 816 bp, Homo sapiens
aaggtgtcctttgaccatttcccatgaatgatcagtctcatcataggaatacgcggtgatacagaaatacgaagtgttccaatcacactgcatttgcatgcgatgttcaagactcactacccgatctccaagtcaaatagcagccaatatttgatcaatgccttgttgagaattccacatctggttggaattggcttgccaatcattagcaaaatgagccgtttgaacagattgatggaggattcccaaggtctgggcaaagttaccagaatccagattccttctcgagctagaaccaacattacacttttcctggagtcaaaatgggaggaaatctacattagccatgaaaatgaccccagtctcaggcgagtgtggctgcaaagtagaaagattcaattgcatgggcataagaactactacaacatcctccaatctcagaactatgtctgagaaaagcttgccattactcttggcaagaataaagaattatttctctggagatcatggccattatgtattgtcctgaagactaaagaacaccaaaatttgtgttcttctaactgttatcaattcaagcaattagaacctctctaccatctgctgaaatcaaagtaaattaagagagagaaagagagacagagaacaagtacaagccatggccctaaacctacaatggcctatgggttcctggtatgtttccagttcattttctttctctcatttattaactgctgtcacgataacttactgtttcccctctccatacacctgtgctaatcattgaacgtatcagacattcactctccttaggaa

SEQ ID NO: 472622 - DNA, 633 bp, Homo sapiens
acccgggaggcggagcttgcagcccagaggcctagcaggaaaaactggtttcaggggctgggcccagggctactctgctgtgtgcagcctagggacttgatgccctgtgtcgcagccactctagccatggctaaaaggggtcaagggacagttggggccatggcttcagagggttcaagcccaaagccttggcagattccacaaggtgttgagtctgcaggtgcacagaagtcaagaattgagggaatctcctggtctttgggttgtaaaaactgtgagaaaagcataggaaaaagcatagtatctgggccggatagcactgtccctcacagcacagtgcctcacggcttcccttggctaggggagggaattccccaaccccttgcacttcctggaaatggtttggtttaccctgagaacaagaaaaatacaaggatgtcccctctcgccactcctattcaacacagtactggaaatcctagcaagagcaatcagacaacagaaagagataaaaagcacacaaataagaagaagaagtcaaactatctttcattgatgatatgaagatatacacagaaaaccctaaagagtccaccaaaagcctcgtaggactaataaacagattcagtattt

SEQ ID NO: 472623 - DNA, 743 bp, Homo sapiens
aagcagctgcctgcctacttttggctggaggtgagtttccatctctctctggccccgcctcagctggtgccaaacatgttcctgattgcctcggaagaactgcctttgaaatttaacattggcattgggataggatcagcttccctcaatttgggaaatttctatggaatttattgtttgcaggttgatcaagcccaaccaacagagagagcatctcaaccatttcagtttggacatttgtatttgttgctgcaaaagttggattgtcttctggtgattgtgtgtgttttatatagtcatgagaaattagaatttggtaaagtgatattcttttgcaatactgtttggccccgatattgtttggaattctggagtttgctattgaatgggaaagacagatggagttgcatatatccaggcttttgtgctgctgttctaagcagggttaggcctgcttactatgcgatgttttcctttggtgttgttaggcccctgtgttcttttgagtctggggaggtttggcctttaaaaatcaaacttgaaactgctttacccaaaattttggttcacagccttaactggattacctattggggcaaacaaagtaaaactgaaaactgccactgacaagcatcatcattaaccctatcagaaagaagaaaaggcaaggcagtctgcaagggagatttagtgtgaggtttccatgctggatatctatttatttattttttacatttttgcaa

SEQ ID NO: 472624 - DNA, 475 bp, Homo sapiens
gcggcttcattcttgaagtcagttcttggggtccccaattccaggaaatggctttttggatgacatttctggacctgccctgggccagaggggagtccagtaccctgaggggtgcatcacagtcctggcagcattcaccacaagctgagttaagagtccttaggccttatgggaacatcagtggtagtccggcagtactcctcatggcgggtagtggcgatgtccacagggcagtaccccagtgtggactccatgtgcaggctccaaccccacaactgccctctgtactggctctttatgagggctgtgtccctgtaacaggcctctccctggatatacaggctttttcatacatcctcctaaatctaggtagaggttccgaagcctcaactctttcactctgtccacccacaggagtaaaaccacatggaagccttgaaggcttacaaccccctgaagaagagccctgagctgt

SEQ ID NO: 472625 - DNA, 648 bp, Homo sapiens
aggatcaattgaccctcaaagaaatatgagtttaataatactggaatgtgtaaggaaatttgagacagcagagggttcagtacaagacaggaagatgcaggaaagtttggaacttcttcgagacttcttgaatggctttgaccaaaatgctgatagtgatatggaaaatgaagtccaggctgcggtattctcagagggagatgaggaacttggtgggaactggagcaaaggtcactcttgctatgctttagcaaagagattggagacgttttgctcctgccctagagatctgtggaactttgaaattcagagaggtgctgtatggtatcaggcagaagaagtttcaaagcagcaaagtgttcaagatataacctgggtgctcttaaaagcattccgttttatatattcacagagaaggtttgaaattggaacttatgtttaaaagggaaacagagcataaaagtttggaaaatttgccgcctaaggatgcaaaagagaagcaaaacccattttctagagagaaattgaagtcagccccagaaattagcataagtaacaatgagccaattgtaaatcacaagacaatggagaaaatgttcccagggcatgtcagagaccttcacagcagcctctcccatcataggtttg

SEQ ID NO: 472626 - DNA, 1417 bp, Homo sapiens
aaggatcctgtgacactggtcgtgatgtgcgtgaatgccaatttgccacaatgtggaatgtgtaagctttgtgatgaccaagtcggggagaccaagattaatgtccataggtcaggggatcagagagaggagttgcacaaaaagaattccagagatctgcagaaggtgccttcaagcattcagataagtagtgatcagtgcacgggtgtgagggacatggatgaagctggaaaccattattctcagcaaactaacacaggaacagaaaaccaaacagtgaatgttctcactcataagtgggagttgaacagtcaaaacacatggacacaaggaggggaacatcacacaccagggcctgttggggggaagccaagtattggtgaagatgtagagaaaagggaacccttacacactgttggtgggagagtaaatgggaataagttattatgaaaaaagacattatagtaatttgatcattgtcaataaaaatgattttctgcattttaaaactatacatgaataattatttaaaatagcagataatcaataaacagttcattattaattttaatatgaatgtttaatgtgttgattacttattctaacagcatttttttaagtttaggcaaatactttaatacatgtaattgataatattaatttaaccattcatatataattattaaaaggctaaaacactatttttctaaaaaataatcaaattcaactgaaattaaatttgtagtaataagtcatattttgcactatcatacaagctatagaatagctctatactgtcagaagttttctgctctataagatttgattgatgttatatagtaattgattgtaagaataaagtaaaaaatatttaacatatgttgatttaaagaaatattaaactatttttaaaagagtgtgtttttcctctgttttagggcatgcagtaaatttagcaataagattctgattgctggagggagactgtggctttgcagtgttgcctgactgtgatggttaatattcattgtcaacttgattggattgaaggatgcaaagtattgttcctgggcaaaatatacttagattttaagataacttttttctgttccatgtagttgaaagaatcctgactgaacagaaattaacatctttagaatggatacagcaggaaacaacttgagaacacatgctagtacataaaaatgtgacagatggaaaatatcagatttccaaattcatagtattgatatttgtaaaatgctatgtatggaatagaaaaagagaaggatacagatgcccaggaataactgtgaaaagctgaagaagatagaattgagatgagaactgaagaactgataagatttgaggattggcttaggatcatatacactatgtagtttagaatgcattctac

SEQ ID NO: 472627 - DNA, 664 bp, Homo sapiens
tattccctgctaggaacaatggctaggttgaaactagacttcccagcacagccatctctccactctctcctcctgtgtgtgctgccaacctcactgcgtacgctctggtatgaaataattattagaaagtactttgtaagtttcagatactcaagcttgagggcttcagtagatgaaaagaattggagttgctttctttgttatggtttcagcatggaagcctttccagttgtgagtaatttgctgattcattgtcaagaggagacaaatgaaacaaaagggaaaattcgtgtgctgcttaaacacagaatgaacgagtttggtgctggtgagattgtgaacaaatgggtcccatcctgtagggaagaagaaacacatcaggccatttttggctcctttataagacacacatggtatccagtctggctggaacacacttcaaacccatctttgtatgaataactttttacttattttaaagcatcttctctcattgctatgagaatattctaatttctaaaattttttgcattatcattttctcttctgaaatcttctgtgatctatttgatttgatctcttagattttcctcacatatttattttcttagcctaaatcattataaagatgattgaaatgttatgttcatgtatgggacttgtc

SEQ ID NO: 472628 - DNA, 790 bp, Homo sapiens
agtctaggtagacactttcactggatagaattcaggcctgccctcggaatgttacagggttcccgtgccgcccctaatcccgctcgaagcagccctgagaaacatcgccaattatctctccataccatcccccaaaattttcgccatcccaacgctttaccactatttccttttatttttcatattaatataagaagacaggaatgtcaggcctctaagcccaagctaagccatcatatcccctgtgacctgcacttacacatccagatggccgatgcagacagcacacttggggaagtagaaatctctggccacagatgctgcgtgagaaattaccactgggccacagaatccctggaggagccagcatcagcttccaaaactgggagctaccctgtgagcaatctgtatacaacactgggcccaggcggaaaagaactgccagaaataataacttcaaactccaaaataagagcgaattcaccaaggaaagcaaatgtaaagaaagaaatgaacggacttaaaaatatctaattagtgttcatagttggatttaagagaattgcagtgataaaaacaatagcaacttgcaaagaaagtgaggcaatcagagcaagaagcgttcttggaaatagaaagcatgattgcaaaacttaatagctcagtaataattcagtaacaaaatggatagttctagaaactgaatttgtgatgacccactcttattaaaattatgggaaagggaaaggctaaaacacatagaaaatggtaaagtacatgcttggcaaaa

SEQ ID NO: 472629 - DNA, 648 bp, Homo sapiens
ttaggaaaaagatggcatccgatgtggacagctaaaacacaaaaccccagaccagctttccttccttctgggtgtggggcaggactgtctctggaatgggggtcttatgacctacagtcaaataaggtagatcagaattcgtatgttgaagccccaaccctcaatgtgactgtatttgaagacatgacctttatggagctgacatatgttagtaggtcatttcaatatcgaaaatatgatttgagaataattgtgcatgctaagtgctacactgtgactaagatgatgaagaggattatgttcttaggaagtcatgtaacaggaaagctgcattcagctgcttctgcttcagtcaaacagccagttattgcacaactcatccgatccgcctttccttcgctaacaaacccaagctaacttgccagtgagaatcattccttttgcaaattgtgaagaatctcacactggcacatctattttcttcatcttctcacctttcactattttattttatttttgcagatgaagtctctgctatccacgaaatttcacttggtaataaacaggttgaatcaagcacaaccaaataaaagtaacactgttttactcatttcacttactctcttttacacagcctgatttcctttc

SEQ ID NO: 472630 - DNA, 802 bp, Homo sapiens
agctcatgtatataactccagacactggctgtttgagaaatggagccaggacaggagaaggagttggaggaggaggaggagttggagaaagaggaagaagaggaggagaaagagaaggtgatagaggaggaagaggtggtgaaggaggaggagaaggaggaggtggtggtagaggaggtggaggaagaagagaatgaagagaatgtcagtggagaaaagttggaccactggaaagttactgacatcctacaaataccagtgggtaagcccactacagcccagcctccacctggaaatcgagtaattattttggtgatttctaaatggtatggtatcgtcacttttagccagaaatgtgcaacagaaattacttacaaagcttttctaaaaatgcaagtgtcaggtttgacttcagaccaactaaatcagaatctccaagaaaatagttgaggtacatacagtctgaattgcatctggtaattttaccaatatattctgtatattgctgccagggtaatctttctcaagattaaatgtgatcatgcctttgacctactgaaatttcttcagatatctctattacccatgaagaaaacaatcagatgcttttgcatgtcccctgtgttcttcacaatgttctattttacttcagttttgttttttttgttttgggattttgtttgttcgtttctttagcgcaatcagagcctataccctaactaggacaacgatcatgtttctttgcctagtcttagtgtctcataaactctattctctggccataactgttactcatgtttac

SEQ ID NO: 472631 - DNA, 749 bp, Homo sapiens
cctctctctggaagcactgcctccttaaccagctgcaagctgcaggatggcagagccacgtgcccctcccagagactcacacgtgcatacaaaggggtacctcgtctggcgtgcatcccgggaacagctgtgggcatgcggtgggcactcaaagaagacttggccatgtgcgatgatgctgatatgaccagagctaaggggacattcacactggacctgggctgggactctggccagggggtgctcgccccttctggaaggagagctgccggcagtgtctcctacattgaaagaactaaaatacggctggaggcacatttccacatccccatcgaagatgacctgctcctgctcctggcctccttggaattcagggaatgctgcccgagccgcctcctggcgttgcttttctggaaagaaggctcaaagcggggtcccccatgggagccctggccctgcagtgctggggaggggcagacccgggctttgagcagagccaggaacgcacttctcttgagagaccgtttgctcctctctggaggtttccatcctgctgctattttgtgagcaggatgtttacccccatggggttttagagcagaacttagcctcgcttaggggcttcagatttgtgtacagagtacgagccaataagacaccggccagtccgggatgttctggtccagtgggcaccctcagagctgtggagccgtttgtccccaagggacatggttgggctggccctggct

SEQ ID NO: 472632 - DNA, 1140 bp, Homo sapiens
cctggcggtgagaggaacgcaagcctgggcgtccggtcctctcttccccacccacctccctctgcagcctcctttccgccctctggatccagccacctgtgctccagcaggtccccggagggccttagacctagctctgcctggcctgcacatggcatcccataacccctatggacatccaattgctccgttagagcatttgttgaaaatgctttccttgctccatgtgatgactctggtgcccttgtcaaaagccagctgggcctattcgtgtggagctgctagcactaccagagcagaagtgccaaagctgatggaaaacacaggattcctgggatttgacatccagtgctacaggaaagcaaaccctgctttatccaccattgccagcatagtgaaaggtggaagaagaaccggattcctgagtttttctgttgatcagcactggaaactgggcatgtctctaatctattcaagtctggtttttcacctacagcatgggaaccatgagaatacttacggccttggtgtggggtcagttgaaacagtacatgcaaagtatctcacagtagaaattatgaataaagctgctgggaatattcctgtgcaggtttctgtgtggacataagttttcaactcatttgggtaagtgcagaggagtgcaattgcggtttgtatggtaagactatgtttagctttgtaagaaactgcaaagctgccttccatagtggcagttccattctgcattcccaccagcaatgaaggagggtggctgttgctctgtgtccttgtcagcattcttctaagactttagccgttctaaaagtgtgtagtggtatctcatggaagttactttcaagtctatttttataggtggagaatacgcgtgtatctgatgtgcacaggaatccctcattgctgagggacgccttcgtgaaataggtaggaagttctgaaatcttgttgatggtctttgtttcttcccgtttggagtgggtccccaggccaggccttgccttttccaattcactgtgagcatgtacacaactgtccccatgaaaaatactccagaaagccctagaagcacaattaatcaacgtgtaatttattgcttatgcagcaattacccaatctggtaac

SEQ ID NO: 472633 - DNA, 647 bp, Homo sapiens
gttttgctgatttggtgcttgcgtagttattttttatatatataaatagggatggaaatcattgaaaaattttactacctgcctactaccctgattcctgtcccactatggcctgggctttctccagcacccagagactggggtacatggcttttccctgtggctctcaaaccagttgatggttttcagatctccgtggccatcgtgtccatggcaacagcagctttcagctctcccacctcagtggttctttctgataatggtttccaaaagaattcccaagaacttgatcttcgctatgtgggaatctccaatctctgcaggagggatttgctgccttcctgtgacactcactccatcccggggacactaagcattataaagctattctttatgctaagcccaatctaacgcattcagactcaaagccactgaagttcagggaagacataattgtgtcgtttgatttgttcaccaaagagcaggtcagatggaaaggttactgtcctcttaaaaatattctgacaacaaattttttaaaattttaatgttatcattttgcctttttggagaaagggtttctatttatcagcgatgattaaacacttctgaaatctggaattactgactttgaccttttctttatc

SEQ ID NO: 472634 - DNA, 1003 bp, Homo sapiens
gctgaccccagcagtccttggtaaggagcctctgagtacgtctcccccagactcccacccacttgtgcagctccaccctccagcggctgttgtgcgacgtcaggatggaatatccaggaagcagtttgttgaagttggacgaaaacataggagcatttttaggctggatattgttacctaagatgaggttcgcatggaggttaaaggaaatggtttttatccggaaaacaaataattgcaattcgggtacactggatcagggcagctccgaagagggtcctaacagccagtgccggagagtttttctcattggagatatctgcaaaaagttgttttcggaggccgtcattggtcaggcagaaatcctaaatgacaaacccgttctgattggtcagctcgtgaggagagaggtaatagctagtcaggtcctgcccccagctccctgtctctaccctctggggctgcggtgttttggttgccgaagggaactactgaccatttgctcagcaccttctgggtggcagaagcttgaagcctgtcacgtcactcagtccccacagtgaccctctgatgtggcagctgattgtaagctccctaaaacgggggtcttttctctcaccttcatcctgctatattccctggcagagagagaggctcactaatatttagtgcatgctaccttttaccttctagtattggtctcaactcactgcccagcccagcccagctgatttttaggcattctccatcctcacatcttttgccacaatttatttggtggtttgatgggcaaaaaagattcctggtctgtacctttaatgtaacgaggacattagtgatgtgtaatggaggtggaaatcgctttctaatgcataaaacataaatacagcaaaagtgcacaaatgagccataactcttcttcctttcataggcaataaaaaaatccccatactctttcctcattaatttggaccgcatgaaactgtggagctgctgattttcc

SEQ ID NO: 472635 - DNA, 3677 bp, Homo sapiens
tctcctgcttctcctgctgcgtctcccacaccccatgccgcgtctccacaccccatgccgcgtctccacaccccatgccgcgtctcccacaccccatgctgcgtccccacaccccatgccgcgtccccacaccccatgccgcgtctcccacaccccatgctgcgtctccacatcccgtgccgcgtctccacaccccatactgcatccccgcaccccatgctgcgtctctacaccgcatactgcatccctgcaccccatgctgcgttcctgcaccccatactgcgtctccacaccacatctgcatcttccacaccccatgctgcgtctccgcaccccatgcttgctggtttctcccttgtaatgagaatgagctttatgcacttgagcctgacccttgcccagcattaacggagcccagggtgtgagtgctgccagagtgtaccttcagccctccttatccacgacacacttaatcaatcccgaatcctcaggaagagtgccagagccttggttccaggcttaacacatggggaatgaactgaatgaatgtatggtccccctcaaggacaaggaactttcattctgtggtatccagaggactcagcatgaaacctgggcgatggccttccgcgtctcccttcggacggcaacccctcccgtccatcgcctttgctgcatccgtgaagctgctgtaacaaattatcccaaacctggtggtggaaaacagttgtggaggacagacatctccattcagtctgaaggggttaaagtcaaggtgttggccgggctgggtccttctggaggctccaggggagactctgttcccgggttcttccagcttctggtggctcctggtgtttcctggcctgatgccacatcgctgcatcattccggtctttgtctctgtggtcacatagatctctctgcttctgtgtcaaatattcctctgtctgcctcttataaggacacttgatgccgcttgcgttcactgagactgaaccacagtgctccagcccccaccccttcatgtttaacagctgcacttgcagcctgtgcctgccaccatcctatttattctgttccacccagagacctagagacatgctcatcataccagcccgtctaaaccgactgaaatgtaaagagacacctctccacgcatgtgatgctctggcttatggggagacgaaggtggggaatgtctgcccttgatgaagattagttgactgtgtatatgtaggttaatttctgagctctctattctgttccattctgtgtctgtttttatgccagtgccatgctgttttgattactatagctttgtaatgtagtttaaaatcaggaagtatgatgcctacagctttgttcttttttctcaaggttgctttggctgggtcttttgtggttccataaaatttttagaatgtttttcatctctataaaatttccattggagttttgattgctatgaaaaagtgccattggaatggctgttgccattgcaatttagatttcattcaatccataaattgctttgggaaatgtggacatgttaacaatattaattcatccattccataaacatggaatatatttatttatttgtgtgtttttcaatttatttcatcaatgttttatagctttcagtgtacagatctttcacttccttggttatatttatttctaatttattctttttcatgtggttgtaatttggattgttttcttaattttttgggtagtttcttgttagtgcatagaaatacaacttatttttgtatgttggttttgtgtcctgcaactttactgaattcattgattatttctaacatttttttgagaagtctttaaggttttctatatataagatcatattatctgcaaatagaggcaatttaaattcttttctgatttggatgtcttttatttttcttgtctaattgctctgactcaatagaacttccaatactgtgttaatagaagtgacaacttcatcttgtttctgatcttatacaaaaagttttcagctttccactgttgagaatgatgttagctgtgggcttggcatacatggcctttattgagttgagcacattcccgctatacctaatttgttgagagtttttatcaagaagtgatgttggattttgtctaacgccttttctgcatctgctgaattaatcacaatttttacctttattctgtcaatgtggtgtatcacatttattgatctgtgtatgttgaaccattcttgcatcccagagataaatccaacttgattatggtgaatgatcctttcaatgtactattgaatttggtttgctagtagtaaatttttgcatctatgtttatcagggatattgtcctgtaattttctttttcttatagtagccttgtctaattttgtagttggaagtgtttcttgcttttcaattttttggaaccgtttgaggattgatgttaattcttctttaaaagcttggtagaattgacccatggaacattctggtcctgggcttttcttggttggttggaagattttttttattactgatttaatctccttacttgttattggtctgttcagattttctatttcttcattgattcagtctttgtagattgtatgcttctaggaatttattcatttctttgaggttatccagttggttggtatataattatttataatactctttaatgatcctttgtacttcgtggtatcagttgtaatgtctccttttccattataattttatttatttgagtcctctctttttccttggttagtccagctaaagatttgttgactttatcttttcaaaaaaacaactcttagttttcttgatcttttctattgtctttctaggctctgtttcatttatttctgctgtaatctttattatttgcttccttctgctaactttgggcttagtttattacttttctatttccttgaggtataaagttaggttatttgagatatttcttttttcttaatcaaggcatttttctctctatatttctcttttagaactgcttttgctgaatcccataagttttggtatgcttcgtttccattttcacttgtctaaagatattttgaatttttcttttgatttttttctataatccattggttgttcaggagcatgttgtttaatttccacatatttgtgaattttccaattttccttctattattgatttctagcttcatatctcagtggtcagaaaagatacttgatatgatttcaatcttcttaaatttgttaagacttgtttcgtggcctaaagtatcattcatcctggagaatgttccatgtgcacttgagaaaaatgtacaatctactgctgttgaatggaatgttctgtatatgtctgtgaggtttatttggtctatagtgttattcaagtctgctagttccttactgattttctgtctgatgattctccattgttgaaagtgaggtattgcagtctcttaccattattgtatttcatctatttctcctttcagttctgttaatatttgctcaatatatttaggtgttccaattttgggtgcatatatatttacaattgttatattctcttgatgaattgactcctttatcattatacagtgactctctttttctcttatgatacattttgactgaaagtttatcagggtg

SEQ ID NO: 472636 - DNA, 3961 bp, Homo sapiens
cgcccccctgtccctcttagttttttagtcccttagtccctttcagagacgacccagaggcaggaagcaggcaaggctcagctggtgaagttgggaaaacggagaagctcctatgtctcgttgttgattgaatctcacaccgttacatcttgctcacagatgtcaggactaaatgagggaagcgtggtgccttcctgacgcatctgggcaattaaatagcaatcagcaagtgtagttaaccagggcagcgctctcctcaatggccctgagtgtgtccgtgcatcatctgccgtcggtgctcattcactgagtctccctgtctaatttggggcaaaaagttaattggaacttgatggtggctggatggtgacctgagacagacaggccaggtagaaatgttaaaagggaaatccatgcaggctccttcctggctccccagagcaggttttcctaaagctccccaggccccccacacttgcctacacattcggattccatcagggatccctgaagtaaagggggaagtgcccagagggcagggccagacctctgtccttggtaggagctcgtggttcctgctgctgactcaggccccatgctgtggagggcgtgtgcctaccacctgcattacctcctgggtgctggactctggcgatgtgggtgtccctggccccatgtacctgccctgggctctcctctccacctgggccctgggagccccttgccacaggtgtagaagcctgagacaccgggaaggacatgttccccagggtggccctattccaatggccaacagctggagagggagacctgcccagttccctcatcttgagctgtaacaacctcttgagcccctcctggcacgtgcagagcacacagcaggcaggtgttaggagaattatgtctgctttttatgactcactcactgtagcacttggaacaattccaggtccttgtggttcctgatacgtttgcaaagtcacagatgcagggaatgtttgttcctgtttcagcaagactgaataatattccattgcatgtacacaccacattgggtttattcattcatctgtccatggacacttgtgttgcttccacattttagctatcatgaataatgcggttataaacatgggtgtcaaatatctgttagaggctctgtttttacttcttttgaataagtaacaaaaaacggaatttctggattatatgttatttccatttttaattttttgaggaactatcatactgtttttcatagtatatatataacattttatattcccaccaacagcgcacaagagttccgatttctccacatcctcatcaacacttctcatgttctgctttttagatggtaaccatcctaatgggtgtgagatgtatctcattgaatttgcatttccctaatgattagggatgttgagcatttttatgtgtttattggccatttgtatatcttctttggataaatgtttactcaagtccttagctcatttttgagttaggtttttttgtttttgttgttgtgtttttgttgagttttaggagctctctatattctgtatattgatcctttatcagatatatgattttcaaatattttctcccattctatgagttgtttttttttttactttgttgatactgtcgtttgatgtacaaaattttttatgaagttcaatttgtctattttttttcttttgttgcctgtgcctttggtgtcatatccaagaaatcactgccaaatccaatgttgtgaagcttttcccctgtttccttctaagagttttgtattttcaggtcttacatttaggtcttagaccattttaagctattgtttgtatatggttataggtaagggtccaacttcattctttcgcatgtgaatatccagttttaccaacaccatttgttgaatagaccatcctttccccattggatggtcttggcatccttgtaaaatatcatttcatcatatatgtgagcgtttatttctgggctctctattctatttgtctatatgtctgtctttatgccagtaccacattattttgatgactgtagctttgtaataggttttgaaaacaggaaatgtaagtcctccagctttctcttatttttcaagattattttggctattcagggtccctagagattccattttaattttaggatggggttttctatttctgcagaaagcatcatctagacgctgatagggattatgttgaatctgtaggtcactttgggtagtactgacatcttaacaatgttaagacttcaaatccataaatacgagatgtgttccatttacaattgactcttgaacaacattagagttggggtgctgacctcctatgcagtcaaaaatccatgcataactttttacttcccaaagacttagccactaatacccaactactgagtggaagccttactgataacataaacattcaacgaacacaaattttgtaggtggtatgcattatgcattcttacaataaagtaagctgttagagaaaagaaaatgttactaagaaaatcataaggaagaggaaatgtgtttactattcactaagtagaagaggattatcataaaggtcttcatccttgtcttcatgttgagtaggctgaggagctggaggaagaggagagggtggtcttgctatctcagatatggaagagatggaagaggaggcaagagaagaaagacaggcacacttggtgtaactttatggaaatacgttgtaatttctatctgactcttttgctttttcatgtctttaaaaatgtttctatatggtaccaatccttttcccaccgtatgctttagttttagtgcctgtatcatagaagggctcaggtcttaaaaaagaaaaaaaaaaaaaaaaaacagaagctgtcttgaacaatcagaacccttctgccagatcgtccaatgttaatttgtttcttggcactacttcttctacattatcttctgcatggtctggcactggttcagaagcactcatctccttcaagtcgacttctgttaattcctctggcatgatgtctattagctcttgaatttctccaagtctatatcttgaaaccctttacacctacttttttttttttttgccatatccacaatctcttaatttccctgattgactctcttgtgaatcttgtgatgtcaggcacaacatctggacacaattgtctccagtaagaattcattgttttaggcttgatagttttcacaactttttgtataacaatgttggcctcttcaatggtgcagaccttcatgatgttccctctgttagtattcttttctgtagcattgataatcctttccatagagtactgtgtgtaatgagcctacagatccttatgacctcccgatctagaggctgaaggggaggcactttgtttgggggcagtacaccactccagtgccttcagtgttgaactcctgggattctgggtggccaggggcattgttcaatatcaaaataactttataaggcagtctcctactggcaaggtatttcctgactttagggacaaagcatcaatgaagccaatccaggaaaaaatgttctcattttccagtccttcttgttgtacaaccaaaagactggcagctggtgtttaatgtttcccttcaaggctgggggattggcagctttatagataagggcagacctggtcataaatccaacttgatttgtacaaaacagtagagatggcctatcccttcctgtcttaaatcctcccactcacttctcttccttattaatgaatgtcctttgtggcatttttttttccagaacagggcacttttgtctgcattaaaaattggttcaggcatatattcttactcctcagtgattttcttaatggtgtttgggaacttgtctgctgcttcttggttggcagaaactgcttctcctgttatcttgacattttc

SEQ ID NO: 472637 - DNA, 626 bp, Homo sapiens
ccctttgccctccgtcttctcatctgtgcaatggttgctgtgaggatcccatgacttggcatggagcctgacactgcggagcttatcagaccccagggactcatctcagcctccagggacgggggtggtgtgaacgcacggagaacagtcctgcacgctggccgtcgtggagagactgggaacaagcgattagagccgaccagtttgcagcctagcttaggaggaagcacagaagcagatctagaacattcacagcctgacaatgtgatagaaaagaaaaacccattttctgaggagaaattcaagccggctgcagaaacttgcaaaagtaacgaggaacccgatgtaaatcgcggaacccaatgtaaatcgcagcagagacactggggaaaatgcctccagggcatcttgcaccgtgcatctggaaaagctgcagacactcaatgccagcccgtgaaagcagccaggaggggggctgtaccctgcaaagccacagggatggagctgcccaaggccatgggagcccacttcttgtatcagcatgacctagatgcgagacctggagtcaagggagatcattttggagctttaagatatgactgacctactggatttctgacttgcat

SEQ ID NO: 472638 - DNA, 1951 bp, Homo sapiens
gcaaaggtcaaggccacgttccccagagctggtgagagaccggggccacccagaccccacatggagcctgcagtggggtgtgggcagcaagttctgcctgacagacgccatgcctgccccgcactctgggctggtgcggcacgggcttaggtggagcgcgtgagccttcttcgtggaaagttgctgagctggccaagcgaggctgggtattatctagtgctgtgtgtgggcagggctgggccctgatcctcctggctccgtggcaggcatgggcatagagcttcgggctgggggagtgtttgtgggatgaatagaggatgctggtccagatccatcccatggctgatgctcccatcctggacctggtgggcacgagaggtgctcacacccattatcccctgtggttcttctcaaacacaccgagccatggggcaaagtctccccgattgaacctgggggagtctgacagacccacgtcctcaaccttccttgtgcattaccagatccttggccaagaggacagagcctggaatctgagtccactggcgcaggatgtggaagtaaacatgagccccaggtcttggaaagaagcctggcctacaggcctgaccccagctgaccccaggtccaggccccacgatgcaggctgctttgccctcagagggtttcatatgcagcggctcttagtcacccagaaccttccccaatctcagacccagggggatgagatcactcccctggcacgagcagccccagaagaagagtgcttgcttcagctgctggctgagtggcgagctcagggcctggggacgttggtccttgttggctccaggggatgggctgggtcagctgtagccaccggagagccaagacgtggattcctgggagcatttctgagctgctgccagaagcttctctatgtcactgggagagaatgtggggcagtgtgaggctttgcccctaacggtgagggctccactgaaggaaagagaaaacaccgtgttgctgctcaagttctgaaagggctgggaaatataactaagagtggggaggacatcccctccatgcgaggaggccaggtgggaatgtgcctcaggtgtgctggctgagtgcaccagctcattccagacccagcactggccagacctgccccagccccagggctgagcccaggcagctccccacagtctcctttgggacaaggcaatggcaaagattggtggagctatgctgagcagggctggttattttattcctgctttccatcgtgggttttattaatatgcagccatggtgggccagcagatcagcaggcagctgcctgtttaaggatttgttactcacagatcccatgaggagggggcaggccacgtcacacagggccacaggggaaagcaggggcatccatcaggaggcagagggagccgggggcaatgtgggcagagcctttatagtggtttctgcaggaaggataggctcgtgtggataatttctgtgggctctggggcagagaggctgcccctaggtgtctggcacctagccaggggtgactagggcaggtggatggtggccctggggggagaatctggtagaggaggtcgtggggtgtgggctctgggtgggttggtattaaaggtgggctcccagcacagtcctttactatctgtaggaattggccagccctgggaagggccgtccctccaggatcagcaaggcactagaagtcaaagtgtcagaacacagaaaattaaacttcacggttagtacaattttttctaatctaccagagtgagtgcagagcaagaggaagccatgagtgtgctggggtttgaaccctcttgcagctgctgttatcaggaggaacagggggaagacactgtcttgaaattagagtttgttggctggtcgtgtaggagcctccgggcccctctttgaacctgcatgctaattc

SEQ ID NO: 472639 - DNA, 654 bp, Homo sapiens
aggagctcactctactacccatacatgtgccaagtgcctggaaatctgctctggcaaggaggaaactggtgccgcaacaaggtctttgcaggggatgggaagcgtggctcagacacctactctaggggtgcaggtgcacctcatcctgggtgatatgtccatagaagaagcagagaaaccactgccacaaggagggcaggtgcaccagaggcctgctatgtgtggaacagagagtgtgctactgcaccaggatttctgcacaggaagagaggggcagctcaggctgctaatcctggagaaaaaaatggcttcagaaactctcctcccacttcagacctgtgatggaagacagcccaattccagtgcctactgctgggatgctttccacatttgtcactcaattctggctgtggggtcctgtcccactccagaagatgactatgggaattttgcctgtctacatgatgacaataatccttttgaaactaataagagattttagaccagccaacacttgactcacttatgtgttttgtttttttatgtacattttttactgtcaattgatataatctcatgttcttgcctctttctgcacagcttttacatttttcaggtctaaatggtttggtgttgaggcaaaaaatacaattt

SEQ ID NO: 472640 - DNA, 909 bp, Homo sapiens
ctgggaagagtatttttatgcctcttctactcttaaagtacaatgttttgcaatttcctctttgcgagctctgtgctgctggcaagctgttttcccactgacaagagaaatgcagagctgccactgacagaagtgatcaggaggggcaaggcggctgtcctgcaggcccagcttgaaggcagaaggtgtggggggccacagcagtggcaaaagctgcaggcctgccaattacctctgggagctccattccagagaaatgcagagctgagactggccaaagtgctcaggcaggactcgggtggctattctggggtcctaggccagtgggctttgcctgatgaggagatttgtaattcacagaaggaggtcaaaatactaacattaagaggaatttggaagaggttgattccaaccctcatggatgacttggaggtgttcaaaactttggtgaaggaacgaactgcttatgtggtgaaaatagcaagagaactagaaatagaagtagagcctgaagatgtgaccaaattgctgcagtctcatgatagaacctgaagaaatgaggagttgctgcttatggatgggcaaagaaagaggtttcttgaaatgaaatctactcctggtgaaggtgctgtgagcattcttgaaatgacaacaaagaatttagaagatgccgtaaacctagttgataaagcagtagcaaggtttgagaggactagttctaattttgaagcttctactctgtgtaaaatgctatcaaatgacattccatgcaatagagaaatcttttgtgaagagtcagttcatgtggaaaacttcattgttgtcctatttcaagaacttgacataggtactcctaccttcagcaaccaccaccctgatgagttggcagccatcaacatcaaggcaaga

SEQ ID NO: 472641 - DNA, 555 bp, Homo sapiens
gctgacaatttgacaggcttaaacacaacctaaggtgggcagctggctttgctggggggtctgctcaagtcactgtttgcctcagaatccataaagcctgaaagcaacaatggctaaggctgctgaacagcaaagattgcagcacagccttccctctggaacctccatcccagagaggtttgaaactgctgctggctggaaaacacaagcaggggtggctgttgaccttgatcagaaggttgcaccagtgaagagaaatgggatctgggacctgcttgaaaaagcagtctggctacttctctatagagcttctgcactggcagctgcactgaaggcaataatagctaaggctatgaaacagcaaagatggcagcctacccctccctctgggagcttcatgtcagggagatgtaacactgctacctgtggatggctggattcccaggccagtgggtcttatcctatgaggtatcatggaagtgggacctgcagaccatcactgctcagccccctggtttcagcccccttcctaggggtatatatggggctctaacc

SEQ ID NO: 472642 - DNA, 500 bp, Homo sapiens
tgcgcagtctcctggtaaataatgatttacaggaagcaagccttgtttttcagagccagcaggcaggaacatttaagtctgctgaagctgtgcccacagcagccccttctttcacgttctctgtcccatggagatgggctttttatctataagtcgctgactgaggctgctgcctttctttcagagatgctctgcccagagaggagggatctagagaggcagtctggctttagtggctttgctgagctgtggtgggctctgcccagttcagactttcgggcagctttgttcacactaccaacagaactcacattccctgtgtccactgggacaggtcttgagaatgcccttgtgctcagtccagttcacaaggatttattgaactcctgttatgtgccagagagtgagccaagtcttgggaatacaaaaatgactatgtgagaataggtgagtaggttgttttttcactctattgattgtttcctttgctgtgcagaagc

SEQ ID NO: 472643 - DNA, 594 bp, Homo sapiens
tttaggtgcgtctgcattctcaggggatgcttaagttacggctatgagtatgtctaccatgcagagtcattctcagtatccttcatttaagttattgctctcaagataccggaaaggctggacgcttcggttattagaggattttggagatggaggtgcttttccagaaatccatgtggctcagtatccactggatatgggacgaaagaaaaaaatatctagtgcgctggccattcaggtggattctgaaggaaaaatcaaatatgatggaatcactcgacaaggacagtcaaaagacaaggtcatttatagcaaatacactgtcctggttccaaaggatgttacgaatgcaaatgatccagacttgcaaaggcccgatgaagaagctataaaagagataacagaaaagacaagagtagccttataaaaagctgtaccacagaaggtcaccgcagtcacaccagttcaggcagctgacaaaccggctcctgctcagtatatccgatacacaccatctcagcaggagtggctttcaactctggagttaaacagaggtttgatgaattgttgctgtttgttaataatgaatgggtg

SEQ ID NO: 472644 - DNA, 617 bp, Homo sapiens
atacacttgctaggagcctgatgtttgttgaatgttaaattatttattgagcttctactgtgtggcaggcactgcgcgagggtttgccatgagaaagcctcacgacttgcagaaggtaatgattctcagcttcagcttccttatgtgtgtaatgatctgtgagcaagtcagcaagagaaggtgtgctaggatggaagccacagtccgttgtcacctcatcttggaagtggggtcccatcgcctcagtcacagaggcggggaccatcaggggacatcgaccacagtaggaattgccgtgttccttagcagaggcatagaaaggccaggtgactctgctgaggtcatacaagagatggtggaggagctgggtgacaatcaaggtagtctggctgcagaagctgctctcattgctaccatgctacactgtgctgccccacagttagaatgccaggggatgcatttcctgaacttagaggaccagagggcacaggctcaatcatgaaaggtactggctaggacagggacacttagccttttccttgccactgcaactattgtgaaatacaattagaggaaaagttagcacctacttcatgatggctatctggtgcctttcc

SEQ ID NO: 472645 - DNA, 588 bp, Homo sapiens
agagaatacgtacatgaatgagcatggctgtgttccagtgcactgcgcgagggtttgccatgagaaagcctcacgacttgcagaaggtaatgattctcagcttcagcttccttatgtgtgtaatgatctgtgagcaagtcagcaagagaaggtgtgctaggatggaagccacagtccgttgtcacctcatcttggaagtggggtcccatcgcctcagtcacagaggcggggaccatcaggggacatcgaccacagtaggaattgccgtgttccttagcagaggcatagaaaggccaggtgactctgctgaggtcatacaagagatggtggaggagctgggtgacaatcaaggtagtctggctgcagaagctgctctcattgctaccatgctacactgtgctgccccacagttagaatgccaggggatgcatttcctgaacttagaggaccagagggcacaggctcaatcatgaaaggtactggctaggacagggacacttagccttttccttgccactgcaactattgtgaaatacaattagaggaaaagttagcacctacttcatgatggctatctggtgcctttcc

SEQ ID NO: 472646 - DNA, 3742 bp, Homo sapiens
gctggtgaggattataggagggggaggaacactcgattggtaagggaagagctcctcaagtgagcatgcacacaacgtcagtaaacactgtgcacgcggccctcccaggtgctggcaggccactgtgcatgcagacagcccacgccaaggggagaatcaggggagaagggatgcagcccccgtcggaagcatgccagcataaaaaacccaagtcaaaggaaatcaaggaagcaagaattgaggttgctccagacccatgcggatttgctgctgctgacatactttggtgctgtgacttggatatgttccctagtggttaccctaaggacagtccttcaggtaactgtcattggtgtgggaagccaggccactggaaggcaaactgccccaatgagataaatgggaaaaagcccggcacagcttgcccctttgccacaagctctgccactggaaaagaactgctctgacggccgaaggactggatcccaatccctgatggccttgagctgaaggagacctctgctctggctggcttccaagtcagacattgtcatcagcaagacaaagccaagggcaacagtagaggacacacacaacaacatgcagtacaaaccataaattcctaacagaaggaaaataacttttctctaattcaaaggttataaaggtaaagaggtatttttgttaaggaagattataaagaaaagaaattttatatgagaaaggatcttttgtcgtaaatttgcatcctaaagaaaaataactgattgtttaaaaagagggatgcttaggacaagtgagaaagtccaagcttttcatagatgttctgtgtaagtcatgaaaagatttgtgaaagggaatttataaaagaaatatcaaacaattttgttttgttttgtttatttatttttacaatttttaatttttgtgagtacacagtaggcatatatatgtatggcgtacatgagatattttgatacaagcatacaatgtgtaataatcacatcaggataaatggggtatctatcacttcaaacatttatcctttctttgtgttacaatctaattatagtcttatagttatttttaaatgtacaataaattattgttgactgtagttaccctgttgtgctatcaaatactagatcttattcattctaactaactatattttcatatccaataaccatcccccattctactactccactacccttcccagactctggtaaccatcattctaacacaaatgtgaattacaatgttctaatgtgaatttagaaatgtttcgcttctcagtaattttgtgatatgaacaaacattaccaaaaacacaagattctatttttctagtaaaataccctatggtagaatttcaaatatcatgttggattcttttcgtgtttatttggatgaaaataaggtatgttaattcacgatgtacagagaaacctttaggctgaacttaaaatacgtaaggaggcagctttaggctgaacttgatttaacacagtaaaattgatacaagacataaaacacaaattagggagaaaatgacattccaaattgtttacaagttttcacttagagagtgaaactcttttctcatggatttccttgctgcctgttgcctacgaaccactgtccacaccctaaaatgcaagtttaatcacattgattgttatgtgccagagaatgtggaaaacgtagcactcatttaatcgtcataacaagtgagatgatttcgtttttacagttgagaaaactactgagaacgtgaagaactttccaaagtttcacagttaataaatgagagaaccaaaattcaaatccaatctggctccaaaatataattaaacactacattgcactgcccctttaataactcccagggacttcaaaataaaatccaaactcattagtgtggtaggcaggggccttcgaggatcagcatcctggttctcatttcctacattttccctctccctacactcccaccagactgaacagttgatcctgctcattcacctttatgcctctgcatgtgttgtttgctctctctggaatgtgcattctacctgtcctgccagcctccttttatcttcatggtttatgtgtattgagcaccgatttggtggcaggtgcatcaattatcctgtttactcatcaccacaattttgtaagagagatactcatctctgttttataaaagtagaaactgagccttgagagggtaaataaatttcccatggacttaagtgctaagtcaaaccaggtttgttgtggccaacttttaacccaatcacttaaaaaaatcatcttttttaaaaaattaaggtattacatgcaaaaaatcatccattttaggtgtacagtttgataaattttgataattatatgtaaccatgtaaccaccactattaagatatatgatatccagctcttcatggcatggaaagaaaagatacgtaatatttctcttattctaaaagcttccttgtgctcctttttagttgatcccttcttctgaccctcaagcaaccactgatctgatttctgtcactgcagtaaaatcatacagtatgtagtctttgttctttcgtgtttgacttctttcactcaatgtccttgaaattcatttatattctcttatgtactaatattttgttcctttttactgctgagtggtattcctcagtatgaatatgctataattgttcatttgtatatcaatgagtgagcatttaaattatttccagtgtttggctcttatgaataaaactgctttaatcttcatatacacatctttgtgtggaggtatgttgacatttctcttgagtaaatacctaggagtgaagttgcaaggtcatgtggtaagtctatgtttaacttgacaagactgccatgctatttttcaaagtggctgtactatgtggcattcccatcctgagttttaattctatttttccaatatttataccttttatttctttttcttatctaattatcctggctaggacattcagtacaatgttaaatagaaatggtaagtgcagatatcctgaacttgttcttgattgtagatagaaagcattgacagctgtaggtttttaatacacattcttaggttgaagaaagtcccttatatttctagtttcccaaagattttcatctcaaaagagtgataaatatgtcacgtttttctgcctttattgaaataatcatatgggttttctcctttattctattaatagtgtgaattagacaaattcatttttagatgttaaatcaatcttgcattcccaggataaaaccacttgattacaatgtcttatcatttttatatattatttgattcaatttggtaatatttttgagaactctttcatgtttgtgtttatgaggagtattggtctgatgttctcttgtgatctctttggttttcaaatcagaataacattagcttcataatataccttggaaagtgttccctcctctattttctgaaagtgtttgtgtagaactgatattatcacttccttaagtgttttaaagaattcgtcagtaaagcaatctacacttaggtttttctttgtgggaagattttagattataaattcaatttcttcattgatatattgctgttcaagctttctatttcttctttggtcaattttggtaatctgtgtttttgaaggactttgctaaattcacctaggttgtcaattttattggcatgaaa

SEQ ID NO: 472647 - DNA, 1136 bp, Homo sapiens
ggatgactgttagaaggaaaatgaacaagcagaaaggaatagcatcaacatcaacaaaaaggacaaaaaaggacatccacaccaaaaccccatctgattgcagcccctcgccagcaacagaacaaagctggatggagaatgacttagaagagctgacagaaataggcttcagaaggtcggtaataacaaacttctctgagctaaaggaggatgttcgaatccatcacaagaaagctaaaaaccttggaaaaagattagatgaatggctaactcgaataaacagtgtagagaagaccttaaatgacctgatggagctgaaaaccatggcacgagaactacatgactcatgcacaagcttcaatagccgatccaatcaagcagaagaaaagatgccggatacagttcagtatagctacccccaagtgttacgggcccagagcgaggagagtagcacacttgcgtgggatattgatttcacggaggatgctcttgtgagacttattcactatcatgagaacagcatgggaaagacctcaccctgtgattcaattgcctcccaccaggaccctcccatgacacgtgggaatgatgagatctacaattcaagttgagatttgtgtggggacacagccaaaccatttcaaatatgttactactcttccatttttaaagctatttcagaagcttctttcttcttgatataagtctgtaaattttcttggtacatttttgcatagttattttattatttttgttgctgtcataagtgtgggtctggtgtgaaggttattgaattctgtatgttagtttataacctgatacatttctgcattttcatactgcttgcagtatgaaatataagataacagtcttataatttcttctcttttccaattttcatatctcatttgttattttttatctttttgataacagccgttctgactagggtgaggtaatagctcatagtagttttgatttgcatttccctgattattagtgatattgaccattttttgtcatatacctgttgactatttgtatgtattcttttgagaaacatctcttcaagtctgttgcccattattaatcacattgtttgttattttgttattgcattgagttccttacatatt

SEQ ID NO: 472648 - DNA, 769 bp, Homo sapiens
gtcaccaagctgggccacttggtcaaggacatgaagatcaagtccctggaggagatctgtctcttctctctgcccattaaggaatccgagatcattgactttctcctgggggcctctctcaaggaggaggttttgaagattatgccggcgcagaagcagacccgtgctggccagcgcatcaggttcaaggcatttgttgctattggggactacaatggccacgtcggtctgggtgttaagtgctccaaggaggtggccactgccatccgtggagccatcatcctgaccaagctctccattgtcctcgtgcgcagaggctactgggggaacaagatcggcaagccccacaccgtcccttgcaaggtgacaggctgctgcagctctgtgctggcgtgcctcatccctccacccaggggcactggcatcgtctcggtgcctgtgcccaagaagttgctcatgatggctggtatcgatgactgctacacctcagcccggggctgcactgccaccctgggcaacttcaccaaggccacctttgatgccatctctaagacctacagctacctgacccccgacctctggaaggagactgtattcaccaagtcccccgatcaggaattcaatgaccacctcgtcaagacccacgccagagtctccatgccgcggacccaggctccagctgtggctacaacaaaggtttttatataagaaaaataaagtgaattaagcctgggtttttatttaagaaaaataaagtgaattaagcctg

SEQ ID NO: 472649 - DNA, 638 bp, Homo sapiens
ttcctaggccagggcctggaatgatcctctcccagaccttcacatggctggcttctccgtgtcacccttcaaaccttagatgagtcaaaggtttctcagggaaggcttctctgaccacccagcctggaggaggtgttccagttccttccatctcagcatccccttcacctccaggccaggattccactggagtgaagcagagaagcccagaccgtatggcctgtcttacagttctctaagacttgacatcttcagcctgtactgtctcagccacctgcacccaccatccctactgacaaaccccctgatccccttcaccaagtgtcttcaacaatcagtgccagcagggagaccaccctggatcctgtcattctctgggcttcttatcaccagcaacctgtgcccagccttactaaacaccaggagggagaacaaaggaagaaaacaggaagaaaaacaggtgtgtgggggagggctgagatgtgtgagtaatatcacttagttttagccacctctaattttccatcttgtcatcacatacaatttcttcttccctctcctccccattcccagctgaacaatgatttccaaattagtggctcattctggctttatcatacaataaatctgtgggcagc

SEQ ID NO: 472650 - DNA, 529 bp, Homo sapiens
agcgcctctgctggccgctgcaaccccagtacatctaaatgaagaacccaagagtcagttagatacatgtcgaggatgctggcttcagatttggttacccagggagagcagagtgagaaaaacaaaatcaagaacaaaaccctgagaagcactgacattgttgaggtcaaggaagaaagtaaaaactacaaaggagaaatgagggaccagaactgtaaaggaaaactgaacagtggtaaccaaaaaccagtgaggaagaaatttgaaaatggagtcctaaatgtgaacttattagacaaatttaccaggaacctattttgtctcatacattatgttaaacacaagggggtgaacaagacaaaaccttttggtgcctactgtctggtggggaagacattgctgtacatcaccaaaaaggccatatttttaataactataccttgcttctttctaaaaagacatgtagcttacccaaaaaaatcagtataataggtaaaatacaattcaaaataattaaaatgggaaattt

SEQ ID NO: 472651 - DNA, 9052 bp, Homo sapiens
cggaatgaaatggaagggaatgcaatggaatggaatggaatcaacccgagtgcaggggaatggaatggaatggaatgcaatggaatggaatcatccggaatggaatggaatggaatggaatgcaatcaacctgatgcaatggaatggaatggaatggaatggaatggtaacatcccgaatggaatggaatgcaatggagttgcaatggaatggattcgaatggaatggaatggaatggaatggattcaacaagaatggaatggaaaggaatggaatcaacccgagtgtaatggcatggaatggaacggaatggaatgggatggaatggaatggaatgcaatggaatggaatcaacccgagtgcaatggaatggagaggaatggaatggaatggaatggaaactacccgaatggaatggaatgtaatggagttggaatggaatggaatggaatggaatgcaatggaatggaatcaacccgagagcaatcgaatggaaccgaatggaatggaatgcaatggaatggattcaacttgaatggaatggaaagaatggaatcaacacgagtggaatggcatggattggaatggaatggaaaggaatcaacccgagtacaggggaatggaatggaatggaatgcaatggaatggaatcatccgaagggaatggatggaatagaatggaatggaatggaatcaacgcgagtgcaggggaatggaatggaatggaatgcaatggaatggaatcttccggaatggaatggaatggaatggaatggaatggaatggaataaacccgagtgcaatggaatggagtggaatggaatggaatggaatggaacaacccgaatggaatggaataatcaatccgaatggaatggaatggaatggaacggaatggaattgaatggaatggaatggaatgcaatggaatggaatcaacctgagtgcaatggaatggagaggaatggaatggaatggaatggaaactacccgaatggaatggaatgtaatggagttgcaatcgaatggaatcgaattgaatggaatgcaatggaatggattcaacttgaatggaatggaaagaatggaatcaacacgagtggaagacatggattggaatgcaatggaatggaaacaacccgaaatggaatggaatggaatggaacggaacggaatggaatggaatggaatggaatggaacggaacggaatggaatggaatggaatggaatggaatggaaaggaatggattcttccggaatggaatggaatggaatgcaatggattcaactcgattgcaatggaatggaatagaatggaatggaatggaatggaatggaatggaattaacccgaataaaatggaatggaatgcaatggaacggaacggaacggaacggaacggaatggaatggaatggaatggaatggaatggaatggtatggaatggaatggaatggtacggaatagaatggaatggaaagaattggaatgcaatggattcgaatggaatggaatggaatggaatggaatcaacccgagtgcaggggaatgtaatggaacggaatgtaatggaatggaatcatccggaatggaatgaaatagaatggaatggaatggaatggaatggaatggaatggaaccaactcgattgtgatggaatggaatggaatggaatggaatggaatggaatggaattaacccgaatacaatggaatggaatggaatggaacggaatggagtggaatggaatggaatcaacccgagtgcaggggaatggaatggaatggaatgcaatggaatggaatcatccggaatggaatggaatgcaaagcaatggaatcaactcgattgcaatggaatggaatggaattgattgggatacatttgaatccacccgaaatcaatccgaatgtaatggaatggaatggaacggaatggaatggaatggaatggaatggaatggaatggaatgcaatggaatggaatcaacccgagtgcaatcgaatggaatcgaatggaatggaatgcaatggaatggattcaaattgaatggaatggaaagaatggagtcaacacgagtggaagggcatgcattggaatgcaatggaatggaatcaactcgagtacaggggaatgaaatggaatggaatgcaatggaatggaatcatccaatggaatggaatggaatggaacggaacggaatggaatggaatggaatggaatggaatggaatggaacggaacggaacggaacggaacggaatggaatggaatggaatggaatggaatggaatggaatcaacgcgaaatggaatggaatggaatggaatgggaataacccgaatagaatggaatggaatggaatgcaacggaatggaacggaatggaatggaatggaatggaatggaatggaatggaatggtatggaatggaatggaatggtacggaatagaatggaatggaacgaattgtaatggaatggaattgaatggaatagaatggaatggaatggaatcaacgcgagtgcaggggaatgtaatggaacggaatgcaatggaatggaatcatccggaatggaatggaatggaatggaatggaatggaatcaacccgaaatcaatccgaatgtaatggaatggaatggaacggaatggaatggaatggaatggaatggaatggaatgcaatggaatggaatcaacccgagtgcaatcgaatggaatcgaattgaatggaatgcaatggaatggattcaacttgaatgtaatggaaagaatggaatcaacacgagtggaaggacatggattggaatgcaatggaatggaaacaacccgagtacaggggaatggaatggaatggaatgcaatggaatggaatcatccaatggaatggaatggaatggaacggaacggaatggaatggaatggaatggaatggaatggaacggaacggaatggaatggaatggaatggaatggaatggaaaggaatggattcttccggaatggaatagaatggaatgcaatggattcaactcgattgcaatggaatagaatagaatggaatggaatggaatggaatggaattaacccgaataaaatggaatggaatggaatggaacggaacggaacggaacggaacggattggaatgcaatggaatggaatggtatggaatggaatggaatggggaatgtaatggaacggaatggaatggaatggaatcatccggaatggaatggaatagaatggaatggaatggaatggaatggaatggaacaaactcgattgtgatggaatggaatggaatggaatggaatggaattaacccgaatacaatggaatggaatggaatggaacggaatggagtggaatggaatggaatcaacccgagtgcaggggaatggaatggaatggaaagcaatggaatggaatcatccggaatggaatggaatgcaaagcaatggaatcaactcgattgcaatggaatggaatggaatggaaaggaatacattggaatcaacccgagtggaatggaatggaaaggactgaaatggaaatggaatcaacacgagtggaatggcatggattggaatggaatggaatggaatgaacccgagtacaggggaatggaatggaatggaatgcaatggaatggaatcatccgtaatggaatggaaaggaatggaatggaatggaatagaatggaatggaatcaaatcgattgcaatcaaatggaatggaatggaattaacctgaatagaatggaatggaatggaatggaatggaacggagcggaacggaagggaatggcatggaatggaacggaatggaatggaacggaaaggaatggaatggaatggaatggaatggaatggaatggaatgaacgcgagtgcaggggaatggaatggaatggaatgcaatggaatggaatcttctggaatggaatggaatggaatggaatggaatggaatggaatggaataaacccgagtgcaatggaatggagaggaatggaatggaatggaatggaacaacccgaatggaatggaatgtaatggagaaatcaatccgaatgtactggaatggaatggaacggaatggaatggaatggaatgcaatggaatggaatggaatgcaatggaatggaatcaacccgagtgcaatcgaatggaatcgaatggaatggaatgcaatggaatggattcaacttgaatggaatggaaagaatggaatcaactcgagtggaatggcatggattggaatgcaatggaatggaatcaacccgagtacaggggaatggaatggaatggaatgcaatggaatggaaccatccaatggaatggaatggaatggaacggaacggaatggaatggaatggaatggaatggaatggaacggaacggaatggaatggaatggaatggaatggaatggattggaatcaacgcgagtgcaggggaatggaatgtagtggaatgcaatggaatggaatcttccggaatggaatggaatggaatggaatggaatcaacccgagtgcaatggaatggagtggaatggaatggaatggaatggaatggaattaccccgaacagaatggaatggaatggaacggaatggaacggaatggaatggaatggaatggaatggaatggaatggaatggaatggaatgaatggaatggaatggaatggaatcaacgcgagtgcaggggaatgtaatggaacggaatgcaatggaatggaatcatccggaatggaatggaatggaatggaatggaatggaatggaatggaatcaacccgatagcaatggaatggagtggaatggaatggaatggaatggaacaacccgaatggaatggaatttgaatagaatcaatccgaatgtaatggaatggaatgcaacggaatggaatggaatggaatggaatggaatggaatggaatggaatgcaaaggaatggaatcaacccgactggaatggcatggaatggaatgcaatggaatggaatggaatggaatcaactcgagtggaaaggaatggaatggaatggaaaggaatggaatgaagtcaactcgagtggaatggaatggaatggaatagattggaatggattgcaatggaatggaatgcaatggaatggaatggaatcaatcattccgagtggaatggaagggaataatggaatggaatggaatggaacggaatggaatggaatggaagggaatggaatcaacacgagggcaggggaatggaatggaatggaatgcaatggaatggaatcatccggaatggaatggaatggaatggaatcaactccattgcaatggaatggaatggaatggaatggaatagaatggaatggaattaacccgaatagaagggaatgcaatagaatggaatgcaacggaaccgaatggagtggaatggaatggaatggaatcaaccggagtacaggggaatggaatggaatggaatgcaatggattggagtcatccgtaatggaatggaaaggaatggaatggaatggaatggaatggaatggaatggaatggaatggaatcaactcgatggcagtcgaatggaatggaatggaatcaacccgaatagaatggaatggaatggaatggaacggaacggaatggaatggaatggaatggaatggaacggaacggaatggaatggaatggaatggaatggaatggaacggaacggaatggaatggaatggaatggaatggaattaacgcgaaatggaatggaatggaattgaacggaatggaatggaatggaatggaacggaatggaatggaatggaatggaagaatggaatggaatggaatggaatcaacccgactgcagggcaatggaatggaatggaatgcaatggaatggattcaacttgaatggaatggaaagaatggaatcaacacgagtggaatggcatggattggaatggaatggaatggaatcaaccctagtacatgggaatggaatggaatggaatgcaatggaatggaatcatccgtaatggaatggaaaggaatggaatggaatggaatggaatggaatggaatggaatggaagggaatggaatcaactcgaatgcaaatggaatggaatggaatggaacggaacggaacggaacggaacggaatggcatggaatggaatggaatggaatggaatggaatggaacggaaaggaatggaatggaatggaatggaatggaatggaatggaatgaacgcgtgtgcaggggaatggaatggaatggaatgcaatggaatggaatcttctggaatggaatggaatggaatggaatggaatggaatcaacgcgagtgcaggggaatggaatggaatggaatgcaatggaatggaatcttcaggaatggaatggaatggaatggaatcaactccattgcaatggaatggaatggaatggaatgcaatggaatagaatggaatggaattaacccgaatagaatggaatgcaatagaatggaatgcaacggaaccgaatggagtggaatggaatggaatggaatcaacccgagtacaggggaatggagaggaatggaatggaatggaatggaaactacccgaatggaatggaatgaatggaatggaatggaatggaatggaatcaactcgattgcaatcgaatggaatggaatggaattaacccgaatagaatggaatggaatggaatggaacggaacggaacggaacggcatggaatggaatggaatggaatggaatggaacggaaaggaatggaatggaatggaatggaatggaatggaatggaatggaatggaatggaatcaacgcgagtgcaggggaatggaatgtaatggaatgtaatggaatggaatcttccggaatggaatggaatggaatggaatggaacggaaaggaatggaatagaatggaatggaatggaatggaacggaacggaacggaacggaatggaatggaatggaacggaatggcatggaatcaacgcgagttgcaggggaatgtaatggaacggaatgcaatggaatggaatcatccggaatggaatggaatggaatggaatggaatcaacccgagtgcaatggaatggagtggaatggaatggaatggaatggaacaacccgaatggaatggaatggaatggagagtaagggagttgaatagaatcaatccgaatgtaatggaatggaatgcaacggaatggaatggaatggaatggaatggaatgcaatggaatggaatcaacccgagtacaatggaatggaatggaatggaatggaatggaatggaatggaatggaatggattggaatgccttgaaaccgaatggaatggaaaggaatggaatcaacacgagtggaatggaatggaatggaaaggaatggaatggaatggaatggaacggaatggaatggaatggaatggaatggaatggaatggaatcaacccgactgaaggggaatggaatggaatggaatgcaatggaatggactcaacttgaatggaatggaaagaatggaatcaacaagagtggaatggcatggattgcaatggaatggaatggaatcaacccgagtacaggggaatggaatggaatggaatgcaatggaatggaatcatccaatggaatggaatggaatggaacggaatggaacggaatggaatggaatggaatggaatggaatggaacggaacggaacggaatggaatggaatggaatggaatggaacggaaaggaatggaatggaatggaatggaatggaatggaatggaatggaatcaacgcgagtgcaggggaatggaatggaatggaatgcaatggaatggaatcttgcggaatggaattgaatggaatggaatcaacccgagtgcaatggaatggagtggaatggaatggaatggaatggaacaacccgaatagaatggaatcaatcgaatggaatggaacggaattaacccaaatagaatggaatggaatggaatggaacggaacggaatggaatggaatggaatggaatggaatggaacggaacggaacggaacggaatggaatggaacggaatggaatggaatggaatggaatcaatgcgagtgtaggggaatggaatggaatggaatgcaatggaatggaatcatccggaatggaatggaatggaatggaatggaatggaatggaatggaatagaatgcaatggaatggaatcaacccgagtacaatggaatggaatggaatggaatggaatggaacggattggaatggaatggaatggaatggaatggaattaaatggaatggaaaggaatggaatcaacccgaaatggaatggaatagaatggaatggaattaatccgaatggaatggaatggaatggaatggaacggaatggaacggaaaggaatggaatggaacggaatggaatggaatggaatggaatggtatggaatggaatggaatggtacggaatagaatggaatggaacgaattgtaatggaatggaattgaatggaatggaatggaatggaatggaatggaatcaacttgagtgcaggggaattgcaatggaatggagtggaatggaatggaatggagtggaacaacctgaatggaatggaatggaatggagagtaagggagttgaatagaatcaatccgaacaatggaatggaacgaaatggaatggaatggaatggaatggaatggaatggaatcaacccgagtgcaatcaaatggaatcgaatggaatggaatgcaatggaatggattcaacttgaatggaatggaaagaatggaatcaacacgagtggattggcatggattggaatggattggaatggaatcaaccctattacatgggattggaatggaatggaatgcaatggaatggattcacccgtaatggaatggaaaggaatggaatggaatggaatggattggaatgaattggattggaagggattggaatcacctcgaatgcagtcgattggaatggaatggatttaccccgaatagaatggaatggattgaattggaccggacc

SEQ ID NO: 472652 - DNA, 6812 bp, Homo sapiens
tggaatggaatgcaaagcaatggaatcaactcgattgcaatggaatggaatggaatggaaaggagtacattggaatcaacccaagtggaatggaatggaaaggactggaatggagtggaatggaatggaatgcaatggaatggaatggaatggaatcaacttgattggaatggaatggaatggaatggaatggaatggaatggaatggaatcaacccgactgcaggggaatggaatggaatggaatgcaatggaatggattcaacttgaatggaatggaaagaatggaatcaacacgagtggaatggcatggattggaatggaatggaatggaatcaacccgagtacaggggaatggaatggaatggaatacaatggaatggaatcatccaatggaacggaatggaatggaacggaacggaatggaatggaatggaatggaaaggaacggaaaggaagggaatggaatggaatagaatggaatggaatggaatcaacgcgagtgcaggggaatggaatggaacggaatgcaatggaatggaatcttccggaatggaatggaatggaatggaatggaatggaatggaatggaatggaatacacccgagtgcaatggaatggagtggaatggaacggaatggaatggaacaacccgaatggaatggaatataatggagaaatcaatccgaatgtaatggaatggaatggaacggaatggaatggaatggaatggaatggaatggaatggaatgcaatggaatggaatcaacccgagtgcaatcgaatggaatcgaatggaatggaatggaaaggaatgcaatggaatggaatggaatggaatggaatcaacacgattgcaatcgaatggaatggaatggaattaacccgaatagaatggaatggaatggaatggaacggaacggaatggaatggaatggaatggaatggaatggaacggaacggaacggaacggaatggaatggaatggaatggaatggaatcaacgcgagtgcaggggaatggaatggaatggaatgcaatggaatggaatcttccggaatggaatggaattgaatggaatggaatggaatggtatggaataaacccaagtgcaatggaatggagtggaatggaatggaatggaatggaacaacccgaatggaatggaatgaatggaatggaacggaatggaatggaatggaatggaatggtatggaatggaatggaatggtacggaatagaatggaatggaacgaattgtaatggaatggaattgaatggaatggaatggaatggaatggaatggaatggaatcaacttgagtgcaggggaatgtaatggaacggaatgcaatggaatggaatcatccggaatggaatggaatggaatggaatcaacccgagtgcaatggaatggagtggaatggaatggaatggagtggaacaacctgaatggaatggaatggaatggagatgcaatcaaatggaatcgaatggaatggaatgcaatggaatggattcaacttgaatggaatggaaagaatggaatcaacacgagtggaatgacatggattggaatggaatggaatggaatcaacccgagtacaggggaatggaatggaatggaatgcaatggaatggaatcatccaatggaatggaatggaatggaacggaacggaacggaacggaacggaatggaatggaatggaatggaatggaatggaaaggaacggaaaggaagggaatggaatggaatagaatggaatggaatggaatcaacgcgagtgcaggggaatggaatggaacggaatggaatgcaatggaatggaatcttccggaatggaatggaatggaatggaatggaatggaatcaacccgaaatcaatccgaatgtaatggaatggaatggaacggaatggaattgaatggaatggaatggaatgcaatggaatggaatcaacccgagtgcaatggaatggagaggaatggaatcaacgcgagtgcaggggaatgggatggaatggaatgcaatggaatggaatcttccggaatggaatggaatggaatggaatggaatggaatggaatcaaccctagtgcaatggaatggagtggaatggaatggaatggaatggaacaacccgaatggaatggaatgtaatggagaaatcaatccgaatgtaatggaatggaatggaacggaatggaatggaatggaatggaatggaatggaatgcaatggaatggaatcaacccgagtgcaatcgaatggaatcgaatggaatggaatgcaatggaatggattcaacttgaatggaatggaaagaatggaatcaacacgagtggaatggcatggattggaatggaatggaatggaatcaacccgagtacaggggaatggaatggaatggaatgcaatggaatggaatcatccaatggaatggaatggaatggaacggaatggaacggaatggaatggaatggaatggaatggaatggtatggaatggaatggaatggtacggaatagaatggaatggaacgaaatgtaatggaatggaattgaatggaatggaatggaatggaatggaatcaacgcgagtgcaggggaatgtaatggaacggaatgcaatggaatggaatcatccggaatggaatggaatggaatggaatggaatggaatcaacacgagtgcaatggaatggagtggaatggaatggaatggaatggaacaacccgaatggaatggaatgtaatggagaaatggaatggaacgaaatggaatggaatggaatggaatggaatggaatggaatggaatggaatggaatggaatcgttccgagtggaataggagggaatgtattcgagtggaatggaaaggaatggaatcaaccagagtggaatgtggaatggaatggaaaggactggaatggaatggaatggaatggaatcaactcgattgtaatggaatggaatggaatggaatggaatggaatggaattaacccgaatacaatggaatggaatagaatggaatggagtggaatggaatggaatcaacccgagtgcaggggaatggaatggaatggaatgcaatggaatggaatcatccggaatggaatggaatggaatggaatgcaaaacaatggaatcatctcgattacaatggaatggaatggaatagaatggaatggaattaacacgaatagaatggaatggaatggaattgaatggaacagaaaggaatggaatggaatggagtggaatcaacccaagtgcaggggaatggaatggaatggaattcaatggaatggagaatggaatggaatggaatggaatggaatcaactcgattgcaatcgaatggaatggaatggaattaacccgaatagaatggaatggaatggaatggaacggaacggaatggaatggaatggaatgcaatggaacggaacggaatggaatggaatggaatggaatggaatggaatggaatcaacgcgaaatggaatggaatggaatggaacggaatggaacggaaaggaacggaatggaatggaatggagtggaatggaatggtatggaatggaatggaatgtgcagggaaatgtaatggaacggaatgcaatggaatggaatcatccggaatggaatggaatggaatggaatggaatggaatggaatgcaatggaatggaatcaacccgagtgcaatcgaatggaatcgaattgaatggaatgcaatggaatggattcaacttgaatggaatggaaagaatggaatcaacactagtggaagggcatggattggaatgcaatggaatggaaacaaccagagtacaggggaatggaatggaatggaatgcaatggaatggaatcatccaatggaatggaatggaatggaacggaacggaatggaatggaatggaatggaatggaatggaacggaacggaatggaatggaatggaatggaatgaaatggaatcaatgcgagggcagggaatggaatggaatggaatgcaatggaatggaaacttccggaatggaatggaatagaatggaatggaatggaatggaatggaatcaatccgagtacaggggaatggaatggaaggaatggaatggaatggaatggaatggaatagaatggaatggaatggaatggaaaggaatggaagggaaggaaatggaatgtaatcaacccgagtgcaggggaatggaatggaatggaatgcgatggaatggaatcatccagaatggaatggaatggaatggaatggaatggaatggaatggaatggaatggaatcaacgcgagtgcaggggaatgtaatggaatggaatgcaatggaatggaatcatccggaatggaatggaatggaatggaatggaatggaatcaacccgagtgcaatggaatggagtggaatggaatggaatggaatgaaatggaatggaatgcaatggaatggaatcaacccgagtgcaatcgaatggaatcgaatggaatggaatgcaatggaatggattcaacttgaatggaatggaaagaatggaatcaacacgagtggaatgacatggattggaatggaatggaatggaatcaacgcgagtgcaggggaatgtaatggaacggaatgcaatggaatggaatcatccggaatggaatggaatggaatggaatggaataaacccgagtgcaatggaatggaggagttgaatagaatcaattcgaatgtaatggaatggaatgcaacggaatggaatggaatggaatggaatggaatggaatggaatggaatggaatggaatgcaaaggaatggaatcaacccgagtggaatggcatggaatggaatgcaatggattggaatggaatggaatcaactcgatggaatgcaaggcaatggaatggaatggaaaggaatggaatggaatcaactcgattgcaatggaatggaatggaatggaatggaatgcattggaatggaatgcaattaaccggaatagaatggaatggaatggaatggaacggaatggaatggaatggaagggaatggaatcaacacgagtgcaggggaatggaatggaatggaatgcaatggaatggaatcatccggaatggaatggaatggaatggaatcaactccattgcaatggaatggaatggaatggaatggaatggaatagaatggaatggaattaacccgaatagaatggaatgcaatagaatggaatgcaatggaaccgaatggagtggaatggaatggaatggaatcaacccgagtacagaggaatggaatggaatggaatgcaatggaatggaaatggaatggaatggaatggaacggaacggaatggaatggaatggaatggaatggaatggaacggaacagaatggaatggaatggaatggaatggaatcaacgcgagtgcaggggaatggaatggaatggaatgcaatggaatggaatcttccggaatggaatggaatggaatggaatggaatgaaaggcaatggattaaactcgattgcaatggaatggaatagaatggaatggaatggaatggaatggaatggaatggaatggaatggaatgccttcaaaccgaatggaatggaaaggaatggaatcaacacgagtggaaaggaatggaatggaaaggaatggaatggaatggaatgaatggaatggaatggaatggaaaggaatggaagggaaggaaatggaatgtaatcaacccgagtgcaggggaatggaatggaatggaatgcgatggaatggaatcatccggaatggaatggaatggaatggaatggaatggaatggaatggtatcaacccgagtgcaggggaatgtaatggaacggaatgcaatggaatggaatcatccggaatggaatggaatggaatggaatggaatggaatcaacccgagtgcaatggaatggagtggaatggaatggaatggaatggaacaaccagaatggaatggaatgtaatggagaaatcaatccgaatgtaatggaatggaatgcaacggaatggaatggaatggaatgcaatggaatggaatggaatggaatgcaaaggaatggaatcaacccgagtggaatggcatggaatggaatgcaatggattggaatggaatggaatcaactcgagtggaaaggaatggaatggaatggaatggaaaggaatggaatgaagtcaactcgagtggaatggagtggaaaaatggaatgcaatagaatggaatgcaacggaaccgaatggagtggaatggaatggaatataatcaacccgagtacaggggaatggaatggaatggaatgcaatggaatggagtcatccgtaatggaatggaaagaatggaatggaatggaatggaatggaatggaatggaatggaatcaactcgatggcaatcgaatggaatgcaatggaattaacccgaatagaatggaatggaatggaatggaacggaacggaatggaatggaatggaatggaacggaacggaatggaatggaatggaatggaatggaatggaatcaacgcgagtgcagaggaatggaatggaatggaatgtaatggaatggaatcttccggaatggaatgcaatggaatggaatggaatgaaaggcaatggattaaacccgattgcaatggaatggtagagaatggaatggaatggaatggaatggaatggaatgccttcaaaccgaaaggaatggaaaggaatggaatcaacacgagtggaaaggaatggaatggaaaggaatggaatggaatggaatgtggaataggagggaatgtattc

SEQ ID NO: 472653 - DNA, 850 bp, Homo sapiens
atctacatgacttatcactcttgatgttgtcattgatcacctggaattgctttactgagggatctctgcagtttttccacccctgtgacaagtctctgcctaggcccctaggctttcagcaatattctttgaatatggctcttgctctctgcaagcctgcagaatcagtagatgcttccaagacttatggcttgtatctttttgagtggtggttccatcattctgtgcagcaagtctatgaaggatgccttgtgcccatccctgaaaaaaaatttgccctcttaggcctttgggccttcaatgggggaggccgcctcaaatatctgaaatgcctttatggtcttgctttcattgttttgaggaatagcacctggctcccttctgtttatgctaaaccgtttggcaagtggttgctgaactatacccttggttttctctcccaaatgtgctttttcactctttatggctcttgtgagtatggatgctccataacttacaatagggttgtgtcacaatgaaccagtcataagttgaaaatatcaataaactaatttcaatttgccttctaactagaaacaactgctaataatatggaaacgtaatgaacacaaggcaaggatctttcacagaaactattcccattatgttcatataatattcttttaaaaatactacatttcagagttgtttggtaatggagaaaacaagtcatcataatttcatgtaatcatgctgttcctctgaatagtttgtgagtgtgacaggtcatttttaatccagctagctgtttacattatgttaatgtgaaaaacccaaactccaaatttgcaagctcttggtgctaaagtaa

SEQ ID NO: 472654 - DNA, 644 bp, Homo sapiens
tccttaaactaataataataataatgacaaaaatacctaccttacaaagagagacaagctgcttgtgctccagcagaccaggactaacaaatacaagtcagactcaagaggttgaaaggagagaggatccctcaggcatggaagccatccaggaagggttccatcgacacagggatactcagagtgggatgctgctgaaaagatacccgaaaatgtggaagcaactttggaactgggtaacaggcagaggttggaacagtttggagagctcagaagaagacaggaaaatgtggaaaagtttggaacacttgttgaatggctttgcccaaaatgctgatattgatatgtacaataagaatcagggggtacacgggcaggtttgtagcaaagatacattgtgtaatgctgcagtttggagtacgaataaatctattacccagataattcatgattattatgagtttacagcttgcaactcactcttctcttatcggtaagtataagatacggatttctcttgtagatttttgtcttgtttactgacacatcccaatgctgagcagtccctgacacatatagtaaatttttcatctatatttgttaaatgaataaataagccatattataatataaaagaaagtttc

SEQ ID NO: 472655 - DNA, 818 bp, Homo sapiens
tgtgtgagcaacatggctgtttatttcacctgggtgcagctgttagtctgtagccgaagacctgagagcctctggcaaaatcctggtccacgcgggcagccgattggatggtgtccacccacaccgtgggtgggtcttcctgatgatgggtcttcctctctcagtcctttgactcaaatgttaaatctgttctggcaacacccagatacacccagaacaattactttgcattcttcagtgattaagttgacatttaacattaaccatcacacattctatggtgcacggtgcaagctgttggtggatctaccattctggggtttggagcacagtggccctcttctcacagctccactaggtggtgccccagcagagactctgcatgggcactctgactccatatttcccttccacactaccctagcagaggttcttcatgagagcctagcccctgcagaaaacttctggctgagcatccaggcatttccatacatcttccgaaatccaggccgaggttcccaaacctcaattcttgacttctgtgcatccgcaggcttaatgccatgtggaagctgccaagggcattagatttaagtttttgatccaccttgagttgatttttgtataagaaactgtgattgtttttttctttatgatatctttttatctgagcatttttattcacattctatattgtttattaatttcttttagttggtttttacctttctctggtatctccttgagtagcttaataataaaccttctttttttttatgatactttaagttttagggtacatgtgcacattgtgcagg

SEQ ID NO: 472656 - DNA, 850 bp, Homo sapiens
cccgaatagaatggaatggaatggaatggaacggaatgtaacggaatggaatggaatggaatggaatggaatggaatggaatggcatggaatggaatggaatggtacgcaatagaatggaatggaacgaatggaaatggaatggaattgaatggaatggaatggaatggaatggaatggaatcaacgcgagtgcaggggaatgtaatggaacggaattcaatggaatggaatcatctagaatggaatggaatggaatggaatggaatggaatggaatggaatcaacccgagtgcaatggaatggagtggaatggaatggaatggaatggaatgcaatggcatggaatggaatggaatgcaaaggaatggaatcaacccgagtggaatggcatggaatggaatgcaatggattggaatggaatggaatcaactcgagtggaaaggaatggaatggaatggaaaggaatggaatgaagtcaactcgagtggaatggaatggaatggaatggattggaatggattaaaatggaatgaaatggaatggaatggaatggaatcaatcattccgagtggaatggaagggaatgtaatggagtggaaaaaagggaatggaatcaacccgagtggaatgcaaggcaatggaatggaatggaaaggaatggaatggaatcaactcgattgcaatggaatggaatggaatggaatggaatggaatggaatggaatggcattaaccggaatagaatggaatggaatggaatggaacggaatggaatggaatggaagggaatggaatcaacacgagtgcaggggaatggaatggaatggaatgcaatggaatggaatcatcc

SEQ ID NO: 472657 - DNA, 2058 bp, Homo sapiens
tggaatcaacccgagtgcaataatcaatccgaatgtaatggaatggaatggaacggaatggaattgaatggaatggaatggaatgcaatggaatggaatcaacccgagtgcaatggaatggagaggaatggaatggaatggaatggaaactacccgaatggaatggaatgtaatggagttgcaatcgaatggaatcgaatggaatggaatgaaatggaatggaatcaacttgaatggaatggaaagaatgaaatcaacacgagtggaatggcatggattggaatggaatggaatggaatcaacccgagtacaggggaatggaatagaatggaatgcaatggaatggaatcatccgtaatggaatggaaaggaatggaatggaatggaatggaatggaatggaattaacccgaatacaatggaatggaatggaatggaatggaatggaggggaatggaatggaatcaaccggagtgcaggggaatggaatggaatggaatgcaatggaatggaatcatccggaatggaatggaatggaatggaatgcaaagcaatggaatcaactcgattgcagtggaatggaatggaatggaaaggaatacattggaatcaacccgagtggaatggaatgcaaaggactggaatggagtggaatgtaatggaatgcaatggaatggaatggaatggaatggaacggaacggaatggaatgcaatggaatggaacggaacggaatggaatggaatggaatggaatggaatcaacgcgaaatggaatggaatggaatggaacggaatggaacggaatggaatggaatggaatggaatggaatggtatggaatggaatggaatggtacggaatagaatggaatggaacgaattgtaatggaatggaattgaatggaatggaatggaatggaatggaatcaacgcgagtgcaggggaatgtaatggaacggaatgcaatggaatggaatcatccggaatggaatggaatggaatggaatggaatggaatggaatcaacccgagtgcaatggaatggagtggaatggaatggaatggaatggaacaacccgaatggaatggaatgagggaaagtattcgagtggaatggaaaggaatggaatcaaccagagtggaatggaagggaatggaatggaatggaaactaatagaatggaatcaacccgagtggaatggaatggaaaggactggaatggaatggaatggaatggaatcaactcgttttgcaggggaatggaatggaatggaatgcaatggaatggaatcatccgaaatggaatcgaatggaatggaatgcaaagcaatggaatcaactcgattgcaatggaatggaatggaatggaaaggagtacattggaatcaacccgagtggaatggaatggaaaggactggaatggagtggaatggaatggaatgcaatggaatggaatggaatggaatcaacttgattggaatggaatggaatggaatggaatggaatggaatggaatcaacccgactgcaggggaatggaatggaatggaatgcaatggaatggattcaacttgaatggaatggaaagaatggaatcaacacgagtggaatggcatggattggaatggaatggaatggaatcaacccgagtacaggggaacggaatggaatggaatgcaatggaatggaatcatccaatggaatggaatggaatggaacggaacggaatggaatggaatggaatggaatggaacggaacggaacggaacggaatggaatggaatggaatggaatggaatcaacgcgagtgcaggggaatggaatggaatggaatgcaatggaatggaatcttccggaatggaatggaatggaatggaatggaatggaatcaacccgagtgcaatggaatggagtggaatggaatggaatggaatggaacaacccgaatggaatggaatgtaatggagagtaagggagttgaatagaatcaatccgaatgtaatggaatggaatggaaaggaatggaattgaatggaatggaatggaatgcaatggaatggaa

SEQ ID NO: 472658 - DNA, 801 bp, Homo sapiens
gctggagcacactgaagctggagcacactgaagtggaagatggggctgcagacagagactgggcagcctctgctccagggaggcccgagagccagagagcagattccataagaagaataactcccattcctcatgcatgagaccctctgctaaatgcttcctgtgcaccacctccagaaatcctcccaagccaggacaccagcagtattacaggaactggatgacaaaaagaagagccgatataaccaggaacctactctggccaccccaagtaaggatctaaagtccagcctcctcctccactgccctcaaggcctttcctcatgaaagcagaggttctgaatgctgatttctgttttaaagcccaataactctttaaacatcttctcttccagtgactcagcaaaacctgtggagccgttcttgatgcttctctttgagtcattcctcacatctggtccatctgtatggccagagaactccacctttagaatatatccagaatttgaccactaccaccatctggaagcaagcctcttggatcattgcaagaactccctaagtgatctccccacttctgcccttcccatcaggccacccccacaacacccaacctatcacagccccacaggagagggattctgctggcgtgcaaagcgggagcttgcagctcacatggtgaaagcgggaccaattgagagaatggggtgggggaggtgccacacacttttaaacgaccagatttcgtgagaattcactatcacaaacatagcaccaagcccgggatctgcccccatgacc

SEQ ID NO: 472659 - DNA, 994 bp, Homo sapiens
ctggcagctccaagctgactcatacaagcccagagccctcgcaattcccacacgccacatgcatggctcagctgcacctcctgccagctccaaacctcacggcacagggtacacacttgtgtgtccatatggattaaaccacgtgcacgctggcatccaggctgggacacactggcattcagcctgggaggctctgagcacccaggacgtgggatttgaggcagaggagtcagtgaacagggggaaccagcagatgggcatcagtgagcagctgaacgcagctggagagaaaggagaagctaagcccgagaatggacgccagccccatcaccctctcggcctgaggatgctggatttgctgtggtgctgtcattgtggaaggagacagatcccaggaactttcataccaggaggcctgtgtcaacctgcctctctcctccttctgcagggactatgctggcctcttcaaagtctaggtctttccaaccatcgtttgtggaaagactttatggcaaggagcacgcaagaggcagcagacagggacgtcattcatgtgagaatctgtagtgtctccccatgggaaagcctgctctttggagagggcaggatgaccatagaattgctcagactcggtggcctggcaggtgctgtgagcaaacaggtaaacagcttcaggacaggagccttcaatcccttatcctgctcccaagcattcggggagaggggccctagagagagactggaaagggtacaatgtgctcaaggaatgaaatggcttgtggagggctgcccagagatggtgggtccagttcaaatcagttctgcctctgttcataatcccacccacaccaggcatcagccggagctgacctgcaggccagaaagaaagaaggggccagaaagtttagttccataagggccagatggcctgagcaatgcccatcagtcagacttgtcttggggattgctaagatacaactgtgctgaaagtgtt

SEQ ID NO: 472660 - DNA, 998 bp, Homo sapiens
ttgtcatggctggctgggatctgagctgttcactctttctattagagatcttggttcactcactgtcacgagaacagcatggggggaactgcccccatgattcagttatctccacctggccccgcccttgacacatggggattattacaattcaagaaatgtacctttttatgcctttgccagcagtaccccagagagtccattagaacatcctgcttacaaggcagcaaaccgtgggtacgggattcggtgccggtaaaaaatgttcacaagctgagcatttccaacatccaaaatagtggaagagttaatggggcagctccacaaaggaatagggaagaaggagagacctattttctcaagtttgagaaacagggttacaaagagaatataaaggatcaggatacagggagatttttctgggaggaaagactgtcaacaagtggaatcacccagagtggcgagctggggtgttggagcacagcctgtggcatcttagggggatgtgcattcagagtgccagtggagacctggaacagaacctcattggaaattgagacaacagttgtttttctttaagatcgaaagaggtaaattacagaaaacttggtgctcatacatgaacacatttttgcatacatgtacatgtgtagggtttttctttttggggggagagttcattgtttaacaaatacgggtttgttttatataccttttgtcaagctcttctcatgaatatcttctattttacttcatttttaaaaacttttattaaatgcctttttagcatttgttgctattattcctatgattctgtagtcttttccataattaatttgttgacgaagtgaattttattgatttcctggtactgagaattatctgtaaaagtaaatactgtggcattaatttaaaaactgaattgcatgtcttgtgcatatcactgagatgcattctgcttagacatgatgggaatctacactattaaatgacaacaa

SEQ ID NO: 472661 - DNA, 547 bp, Homo sapiens
actgtcaaagacaagattctaaaatgccaatctggcatacttattctgagaaggaaattccaggaagttgttcaggcattttcccccctgaaacagcactgccagtaagcacttactgtctacatcactcatgtgacaacaatcctctcaccctgccatcagcatctcgtttcgagaaggggatagacagctatgtgctggacgatgctgaagcatctccctcctcctggagcctgcatccctatcactcctctcctgcctcctctcctcccttgaggcctttccagccccacctcaccttatctcatggatctcaggatgctggtgtctgggatccaattctaggaccccggctctcatttgaagaggggctccaaagaattgcagggctggcagcaggtgtcagcggggaagtgaagaggagctactgggaacgccgtgatttatccatcatcaggaagatctgtgggtgatttcacgttgcaaaatgaatttaagttgactgtaggttactacaagataatttcacactaacttacctgcattc

SEQ ID NO: 472662 - DNA, 446 bp, Homo sapiens
aaaactgccgaatccaagatggcaatgaaagcaacctctggtcatcctcactgctcattacatgctaattacaatacattagcatattttccttctaacagtcagaccactctgctgcaggtctgctggagttttctggaggtccactccagaccctgtttgcctgggtatcaccagcagaggctgcagaacagcaaagattgctgcctgttccttcctctggaagcttcatcccagaggggcacccgccaggtgccagccagagctctcctgtatgaggtgtctgtgggtccctactgggaggtgtctcccagtcaggaaacacaggggtcagggacccacttgaggagacagtctgtcccttatcagagtttgaacgctgtgctgctagatctgctgctctcttcagagctgtcaggcagggacatttaaatctgctgaagctg

SEQ ID NO: 472663 - DNA, 622 bp, Homo sapiens
cgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaaagccggacctggccaccagaggctgaagaggtgtggtggtggcagctgctgcagctcctgctgcctgtggcaggagcaagcacaggaagaagctgggagaagggccagagacccacagagacacgcggctgtgctgcgtcagcctgtgtgggcgctccagtggatttacatcctgcaccaagcacagcatttgatgcacagacaatgctcaagaaagcttctgaaatgaatgaatcaacgcactggcggtggcggcaacatggcatctggtttgaggccgcgtgcctgcaggcaaggagactagatagaagggcactgtgcttgtcttaaagagaccac

SEQ ID NO: 472664 - DNA, 528 bp, Homo sapiens
ttcccccaaccctcggagggaggatatggtcacagtacagaacccacaagttgcaagagaaaaggagcagaagaggaagaagaaggagaagaagaaggagaaggggaaggggaaggggaagaaggaggggaaggggaaggggaagaaggaggggaaggggaaggggaagaaggaggggaaggggaagggggaggagaagggggaggaggaggaagaggagaagaaggacgaggaggaggaagaagatgaggaggaggaagaagaggaggagaaggaggaggagggggaggaagagaaggaggaggaagaagaggaggaggaggagaagaaggaggaggaggaggagaagaagaaggaggaaggggaggaagaggaggaggaggagaagaagaaggaggaaggggaggaagaggaggaggaggagaagaagaaggaggaggagggctattagtagctctattgtggttgattgtttctctgtgtgaagatctgaaatatacaaaacattcaaactttaaatgtttatct

SEQ ID NO: 472665 - DNA, 545 bp, Homo sapiens
atctctgctctcactgccgtaaaacatggcaactgcagttcacttacaccgcttctcaacccggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgaacgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccctagatatctatatctatatatatatctaga

SEQ ID NO: 472666 - DNA, 663 bp, Homo sapiens
ggaggatatggtcacagtacagaacccacaagttgcaagagaaaaggagcagaagaggaagaagaaggagaagaagaaggagaaggggaaggggaaggggaagaaggaggggaaggggaaggggaagaaggaggggaaggggaaggggaagaaggaggggaaggggaagggggaggagaagggggaggaggaggaagaggagaagaaggacgaggaggaggaagaagatgaggaggaggaagaagaggaggagaaggaggaggagggggaggaagagaaggaggaggaagaagaggaggaggaggagaagaaggaggaggaggaggagaagaagaaggaggaaggggaggaagaggaggaggaggagaagaagaaggaggaaggggaggaagaggaggaggaggagaagaagaaggaggaggaggggtagggggagggcccgccagggaaggggaatgggccatcaggaggcaccagtgcgtagtaattaggggagtttgaaagtgtttttgttgttgttgttgttgttgttttgctgggcctgagaattaaaccgacataagacagatcaataggaaagaagcatacacattcacttaatacaagttttatgtggcgttggagccttcataaggaaataaagacccaaagatacaactagag

SEQ ID NO: 472667 - DNA, 619 bp, Homo sapiens
ggcagaagggatccaagcaagctgcacacaggatcttctatgatgcaaattcacacagggaggaggcagagcacctgcctggaaaagtgtctcaaactgagtttggaaggatatacaggggttggcccagcaaaatgggtagttaggataaagtcaacctatacagagaaaaaaacacatttccagaagtggaagtgtggggtgggcccgtgcctggaagatgccagtgtatccgtgaggtatgccagaggtcaaatcttaaaactatctggcctgcctttgaccttcatgggaaaacctaaagtgttctgtctccatagagctagatgttcatcaaatccaattacctctcccagctgcaccgctcaccaggaggcagggctctgctggggacaaagagaggcagaggaagcagactgtccccagccccgcttcctgctgcaaattaagccaggcatcgactgtgccgactcaccacctggctgctgccacaacagcagctgcagcctgttagcactgaagagtttctctcccaactattcccattagtgtggccagcgagggggaggatgacgtcagaagccaacataggcctgctgactcccagagttcggcgcct

SEQ ID NO: 472668 - DNA, 775 bp, Homo sapiens
ccgacctgagcctggaatttgaataattcgaagtgactggaaacccacagctctgccaaaaatgttgctaaggttcttggcgttttgaacaaagaattggacaaaatgttcttcaaagaaagaaagaatgaagcaacaaaagaacgaaagcagggatttatcgaaaacgaaagtacaatccacagtgtggcagcacacccgagcagctgggcaagggcccagatacagaatcttcttgggtccaaatgccccctagaaatgctgctgctgcggctgattgggggctacacattgagaaccactgatttagaagaaggagcaatcatcatggctgaaggaccaggttcctgctcacatttccaagtcaatacatcctgtggtctcttctggggccaacctggagagcctgtgggaccaaaagaccatctatcaatgtctatcatgcggctactgtgtactcagtgcccttggaggggtccgggcgatggcactcaggatgaaaccccaggtgaccagacggaggaggggaaaggggttgggaacagaggcatcgattggatagaactgtgtaaacgaatgaggagattgaaggtgacacgcagactctgtccggcaaagtttctgctgctgcctaactccgtggacactatcctgatggggaccggacacctccagaattctctctccaacaaaagattacttcaaggccagaacccgctcccagctgaagactgactacaagattgactgtgattaatttataacctggcaggat

SEQ ID NO: 472669 - DNA, 2200 bp, Homo sapiens
gaagtgaggcacgtgtagacaagactccatctgccctgggcagctttcctgaacccgagggactggtttgccatggatcctcggcttctgtttatctttgctgctcacctagttgtgttttgcagagagaattgggaattgacactttcctttgccaagatctggggaagcgccaacttgggattactttatgtagatatttgtcttggaagttttgaggccattcatagagtgggaattcagactccagatctgaatgagtgtggggaagatgttctagatgctgtggaaataccgagcagccatattctaagcactgtggctgcctctgcttcgggaactttccatggggcaccaggctccctgcacagtgcattctctctgtgccagtcaccaaatgccaatgaatgcttaacggcccggtgtcacccctcctctttctgccctgttatttttctcctcctcacagattttgaaacgtctgtattatacttaccagttaaagatttctaatctgaaaatccaaaacctgaaattttccaataagcatttcctttgagtgtcatgttgacactcaagaagttcagaattttggaacatttggatttcagacttttggattagggatactcagcttgtatttactctgctggccaccatgaaaacctccattaaaaaccccaatggacattgtgctgacagcttctgggttggtgagcacaggggggtgcagggagggtggtgcaccctggggagatatggtggccccgagcagcttcctccagaccttgccctgggaatcccttccatctggctgttcctgagttgtatcctttgtaataaacaggtaacctagaaaacaaactgttttcctgagttctgtgagcccctctaggaaaggatcaaacccgagaaaaaggttgtgagaacctccatttgtagtcaagttagactagtgtcgcgggtagcctgaagaccctctccttgcagttggagtctgaagttaggggcaggcttgtgggactgagtcctgaacctgtgggatctgtgctgacttcagatcgagccagaattaaattgaattgtaagacaccctgctggagaactggtcagtgggggaaaaaaacaaaacccacacatctgagtcaccgaagtgttctgtgttgactgtggtgtcagaattgaagggctctggaagtgtggagagtggagaaaatggtttgtgttttcctattacacacccactctggaggttcttagggtttgcagaccaggaagcagagaaaacccttcacatggaaaccattcctgcccatccctggctcctgggtggtgggaaggcccattgctaatggggccagggtaggcattttgagttcatttagcttagcccttaatggaatcttactcagacagtcctaagcccaccggcaaggcaataaaagttgtccccacccctatcaaacaactcatagcatattaattttgacacaagatacttttctcatctctaacgtgagtacacattcgatttataacaaaaataaacactgtagaaaggtctttgttttaaagtctgaaatatcaaaagtatccttgtttttgaaatgtcacccgcagcaggcccttcctccgcatctggtgcctctttcatctgcgtgtggctgtcagaagcaggccttgtttgaggaattcttatgtagccagcctgggggtgtccagccacccaggccctttgctgcattggccactgatggtgaattaatcctcagacttgtgttactggtgacaaacgatgatgtcacgtgtacatggacacaattttaagggagatcaggcccagcactccctttcatcttcctccagcccttagtgcctcatgggtgtcctcagtggcagtggtactgtccccaagctccaggctatctcctgctgccttttctgtttgctgtgcttctcgctctttcctgcggcaccttctcgtccacatatctcccctgtgctgtcctcccctgaccacacaggcccaagacagaactatacagaaaagagctctgacttcaccaagcccaaccatttgtattgcaaagataaaagcaaaacaacttacttggtttctgagtctaaaatatctttctttagatcaatggttactttacagctttctccaagaacaatggtgttggagccttacttgttt

SEQ ID NO: 472670 - DNA, 785 bp, Homo sapiens
tatatctgattatctgacaaggccaggtttaccccacgatggacttaaaaataagcttgtcttgctaccaggaagattttccaccaggagcctgcataattggcccttcccattccaagatgcagaaggactatgagaatcctgctgcaggactggctgccatgcatcatctgtgggccttcatctgtcaatggaggaaaatccagagcaaaagacatgagctaagtcttgaagaatggatgcaatggatcctccaagctcacaaactgcccacattccaggcagaagcagcagtaggagcaagagcgtggagaggagtgaggagagctgcctggcaacgcaacgcatcgctgtgcataaactttgtttacagccaaggctggagtaaaggaacagatggcaagaaaatcggatttaaagaaaggaaggatgtgcttgcatctgggagctcggtaaatctcttggcttctggtgtgcgtacaagggtgacgtctagctaccccagcagtcgcgtcccagtttgctgttgatttttgcctgtttggatctgtctctgaggatggttaatacatcttattacaagcatttatctcatccctcccacaggaaatgtgttttcccagggatttgtatgttccctaaccttttatggaaagcagtttcttgatcatccatgtgattgtgtatctaaaatttcaagaatatttaagctgttaatcctgcttgtctgtagaagatgggtttatatttctatgatcttggaaatatttacaatgagcatgtat

SEQ ID NO: 472671 - DNA, 1062 bp, Homo sapiens
agggctctgacccaatctgagggcaggtcaggactgagccctccagctccgccacagcagtccttctgcatgtgccaaaatgtgacaccagggatcatggccttggggatgtctgctgtttatttccaagtcagtggcactaaggagcagccagtcccagggcacccaatgcagagcatcctgcttgagctttggggcttccaggtacaccactgcgtgccagggaaccccaggccagacttcatggaacacagcaaggacctgaccctcagcctcttggatcactcctgccactggcatgggaggagccatagcagcaaggagtacctggagctgcacagggagaacttcctcctcatcctcaggtttctggtggcagggtctgcggaaggggcggcaggtgccatgtccggccacgaaggtggcaagaagaagccaccgaaacagcccaagaagcaggccaaggagatggacgaggaagacaaggctttcaagcagaaacaaaaagaggagcagaagaaactcgaggagctaaaagcgaaggccgcggggaaggggcccttggccacaggtggaattaagaaatctggcgaaaagcaagctgttccttgtgcctgaggagatggtgaccctttatttcatccgtatttaaacttctctattccctgccataacatcttttgccccgtatagctggaataaagtgttatcttggagctgttgtacatttaagaataaacttttgtaaaaaaaaaaaaaaaatcttacagtggctcatcatctctttagttgttttcactaagtcattcctaccataactgtgaatttaaaagtaaaaccagctcagaatcttgccagagtctgctctttggtccttgttctaccctaaactttgtatcacctgaaattaaatcaactcctttgaaaaaaaaaaataacatgtttattgaatatttttaatgagccaaggatatgctaagggttttatatacatgagctcatttaatcttcacaatgaccatggtcttgctctgttgcccaggctggagtgcaatggcttga

SEQ ID NO: 472672 - DNA, 646 bp, Homo sapiens
ccaacagagcactactgtgaacatgccaaaatgcgagagctgtgcagctgaacccctcagctgcaggtctgttggagtttgctggaggtccgtccactccagaccctgtttgcctgggtatcaccagcggaggctgcagaacagcaaatattgctgcctgattcttcctctggaagcttcatcccagaggggcacctgcctgtttgaggtgtctgtcagcccctgctgggagatgtttcccagtcaggctacacgggggtcagggacccgcttgaggaggcagcctgtccgttctcagagctcaaatgctgtgctgagagaaccacgctctcttcagagctgtcagacagggatgtttaagtctgcagaaactgtctgctgccttttgttctactatgccctgccaccagaggtggaatctatagaggcagtaggacttgctgagctgcagtgggctccgctcagtttgtgcttcctggcttctttgttaacactgtgagctactcaagcctcaacaatggtggatgtccctcccgctgtcaagctgcagcatcgcaggttgatctcagacttctgtgctagcagtgagcaaggctctttccctgaggcatttggttgtttactcgagagctttcttttttaaggt

SEQ ID NO: 472673 - DNA, 660 bp, Homo sapiens
cggagcacgtgcattcagaaaacttgagttcagtccttttactagcagtgtggcctcaggacaggtcccagaatgcctgtatccaggcctggcgccaggagccagggcttggagtctggaaccttaggaatgtatctggggctctgttctactgcagctcagattgtggatatgcttcagagtattgtaaatcctgcagtcttaaataaattgaaccaatcagcagatattattgtggtaactcaatattgtggtaacattattgtggtaactcaatattgtgataacagtattgtggtaactcaatattgtgataacattattgtggttgaaaacctaacaaaatcagtctggaaagtgacagaagtctcttacagagaagaatgtgagcaagtaaaagagaaatttctccaagaaacagcatttaggacctttaatgtccctattaggccctaaaatttaaaaataaaaatatgtttgtaactttgaattggatcctgcattatataaataatatcttgtacagatttttggttgttggacaatctttgaagactttgtagttgttgctgctgctattctcatgacatttcaattattgtctgatcattcatacttgtaggcttgattttatgggttgctatgatatgtttatgtaaa

SEQ ID NO: 472674 - DNA, 567 bp, Homo sapiens
tccgtggcagaagtatgggtccccagagactctcactcactcaccatttccctgcagtggagaagcctcctctggctccgtgccattcccagggtgctaggaaactcataaatgaaggacctgagagaaccaacaatgggaggacctcatctaatctgaaacgtgggtacctgtgggtccggtcggcaaccaaattacccacaggtttgttgattcaaaaggatttgtcaattaagtctctgctaaataaatacccacagggccagctagtcgaggctgtggctgctactctttacagcaccttccttggtgtctttgaggggcctggacccttagctcagctgacaggcagaatatctgtgtcagtgtctgttattcatccgtcgttgggtcagggtctgcaggatggacccctgcagctggtgccctgtgtgaggaacgctgcaaagggagtgcaacggacctcccaaaaacgaaggtgaaaaaaactgcacggtcagtgagtcactcaacagaaacagtatataaaagtattgaaacagccgcttaaggctagcggagcctcag

SEQ ID NO: 472675 - DNA, 720 bp, Homo sapiens
cacttctctctcctgcagccatatcaacaaggacatgtttgctgccccttccaccataagtgtggccaaggctcagctcagctctcctgggatgtgtgctctaacactggggggattcggacctggcccacagctttgttatatgccccctcaagatgaagtacctgctgcactgacagggccacagcattctcagtccactggcaacaacagtccaatgggggataccaacaaaagtgcttcattggagcatttgctgaggggtccatgcttacgcacatgtgcaccagctgcagcaggggtgcagtgtggcattgagagcagagtcgagtctgctgctatggtgatggccactgagaagcaccctcgttgggcatgcaaagctgccctccaagagggtatggcctggcggggaccccaggagaggccagtcgacaggagagcatctaatcacattggcatatcccacgggcaagacagcccttctctgtgcaggtctgacaatcaataatgaccaaagtcactcagaggcgtgtggtattcacatcaaaaatctattacctaacatataaaactatcaagtatgttgattatgtttttagtatagtggtattgtttatcctgatttaatcttgaagattaaaaataaaaataatgttaacttcagttaactgttcaggcaaattattttcttttttgataaaatgtatttgtgttgct

SEQ ID NO: 472676 - DNA, 602 bp, Homo sapiens
attgtaacccactgtcttttcaaaggccaaaagtcaccaaggatgcaatgggaactggactatgctgttccctttgacaacatgatttcacagagtgcttcctgcgccgatgcagagaactttcgccagattcaaggaggtgcagggtacagatacttcacgggactggaggcagggaagaggcttgtaaatgtgcaggaccaaaagcgagacaaaagcaaaacaaaagcactaatccttctccacaattgtccaataagaaaacagcgcattcagggggcagaaccaatagaaaagttcatactgaaatccatgcaaaatggatacaaagaggaaaaacaaaccacacccaaatggaactaccctaaaacaattaagctgcgaggccctgaatacaacccagcatcatgtcggtactaccgcagcgtcacgttggtactatcgcattcaggaacacagcctgtttctggtcacgggaaaactgcagacaaatccaaaatgaggaatcatcttctaaaaagggagggttatattgttcacaaggttaatataacagtaagaagaaatgctgtgaaaaagtttcagaataaaggacactaaag

SEQ ID NO: 472677 - DNA, 1382 bp, Homo sapiens
gagcgagtgagggctgccagcacgctgtcacctctcactaccttctccctcacttgtggatgtccatggacaatgctacccaccacagagagtatattcaatatgctaccttctccctcacttgtggatgcccatggacaatactacccaccacagagagtatattcaatatgctaccttctccctcacttgaggatgcctgtggacaatactacccaccacagagagtatattcaatatgctgccttctccctcacttgtggatgcccatggacaatatactacccaccacagggaacatattcaatgtgctaccttctccctcacttgtggatgcccgtggacaatactacccaccacagagagtatattcaatatgctaccttctccctcacttgaggatgcctgtggacaatactacccaccacagagagtatattcaatatgctgccttctccctcacttgtggatgcccatggacaatatactacccaccacagggaacatattcaatgtgctaccttctccctcacttgtggatgcccgtggacaatactacccaccacagagagtatattcaatatgctaccttctccctcacttgaggatgcctgtggacaatactacccaccacagagagtatattcaatatgctgccttctccctcacttgtggatgcccatggacaatatactacccaccacagggaacatattcaatgtgctaccttctccctcacttgtggatgcccgtggacaatactacccaccacagagagtatcttcaatatgctgctttctctctcacttgtggatgcccatggacaatactaccaaccacagagagtatattcaatatgctaccttctccctcacttgtggatgcctgtggacaatatactacccaccacagagagtatattcagtatgctgctttctcccacacttgtggatacctgtggacaatactacccaccacagagagtatatctaatatgctaccttctccctcccttgcagatgcctgtggacaatatactacccatcacagagagtatattcaatatgctgccttctacctcacttgcagatgcctgtggacaatatactacccaccacagagagtatattcaatttctgaaagcccaatttgaagaggaggttcatcgagaaatcagtcagccagcatccaaatggatagtcagcaagttaaagaagggtagaaggtttagaaagcagacacagcaaaacagagccaaaggttttcaaccatccctgggaaaggagctgctgatatatctatgggaaacggtaaatgtatgtgttctatatttgagcaaattggtgtagagcaacaaatcccctggctgcccaagactgcag

SEQ ID NO: 472678 - DNA, 858 bp, Homo sapiens
gctccagcacctttaggagaacagaagatcatgtttaaaaaggttgtagcagccatgagggagccatgcaaagaggagaagagcttcccagacaaaggcggtatcatgatgtgagatgccaagttggaaggcctcttgtggaagagtggctaacacttctggagtatgagctgtggaaagaggcagagcaggcaccaactccatcagtgacagaggcctggaccacctctggccgaggaggtgggaaaggggtctggcagtcggtggagccagggacctccaagtcacttccaagtcctgcaaaactacaggagcaaagatcttttcaggggccccatttcctgtcagtgggtgctgcaacaccagcagcagcaggacaaaagagaggagtgcaggctcagaggtttgtgggaaacaggagatctgggagatcaagtttagatttctctggagaccttgcaattatgggcccaggcaagggaaggcttcagcctccccgtgagaggcctcgagctgctccaagtgctggagaagctgtagttcggaagctccctccccgcctgctccagggcacatcagactcagcgagtctggctgtttccaatgttagtcccaataggaagaacaaggcccaatcgggaccttcctgcctctacttgagtgggctggttgattactcagtgcacttttctgttgagagagcataggatttatattaactattcacttttctttcattcattagagtgttttacagtgtattttctatgtgtatgacactgtgctaggcactgcaaagtacagaaaattataacctgttttaatgctgctgataaagacatacctgagactgggcaa

SEQ ID NO: 472679 - DNA, 643 bp, Homo sapiens
gtcctacgttgtctgagatgttctactcaggagccctgccttctgccatgtgaggatgtggcacaaaggtgccatttgggagcagaaactggaccctcaccagacaccagacctgccagagtttaagagcattagaggccacggccatcattatactattgtgcacattactgaaatgcagttcttaattgccactaccatgactgtcctcaccacagttggcatcaccatcaacttcactatcatcataaaggaaaatttggagacagacacatatacagggaagataccaactgaacatgaagatgaccgcctacaagccaaagagaagaggcatggaatggatccttctctcatagccctcagaaggaaccaactctgccagcaccttgattttggatttctggcctccaaaactgcagcaattctgctgtatgctgcatggaccagatcatgcctgacctgcactgtacagattatctttgcaccagatcctctgagctcatctaaaagggatgtgggtgggatggttgaggatgggatggtgaaaaggaaattatgttatatcagcgacaacagatggaaattgatttatgtagcctagggaaggaaagatttgggaagcaaaggaggaggcaatatt

SEQ ID NO: 472680 - DNA, 1345 bp, Homo sapiens
gggaccttgtcatggagaaatctgctgggccctatgacaaaggtgaatacttgacctctgtgcagaagaccctctgtgatatccaggtgctctccctgagccgagttcctgcggccttcctctggctgtgcctccctccactaggtgaagaatcagtggggccacagcaacatactctgcagaggcccatgcattccccagaatttcctgtccaaatagccctgagactacttcgggaacgtgggcaaatctcttctcgagatctgtcttccagagggcgaatcatgctattggtgttcacccttaggcctgagagtaggcaaaggggcagatgtttgcaggagatagaagatatggaaatcagcctgccaaacattcactacttcaacatagacatgtccaaaatgggtctgatcaacaaggaagagccatggcagaatgttaaaccactcagtgtgtctgactagacagcctgaagtactgactggtgggttggtgtggaaattgactcatctctcaactattgccagaataataaggcattaccatgcttgaagtaactttagtggaggacatacacattttcctgtttagtcttgctgccattagacaatccatatggaaaaattactggtacagtcaagaggaagttgtcttcaagactgtgacattgtggccaccaataggagtccactctcagctgaggaattccttaagtcatttgtgatgctggagatgatagcatgtagccatgcaaaatttcacactagtatattgatttatagtgttcactttcctccaatatgaaacagtttatttcttctacacctagctcagcaaggcattctgtggattaccttattagtaattataacaggctttatggctataatttactttaaaaatgctgagcagtattagaacagttataaatcaatatttctttttggttatcttatgccttcctatcttggagaagctttagaatcaattcattaagaaaataatcatgaattaatgagtgtgtcacatcaattaatttgtgcacaggtttaagaaacaaatattgttttcatcctactgatgcttctaagtaatgcagaaaatgaaataaaattatattgaaaaatatcaccattgttacttcatttgactgaatatttgattttaagaatgctctagcatatgtatcattgattatttatttccactctgatagtacttctgtgatcttaatgtttgattttaaactttttcaatccttagagaatatttagtacatatgagggtactgaaaaagagtagaaattttctttgaataatgcatcccttatgtgcacaaaac

SEQ ID NO: 472681 - DNA, 517 bp, Homo sapiens
cctagcaacgaggaggaaaaaaataatgacacgatcgatacatttgctccctggtgggaggggcattggtaagaatagaggagaagtggtccttggactgtacaccaggaccaggccttgtggcctagactgtgaaaagggaaactcaaggaggggctgttctgatgagcagataggagtcatggatatgagccctgatgggaagatggttggactggcctgcctccgttcctactgggccgaggaatggactgaggttggctgcaagtctgactttttggatatagggaaacaactggcttgcagcatgtaccagtctctccttggtcaccagacactgctccatctcacagaggtgtgtagacctgagtcatcaggagactggttaaacccttatctgcatatggtcatggcattgtcagtgaagccaaagttaatcaagaattatactagctgaatgaaatccttagtaaatgtctgaatatttaaagccccatcattgctctttcttattcgt

SEQ ID NO: 472682 - DNA, 7050 bp, Homo sapiens
aggagagctgacacccgccacgtggagtgggggaattttctatactgtcttcttgaaatcaacttagagaaaatgaacacaatagattttaagatcttaattcactaatgtttaatgaatatgtttgatgctgacacaaccaccaacttggtaacaatttctttcattttgcctataggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagctctgctcgggccaagtggttaaaagctgctgaaaagactgtggcctgtaacagaagcaacagccagccccgaatcatgcaagtcatagccatgtccaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctactcgcaaaagaccatatgttgattctacctgtgttctgttccagcgaattgggaagtctcaccaagctagattgtctaccatcagcccagaactctgtaacttttcagaactgctatactcaaacttgcagatctcacatcaaggagagggaaaagcacaatgcaagaacctaactaacgtgatgatatgaagagttttcttaagacctgtcgtcaaacttaaaaggttttgcagagggcagtatcaaaagaaagtggttttcttcaaatgtatactattttacttcctgaatgtgccaactttggggatttttctttatagtgagctgtgggaacccagaacacacacgttttccctacagcagaggccatgcagtattatatattcattttgcagaatctgcacctacagctcaatacgggtggtgctgattattatagtacatataccatgtaaactctcaaactctatttagctgtgaaatagtggtgtgcaattccttgttaaagaaatgctactttattaagaagatgctggctgctttgtgttagaataggacaccccgcagcttctctgtagtggctctgtcacagtcaaaaaatgaaaaggtttttgtgcgtttcttcaaaattctgctttcttcaacatcaaaaattgtgtagaaatattttcagtgaaagggaataactagtacttttctgcatagtttttcttctgcttactttttatttaagtataggtactgctaatgaatctgttttcttagtgagtaaatttgcataattttataaatattattttagagaatcttttgaaattgttgtgatcatattttgctttctatggcttctccttaacttattgattaattttttgaagttatagatatgttctcctattttaaaagcaaaaataacaattgacattccttgagcaaaatatactgctgtgaatttgcaaacaagaaatctgagccaaaacttgacattgtgggttacattgccagaaatgttggtcaagtttgcccttagatgtctacaactagctggcataggttgccatcttaacaagtaatctaaaagtcccattcggttctacattattaactttttttttctatatcctgatgaccagtaaattagagccacactggttaagtttgactcgtctctaaaacgtttttgttaattggacaccaagaggaagaatctgaaaaaaaaatgcatgttggtaagtaaaagtatctcacggtacaaattaagaatgactttcttcaaaatatctgaataggtgcagttttagtttaacatgcaaacaaccattgttgctacctatcctgaatcaagccttgagcctaaatcaaagcaaaccaataccattgataagaagaagataaaaacaaaatattttggagtgttttccaacttaaagtatgaagacatactcagttcttggaacttagtattaaaccttttttatgccatttcataagaattccgatatatacttgatgattgccaaggggatgaaaggaaacaacagagatggttgatctgatcttagctcactttccaataacagaaggagttgtttacagatgaatagtatcacatcattatcaatttccacatgaaaaaggtggagctttctagaaaaaccaacctctaaggcattaggaatttagctgaaaccagcagaattgaaaactctggcaataaaacatggactcaaccatatcccttctggcaatttccttctcagagaggggagtgggaataaaatgttgccttccccacttctcaccaccaccgccatcatgacgctcatactggcttttgcctgtttgtagaggaaaaggtgggctggttttagtactctgaaggacaaaaacaagcaaacaaaaacccctgctgcagcatttcaggtgcagtatgatatttcctaatctttcctatttcttaacaaaagattttaaagtacttctctagtcattgaagtttttttttctttacataaatattgatatattctttttctactcaaagtgccaaaggctacagtttttaatgacttaacaaattgtaccacattgttaaggacatataatgatagacactagaactcagacctctgcatgtatatttgataacatgtcttttgtaaaacaaaaattacaaaaaaatttgtttacattccactggtaccttaatttaaaataaatcagactaaaaggtggtatctcttcttagtgttctatttatcttatttgctaatgggagcacttcttcctttgttaggctgtgctttactgataaaaccaagtattgaataaagagagttaattatctttttaaagtaaataaaattatgaaaatatatatagtatatataaagtactgtgtttaaaaaaatgttatgcaatgttttccaaactgataaagtttgtaaagtgctataaatgtattttgttaagtacagataaaagctattgtgtgagtatattgtgctaaaatcatagaaataaagattagatttcttcatcaaaattggaatagtttggtttttacttcagagtctgaatagataatagcttggcttgtaggaaaataactgaggaaataagaaaaaatcagaattgattaaattcataattgtttaggaatgggttacaactaagaaagaaaagtttctcaatctatgacatgttttcttattgttagaattttcttttatgcttattaaaggagctcttttatactttacacatatttttgcatatcaatgttacagtgtatgaaaaagaaaatatgaaggacttgactaagagtagttgatgtacttattttcccaaacagtagagacctttatgtcatcatggccattggcgttgcagcttttcttaaaagaatgcttcaccattaactccacgatattctttcaagccattaaggctcattatattaattttactgctgatgatttgtacatctcactggaaggtattagcacaagtttttagaccacaaccagaacttaggatttactcaaatggtcctaaggagtttgttgaatgatatgtgaagttacaaacatccagtaatgccaccaagttcatgtagctgtccaattgcaacaaagttcatacataccaggcaacaacatcacaatcactacctggccaacagccaatgtaagatactattgattgtaggaaacaccctggttttagagaagttaacatgtgaaaaaacaatgtgtatcttatataatgggtgaaatacagtttctctaggtctttaaattaaacttctctaggtcttgattttttcatttctaaaatggagacattcagccatatttcccttctaaaggatgtcctaaagttctcaatttctatggattatcattatgtattttatccaatgagcaaaaactggtaagaaaataggaaataacttgatgatctaaaataactaactaattagtattgccatctttgactacaaggttaatagaagcaagccaactggggctgctgaaagcctacatcaactatttcaccacataacatatcaaaacaggtgacctgtatacgtatacccctagtcctagtacctttctcatgaggcaacagttgagtagattcttggttattatacacctaggaagctatcattaagggccctgctatttctgtcttttataggtcaagtctttacttgatctctatgggtaatttcatattacaggtcaaagggaaaatgaatatgtatgcatgattcagagagtaatgtaattaatataaatgaaaaaatcaaaatgaattaagatgatttaatctaaaaaaacaacaaccatgacttggaaaattgtcaaaggcctgtctgtgattggatatttcatttcctctgcttaaatatgtttctgcctttattctgtaagaagattctaaaatgccctaggatcaaatattcccatttgaagaaagcatatatttcagtaatagtatatagattgcaagtaagatctatttatagaagatccccattgacgatgctttcaagttgaaagaacatttagataagccatttgatatagaagtgacttttatttcacggtcaaaacaattatcagccaaagaaagttcctaattttgtgtatttgtgcaccacagtaaatgacaagtgaaactatagttctgccaccaattctacttcacgaacttgaatgcccttttcatctcctttactcccctaccttaagattctgtcattgcctatgagaaaaatgtatctaaattctaaagttacattttcaaaatggtacaactgaccattagataaatgagtttgaagaagagaaaatatgaaaattgcatttgtataaaatctcattttctatttatcactttgtatgcctggctacttccttataagaatgagagaaaggaagtcaaggataagcctctttgtctttaaaaagatgacataaggccaggcatggtggctcacgcctgcaatcccagcactttgggaggccaaggcaggcggatcacctgaggtcaggagttcaagaccagtctggccaatgtggtgaaaccccgtctctactaaaaatgcaaacattagcggggcatggtgccaggcacctgtaatcccagctactcaggaggctgaggtaggagaatcccttgaacctgggaggcagaggttgcagtgagcagaaatcacgccactgcactccagcctgggcgacagaatgtgactctgtcaaaaaaaaaaaaggaagaagaagaagaaaagaaaaaaaagatgatatagaagtgaccgtcatttataatccacttgattgacccaaactagatccagtgaaacttttccttttatgagtaatgcttttaaggtcaaatctagaatattaacataattctcaaaactcaacagtagaaaaaaacagagtaaattaaaaaagtaaaaatgtaaaataaaaatggacaaaaatatgtacagaagtttcaccaaaaaagcatatacagatggcaaataaacacgtgaatagatattctgcattgttagccatttggaaaatgc

SEQ ID NO: 472683 - DNA, 736 bp, Homo sapiens
gaaatgagatcttggatcccatactgaaaagtaggctgaggagactccttatctcccttccatatcgaagcacccactaacaaacactaccggttgtgtgggaatgatgtgggttccttgcatccagagaggcagatgtgtgaatgcacagaacttgaacattttcaatggaaatcctgtttcagtgcattcgaatgaaaaatggcacccactgaaaaagcagccctctgacattttgcgagacagagtacttcatagcacaaataacctggaaaaaatatgcctgaaaatgcatttgacactattatttaaagtgtcagacttctcagaatttgctgctgcaccccaatgtactaaatatagccaagagggagccccactacttgaaaacccactggacaaccagctgcagcatatgttattgcccaagagcaccgggcacacccctaggtgtggtctgttaaaggtgcttggagagtggagagatccaacggttctcctcacaggaggaggggaaaaggcctaacagcatcagaaatggggtaatgtaattttcaagatgggcacattgcctaacccaacaaaatcacaattctgacattcaggtgagcaattagcagcttctgcctagtgtttgtgcaggtaatatgtgaatgctaaagaaacaagtaaatgtaaggcaatgtttttatatttgctaaacatgttttcttcgaataaattttagatatattta

SEQ ID NO: 472684 - DNA, 893 bp, Homo sapiens
ggcggctgtgggtgcagctttagcagacttaaaagtccctgcctgatggctctgaagagcacagcggacctcccagcatggcgttcgagctctgctaagggtcagactgcctcctcaagtgggtccctgacccccgtgtatccagactcctctgctggtgatacccaggaaaacagggtcaggagtgggcctccagcaaactccagcagatctgcagcagaggggcctgaatgttagaaggaaaactaacaaacagaaaggaatggcatgaccactcaaagaccccatctgaaggtcaccaacatcaaagaacaaaggtagataaatccacaaagatggggagaaaccagcgcaaaaaggctgaaaattccaaaaaccagaatgcctcttttcctccaaaggatcataactcctcgcaagcaacagaacaaaactggacagagaatgagtttgacgaattgacagaagtagccttcagaaggtgggacagccagagagaaagatcagaatattcacaaaaggaagccatcagactaacagtggatctctcttcagaaaccctacaagccagaagagagtggggaccaatattcaacattcttaaagaaaaaaattttcaacgcagaatgccatatccagctaaactaagcttcttaagcgaaagagaaataaaatcctttacagacaagcaaatgctgagagattttgtcatcaccaggtgtgccttacaagagctcctgaaggaagcactaaacatggaaaggaacaactggtaccagccactgcaaaaacataccaaattgtaaagaacaactacactaggaagaaactgcatcaactaatgggcaaaacaaccagttagcatcatgataacaggatcaaattcacacata

SEQ ID NO: 472685 - DNA, 629 bp, Homo sapiens
tgttgctgtgtctgtgtagaaagaaactgtggggcggcctggcagaggggctcctcacttcccagacggcatgggggctgggcagaggcgctccctctcttcttataaggaccaccactacagcctacctccctgccagcccctcccaaagcccatacctggccgctcctgcggggttgtgtacacagtgcagcctctgctacccaacctgggtgttttgcaggggccccatctgagtactttcttggaagcttgggtgtactttggatcctccagtgccactggtgccggacctcaagggactggagatggagccacgggctggtctcaatgccatagggctgtagtgctgctcaggagtgctcaaccaagattcacagccggtgctcatgttggtgaggatccccccactctgagaacactgagagaggactctctcctgcaggtctgctgcagtttgctggaggtcaactccagaccctatttgcctgagtatcaccaggggagcctgcagaacagcaaagattgctgcctgctccttcctctggaagcttcatcccagaagggcaccggctttatgccagccagagctctcctatatgaggtgtctgtcaacccctgttgagagg

SEQ ID NO: 472686 - DNA, 663 bp, Homo sapiens
ggaagctgcagtggagaagaggaggctgagagggcagccatcatgtgcagagccgttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgacctcacatcacagaaattcccatgtcttcaacaaccactaagcagcatgagatcaccagtgttgccaaatgacttagtgtactcccagccaaaagcaaagaacattgacgttttggttaatgcatgtgggcttatgatggataaatatactatttgattaggctgtttgaaatattgaaaaatatgtcagaattatatttatgtgtctggggtttcttatgttagcaaacgtc

SEQ ID NO: 472687 - DNA, 730 bp, Homo sapiens
atattgttagaagaatatgtggaatggagataattgtactgccatgtttggaaaaaaaactgcctgctacaatgagtactattgagaaaggtcctgtttatgggccattcctgaactacctattcatacccattgcccattgtaaaatcttcatttttgaatttttattgatttgtatacatgctttgtatattcagaatatattaacctggtctatcatatgtgtggccaatatatttttttttcctgaggacatttcttttaatgtggattccagtggcttcttaacggggatacactgggataggcatccccagcacacatgcttgaattgcgctgtggctaaaatttataggaatattcaattccatagggctcttattacatatttgaaaataaataattcataagttaaaatgagaacattatacttgctttggggtggggaaacaatatcattctgggaggacgttaaagggaagtatttccaagagtaagtaataaaatatatttcttatgtgcgaaaattagacagtgcctagcacctagatcacagtcttgtgctgtccattgctcaatatctgaaaacagttttttaaaataatagttttttcaattttataattctttattatgtgaggggattttttaacatgaagagatgcacaattctatcaaaagctttttctgcatctattgagctgatcatacagtatattagtctgttttc

SEQ ID NO: 472688 - DNA, 668 bp, Homo sapiens
cagtgactatttccaccctctatgtccatgtgtatacattgtttagctcccacttgtttgaacaattacccctccaaagtgcacatacaagttctgagtaacccccatggaagacataatacttcaagcccacttaaaatgcggttttttaaaaatgcccgcgagagtctaccaaatgggactgaagtcatttcaggggctacatttatataccttcggactgatgggaagtaccgagaggcatattttgcatgtggaaaagcccacattcgcctgccattagggactgctacttatgtgtggcagatgaggcagccagaatgcagacaccgactaacaagctggctgagtttaaaaaactcaggaaaagtttctaggtgttctggaagagtaaagtgttccctgacaacaggattgaatctccaggaaggtagaggagaatagtaacctgtattatttggcagcagatgtgattggcatatattaaagcaagttatctacaagtagaaaaatatcgaatgggcttattttgcttgtgaataaagggtagttatgtttttgctcatctacttgctcattcattcaaaacaatgtgcctattctcatttagagaatacagtgaatggtatattttcacctgtaatattctgaattcacaagaaggacac

SEQ ID NO: 472689 - DNA, 925 bp, Homo sapiens
cgtagataggtaaacaagtgttctaagccatacttgtttcgaatgtatttgccatctggactaaatttctgtgaaattgagctgggtgaggaggctccactaaagtctttcctcttagaagtgggcctttgttttggaggacctgggcctatttcacaaggattacttttccctgtgctagacagagctatgaagggatcgctctcatatcttcataatggaaacctggggtggtttctggagcccacagccaacatcatactgaatgggcaaaaacgggacgcattccacttaaaaaccagcacaagacaaggatgccctcttttaccactcttatttaacatagtattggaagtcatggccaaagcaatcaggcaagagaaagaaataaaaggcatccaaataggaagagaggaatccaaacagtccctgtttgcagatgacatgattctgtatctggaaaaccccatagtctctgcccaaaaaatccttgagctgataaacaactttaaaaaagtttcaagatataaaatcagtgtacaaaaatcactagcattcctctgcaccaacaacagccaagccaagagccaaatcaggaatgaaatcccattcacaattgccacaaaaagaatgaaatgcatgggaatacagctaactaaaactctacaatgagaattgaaaaacactgctcaaagaaatcagaggtgacactaacaaatgaaaaacattctgtacttgtgaataggaagaatcaatattgttaaaatggccatgctgcccaaagaaacgtacagattcagtgcattactatcaaactaccagtgacagtcttcacagaactaggaaaaaaaactacttaaaaatccatatggaactaaaaaaaagagccttaatagctaaagtgatcctaagcaaaatgaatgac

SEQ ID NO: 472690 - DNA, 631 bp, Homo sapiens
tcaccatagggtcaatgcagccattcctgttgccagagctagcactctcaatgggtataaagagcatgtgcagaggaagaatgcataacgagacagaacactccggagaaacttacaggtcattcaatgtggctaaatctcaaagtttaaaaagaggaatggagcaaggtatagctgaagtggaagtcaagttcagatcatgttatgctaggcacttccacccttatcctgaatgctttgaaatcaggggcctgcagcacacacgactggcatcaagatcattcacggttggcagtggatcagtggcagtctggggtggaagagcacggaaagccatgctccccagaatccatggatctgataaaactcaggccaaaaatgattccccgactggcctaagcaaaaccataatggaagttaagctgttggcacagagaagcaaacaagcagcaggaatctagatgttcatcttttcctttgtgaagtccatactgtgtgcaagatccatggttaagatgatagagggagtgggcttagatgtacatgtgcaggtttgttatctaagtaaactcatgtcacaggcgtttgatgtacagatcatttagttactcaggtactaagcatagtaccc

SEQ ID NO: 472691 - DNA, 1935 bp, Homo sapiens
ctaagtggaaagctgcctgggaagtccatgctcccacacccaggaaccccaaggaagtgtgggagctatgccgatccacatatttagcacattcaaaggaaactaccatgtgtctagcacctgctatgaggcaggcactgtgtgctcaggatgtaaaggtgggcatcccatcaggagcctggaggtccaggatggcatggcagatgctatgagtggcagacgcgcagcggggaggaaggtgatcaagaagggctttccagaagggttgcttggccagactttaggaaaaggggagttgggcagaggagagggggctgggggaatggaattccaggctgtgggcacatgtgcagaggcacagaagcatgagaagagccggactgaggctgtgaaaagggagagaggtagaggtggcctggagccatgtgccgtgacagatcaagtttccttgcgcatcctctgtgaggtcacatcctctgtgtggacacagtgaagcaatgtcttgcctgtgccccagccgggcagcacagccggttgcatccgagaaggtgcagggggctggcgggctccagaagggaagaggaagtctgtaagagtccccaccacgtgttcccaagtggctctgaggagtcctagaaatagaagtggcaatccaagggtagtgcaaggaccagaggtggaagagggcggcccttgacagcagctgtcagaaagaaaatctcatgtgacttctacaaagaggctgaaagtatagtaagaagggcaggggctagctccattgccatggaggtttgagttcagattttaccacctactgtggatgaccctagcacgtcactcgacgtttctcatagggctggtttgaaagtaaaatgagatgaagctcctggcacctggtctgctctgaaaagatattaatttctttttccacctctaaggggcctgagccagtttttcacaactgactcgccggcccagtgccttaaaggggaggggaaaggactcgggtgctggttggggtgcatatggaagaggctggggggcattgccaggccatacgtttttgctgtgctcagtcacaagggcaaagggctgagggacgaggtctcagagcccagctctttgtcaccttcaggggtcagctctggctaggagctttgggtgcagaaggagggacaaacactgcagccaatcttgctgctatggccccaagcagtgggacaagctgtgaggcagcatccaggccactgaaggaaatcggcgccggtgccagcgtcgtctctcttcgaggaaaagcaagtgtttctctcattgtcttcactcttcaaacctcctctgcactgttccctcctacactgtcagctaaggaccttgccttaaacttcgcttagataaaagaagcaatcagaagggaaccccctcatttcctcccccacatccactgcctgccctgtgtctgtactcacctgccttccctcccacgcgacagcaggaagtgcctcttcttgagcctcttctagtggccatggccaaccctcccgcttgtaccctgcagctcaccctctcctctcctgcacattcttcccgttctactgcatcctgcccaccccaccaacaaatgcacctctgcactgcccatcttacccttgtctctcgatgctccccattcaacgagttgtcaagttactgcctcttcccttcccatttgccacctaacccactccagttggactcattccccctctgctgaaaatgctcttgtccaatgattccctttctatgccaccctcaccttaccccattggcattcaacagcagattccctgctttgttgaagcattgtcctctcctgctgtctgtgaccctgtgctttcccagccatctacctcattgccacttgctcattctgccttctttgctggcccccttcctctg

SEQ ID NO: 472692 - DNA, 522 bp, Homo sapiens
ttcctgaactccatgatttcgatgcttttacttctcataattttgttttatatgtgcatttttattgaattaatctttcattttgataactatatacttaataataaaggacttttggacattgcttttagtgtatcatgtgttaaagctaaatgtcttatttatttattttattatactttaagttctagggtacatgtgcacaaagtgcaggtttgttacatatgtatacatgtaccatgttggtgtgctgcacccattaactcatcatttacattagattatcatatcttcctttacattaatttatcagatttagcctcttcttctgctggtagtattaatctcaaggacaaagtcaaaagtatttataaggattcaaagaggtgctcatagagctattgagaaatttttttttaatttcttcctagcatttagaaatattctactttaaaagaaggtattatgagcaactgtatgcaaatgaattggaaaacctgaaagaaatggataagttcctag

SEQ ID NO: 472693 - DNA, 524 bp, Homo sapiens
atatgattgcttacagtggagagaactggggatctcagagaaggacttatgataagcagttgcatacaacaagatgggaactgtgggaatcataaccagagcagcattgtaacaaaatgcaccaggtcatcagtggctacccggaagcaaatcagcattgatggatggtggtcaatgtctaaaataggaaagcacagccacagaaaacagcaacagggaaaaaaatgctctgaagatcttccagaaagatctatcacatatttacaagaagctgaagtttttggcagtgttcattggtttggtgtggtgtcaaggatgaaaacaatactttataaaatgggtgtgttggcttgtgctacccctccccaaacctcagacagcacagctcgtggctccaaaagagacctcttgcttttgcttgaggagaagaagggcaagagtaataaggactttgtcttgcatcttggatacaagttcagctacagtaagatagggtaccagtcagaattgtgaagcccccactc

SEQ ID NO: 472694 - DNA, 1020 bp, Homo sapiens
cctccttgaagccatgccaacagttacagtcacatctttactgccatttctctctgataactcagatgtctttttgtatgcttctttagaaattgtctgtcgtcgaccacagattccaaaggcaatctttgtttctggatttggacccctctatacttacaaagactctattatggttaactgtgaggaaggttatatcctcagaggcagcagtttaatctattgtgaaacgaataatgagtggtatccttctgttccctcttgcatatccatttgcagttaccctcccagtattgcccatggacactacaaggaagttattttaataactccttatcctgaggctacatatgaatgtgatgaaggatatgttttggctggatttgctacaatctactgcaagtcttttcactggcaacttgcacctcctcaatgtaaagctctgtgtctgaaaccagaaatagtgaatggaaggctgtctgtggataaggatcagtatgttgagtctgaaaatgttaccattgaatgtgattctggctatggtgtggttggtctcaaaagtatcacttgctcagagaagagaacctggtacccagaagtgcccaggtgtgagtgggaggcacctgaaggttgtgagcaagtgctcacaggcagaaaactcatgcagtgtctcccaagcccagaggatgtgaaagtggccctggaggtgtataagctgtctctggagataaaacaacttgaaaaagagagagacaaattgatgaacacccatcagaaattttctgaaaaagaggaaatgaaggacttatttttcccttcaaatcaacatacagaatcttcactcatccaccctactcttccttgagcaccatcactctcataagggtctgggctaggagaactttcttattactgccagagaaaaatgtgtaattattggtaatctagccttttgtagctcaaatgtccagtttcctggacttgaagtgctggttaattaaataattatttaccaaatat

SEQ ID NO: 472695 - DNA, 607 bp, Homo sapiens
gtcatctcacctctactcaatcagccttcagtgcaggacccatggacaccctccatctacaagctctgtcccaccagtccctgctaagtggaaaagtgatttgccttacattacagaagagttcacaggtgccaccaggaaatggaacaagcatacttgactcccttatctgtgccataagactgtgtcatgcaggatttatccatttggcgaatgtgcatctgggtaattctgttgtatcgtgtccagagtgtatccaccatgtgattcttacagccccagtaacaggcaccattgttggctcaaggctttgctgctacaatcaacaccgtgaggaccattcttttccatgtccctataccatcatgggagatctgcctgggcatgaagtggaaagggctcccctgcaacaagatctctgcacaggaagagtggggcagctcaggctgctcatccagcccaggaaaatatcaaaattcaaaattcaaagtacagactaaatgcatatcattttcacaccttcataaagttgaaaaatcaagtcgggacatcattaagttggggactgtctatatttagatgacccattaatcccgtattatatctc

SEQ ID NO: 472696 - DNA, 999 bp, Homo sapiens
ctataccatagtcacctttgcaactatgttcagcacactattgaccatgttctcaggccttcaggcttggactgagagttacatggtcagctgctctgtttctcaggccttcagacttagactgagctattctgctggcttccctcattttacagcttgcaagatggcatactctgggacttctcagcctctaaatgtatttaagctccaccagcatttcacaacctcctacctgaatcttgaggctcccacagggagacttttgtctgtggatgggtgtaaaattcttgttgtcgttggaggatacaagtgggtaactttctattctgccatcttgctgatgtcattcctcttatatagggaccacattttgactgaggtacaaagtggccctgaagaaggcagtaggctgttgtggagtctggaaactccatatgcagagtgactttaattaattaagaatatattttggccttgtagagaaacatttcccaaatacattctcatcatatctatgagatgctgcacaataaaagacttcatggtcaattgagattgagaaatgatacatactacacacttttcttggaaacttaaaatgcacttttaaataggtgctagaggaaagttatttacacttatttaagtacatatatatgtatatgtttatttaatagcaacatgtttattagcctcccaagaattaatagttctcagaatttgctttgggcatttccactataatgtctgcaaactgcgaaacctgtctagactgctagacatgcaagttactgagaaatggtcatggatcatcaaaccctctgaaaaggcttttttgaaggcaaaggatggtatgggccaatcctgtaaatagaaatgaaaggaataaaatgttcggtaaagcatagactggctagaataagctgggttggctgctgtccacgatggagaggtgctgaaacagagatttccccctggtgctattaaaaatggattccc

SEQ ID NO: 472697 - DNA, 740 bp, Homo sapiens
ccagttacccattttttcctgcctcttttccccttttgggtgatgtttaagcctgtctctcttctcctcgcatgcaccttatgaaaaatggctttgccatctgcagctgtcaggaggctgtggacttgggagtacagctcaatgaatatacaaatgtgcagctggaccacagccccttccagaaggacttaaaaggatatgagagctcagatggcaaaaaggaacaactcttcactgtctgtttttgtgcctgttattcctcagcaggccttccagacattttaagccgactgaccattgtgtttttcaagtctgtgatcattgcagctctctcagcactagagggagttcataagtccagatggggtagtttttcaactgtaccaggagaagctgggccaagactggaccccctcaggatctgccgtgggatggcagctggcaagcccatctcattggcccaaagcaggtccctgcacagagggaatatttctaatccctgactgcagcaggagagaaatatattaactacttaattttccttaatggttccttagtgtcagtcttaagtcatagtttttctatggttttaaccaattcagcttattttttcagtttttgtcattaagttacttgcatcattatggtgccccctcttctagtacctactcttaattttcctgaaatacaatggaaaagacattgtaaatgttgggaatacgatagaacatcaaatcagc

SEQ ID NO: 472698 - DNA, 759 bp, Homo sapiens
ctacacagcagtactctgagaaacttctttgcggtggatatttggagggttttgagtcctatggtggtaaaggaaatgtcgtcacatgaaaaatacacagaggcattctgggaaacttttttaacctgcaagtggatattggagccatttgtggcctatggtgtaaaaggaaatatcttaactttaaaactacacagaaacattctgagaagcttctttgtgacctgtttggaaacagtctttttgaagaatctgcaaacggatatttgtgagcactctgaggcctatgcaggaaaagaggtatcttcacagaaaactataaagaaggtttctgagaaactgttttgtgatgtctgcattcatctctcagagaaacagttttgggatgtaggcattcatctcacagagaagctgcaaagggatatttgtgagcactttgaggcttatggtgaaaaactagacagaagcattctgagaaactgcttcgtgatgtgtgcattcaccacacagagttgaacctttgtttttattgagcagtttggaaacagtctttttgtagattctgcaaaggatatttggagcactttgaggcctatcatgaaaaaggaaatatattcacataaaaactagactggaggattctgagaaacttctttgagctgtgtgcattcatctcacagtgttcaataattctttttattgagcggtttggaaacagtctttttgtagaatctgcaaagggatatttgtgaggtcttt

SEQ ID NO: 472699 - DNA, 678 bp, Homo sapiens
tccaagtctacccgcccctcacgttgaaggcaggcagttgcccttcgggcgcgcgatgcagctcgcggatcagttccatggctttttcgcagaacatggcggacgcttcccactcccgcggccttgccaaccaccagctctcacgccaaaatggtatctgggctctcggcgcctcactcctttcgttctagtcctacagcgccaggctctcgcctcggcctccgctccgcgctttggcgccgaacaaagctagccaataggaacgcgcctacggcgcccgaaaagggacatccaccgctcagccgcattccaagaggggcggagtgggaggggtctttccaaggttcatgcaggttacaggtggcacccccgatcagcgacagaatcaggtactctacaaagtggcgcccaaacagggacttcaaggacatgaagaagaaggtctgctggagcagaggaactgaaattgacaaggtgaacggggatcccagggtgagtctgccggtagcggatataagactgcgagaagcagtgaagcgccaaattcctcataccgcagctgcagaaatgctaatcttaactctagcttttgagaacgcaaacacggattataaacatgcactggcaccgagcttgtcaggacgtgggaactgagcttcatcactctgaaatgttagc

SEQ ID NO: 472700 - DNA, 1008 bp, Homo sapiens
caccctgaacccggatccctgccatggacagagggtctgggcaactctgccctttccctggtcttggtctagccccttctccctcctacagcgtgaagcacatctcctgtcccctgctcatcctgcacgctgaggacgacccggtggtgcccttccagcttggcagaaagctctatagcatcgccgcaccagctcgaagcttccgagacttcaaagttcagtttgtgccctttcattcagaccttggctacaggcacaaatacatttacaagagccctgagctgccacggatactgagtcagcagcccggtatcctgaagccccggggggccggcacctgcaatgctcaggagcccagctcgcacctggagagcacctcagatcccagagaacgtggggtccaggttctttctgcaccttcccagcacatgcagaatgactccagtggttccatcgtcccctcctgccctgtgtacctgcttgcctttctcagctgccccacctcccctgggctggcccactcacccacagtggaagtgcccgggatctgcacttcctcccctttcacctacctgtacacctaacctggccttagactgagctttatttaagaataaaatcgtggtggtggtccttttgtctctctgcagcgcgagaagggtcaatgttgcctcctccatgccccagagccgcccacagcccagcctctagccgctttggagccactccatgactcagcctcagactatgaaattttctagtcccagcagctcagaaatttgccaggagtaggaagttttgttcacctgctcgcccctttctccaagttgcagtcccagcatcagcagctgtgggctggcagggagcccagaggtcctcgcggttacactccttcactggggtaccctgagctacctatagcggttctcagatctacaaaacacttttcctacgcaggggagcagctgagtagacattacttctgaggtcagttcatgagaacactgg

SEQ ID NO: 472701 - DNA, 8221 bp, Homo sapiens
ggtccctgagaacggcgcccagtcctgttccctgagaacggccgccaacatgacactctaaggaaatgcttattggagcaactcagactcaggcgtttgaattcgagatgctcaaccagtttgtaattcgctttgaattaattttaacgtggtgtaaggttttcgctggaggctactgcagtttcgctacatcttcaggctctgtctctgattctagtgctcttgttatttccaccatatcagcagttacttcctccacagaagtcttgaattcctcagtgtcatctgtcaaacattcagacacttgcaacgactctagtggcagcagcagtgttcaggaatcctatgtgagggacaaacacgcagaacccagcaggagtgttctagaatcctatgtgagggaaaaactttcagaccctcttagccgtgttctggaatcctataacaagcattcagaccacagcaggagtgttctggaatactatgtgaggaacaaacattcagaccctcgtagcagtgttctggaatcctatgtgagggacaaacattcagaccacagcaggagtgttctggaatcctatgtgagagacaaacattcagaccctcgtaacagtgttctgcaatcctttgtgagggaaaaacattcagaccctcgtagcagagttccggaaacctatgtgaggggcaaacattcagaccacagcagtattctggaatcctatatgaacattcagaccctcgtagcagtgttctgcaatcctatgtcacggaccttcagaccccagccacagtgttctggaatcctgacaaacaaacattcagaccacagcagcagtgttctggaatcctatgtgagggacaaactttcacatcacagcaggagtgttctggaatcctgtgtgagggacaaacattcagaccacagcaacagcgttctggaatcctgtgtgagggacaaatattcagacccttgtagcagtgttctggaatcctatgtgagggacaaacattcagaccccagcaacagtgttctggaatcttatgcgagggacaaacattcagatcctcctagctgtgttctggaatcctatgtcagggacaaatattcagacaccagctgcaatgttctggaatcctatgtgacagaccaacattcagaccatagcagcagtgtcctggaatcctacggcaaaaattgtgatcccagcatcaatgttgtggaatcctatgtgagtgacaaacattcagaccacagcagctgtgttctggaatcctatgtgagggacaaacattcagaccccatcaggagtattctggaatcctatgtgagggacaaacattcagaccctcgtagcagtgttcaggaatcctatgtgagggacaaactttcagaccacagcagctgtgttctggaatcctgtgagaggaacaaacattcagaccacatcaggagtgttctggaatcctctgtgaggggcaaacattcagactccagcaggagtgtccttgaattttatgtgaggaacaaacactcagaccacagcaggagtgttctggaatcctatgtgaggaacaaacattcacaccacagcaggactgatctgggattctatgtgagggactaccattcagacccttgcagcagtgttctggaatcttatgtgagggacaaacattcagaccccagcaggactactctggattccaatgtgagggacaagcatttcaaccgtcgtagcactgttcaggaatcctatgtgagggacaaatattcagaccaaagcagcagtgttctggaatcctttgtgagggacaaacattcagacccttgtagcagtgttctggaatcctttgtgaaggaaaaacactcagatcctcgtagcagtgttcaggaatcctatgggaaacaatcggaccccagtatcaatgttctggaatcctatgtgagggacatacattcagaccacagcaatagtgttctggaatgctatgtgaggtacaaacattcacaccacagcaggactgttctgggatcctattgttcaggaatcctatgggagggacaaacattcagaccacagcagcagtgttctggaatcctttttgatggacaaacatcagaccctcgtagtagtggtctggaatcctatctgagagacaaatattcagaccctcttagcagtgttctggaatcctgtgagagggacaaatattcagaccacagcagtagtgttctggaatcctatgtaagggacaaacagactacacaggagtgttctggaatcctgcttgtggaacaaacattcaaaccacaggaaaaacattcaaaccacaataggagtgttctggaatcctgtgtgagggacgaactttcagagcatagcaggagtgttctgaaatgctatgtgaggaacaaacattcagaaaactgcaggagtgttctgggaacctatgacagggacacgtattcagaccctcgtagcagtgctctagaatcctttgtgaaaaacaaacattcacatcacaacaggagtgttctggaatcctacatgagggacgaacattcagaccacagcaggcgttttctggaatcgcatgtgagggacaaacattcagaacgtggtagcagtgtgctggaatcttatgtgagggacagatatttagaccctcgcagaagtgttctggaatcctatgtgaagggcaaaccttcagaccctcgcagcagtgttctccatggaatcctatgtgagggacaacattcagaccacagcagcggtgttctggaatcctttgtgagggacaatcattcagaccttcgtagcagtgttctggaatcctgtgagagggacagacattcagaccacagcggaagtgttctggaatcctatgtgagggacaaaccgtcagacaacagcaggagtgttatggaatcctgtgtgaggaacaaacattcaaaccacagtaggaatgttctggaatcctttgtgaggaacaaaatttcaaaacctcgtggcagtgttctggaatcctgtgtgaggaacaaacattcagaccacagcaggagtgttctggaatcctatgtgagagacaaacattcagaacctggtagcagtgtgctggaatcttatgtgagggagaaacattcaaaccctcatagccgtgttctggaatcctatctgagaggcaaacattcagaccctcgtagcagtgttctggaatcctgtgagagggacaaacattcagaccacagcaggaatgttttggaatcctctgtgaggcacaaactttcagactccagcaggagtgttcttgaatcctatgtgaggaacaaacattcagaccacagcagcagtgttctggaatcctatgtgagggacaaacattcagactccagcaggagtgttcttggatcctatgtgaggaacaaaaattcagaccacagcaacagtgttctggaatcctatgaacaaacagccagacacagcaggagtgttctggaatcctatgtgagggaaaaacatttagaccacagcgagagtgttctggaatgctatgtgtggaacaaacattcacaccactgcaggattgttctggcatcctacgtgagggacaagcattcagaccctcgtagcagtgttctggaatcctatgtgagggacaaacattcagactacagcagcagtgttgtggaatcctatgtgagggacaaacagtcagaccacagcgggagagttctggaattttctgtgaggaacaaacattcaaaccacagcaggattgttccagaatcctgtgtgagggtcaaaatttcagaaagtcatagcagtgttctggacaaacattcagacgcgaggagcagtgtactgaaatcctatgtaaatgggaaagaatcagaccccatcatcaatgttctggaatcctgtatgagggacatacattcagaccacagcaatagtgttctggaatgctatgtgaggaacaaacattcacaccacagcagaactgttctgggattctatgtgagtgacaaacattcagaccacagcaggagtgttctggaatcctatgtgagggacaaacatgtaaaccccagaagaagtgttctggaattttatgtgagggacaaacattcagaccacagcaggagtgtcctggaatcctatgtgagggacaagcattcagaccctcatagcagtgttcaggaatcctatttgagggacaaacattcagaccacagcagcagtgttctggaatcctttgtgagggacaatcattcagaccctcgtagtagtgttctggaatcctatcggagaaacaaacattcagacacttgtagcagttttctggaattctgtgggagggacaaacattcagaccacagcaggagttttctggactcctatgtgagggagaaaatggcagacaacagcaggagtgttctggaatcctgtgaatcctatgtgagggacaaatattcagaccaaagcagcagtgttctggaatcctatgtgaggaacaaacattcagacccttgtagcagtgttctggaatcctatgtgaaagagaaacattcacaacacagcagcagcgttctgaaatcctatgtgaggggcaaacattcagaccccagcaggagtgttctggaatcctatgggagggacaaacactcagaccccagcaggagtattctggaatcccatttgagggataaacattcagaccaaagcaacagtgttctggaatcctatgtgagtatggataaacattcagaccctggtaacagtgttctggaatcctatctgagagacaaacattcagaccagagaagcagtgttctggaatcctgtgagagggacacacattcagaccacagcgggagtgttgtggaaccctatgtgagggacaaacaatcagaccacaacaatagtgttcaggaatgctatgtgaggaacaaacattcacaccacagcaggactgttctgggatcttatgtgagtgacaagcattcagaccacagcagcagtgttctggaatcctatgtgagggacaagcattcagaccctcgtagcagtgttcaggaatcctatgtgagggacaaacaatcagaccacagcagcagtgttctggaatcctttgtgagggacaaacattcagaccctcgtaggaatgttccagaaacctatgtgagagacaaacattcagaccctcgtagcagtgttctggaatcctgtgagagggacaaacattcagaccacagttggagggttctggaatcctatgtgagggacaaacattcagaccccagcaggagtgttcttgaatcctatgtgagaaagaaacattcacagcactgcaggagtgttctggattcctatgtgaggggcgaacattcagaccacagcagtagtgttctgcaatacaggagtgttctggaatcttgtgtgaagaacaaacattcacacaacagcaggaatgttctggaatcctgtgtgagggacaaacattcacacaacagcaagaatgttctggaatcctgtgtgagggacaaacattcagatccttctagcagtgttctggaatcctttgtgagagacaaagattcagaccccagcagcagtgttctggaatcctatgagaggggtgtcctggaatcctgtgtgacggtcaaacattcagaccacagcagcagtgttctggaatcctatgtgaagaacaaactttcagcccactgtaggagtgttctggaatccaatgtgagggacaaacattcagacgctcgcaacagtgttctggaatcctgtgagagggacaaacattcagaccacagttggagtgttctggaatcctatgtgagggacaaacattcagacaccagcagcagtgttctggaatcatactgtactcaatgctatgtgaggaacaaacattcacaccacagcagtactgttctgggatcctatgtgagtgacaaactttcagaccacagcagctgtcttctggaatcctatgtgagagacaaccattcagaccacagcagtagtgttctggaatgctatgtgaggaacaaacattcacaccacagtagtactgttctgggatcctatgtgagggacaaacattcagaacacaacagcagtgttctggaatactgtgtaagggacaaacattcagaccccaacaggagtattctggaatcctacgtgaggaacaaacattcataccctcggaggagtattcaggaatcctatgtgagggacaagcattcagactacagcaggagtgttctggaattctttgtgaggaacaaacattcagaccgtcgtagcagtgttctggaatcctatttgagggacaaacattcagagcccaggggcagttttctgaaatcctatgttaagggaaaacattcggaccccagcatcaatgttctggaatcctatgtgagggacctacattcaaaccacagcgctagtgttctagaatgctatgtgaagaacaaacattcccaccacagcaggactgttctgggttcctctgtgtgggacaaacattcaaacaacgtcaggggtgttctggaatcctgtttcagggacaaaaattctgaacgtcgtagcagtgttctggaatcctatgtgaggagcaaacattcagaatacagcaggagtgctgtggaatcctatgggagggacaaacattcagacacttgtagcagtgttctagaatcctgtgtgagggacaaacattcagaccgcagcaggagtgttctggaatcctatgtgagggacaaacatttggaccctggcagcagtgttctcactaccagcagcagtgttctggaatcctatgtgagggacaaacattctgaccccagcaggagtgttctggaatgctatgtgagggacaaatattcagaccttcgtagcagtgttcaggaatcctatgtgagggacaaacattcagaccacagcaggagtgttctggaatcctttgtgatggacaaacattcagaccctcgtaccagtgttctggaatcctatgtgagggacaaacattcagacacttgtagcagtgctctggaatcctatgggagggacaaacattcagaacccaccaggagtgttctggaatcttatggatattcagaacccacccgcagtgttctggaattctatgtgacagacatactttcagaccacagcagcagtgttctggaatcctatgtgagggacaaactttcagaccacagcagtagtgttcttgaatactatgtgagggacaaattttcagaccatagcagtagtgttctcaaatcccatgtgagagacagacattcagaacctcgtagcagtgatctcgaatccaatgtgatggacaaacattcagaccccagcagcagtgttctggaatccgatgtgaggggcagacatgcacaccccatccacagtgttctggagtcctatgtgatagacaaacattcagaacacaacaacagtgatctcaaatccaatggatattcagaccccagatgcagtgttctggaatcctatgtgacagacaaagattcagacgacagcagcagtgttctggaatcctatgtgagggacaaactttcagaccaaagcaggagtgttctggaatcctatgtgagggacaaagtttcagaccatagcaggagtgttctggaatcctatgtgagggacaaagtttcagaccatagcagtagtgttctcgaatcctacgtgagggacagacactcagaatctcgtagcaatgatctcgaatcctatgttagggataaacattcagaacctcctgacagtgttctagaatcctatgtgagggaccaatattcataccctcgtagcagggttgtggaatgctatgtgacaaatattcagaccctaatagccatgttctcgaatcctatgtcagagatattcagaccccagcctcagtgttcccgaatcctttgggacagacaaactttcagaccacagcagcagtgttctggaatcctatgtgagggacattcagaccacggcagcagtgttctggaatcctgtgtgagggacaaacattcagaccaccacggcagcagttttctggaatcctatgtgacggacatacagaccctcgtagcagtgttatggaatcctatgtgagggagaaatattcagacctcaggagcagtgttttggtatcttatgtgagcgacaaacac

SEQ ID NO: 472702 - DNA, 1995 bp, Homo sapiens
agtaggcttctgatactttctcatagtcatgagaattcatggttcatctgtccagatcattgatgaccttattgaaaggagccatgaaagtcatgatagatttttctggcaaattaacgtgcttttcccaattaagccttgtgagacacagtctggagagaaacctcatgtccctgatataaccaggaaatcccacagatatcaagagcatcttactcagcatcacaagattcaaactctgctgcaggcttttcaatgtaataaacaagagaaaaccttcaacacagaggtaatattctttatacataagagggctcatataggacagacctttggtaaatataatgaatatgagaaagtctgtaataactcagctgttattgtccaagggataactcaggtaggacagccaacttgctgtagaaagtctgacttcactaaacatcagcaaacacacacaggagagaaaccctgtgaatgtattgaatgtgagaaaccctccattagcaaatcagaccttatgatacagcacaacctcactatccatcagagaattcacacaggggaaaagccctatggatgcaatgaatgtggaaaaacctttcaccgtaagtcattcctcactttacatcagagaactcacacaggggataaaccctacaaatgtattgaatgtggaaaaacttttcacttgaacgtggaaaaacctttagccagaagtcatacctcacaatacatcatagaactcacaccggggaaaatccctatgcatgtgaccattgagaaaaagcatttatctataagtcaagatttactgcccatcagagaacacacacaggggaaaaaccctatgaatgtaatgagtgtggaaaaccctttatcaataagtcgaacctcaggatacatcagagaactcacacaggggaaaaaccctatgaatgcaatgaatgtaggaaaacctttcaccgtaggttgttcctcactgtccatcaaaggactcacatgggaaaaaccctacgaatgcaatgaatgtgagaaaacctttccctataagtcattcctcactgtccagcagagaactcatactggggaaaaaccatatgcatgtaacgaatgtggaaaaacatatagccacaagtcataccttacagtacatcacagaactcacacaggggaaaaaccctatgaatgtaatgaatgtggaaaatccttttactgtaattcattcctaactatacatcagagaactcatgctggcaaaaaaccctatgaatgtaatgaatgtgagaaaacctttatcaataagttaaaccttgggatacacaagagaactcacacaggggaaagaccctatgaatgtaatgaatgtggaaaacctttcatcagaagtcaaatctcagcacccatcagggaactcacacaggggagaaaccttatgtatgtaatgaatgtggaaaaacctttcatcgcaagtcattcctcaccatacaccagagaactcacacgggaaaaaccgtatgaatgtaatgaaagtggaaaaactttttgtcagaaatcataccttattatacatcagagaactcaaactggggaaaaaccctatgaaagtaatgaatgtggaaaatcctttcatcagaaggcaaatctttagaagcatcaaagtattcacatggggtagaaacactatgaatgtagcgaatgtggaaaaaccttcagtcagaagtcagtcctcactgtacatcatagaacccataatggagaaaaaccttacaaatggcacacactgaggcggatggcatctcactgttcatcaagaacaaaaagccttaaattatgccagaaaccactatagcaatgtctgtgtcaagaggctgtctgcatatctaaatgtacatttcacagtacagcaaacactttttttgaactacattatctgtcagattgcctaaggcactgaaatataaaactcctagtgcttgctgtattttcctagct

SEQ ID NO: 472703 - DNA, 462 bp, Homo sapiens
ctgagggcctggtcctggcccatgcagtccttaagtgggtctctgcttcttcacatgaaggaaaaaatatctctccctgaacatgaagtccaatcccagagcagaagtcaccctggaaacagagtccataatgcagtgagggcttgtgtaggacagaagaggaatcacttcctgctctttcctgtgggttctccctctggttgctttgcctcagctccagggactgcctcagacacagacagagcctgcaaaagaggcaggagagtaagcagcggtttggaacagacagttggcggtggcccccagggtgggggctgtgaggaaagtgaaagcagcatcactctctggcatgctgagagcctctcctctaggtttctggggatttcactcataggttccacattaccctgcaaagctgggagaactagggactacggtggccattaaaacttgtgaatgttc

SEQ ID NO: 472704 - DNA, 837 bp, Homo sapiens
cctcttaagaagtcccttgactcccctcctgcctttgtaaggattttggctttgctctgagtgagattttgagctgccaagtccattttaatggactcgctctggctggctgtgttgaaaatcggtaatgggggtcaagggaagaagcagggagaccagaggcagcggtggaagaagctgtgagaaggggtcagattctggatacattttgaaagtagacctaacaggttttgctgatgtttttggtgtggaccatgtggcctgtcctgtgttaatccaacaggacaccagcccagcctgggacttcacagaccgaggcgctgatgtagtaaacacagacaagtgtcactcactggctcagcatgctgggggccatcttcagcccagctgggcaaaaatagaacctgaaaacagatcacaaagttcattctgccggcatgccccttccatagcaggcaatgctacctttgccgcagcaatcctccctcctcagccaggtgtggatgcacccctcaccctccatattgaggccccagatgccctgctcagagtttgtttccccagcaggtccctccatgtgacctacctctctccttgccaattagtgcttttggagacttttcctggaccatctcatgttcctgcccattcagcagcaaaaggagttcatcttattcccttagttatggataaggctcacattcaaaaccccagttagccccatccattatctttgaacccagctcatagattccattatgcaagtattgtatatgcattcggctttgaggaaagtggtgccctttgatctgtataacctttaggtttagcctggtc

SEQ ID NO: 472705 - DNA, 714 bp, Homo sapiens
ctgagagggctggaaaaacttgcaaaatggttctgactcactgttctctaggctttctgctgacctgtgatcacctgctgaatttttctattccagaagttcagtttggttctttcttaaaatggctatttcaactcttgtatcactttattggcttcattggattgggtttcaactttctcctgagtaccactgagtttctttgccatccaggttctgaattctgtatctgtcaattcagccacatttcaatctgggtagggttcattgctggggagccagtgcaaccatttggagagcaaaatggagagccttggaggatggacacctatggtcacattttgctgcagttgtcccccatgcaaaaccttttgggcttagcacaggagtatgagcctggaacaatagctgagtcttggccaatcccagtggccatatttcaaccactcatagactgctaagtgttcatactgtgttcaaataaggcaaacgccaacctttaaccaatccaggtgtttctgtacctcacttccgatttctatatgttactggagaattattatgttcctttggaagtgtcatactttcttgctgtttcatgtttcctgtgtacttatattgacatctgtgcatttggtgtaacagttgcttcttccagtttttgaatttgctttcataggggaggactttttcctgaagatgtatctatggtat

SEQ ID NO: 472706 - DNA, 507 bp, Homo sapiens
agtgccacttctctgaaatctcgctaccattgccacatttcattttcaggacacgaacacaatgcaggttgtaaagcagccatgttatgagaatgagctaacaagcaaaagcaaacatgaggacaatgaaatagaagactggaatgagcctccagagctaccagactctgggctggcactggggagtgtctgcaaagagtcccgtgatgtgatccatcttcaggtctttcagccgtggataccagcaccagctctggtggaggtagcaggggtgggaagtggactctactctccttgggcagggcttgctatgactgctgtgggggatgggggtgtggttccaaggccaatggggttgtgttcccagggggattatggctgcctctgcttcatcatacaggtcatcaaggaagtgggggaaagctggcagtcacaggcctcacactgctcccatgcagcccactgtcctaaagcccggtctcactcccgctgtgccccccaatagca

SEQ ID NO: 472707 - DNA, 591 bp, Homo sapiens
gagtcgcacttatgcaccagcactgtccccattaccagctcccctcggcccgaacgtccactgctgtgaccctggacagctgctggccttctgcggccacagcccgtgccgccgaggacatgccagacaaagacagagggtgtgggctggccggggaggtggggagcagctgcctgcagagggcacagccggcctgtgccctacctcagtggagcctggagtggagcccggcagggaagggcctgcccctggagggaggctcgggacccatccggcacgtgcagcaggggagggtcaaaaacctgagcgggaggctgtggaccccttacccaccgggccctccaggatcctgtgaggggcaggatgtgaatgaaaagcagtcctgggtatggtacaaactggtgggtcccaaagtttctgatttcaggggcagcaaagtttaacaaatgagggaactgctctcagcaagtcaggaatagcaggaaattatctcagcttgataaaaagcatctacaaaatccctctggctcacatcaatttaatggtggaagactgagtgctcttccacagatgaggaatggggcaaggatg

SEQ ID NO: 472708 - DNA, 1954 bp, Homo sapiens
cgcgcacaacgatggagccctactacgaaccggactcagagtttcgcgagccgctcacggacgtggatgcgttcctcgacagtgcgcggtacaacgaagccggtgacctggatctgctcaaggcgtacctggagaagaacccgagcgacgtcgacgcgcgggatgagcagggccgcacggcggtgcacatggcagctgcgaatggccacatgcccatcttggagatgctcttccagttcaacccccaaccaaatgtcccgaatgatgagggcaacacggccctgcactttgctgcgctgaacaaccgcgtcgctgcggcggaggcgctgctggcgcacgggtggagggcggctgagcagaacatcatgggcaagaccgcgctgcagctcatttacgagaagcagtacaacgagatggagacgctgctcatgagccgtgatgagacgctcgatacctacgttccgcccacccaggcttccgtgatggtcgacctctcagccaaggaaggggacgaggacgaggacaacgagcgagaagagaagccgaccgtggaggcgaaggttgcggcagaacgcaagacaccaccggcacccatggcgcctgcaaagaaaattgtgccatcggcgagcgaggcgccagcacctgtggaaatgtctatcggcgagcgtttcttcgaggctctcttcagctttgcggagggcgactacgttgccacgcgacgtttcctctttcaaaactgcaccttggaagcggtgcgcgccaacaagtcgagcggccacaaccgcgtcgccagtcagttcaacctgctcgagttctcgtcgtctgaaatttcaccggagcacggtgtgcgtcactacgcgcattatccgacccaggggccggcgtgcgcctcggcgtggatggctggtactgtctatcgtaactacctcctacatcccgacttctttggcggcacacatgcggcgcctttcatggaaaatgctgatgtggccgaccgtggacagcgaacgaatcgccagctgaacatgctggacgaccttgtcgagtacctcacccgtgcgcgcaacagtggcgacgccacctccgctgcagacgccgccaattctactgcttgcagcgcacctgcgctgctgcgggagcacttcttcacgatttgcaacgggtacttcgttcagaaacggcagatggcctcgctgcccgcgcgattgtatcgcatcgccgccgtcgaggggatctcgatggcagatgtcgaggaggagtcggtgtcgcgcctccacatcggactagtggaagtcgccaccgtgacgctgcttctgcacgacccgcctgtttcccgtgttcgtgagcagcgccaactcaccgatcaagccgagcgaaaagttgtgcgcagatcggatgtagatgtggctgccgaggtggaggtccatgaagtgactcagacgtacaacagtgccttgagcttgcccccaaaggactattgcacgccactggagtggagcggcatcgccactctctcccgcatcatcttacgcggcacgtatgaggccacgctcctggccggcgttcagcacaccctccgtgatttggagcggcaggccagcttggcagacgcgtcttcgccagcgacgccgcccttttcgctaccgcccatctttctcgccaatgtgggcggcggtgtctttaacaacgataaggagtggattgcctctgggatcgcgtcggcggtgcaccgcgtagctgcgctcagcgtaccgctcaacgtgcgactcgtgcacttttgccagatggatgagtactacatgaaatactttccatcgtggcctgtgctggactaaatcgcgcctgcgtcacgccacccgtgtacgtatgacagaagacaggaaacaccacgtagagggtgcggacacatctagttctcgtgtagcgtacttctctatttctcatgggtgcatcc

SEQ ID NO: 472709 - DNA, 4277 bp, Homo sapiens
cccctctctctctcttcctctgcgccctcttcctccgatctccgtagtctacccctctcgtgaaagccgtcatacatgcatctgcgctgaggtggcacgaaaaaggcgcgccgcgatcacgcaccatgaacaactatgtgcttaatgacgagatcggccagggtgccttcagcactatttacaagggccgctatcgcaccaccaccgagttctacgcgattgcttccatcgacaagaagcgacgggagcgcgtcgtgaactgcgttcagctgttacgctccatgcaccactcaaacgtcatagagttccacaactggtatgagaccaacaatcacttgtggatcattacggagtactgcaccggcggagacatgagcacgatcctccgctcgaacattaatctcaccactcaggcggtccaggcgttcggccgtgatgtggcgatgggcctcatgtacatccacagtaagggtgtcgtgtataacgacttgcagactcgcaatctgctgatggactccgcagcaatgctgcgcttccacgactttagcttggcctgtctcttccaagacgcggcgacgcggccactggtggggacgccactgtacatggcccccgagttgttcatggcggatcgcccgctgtactcgatggcatcagacctgtggtccttcggttgtgtgctgcacgagctggcgacaggcaagccgccctttgccgcatccgacctcgagacgctgctgggcgacatactgacgagtccgacgccagcggtgcctggtgcgccggagtcctttcaaacgctcctgtgcggcctgctggaaaaggacccgttgaagcgctacgcgtgggtcgatgttgtccgcagcgagttctgggatgagcccttgccgctgccgagcaacggctttccatctcaggtggcgtgggaggactacaagcgttcgcgttctggacgcggtgcgagtcagtataattggacggactccgatgtgcgtgtggcagtggctcacgccgtgggggcagcgaaatcaaacgcttctacgcacaacgtggaggagagggagcgagcggctgcgacgttgaacgtcgcgaaggagctggacttcactgcaagcgcggcgatgttgctggaacggttaccggagcggacacaggagcgtgctgcgcacgcaacaggccatgtcgcgaccgcgcacggcagcctggtgcacggctgcccatccacggcctcagcggcgtcgaataccttcaacgccaacggctcttcttcaagtgctgtcgcgtcttctcgccgcagtcgtctcagcgaatcgaaaaacaatggcggtgacccacaacggcaccgcgtgagcaagggacgtggcgcgacaagcatccgaacgtctggtagtgccgccatagcgtacgaaggcgggtgcaccgcgtacgcgaccaacaccggcgccaaggaggaccgcccaaccgaggcgagcttgcatctcttcgcgagcgaggcgctgcgccacctcacaatcagcgacctcctcccccatcatacagatcagcacattcgtcctctgagcaacaacagccgcatcgagtacacgcccgagccgtcgtacgacatctccacgctgggctttacggcgctgacggcggcagagatcaacagcctcacgggtaaggaacacacggcgtttttccgctcgctctacctggccctctccaccttgagcagtggttacgataacgtgctcaacaccatgaactacgtcatttcgctctgcggtgacgcggaggtggcgcgcgcctcggttaacagctccgtgatgcggctgtgtgtgaagcacgcgggccgcaaggatgccccagcgggctttcgcacggcggcagcgctcattatggggcttttggtgcgcacaacggcctttatcacgccggaagtggcctcgtcgtctatcctgccagacattatgcagttgtttgaagacgaaacagatgtgccggtgaagcgaaagctgatcgcgtgcatcagtgagtttcttttctacatcgccgtccagcagaagaggcagcgcgccatgtggaacgtgcagccggcgacggtgaagcgcatctacgcctcggcgttggactccgacgacgacgtgctgaagcattatgcggcaaagatgatcgagaacatggcatccactccgcagaaggagatgacgctggagctgtttgccgaccccgtctttgtggagaagctgctggccgtgttcgcgcttccgtcggcggagggtcggagcgaggacatgcgctcagatgcggtgtgcgcggcgcttaagctcgccatggtgaaggacgagctgatcctcgctgtcatgcagtgcaagtggcttccagtgacgtcgtacgcgaccgtgatgcagcgatccactctcacgcacacgatgcagatcctgctaacatttctcaactatgcccttgtgaagggcagcggcggcagcggcagtggccgccgaggctgtgccttgacgtcctcactcagcgtcgaggatgcggaggaggttgtcggcaacgcgttgttcgtgagtgaggacttgctggcgcgcctgagcgaggcgatcgagcaggcgtcagtcgctgtctatggcaaaacgctgctctttgtgatgctcatcggctgcgtcggcgggagcaccatctgccaaatcctcaacagccgcatcgtcgccttcctcgatcgcctcgtccgcgacgcggacttgtacgtgaagcgctgtggcgcagccttgtcggccttccttggctggttcgtgtctgagaagctcgcgagcattgcgcggcgagtgtcttcgacctcgacggcgacgcaccttgccgccattcagcagctgctgagcaactccgccgtgcgcagcggcatcgactttcaaaaggatgtcttccagagcctctcgacctgcattgacaaggccatgcacaacacgatctacggcacctaccgggacgaattcaacaccatcgccgatcgctttgtcgagagccctgaggaggtgctgcggtatgaagagaacatatgcctgtacctcgccacttcttacgcagaaatgctgcgacgcaaggaggcgagcggtcgcttcactgctattcgttttttgacatctgtcatggtgcccatctctgccgaggtgacggcaacgcgcaaggagagcagtggcgccacgtcggctgcgcgccaggtgctgaacgcggtggcaccgaatgttacctctctcttgcaagagacaagcccgatccccacgaacacgattcggcttctcgtgacgtgtggcgagatggctcagagcaagctctctggcctcgtatccgagcagctactgggccacatcatggactacgtgaatgaaagcggggatggcgacggcatctactacccgctctcttttatccacctctgcctgctggtgagccagcgggtagatatcttcaactacgtcgtgcgtcagggactgtgcgcgctggcccttgagacgctcgcgtccgccgccaagagcaggaatgagccgctggtggaaatgtgttgcaacctcttggcggtggtggtgcgtcgcgtggcgggggacccgtcatcacgagtgaaggcgcagtgcgctagctgcgtgcaggaggactccatcggctctgtcttgctgcccatttgcgcagacactgccagcagtattgctctgatggagtccgccgcttccgtgatcgaggactttgtccgtctttcgtcagcggcccgcgacgacctcacctcggcatccgcaatcgcgacgtgggcaggagccttgtccaatgcgcttctgtcttcggcgaggcgcgccgtagctgcgagcctgctggcagctctttccacgtcgtgcgagtccgcctcgcgcgacgtgctccaggaactcaagtgtgattcgcgcctcatgtcagtgctggccaacgccgccgactgcacgcacatgcgtcttgtcgccagcgaggcgaacaggattctgaagaaactctcctagatgtatcaggagaggtgctacagagcacttctttctgcatgcgtgtgtgtgtgtgtgtgtgcccgtgcccgtgcccgtgcctgcgcctgcgcctgcgcctgcgcatctgtcttcggacgtgtttgttgttgttgcctgtacgatttcgtgtgtttttctcaccctttcttttggttgttgtttctttcaatgcctctcgcgcgccaccgttcccgtcgaacagacccgccaaccaacctgtctcgcgcgctctctctctctgttgct

SEQ ID NO: 472710 - DNA, 464 bp, Homo sapiens
gcccagcttctgttttggaaaagtatatatgcatgaacactagtatatgctgggggcaaacacgaatgatagtggtaacctcttatcccactgtgtctccatgaaagctttaaagggaccactgtggaacagaaggagcataaatccagaactcagaagcatcttcttattcttctcctttgttctttggtgcattatgtttgttgtaaaatccctaggcctctcaaccaggttttctcatctgcaagatgaaggcatggaagatgatagcagcttcctgcaatttgaaaagtcccaggcagagccccactcccatgccttgacagtgaagcagaaaattttcctgcctcttttgaatgaacttaacactatgttcacacatcatataaggaaaaaaaaaggaaagaaacccctcacacccactctggtacaccttggtgtttgccattattagaacagcaaac

SEQ ID NO: 472711 - DNA, 965 bp, Homo sapiens
cactctatacttctgtgtgtgggtctttaagtcctctagtgcctatgggttagggtctccatgactgagctggccttggtccactatgttgcccagccacaccagccttctggctgctcctccaatgaggcaggcatctcttgccacaaggcctttgatcttgcatttctctctgcctggaattctactccccagacaattgcacggcttcacccatcacacccttcagtctttgttcaaacgtcttctcaacagagaggacttcctcggccacctgaaagttgttaatgaattccttcacttcacctcaaagaatctccagagtgcaaagctaaaagctgaaggcattgacctttcaagctccaaaaatgctgcaagagcagcttcaaaagagtcagaaaaggctcaatggcggaagaagaaactgaaggatgggaaagagaatgaaaacaggaaggaaggagtaacctcttcaagagctttttggaaagcccaaagctttccagaaacagacctctggatcaatggtagtcctggtggtctaaacatgttcttgaaagaagcaagagaaatcaagattgacgaaggagcaacaaagcttggaaagatatttgtctctgggaagaatcttccaggccctttcaggaagttgaagggagaaggtggtctttctcagagccactgcttgagcgcttatgcatcccatggtgtggtaactggggttgaaaatgggatctcaaaaccaacccaacaggaagggcaggggaaggtctgagttgtcttttggtgcccttgggtcaggtctacctggctcaacctctccaagctcttgataaccagtattacaaggtcaaggagtgatgctatttgcgtcaaactcatgctgtctcacaaatctatttatgtgcacctttaaatgtgggaaatgagaaattccaccttcaaacacacctttccaagcattt

SEQ ID NO: 472712 - DNA, 1022 bp, Homo sapiens
tcctaccttcagaaagggtgaagggcgggctccagcagcggggagaaacaactcacagtcaaggcatttctcaaggtgttatgtgtcgaccatgggcatcagaatcactgtccaagaatcaattggtttatgagaattattgtgcggatgtcgatgagaaagtaaggagagctaagtggtactgggacacaaatgccagtgttaggagtggtcattcactagctgagtggctggcaagtacactctggcctcctggcagccccattcaaatttgtgtctcagcaaattacctcatgacagggaccttttggattactcactgggggtttttatcattcatgcatattcagtctgcaaatgccaatgcagggctatctgtagctcaaatgaaatccccagaatttgcaacagtttctctgtgctgctcttctaagtttctctttctgtctcctcatgggttatcagttctagacaccacgaaaatgggaaagctccaatgacaagaccttgacaacaatcattccttgtgaataacttcattggagttcattctcagggcacagaacaaatgatcctttgtacttcaagcttctgatgttcttgggcatgacagagctcctcagttccctgaaaatatcaataagccttttcttagtgcctgttgttatgatggtgcttagagattctgagacatataatatactacatgtagttcttaccttattaatagcactcacacttttaaaaatacaatttatttacatgtctctctcgtgaatacattatcattgtcttgggtttgtgcattgtatttaatttgattttttgtcctcagttctaagcacagtgcctggcactttgtgtgtgctcaaatgataatgagtaagaggaaagcctattctttacttcctgttgtccaatgtctgaaatcttgtttcataaagtttgttcagtttttaaattatttaaggagggaaagaaacttaggctatttttattccatcttggttggaagtgaaagt

SEQ ID NO: 472713 - DNA, 968 bp, Homo sapiens
cggggatactacagggcacagtaggaagagggagcaaagaagacagcagcaatgggaaaaatgagcaagagttggataatcttcccagcgcagaagctgatgacaaataagatagaaactgatgcccaaatagaagtgaaagagcttgaggcttctcagggaaaaggaagagaaagaagttcagaaaaagagggaatcaactcaagtgatactatggaagcagaattggcaagacttggtggccaattgcaaaagagggtgagggagaagggagttacaaggagccccagacccttggacatcttggtagaagcaggatttacaacagtgaccttgggcagggcggttttgtttggcatcaaggggacagaggccagactgcagacatttgcagaaggcatgggaaatgagggcctgaaactgaggcacacagagacaaagttggttcaaagtcatcagcaaaggggagttctgctagaagaccacagctgtccagaccgcacactaccttttatgacttggcaggatacagactttgaaagaatggttgtgcagggtggggcccaggccctgtaccggctgatcgctgacgacgtgcagggcaagagcctccagggctaagcaattacgccgtgggttaaatcaccatatttcaagaatgtacttgctgagatgcaaatccctctgataaagataacatattaatcttgtcatctatttgcattagtaaggataagttcatataggagctccagaaagcacagttctgttggggcatgattgtaccccatagatgtgtaaaaggaaaatcaatatttgactggatactgaacgtcctcagcattatgctatgagctgcaacagataaaaaagcttaaagtctggtcctggttcttaatattcattcatttactcattcattcattcattcatgctaaggattcactagtaccaggccctgttaggat

SEQ ID NO: 472714 - DNA, 540 bp, Homo sapiens
gcgatagtcgatagtcccatctgggttgccaaaatgtgtccagaattggttccttccagtgggttctttgtctcgctgacttcaagaatgaagctgtggaccctcacagtgagtgttacagttcttaaagttggagtgaagccacagacctttgccgtgagtgttacaactcttaaaggtggtgcgtccggagttgtttattcctcctggtgggttcgtggtttcactgacttcaggaatgaagccgcagaccctcgtgtgaagcgcatgtccgtggaaacaatcattggaccagcagatgtagtagaatctgggccatcaaaggccatcccatgcctttatatacacagaaatgggaagtcagccaaaaagctgtgtaatttcattttaccctttgcttttctcattgaacttggtagttcccgtctaaatgaactgagtgttgagctttgaattcttccatcaatagttctagcaagccagtgtacattgtgattaaaatgtactgaccctccttaaagaaataaaatgcaactaaac

SEQ ID NO: 472715 - DNA, 960 bp, Homo sapiens
gcctccctcccatgcttgccggtgcccaaagtccagaggagactgaggcagcaggggactggtgtgtcagtgctgccccaagcatgtgcacacctggccaggtcatgacagcactctgggtcagtaacaactttgctctaaaattggagctggccctgggaacagggagaggccaggcagtggaaggaggcacttccaagcctgtgggggttagaggcgttcccaggccctcaagagtgcagagatgccagggtctgcagctgcggcttggtggctgcactgtgcccgagaggatgtggcttctggctttacaacttgaaagacggcagggcttctacctgttcttggctcctgccttctctgtggagtgcacagcccaagccatgcctctcccactgcagcccgcctcatggcactccagataggctgctattgccatcatgataacatcaaagtttatatataaaacccagatcatatgtctgctgtattatctaaacattaaaaatcataaataactgattaaaggggtatgccacaagtacctgaaaatcaacaggtttaaactcgtcattttggtgtcttcaaaaattatcctccttcattctccattctgattcacttgttgagaatcgtctataactttctatttatccataatatttaaacattcctagatgctacaattctaatttcttaaaatattcttatcaacatacttcttttttttcccactgcttaagttaggccctattactttttgcaggatttttgttaagtaactatactaaactcacaatttcagctttgtaacaattagcccaattggtattctccaggtataattatctttctgcaaataaacaccaaatatattctctttaatacttacatgaaaacttttcatttgatatgagattaatgtttgttaacagactggccttatgtaaaaaataaacc

SEQ ID NO: 472716 - DNA, 671 bp, Homo sapiens
cacacatattaacataatggcagtgcggatccccaggacctgggtgggtccagaggtgctgacagaggagcctcaatccctagccatcagcactccagaccatgaggagtactgccaaactaccagctactgttcccttaaggcccaagcgctcttaagtcagcttgtaatgaatgctacctggcctcagacttactattcagggcccaaggctctacagttagcaggtgatgaatgctgccaggactggttgctttccttcaagacagcttgtttctatcatgcccaggatatgtctagaaatgtcatctgggaaataagacctggaacaggggcctcacgaccctgtccagtgccttatcctgctgtggctgagcagcctgatgaagtacgggtagaagaggaagtgactttggacagcctacttaagatttctgagcctcagtttccacagtgataaaggatatttgcatcaagtggatgctgtgaggagaaaataatatagaccatgtatagcactgtgtgtgatccataacaaccgttccatcaaagcattttttattattgcacttattgctgttcatccagtagattcttcacctttaatgcagatatcaaacaactaattttttttcttgactagttttgtggctcttgaataatgatattac

SEQ ID NO: 472717 - DNA, 449 bp, Homo sapiens
agcagcactgagtccagtctgtatgtttggagtccgagcacacagataccccttctatcaaagagtatctaaccctcacaccaagcccaatttctctgcgctgtgtggaagcacactatttccgaatggagaacctggtgacccccagaatgtagattcagacttctcagagagattatcagtagccacagcagcacaccacctttccaaagcccctacctgctctccaacttccccatgtcacgatgtgacatctcctttcactcgatttcttagacccagaagcctgaagattcccctttcaatcatacgtgcagtcagcaaacccttccggctccacatatccaacccggcacccctcctcgctggcctactgcgacagcatccttactggtttcatttcttccagccttacccctcttcactccatctcccctttaaataagaaa

SEQ ID NO: 472718 - DNA, 1686 bp, Homo sapiens
gcctctggcaactgcctcaggggaggccatcactcttgcctcaggctggaggaaggtggaaaggctgatggcagcatgggtctgggagaggatgttgccattactggggatgaaaagctgtttcttttggcgaaaaaggttcatcagaacttacaagctcagtgtccccagcttcaacaaggtcatcccacacatccccattccaagtttcaggctcccattctttttcaaccaattctctcactttgtaacagtagacaccttgtgaggctgtgcatgcacctttcattgcaggtcagccactctcatggtaagcgcttgtgttcattttcccagaatttcagctctttttctacaggagataagactctgactcagggcactcttatgtttcttggttttccacctagagtcaaaggtattatgtatagagtcattaaactcatcgcctctcacgagcggtggatcaggagtgtcttatgcctttattttgcataactctctaaacagttcatgccaaggactatcagtgttctccatactattacaggttatctgaatatccagcattcaagttcttaaatatcatgttgtgcttcctgtcagatatgttaaataactatttgttacatgaactaatttttgaattccttaggacaagactttttattacaaaattttaattaatttattcatatattattaaaatgagaaatatgcattaataatttttctttgcaggaggaaatcattgaaaattggagtagcctgaaacagaagatatacaagggtttcacattgttgttttgagtgttacatctatatttaataatatcacataataaatcctgctcattaaatataatgacattaaaagtagaattcagaaaagaaaagaaagcggaatgaatctctaaaatttgttttgatgacaacttatcagaaaccaattgcttagaaatagtttgcatttcatgtattttatttgagcattcatattattttaaaaaatcatcaaagtttttacatttatttaacataattatttaataattgagtaaatgtcaacaaataatactctattcagtttgacatgaaaaatgagtactgaaattatcggtattaatacaagaatttaatagaatggtaaatttgattaaaagccaaagaactgcaaaagttcccttactttatagtgtcattgtacaaataataaagaccttccatgtgatttgcattttgagagataatatggggtgctcaatttttatgactggctgtggagaacaagttaatcaggctctggttgggatgctgggtatttaaataagtgaatgtgaaatgaagacagtttgaaatgggactctattgcatatgataacatgggcaataagggaaaaatgcaaaagttttacataaaaagtattctggttgaagaaaggaagtatcagcttggtaacgtatctttcctaagcaaagtagaagactcagttaccagtgtctctatttatttcaatggacattagtattgaccatgttcaatcctggaagggttggaggtaaggtatggttcaggtatttttcaggtatttttgtccagatattctatccagaaatgccaaccaaatttcaaattatgtgtggtgattatattttgtgaaaatatcttgctagactttcttttcc

SEQ ID NO: 472719 - DNA, 1089 bp, Homo sapiens
tcaatctaaatgtccatcagtgatagactggatgaagaaaatttggtacatatacaccatcatgtcctttgcagggacatggatggagctggaggtgatcatccttggcaaactaaggcaggaagagaaaaccaaagatcacatgctctcacttataagtgggagctaaatgatgagaacacatggacacatagaagggaacaacacacactggggcctactggagaagttcaagatcaaggtgtcagcaagttcggttatctggtgagggctgctttcttgcaatatcctctggaggtgaggaaaactgtgtcttcacatggtagaaggtggaatggcaagctaaccaaaagctataatgatgccgcttttcaagggccttaattccattcatgtgggagaagccctcatggactaatcatctcttaaatgccctacctgctaattctatcacaatgacaacacctgaattttggatgggaccggttcaaaccatagcacaagctatgtgacccaggcaaatacttgaactgtcctttcatcagaataaggagtaatacaaggtttataatctttcattctttttgtactctaggtttctatgattctaacattgctttctattttttttcaactacagatggtccttatgaagtggttacgcctgtcataattcgaaaatactttaagtcaagaattctgttaataccccaataaaacaataataatgtcaaaaaattaacatttcaataattgtaagttgagaactgtctctatacagatattccatcattataagtatttataacctaatataatgtcagctcttctaaagccttagtaatttagcaatatttttatgctaaaaatagaaatgtttgtaattcatcaagtaatgaatagaaaaatttatcttaactagtgatacctgggaaagtaatcttaatcaaacagtgcaacatcagaccaaatcagatacttcaccactgtaatcatgagttcatttatttcagctgtggtgagtgggttttggctatgggcagagcatgttttatgtttatgagcattgagtagtttcagctacttaac

SEQ ID NO: 472720 - DNA, 665 bp, Homo sapiens
atctccactttgttcgtgtaagcttcatccacatccttctcgatgaggacaaattcattctccatctttgcatcttctgtgctgcaggctccacttagtctccagcatcttgttctgctgctccttgttgatgaaggaggcaaacttgttgttgagggtcttgatctgcttcttctcctgggtgcgcatggcctggatgttggggtccacctccaggttaagagggctcagcaggctctggttgacggtgacagtggtgatgcttcccataccacaggacctgccatagcctctgcccaggccacccgggaagctgctgctgaccactcgggagaagctcgaggagctgatgcaggcaccggactcactcttgtaggagcagctgctgaaggcccgggggccggaggtggacaccttgtaggacttctgggtcaccctcatggacatggtggaggcaggagtggaggcaggcaggctgaaccaggcatagattccagaaggagaggagaagctgcttcttgtagtttgtctttcttctagaactgtttcttgccaatccttgtaatattctaccttttagatttctaaaagaaaaactttttcctatattaaaatgtctaaaagaaaccatatatttacaaattataattaaaataatgttattg

SEQ ID NO: 472721 - DNA, 970 bp, Homo sapiens
tattgcctataaaaaggctccacaccgacttctgaacctgtgcaatgcagccttctcagttttctgagagtgtgggctcctccccctttcaagtgccaagcacagatcccattttggcactcctaagctgcaggccacagtcctggggtgcgaggacatgctggctgcttcttcttctgaatgcttgtggttgggttcctggtacagtgtgggatctgaagcgttcccaggctgccaggattcactcaggtgaaacaaagcacctaggctgggcagcagaggctacactgggtatgcattcttatggagtggccaggcaaggaccatgggaggggctggtgaatagacaggtctgcaggacagatgtgcctcagtcctgtgaggaagctggtcctgctttctccctggttgttagctggggccaggacctctcggttggagggaggcagggagccctcgtggatgagatggcagccctggctggcaccttgattgaatccagagatatgctgagtcagaggaaaagctaagcagtaacctttattcctgacacacaatttatgagaaaataaatgtgcaatgttttaagctgaatataggctttgcacacattgagtcaaatatttagaattttataactaaatttgaatttactgttttcacacagttataaagaaatgccttacaatctttctcagaatgtttcattataataacaataatagtttataagaaggaataaagaagtcaagcacacagaaaactttttaacctattagtctctcccattctctttcaaaactcatgaaataactggcttgaatggcagtataattgcttataattgcataataaacttcatttgttatattttttggctctaacttttcctttagtaaagtgtgatttccttcatctcttgagactatttttaaaacataaacttcaattacctgtttttttaaagaac

SEQ ID NO: 472722 - DNA, 465 bp, Homo sapiens
caccatctcttattttgttatcaccgatagaatggagtattactttgctgctgcagtcttaactgtaacactcaccacaaagatctgcggctttgtcctgaagtcagcaagaccacgaacccaccagaaggaagaaactctggatgcatcagaacatctgaaggaacaaactccggacgcaccatctttaagaactgtaacactcactgtgatggtccacggcttcattcttgaagtcagcgagaccaagaacccaccagaaggaaccaattccagacacaatatgaccagaaaccctttaatcatttaccagagccaaagcaaactgggatttaaggttccaattagtgccaaactgctgtatcaagaggatacaacaattataaacaactataaatcccacagtggagagctcagatatatgaagcaaaccttagtagatccaaaaggggagctagagtgaaa

SEQ ID NO: 472723 - DNA, 811 bp, Homo sapiens
aaagaaaggctgcagcagctaacactgggctgccccggtgtgtgatgttccccatcctgtgtccatgtgctctcattgttcaattccaacctatgaaagaagacaggaaaatgtgggaaagtttggaacttcctagagacttgttgaatggctttgaccaaaagcctgatagcaatatggacaataaggtccagactgagatggtctcagatggacatgaagaacttgttgggaactggagcaaaggatgttcagtgaaggctcagatcaatgagtattttgtggttctaaattcaatagaattacttggtcatttgttttataaaaaagaaatttctagtttctattcttaccatactagatcagaagatcttatctttactagatctgtagatgattctggtgcactgtctgtgattgggaacaaatggtcaaataagacagcaaatgatgtgtaaaaggatcactctcttggaatctttgctgatcactgtcagtgaaatagactatgagcaaggatatcagaagccatcatacttctaaacatgtttacgttgttttttctaaaaaataagagaacttgaatatttaaaataattaatgtaacaattgacaaatgcaactttagtacttataactttatattagaatctactctaagtgaaatatatatttgataccttacaaatgtattacacagtgtatacatcaatctttagtttaagctgtgttctgaaagccatttgtgtaaaacagatgtatttttgatgaaataactctatggccaaagattttggggaaataccacaga

SEQ ID NO: 472724 - DNA, 2463 bp, Homo sapiens
cagctatttgcctctttcaaagttggcaggatgaaggtcacatccatattaattgccctgataatgaaaccttcctggaggccacctgtcagaacatctggagctcttgttgttactgcttccaacaaggcccatttccatccctacgctgacttcaaagacccatcttcaaggttgatggaaagtctggaagttcctagagatttggaggactacgaagacaggaagatgtgggaaagtttggaacttcctagacacttgttgaatggtttccaccaaaattctaatactagtgatatggacaataaagtgcaggctgaggtggtctcagatggagatgaggaacttgttgggaactacagcaaaggtgactcttgttatactttagcaaagagactggcagcattttgcccctgccccagagatctgtggaactttgaacttgagagagatgatttagggcatctggtggaagaaatttctaagcagcaaagcattcaatatgtgacttgggtgctggcagagcagaaaggaaatgtggggtcagagccccaacacagagctcccactggggcactgcctgttggagctgtgagaagagggccattgtcctccagatgccagaatggtagatatactgacagtttgcacggtgcatctgggaaagccactggcactcagtgtcagcccatgaaagcagctgggaaggggggtgtatgctgcaaagcctccagggtgtcactgcccaaggccatgggagcctacctcttgtatcagcatgacctggatgtgagacatggagtcaaaggagatcatttcagagctttaagactaggctgctccattgaatttcagacttgcatagggccctatttaatagaacacactttgagaaatgctgacttaggctttgatattcaaacagattcttctcatatggctttcagtactactagcattctgctggagagagtcacatctatactgaaaggtggggcagttcaggctgctgatccaggtgagtgggtgctccacatgtctggagatcttcctgggcatgaagtggagatggcctcaccataccatgatttgtgtccagaaatggtggtgtgggtcaggctgctgaacaaggcaagtgggtgctccaagtgtctggagaatctgcctagacatgaagcagagagacctccttgcacaggatctctgcacaggaatggtgtgggtattctggctgctggaccctgcactgtggtttcagggaagccagctggggcacaaagaagtgacacacgcagaccagttccaagttaccaagctggccctggctgcaactcccatcatataggagatactgtagctgtagcagctcttctcctgccccaggccaatgacaggggaaattacaattccagttcctgctgctgaggcactttccatagttctggctgtggaggcctctattctactccagggcagtgggtgccatgaaaaaaaaattacaatttgcaagtgctaaaagagcaaagcttaaagttagagctatctttttcccctctaaaagtcactgacacaaaagaaaaagatgaacaaagaactgtgaaagtatgcgttggatgggagcttccagaagttatgtgttactttgctaaaaatcacaaaccacaaaaaaagtcttaatgtcacccctattgagaggtcagtgctagtttggcagtcactgaaccttgattttaacatgtatatgtacagagagaaagttaaagctagagaactcgacatagatgtgcaatgtttctaaaatagtttaaagaatcttttgagaatattgttgaaaaaggaataagaatggcagaaaaatatttgttaaggctttatttctatcctaatagactgggaaatacagactttctcataaatataattaactatgtaaatatcaaactgattaaaagagttcactgttattttaataattgtagatgaagtttcatgttccttcagaaatcttgctgattataggaaaatgtatcaatacattgatttatcaaaatatcaaaatttatcaaaattcattaatcaccttttaaagagaaatttttagggatatgttttgaacatttcccatttagaatgacagtattgactgcaatgtgtgtactatgaatatgtttgaatacctagatatgtgttcgctggatatatctgggagaaaagagtctactttatatttattcagaagacatgatcatgtggatttgggaagacgtgggaacatggaaggttatttcttcaacctttttatcttatatgaatcattaatgctttaggattccataatgttcttagcttatgaaggtcattttctagcattatcagatgcaacaacattgctttatgtaggtagaagaaaaaaggaaaaatggtgtttctaaaagtcctgtgtgccacttagtaagtaaagcc

SEQ ID NO: 472725 - DNA, 809 bp, Homo sapiens
agggtccagtttcacagagtggagagagtgaggaggcctgctctgacagctgttacagtacattgagctccatagagacagcgccagggcaagtgggagccggatgagcactgggtgactctgtgcctcactgaggaaaaaaataactaaacatgggcaaaggagatcctaagaagccaagaggcaaaatgttatcatatgcatttcttgtgaaaacttgtcagaaggagcataagaagcttcagtcaacttctcagagttttctaagaagtgctcagagagaggccaggtggaagaccatatctgctaaacagaaaggaaaatctgaagatatggcaaaggcaaacaaggcccgttatgaaagagaaatgaaaatctatatcccccctaaaggggagacaaaaaagaagttcaagtccaatgcacccaagtggcctcctgcagcctcaaaaaagggagtcatcaaggctgaaaaaagcaagaagaagaaggaaggggaggaagatgaagaggatcaggaggaggaggaagatgaaggtgaagaaaatgatgatgaataagttgattctagtgcagtttttttttcttgtctaaaaagcatttaacccccctgtacaaaactcactcattttaaagaaaaaaaaattgaaatataagactttaatgtaaggttttaattatctttaaagtttttatgttttcctttttatcctgtaatttttatttaatattattttatgtcatacttatacatacagatttcaacaaaagaactgtcactgtctgcatttcttttctatgtaattttt

SEQ ID NO: 472726 - DNA, 1036 bp, Homo sapiens
ggtcttttgtggtttgtgatgcgttcatgggtgttggtctggcctcctcaccaagaccacatcctcacaggcaggtccttcacgacccaccgacccaccggaaaagggcagaaccagcattgggcggagtcagggaagtgcccccaccttgcccaaggggcgctctcctagcaggtcttgcacaggcctgagagggctgcccagtggatgccaggactgggctgaacagctgcagtaacctgaggcactgattttatctaacaaataggcctgtccctgactcagcctgctcaggtcaggaggcttgcggaaatgcgccagctgcctaaacagatacgaaagctcttatttcatcaccaaaacatcttctgtaaggcggtgttgagctccgacacgaaaaccaacttggataagatcctcagggctagtgccctttccaccatccaacaccaagctcttgtcagtgtgcctcctgtcacctgggagagctgcactggaaggtgcccatgtgatgtggagccaaccctggcccttgtggatgtgctgactctggccacacagaagctggcgctaaattcctgggggtctgggaaaagggagtacctcactaaggatatcaaagccaaaacttggtcagaaacagatttgactttcacttataatccaaaccaggaattccctggaaataagatcacaaatctagggggaatcctgcttatggatattctgggtgattccaaaaccttagttattggaaactctgattccaaacttgaatgtttcttttccatgcatgctctctcatcctgtgggcaagaatcatgatgaatttactgtttttagagcttattactactctaatgtcaagccaaggtatatttaaaaaaaaaaaaaaaaaggtttgccatcactcatgtgatattctgttctgtcagggacttctgtcaaaccatgattgttggaacagctttgcctctctggaaagcagcttgctagagagacttgcggtagagagggagggtcatggccagatgcc

SEQ ID NO: 472727 - DNA, 592 bp, Homo sapiens
ggtgcctcgagctctctcagagaccacatccaggttccctgtataccagccccaggatgtacacacaccataaacaagagggactgagggctgtgctatgagggctacaaaagatgtgcacatccagacccttgccctcaggaaagtgtccaatgccagctgtgtctgcaacaggctggtggaggtgctgctgagtgtgggaagtctggagtgcggagaaggcgcccagagagacttcctggtgagctcttcagaggaaggagcaagtgcaaaggcgattgcagaagccaagggatcatcttttcctcaacatgcacagccagaagaagaatctcagaagctgcatgaaaggggtcccgatccagatcccaagagagggttcttggatctcacgcaagaaagaattcaggaccatatagggtaccttcctgatgttgccatggcatttgcaaactgtcatggcgctggtgggagtgcagcagtgaggacgaccagaggtcactctcgtcgccattttggtttcggtgggttttggccggctcgtttactgtgacctgttttaacagcaaggtctttatgacttctattttgc

SEQ ID NO: 472728 - DNA, 659 bp, Homo sapiens
aagaatttacctccaacttcttgctatggggatctctcagcccctgcaggaggccctcaggacaacatccatgatgacccaagccagggtgtctttccttatagtccatcgttacaatactgcacagcccttgccccaacaaaccaggggtgctggccggccctgccaagacagcaatctgctgacccggcttccaaagcagcagtcttctgcccttcagcagaggcagcaatgtggtcaaaggcatggattccagggctggccagacctagatttgaatcccagcactgctgctgatgagctgtgtaatcttgggaaagtacttcactccctggaatctcaggttctgcctcagcaaaatgagggtattgctcacctcacattgcacagtcatagtaatgagccctttaagagcctcgacacttctggaaagcagcccgtggagctgcttcagcaccgagtgggtctgagctacaagagggagagacaacttcaaaaaaaattgttttaggggcccccaaaatttcagatgaggacactatgaagattttgagtcttgcaagctgtgtgattaaaatgatcaagtgattaaaatgctgttttaatgctattataaaatggtattttagtttggacacatccttagaaagactccttcc

SEQ ID NO: 472729 - DNA, 710 bp, Homo sapiens
caccatatagctgctgtaggggatgaggaaggggtggcactggcaattcaaaatgctttcctaccctcttcaaaaagaaggaagcagctcacatcctacctcgtccatactccagtcaggaccagctcagaaccgggataaacttttcagtgaagggaaagcccagcagagggaactgcctggtgtccatatggctgcacttcttccagaggagtcaatgctgtgctctgcccttcatgggctgctactctgctgtgccatgttagatccagaaccatggctggaggaagtcctgctcgggagagctgggccagtgctgcccctgaggagcaggggcagagtcacagcaacaacccagccccctaggcctgagcagctgaggtatgcaccagagtcacagaccttagctttatggcagtcagcacctacctatgcctcagagagtgaacatgtgtccaaattcccaggtgccacagtagagtggtgaggtcctgagcacaggaccctggctccacagctgctctgagcatctcctccctgaaacccagtgccactgcagttgcttgtggttcatgtcagacttgataccaagaaggatcccctcagtaaagactccccattttggggaaaacaaacacaggaggaccctaaaagcccttgccatggaggacactaatggcatatgctgctgatgccactgcaacaaactt

SEQ ID NO: 472730 - DNA, 586 bp, Homo sapiens
cgagtatctggatatttcagttaaaggtgctgtattcacgcacctctttcgttcctctctgtgaatgccacagaccgcagctgcttctaatcagccatcttgccatttttccttgaataaactttccttgtattgctgcaagcctttgcttaatttccaatgttctgaaaaatttgactctgaccatttttgtcagtgttctcactgcttgtatagagatgattttccacgatcctcacttatgcttttcactgatacccctccacagattctttcaatggcatttatcttttccttgacatcaactcttatttttccgaacactgaaaaatctaaagccccaaatagtttatacgtgctctgttttcaagaagtgagttttctgagatgtatttctggaaatactgtccctgttgctgctgctcagaaatattataagaaaaccacacttaatattgcaacaacaaaaatttaacccattaactacaaactctcttcatttttcctccttcaagttgctgttttgtgtcttaaactgagccagtcatatttgagcacatatttatttagagtgatagactcattt

SEQ ID NO: 472731 - DNA, 713 bp, Homo sapiens
cggccaggcttctaaacctcttaaaactccccaactctggacacctctactccctccttggcaatggatgatgcaccccttaccatcccattaaaacctaatcacccttacccctctcaacgccagtatcccatcccacagcatgctttaaaaggattaaagcctgttatcactcccctgttacagcatggccttttaaagcctataaactctccttacaattccccattttacctgtccaaaaaccggacaagccttacaggtttagttcaggatctgcaccttatcaaccaaattgttttacctatccacctcatggtgacaaacccatatactctcctatcctcaatacctccctccacagcccattcttctgttctggatctcaaacatgctttctttattattcctttgcacccttcatcccagcctctcttcgctttcacttggactgaccctgacacccatcaggctcagcaaattacctgggctgtactgctacaaggcttcacagacagcccccattacttcagtcaagcccaaatttcttcctcatctgttacctatctcagcataattctcataaaaacacatgtgctctccctgctgatcgtgtctgactaatctcccaaaccccaatcccctctacagaacaacaactcctttcctttcctaggcatggttagtgtggtcagaattcttacccaagagtc

SEQ ID NO: 472732 - DNA, 694 bp, Homo sapiens
cccagcaggccttcgcaacatgaaaaacagcctgggagcaatgggggggggaaaaagatttagtgatgatgacaattttgaactgttctatcacaccctgcgtgtgtatggcatttacaaatctcttactgcttgttcttttcatagctcaatccctggcacagggatggttatttgcatagcacaattgttgttattgtgctgcctcacatattctttctgccctgggcaaacgcgaacaatgatggactatatttatgaaaccagcagcttagaagcacgagcttcagattaccatgagaattgtagtaagattttaaaatacagtttagcaccatctatatggaaagcccatctctcaaagtctcatgcaaataaactggccctttgtgtattcagagagttcctcagtttttttttccatagtttcaatcacttcacatttctcaactttctagatgctgacttcacagacacgcagtgttcatgaagcgttgatatgacaactgcctctaaaagctagaaaataagaaaataaaagtagttttgatttcctttaaggatgggttggggaggggggttggagttagagtaggatagaaagatgattggtgacaaagctgtttatgatttaaggtcttctctttaggctcatcctggatttagggctatcgtaaatccagagcctcatctt

SEQ ID NO: 472733 - DNA, 735 bp, Homo sapiens
tctgcagtggacctccagcaagctgcaacagacctgcagctgagggacctgactgttagaagaaaaactaacaaacagaaaggaatagcatcaacgtcaacaaaaaggacatccacaccaaaacccgatctgtaggtcactaacatcaaagaccaaaagtagataaaaccacaaagatggggagaaaccagagcagaaaagctgaaaattctaaaaaccagagcgtctcttctcctccaaaggattgcagctcctctccagcaacagaacaaagctggatggagaatgactttgacaagctgacagaagaaggcttcagaagccaattcgatcaagtggaaaaaagggtatcagtgattgaagatgaaataaatgaaataaagaaagaagagaagtttagagaaaaaagagtgaaaagaaacgaacaaatcctcaaagaaatatgggtctatgtgaaaagaccaaatctacatctgattggtatacctgaaagtgacggggagaatggaaccaagctggaaaacactcttcaggatattatccaggagaacttccccaacctagcaaggcaagccaacattcaaattcggaaatacagagaacaccacaaaaatactcctcaagaagagcaaccccaagacacataattgtcagattcaccaaggttgaaatgaaggaaaaaatgttaagggcagccagagagaaaggtcgggttacccacaaagggaagcccat

SEQ ID NO: 472734 - DNA, 3615 bp, Homo sapiens
caattttcacctatgctggtttatgacctagttagagaagacatcatagggcattatttagatcactttgccagctgtgtggaggatggatttgagggagacaagactggaggcagtagtccagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaagaatgtgaaacactgaactactatcttcatgcagaaagccttgctccaaaaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaagtgccaagcacatcagcaaattgagatgattaaccctagtgccattgctgacaatgcagaggaagataccatggaggtagaagaattcctgaaagaagctgcagtaatgaaggaaatcaagcatcctaatctggtacaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccatagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctgggcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccaggtatgggtcccttagcagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcaga

SEQ ID NO: 472735 - DNA, 607 bp, Homo sapiens
aaagaaccataaacaagtatctcattgttcctttctagtttctgaatactgattgacaattggcctaatcatggtgatttctcaagatctcaagaaattcctctcaaaacataatggaggccaaatggccacagtgagaaattgctgtcaaaatggaggagagctggtttctctggccctcatctaccagaagcatctctgtcccctggcgttcttgccactcacaatacctggtatggtacttctgaactgtgcagaacagtatctgaggtttactgttgatgacactaaagcaatagacacagatgacatgtatcacaattctgctccaaatatggtgtggtctgaggacagtgctgtgcctggcctttccccttcaacacgccagctgctccctcagagtgaacagggctttgctactctgctcaggtcaaaagtagttggaaaaccagaactctatccaaatgatatagatatcttgactgttaagagttggagacgtttcagaagttctcacatactcctacggatcccagactgaagcaggaatttacaaaggaagtgagctactactggcttgatacaagctaagacagagacacaaacc

SEQ ID NO: 472736 - DNA, 1097 bp, Homo sapiens
aggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagccaaagacactaacagatactttgattcctgaagaatttcatattgtgtcaagtacaggagtttcaggtttggagtgttatgatgagaaacctaataaaagagtagaagtggcccagctgaatgatgtgatggatactatgctagagagggctggtgtggaaaatcaggaatatacaggaccaacgaagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaaaaccagtcttcaagttctgagattctttcttcaacttggtttattctgctattaatacttcattttgaatatatcattcaattctttcctggcttaaggtttctgctgagaaacccattagtctaatgtggattcccttatgtgtaacttgatgtttttctcttgctgtttttagaattctccctttgtctctgacttctgacagtttgactgtaatatgccttagaaaatatctttgtgggttgactgtcccacagtcaaatttgggaatttggcaagttgtttataaaacccatctggaagaatctgaatatgagaataataaaacattttaaaagaagattaataaaaataacttgtacttttagacatcaaaatgtattataaagtcaaagtaactg

SEQ ID NO: 472737 - DNA, 794 bp, Homo sapiens
gagctgctttcttgatttcatcttcagattttgtccccaggttatgagggttgatgtcatcgtgacccttgtcagccttctctccgtctttgcactcaggctcagctggctcatggctcgtaccggagggaccgggcccatgatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggtggagagagcgtgtttaaatctgttaacgttgagctggctgccaaagatggtgacaccagtgaactccctggagacttgttgaatggctttgaacaagatgctaataatgatatggacaatgaaatccaggctaaggtggtctcagatggagatgaggaacttcttgggaactggagcaaaggtgactcttgttatattttagcaaagggactggcagcattttgccccatcctagagatttgtggaactttgaacttgagagagatgatttagggtatctggcagaataaatttctaagcaacaaagcattcaagaggtgacttgagtgctgttaaaggcattcagttttaaaagggaaacagagcataaaagtttgtaaaatttgcagcctgacaatgcgatagaaaagaaaat

SEQ ID NO: 472738 - DNA, 1465 bp, Homo sapiens
ttatatctcactgacaccagccaggtgcagagaggatgtggcgggcagcggggcggactgctagaggcacatcacctgccgctgggctcatatgtgacaccctgtgagctcagggatgtgggggactggctgcctccagtagtagccagcatggacggcagaggaacatacacagccattgcttctggatgccagatctggcgcattctgcatccaaataacatttcatacaggaaccgttgccccacaccagggcaggaccaaacttccttaaagccacattttctgtggatacgtgcttacctgggcctggagaactggctgggattgagcagagtatacaccatcacgactccgggttggtgggcccagcgaggtgaggattctcatgtgagtcttggagagaatgctcatgtgattaacatcccggctgatgcagatgagtgtaccagtgatggaaacatgtgcttgtatcatgatgaaatgcagattagaggccctggagccaacccaaggaaatcagcccaaaactgtttcatctctgtcagttttaatctgatagaaagaaagcatgctttaatgcagcgagaaaaatatgaatgcctgatataaccaagtggcactctatcttccattgagatgttatgaaaatactcacattgtggtatagtagaaagtatactggagtataacttaaaatacctgaattaaaatttcatcttggtcactaacttatgctgtgagatctctcccagggtcttaagtttctgtatctgtaaaatgaatgttctgggttagaccaagggttttcaatagaattctccttcacaattcaaataaaaataatatttacacactctcgtgagcagccccagggttgtacacaattacccatgtactatatatatagctcagtccctttccttctgctcaagtaagcatatcagaagcacatgagtgagactgacattttaagataaccttgaatcctattctaattcatttaaaacattaaaaaagcaaataatttggaatattgggtacatcactaataattcttaaaaggtgatttgctacacaattcccaaaaagtatgttacaaaacttgattcaattatctctaaacgattttaactgtcccttgtgatacagatattattctatatctctatgagttaatcaaggtaccagtaaagtccaaagcatcgagtctttagctatttggaataaaattacaaggagtacatttttgtaggtaggcctcactttggtgggtattctcatttccccttagaaaattgtggcaatagtaacttcttgattcttatgttgatgtgctaagcagaaccgtgtttctaaaatgaagtaataacatgtcacttaaaataagatggaatactttttaaaaattcaacacatatagtacttgactaaaacagtagtgagtcatgttttgagatatctc

SEQ ID NO: 472739 - DNA, 705 bp, Homo sapiens
gtgacatccactcagaggtccctttctctcaggaagctcgtgttccctcatcagagcagtacgaggtaggtgaggaggagtgggggcggggcggggtggggcgggggggcgggcagggctgcaggccaaggggttgcctgcggatgctctgggcctctgtcctgctggtgctgagctccctggtgtctcttgctggttatgtctacctggactggatcctgttctttgtgctctatgatttctgtcttgtttgcataaccacctatgccatcaacgtgggcctgatgtggctcagtttccagaaggtccaagaaccccagggcaaggctaagagcattatacatttgctgctgcatgcagaatacacaggagaggagggaagagaagggggagaaacagtgagtggaagagctgagaccggcttacactgtgggcaaatcaaagctctcttctccctccatgacctacttctccctgccttactggaggccttatgtgaggattatacaaaagactacatggaaagcatttggcaaagtgtcttgtactgagaaatcaaacattcaataaatgtcagctacttttgaggaggtggatgatatttttctctgtattcttaacagtaccatttcattccagctgctctgatgagagatctgtagctactctgtagattcatgtcacacctttgatgggtcaaatgaa

SEQ ID NO: 472740 - DNA, 579 bp, Homo sapiens
ccagaagaagagagttcagaaaggttcttggtcataggtgaaggggagtgtgcctgccaagttccttgtaataacttcacacgcagagtattttctgaaatggatctgctagagtcatctcatggaatcttctcattcttctggagtctcctcattttacagacgctgaaggaaaaacaccagctgaggaagaatgaagaactgcctgttctaagttattctccttctgtggtcattcgagcaccaggaagaccagggtacacgtcgaggctccaagctggaatgaatatggccttcaacatactctttatcatacagaagcttgtgttcagggcttggattttgaagtcagacagacctggattaaaaaccaattcaactacctattacatatgtgacctagaagacttaaaagcaggtctgtttttaaatacaccacatattgaactttccccactatgggaggcaggccaagtagtgggttttgaaggttttaaaggctcactggcccttcaaaaaatggctgttgtggacatatggttttagaagcttttaaaaaagccttgtgggcttattttt

SEQ ID NO: 472741 - DNA, 729 bp, Homo sapiens
tacattctagcagggagggtggcattggacaagtagccaggaacatgatgggaagaaattcgtttctaccaaaaatggattttgctggagatcttatcagggagacagaagaggaagtggaggctttggggctgacaaacggtacaccggaaaggagaggggagagcctgccaggagggggtcggcaaagccagttccctcaaagcattgtcctttccttcctccaacaggatgccaggagccccacagaaaagggactcatttgtcttccttcccagcacaataacctgttgctggcctttctcttgggccttgctcagagcaacaggatacagtctttgccaggggagaaggaaggaaggaaggaaggaggggagggaaatgacaggagctcaggatctccagtccctagcctgggccccggagagacccagcactgtgaggccaggacccagactagagctgtccaggtccagtcggcctggtatgaggaacaatttcgttttacagaaaaccttaatcagatgtaagctgagtaaccgttagaagctgagctatcatttctgagcatatctgagtggcctctctccaacttttatcttaatctcatttagaaaagaaaaataaattgggtcaatttagaactgtaccttctttcctttttttattcattgttaaaaagaagaaaagaaggtatgcattggagtttgtttgtttgccatggaaaaa

SEQ ID NO: 472742 - DNA, 950 bp, Homo sapiens
ctaaaaacctctctatgggtccctgaccttgggtctcctgactgggggacaactcccagcacgggtcgagagacacatgatacaggagagctccggctggcatctagcacaagtccctctgggacgaagcttccagaggaaggaacaggctgcaatctttggggttctgcagcctcccctggtgatatccaggtaagcagggtctagagtggacctccagcaaactcgagcagacctgtagcagaggggtctgcctgactgttagaaggaaaactaacaaacagaaaggaatagcatcaacatcaccaaaaagaacgaccacatgaaaaccccatctgaaggtaaccaacatcaaagaccaaaggtagataaatgcgcgaagatgaggaaaaaccagcataaaaaggctgaaaattccaaaaacaagaatgcctcttctcctccaaaggatcacaactcgttgccagcaagggaacaaaacttgacagagaatgggtttgacgaattggcagaagtaggcttcagaaggagggcaataacaaactcctccaagctaaagaagcatgttctaacccaatgcaaggaagctaagaaccttaaaaaaaggttagagaaattgctaactagaataaccagttcagagaagaacataaatgacctgatggagctgaaaaacacagcacgagaacttcatgaagcatacacaactatcagtagccgaatcgatcaagtggaagaaagattatcagaaatgaatgatcaacttaatgaaataaagtgtgaagacaagattagagaaaaaagaatgaaaaggaatgaacaaagcctccaagaaatatgggactatgtgaaaagaccaagcctacctttggttggtgtacctgaaagtgatggggagagtggaaccaaattcagagccgaattctactagaggtacaaagaagagctgg

SEQ ID NO: 472743 - DNA, 793 bp, Homo sapiens
tgtgaggtgggctgctcagggagctacatgagcaaacagagccgtccactggtgaacaaggccatccctggctggcctgtctgtcactcacaataagccaggacttatctctttaggtatgtctgtgggagcccagaattatgcaccctcccagctcagtttcaatggtctccattgcattcagcgagcatataacctgtgggagtccagctgccctgaccttgaggtcagtgtcctgaaactcccatggtccaagattcacagactttggacctgctggggaaaacagcactgggggaaaatatctcaggcaggatgccaggaggaaacagatggcatgctaaggttggctaatgttggggctgtggctttccaattagagggatgtgccaattcctggtgtgccagctctccctctgactctgccgagtctccactgtcctatcagtgtagtccttacatgccagccttggaggcacagaagagagcaagaagggtagaaggtggatgtgaaggggcagtggaagatggtgagctcaaaagcaagcccagcagggcctcagagctgtttaattacacgaaaatgaaccacagaggcagcacactgaattaaaaggctcctgtggcagtttgtatattgtgggtgaatgacaatgggaaggtgtaatcaatttccatttcctgtcccttgctccctagcaacttcccacactcaatgactggcttgcaaatttgttttgctttgtggcagatgatatggatgctgagaggtgcgcccctgcccccaagtgtc

SEQ ID NO: 472744 - DNA, 4860 bp, Homo sapiens
agaggagactgagggtcagagcagcgaggggctggctccaaggcacacaggaagaggctgagggcagccctaggcaggtagccagatggagatagagttggaggagaagttggtccactgcccgctgactgggccaccctggcacccccctcgaggggagctgggctttcttctccaccttgctctatgggcctcctcctgtgggtctgaggcctttgccctccacacggggatggaatggggtgtggtgcaggactccttgtaggaggggcagtggctggctgtggggagaagtccttaggaagccccctgttctgagcatgctcctctgttcaaaatcccacagctacagtccctgagtgtcagcttgcttcgtgtccactctgtcttcatctccaggaaataaatgctctttgaggagtcttgtatctcctcagtgtctcttaaatccactcacttcttgccctccctcctggcactgccctgggccaagcttctggtcctgcttcggacactgaagggatctttctgaaatgctgactcacgctgctgtccttcagcatcgggctcctcattgctcccaagggcctctggcttccctagcatgccctagcaggccctccctgcctggactttagagcctcccccagctcctcagcttcatctttatcacaccccatccctggccctgccagactagactgcataaagaaaatgtggtacatgtacatcatggagtactatgcaaccataaaaaggaatgagatcatgtcccttggagggacatggatggagctagaagccattatcctcagcaaactaatacaggaacagaaaaccaaacaccacatgttctcacttcagcatgaaaacagactaatacagtatattggtaccagaagtggggtgctgctgaaaagatacctgaaaatgtggaagcgactttggaactgggtaaccggcagaggttggaacagtttggagggctcagaagaaaacaggaaaatgtgggacagtttggaacttcctagagatttgttgaatggctttgaccaaaatgccgacaatgatatggaccatgaaatccaggctgaggtggtctcagatggagatgagggacttgttgggaactggagcaaagtcactctagctgtgattaaaagatgccaaggtgtagctcgggctgtggcttcagaggtgcaagccccaagccttggcagcttccatgtggtgttgagcctgtgggtgtacagaagtcaagaattcaggtttgggaacctctgcctagatgtcagaggatgtatgaaaacacctggatgttcaggtagaagtttgctgcagggaccccagaatggtagacccatcgacagcttgcaccgtgtacctggaaaagctgcagacactcaatgccagcctgtgaaagcagccaggaggaaagctgtactctgcaaagccacaggggtagagctgcccaataccatgggaacccacctcttgcatcagcatgacctggatgtgagacatggagtcaaaggagatcattttgaagctttaagatttgactgccccattggattttggacttgcatggggcctcaggctacacaaataaatgatcaatgcacagaaaaacaaggccctctgaggtgtttgcccaagaccacttatgtgtcaaacagacttattagatgtgaagggaatgattatttgcacaaagtgaaatgaacatgtgcaataatactgtaaaatgtttattagtctagagtgtgctgaatgttcctaaaatatatcaggttctcagcttgcatttaatgtactgttataaatgatatcacatccttccaagccgattttccgcttaacgctaagcttctttgctggggaaatcgtgttttcagatcccaagtatgaaaacattgtggggttaaactctcccttctactccctaacccccaccccaatcagttacctccctataaaacttgtcctgagtctggctgggagggatagggcagttggtcaggccagatggtggttggaaaaggaaaagggggtcaatgagttattgtggtggggatattaggctggaagtccagtgattcagatttcaggatctactcactaatctcctgctgtgtgaccttggggtagtcccttcctctctccgagccttaataatctcagtcagaaaatgggaataatgtctaaagagactcccagagctgaacgcttacatattctaaatcccagcttgctaagtcatgagtctgaaagataaaaagagattctggaagtgaacaaataaagtgctacagaaacattcttatttttttctatgattctggccaattcttacttaacctttgaggccctgaccaactgtcccctcctctgggaagccttctctgacccgctaaccagctggtcagtctgtcatctttgctctaacagtgcaaaatccttgtgtcccttattgccccgccagctcatggtatcaccacatctctctgtgtgaacaggctcttccttctgttcagtggggaaagctctacaggaaggagaaagtggcttcattctctgtgctgcttagaccagcaggactctcctccctcagtgagtcgtctgcctccatgaatgcagccgctgagctggccagcttcctggcatgcatgtccagctgtcagcttgctctgaactgaggtccccaaaagatccccagacctgggtcaggcacagagctggtactcaggaaatgattcgtggatgctggatggggaggagccgagctagtgtgacccttggagcttatcccccacccaccccgcatgttaaagatgggagttttatcccagagtagggaagggattggctagggggctactcaggcctcttggagaagggtcagagagagtgtttcctataacatgtcaactctccacccaagaaggaggggtagaggagcccagccagatcccatgtccttggcccagaacgggggtgggaggtattggtagtgggcagttcttggcatcagctgagagcacagggctggctttggaggttgtggaggtggttggggatatggggggtttccagtttcctggctgagtcacgtccctctcctttcccctgcccccagaggtttgctcaaaggccccctggagggtgatcttctgtgagctcaactgatggtctggggatcttttggggatctcagttcagagcaagccgacagctggatgcgcatgccaggaagctggccagctcagtggctgcattcatggaggaagacgactcgttgagggaggagagtcctgctggtctaagcagagtggagaatgaagcccctttctccttccttcacagctttccccagaaatgactgaaagcaatctacatggaaatatatactaaaacgtgggaaaataaagttagaagtaagcattcaaggcaaagattaaaaagtttaggagggtagggtggattctggagtgaggcttctaagcagggatcctgccctaagagtttagtaaagtagtccttggaacacggaaagaagtgttcctgttcaagttgaaccccgggcccgagggatgggcagcagaattagcacccccatgttgcagatgcagatgcagaaacaaggctcagagaggctgtccaccttgcctctcctcaccacccaccaaggtcacataaattcaccagggacctggtggttcctggtccaggggtgagcttctgcaggttgaatgtacctgcagtacatggagtacatgtacctgcagtaaatatctagctcagtacatggactggggcctgccacaagggcctgctcaagtgttcctgcctgggctgaggtcttctgtggcccctccaggggcacactcaccttcctccaacctgccctgtgcctgaggctgacccgtgtgtcctatcagtgggctctgtggagtcaggcctccagctgggtttggtcactgtgaggtctttacatgggcaactacttttcagctttaaggtctcagcctgactaatgttttctcagaaagactttcccagagagaggggtcacctctagccaaaggtgtccccctcaccctggttgttctcaatcccatagccctagattagtttcttccttgtatctgtcagtgtttgcaatgtttgtctggctttctcctctggaatgcaagctccgtaagagccggggtttttatctgtcttgtttacttctgtatcccccaagcctaggacactgtctagcacacagtaggcacttactataaatgtttattgaatttgtaaatgagacagattcaatatgcaaaccagggagtagcataaatgaatgaatgaatgtatatattggcaagtaactcatctgaattaatggatgaatgaattgggcaaatgtgtgacaaatgaatgaacacattgacacagacatgcacctggggagaatgccatgtgaaggcgaaggcagggattggggtgatgcctctacaagcccaggactcagaagattgccggcaagtccccagaagctaggggagaggcatggaacagattcttcctcacagccctcagaaggaacccaccatacccatacctggattgtgggcttctagcctccaaaactgtgggacaatctgtttctgtttgtgaagccacccagtctgtattacttcttatggcagcccgagcaaatgaataaagtatgtctaggctttaggcttctagagctttagaggtgatgacctaccatgtacaggctttggagaggcagcacagtgtggtcgcaagagagtgggctggcagctggggacagtcccagctctgccactgacttgctgggct

SEQ ID NO: 472745 - DNA, 5360 bp, Homo sapiens
aggaggttcccagcagccttggtgagcactggctcctggcagctgataggtaccagccagactggggtgggtggagggggtgccaggaacgccactcatgcccttccgtctgtctgcgagggcccccagaccctttttcttggcaggcaaactaggagcacacccaatattccatcccagaatgaagcctgggtccttgagagggcagctgtccactctttgtctctggatgggactggactgctcctgtgtgctgtgggcttgcccatctccaggccttctcctaggctggccccctcccagcagagcttccaggcccatcctgatcctcagtgactgacaactttcaagatggcagttgctccagtagcccaggacctgagtgagcccccatcaactcttaatggccatgtgcggaagcgcaggccgaacagagtcaggatcggaagcacagagcagtggcctggggcagttcctggggcagaggaggaaaggaagtggagaggtcctgactaccagcaaggggagcccatccccctttccctggaggctcaggcacctgtgtgggtctccaggcttcccaggccccactaccacctcttcagcaaatcaacacttccaagcgtggagacaagttcagcatttgggattccctataccaaggggagaggcttggagagtctaaagtttctagagctctctgctgttaagagtctgtgcttccagacgtctcaggcagttggatgcacggatctgcagatcctgttattctaagaccaagtgactagggcccacagtaaccccttccacctcaggatgctggtggtggaacagatagagtccccggttttggccttgcccgtgctggctatgccgtgtgttaatgtggcccagcgtgtgagttcatctcagcaggttccctgagcgcggcagatgccgcctttgccgactcaccaccaaaggtgccttgagtcctctggggagtgtgggtgcttagagggccaggtctcatgtggggacggtatgagcttcagccctttccaagtcttggagtccggaagccaccaggaaccaaaaggatctttgcaaatcattgttttgcagcagtttcttctccagggcagccaaaatctggctgggtttcctctcgctggtatgtgtcctggttgccaccccctcactgacattgtactggaaatgtcttttcttctccaaacttgcctcccgtgcagggtgggctggcctggttgaaataaagcatgacgtacagagacctccagcaacctgtgctggctctgtgtagccctaaggttctgggtttccaaggtcccgtgattctagattttacttatctaatatcttgtgattctagattccaggacctgaaaaattcatgatgctacagtttgtaggattctctgactctagactgtcctgtactttcaagtctccagggtcccacatagggcctgacaccttgtaaatgtttaatgtttgcctgtatgattctctgagttgattacttggaaattctacgcatttccaaatttccaggactccccagatctgtagttggtcatttcatttagcatcaacagggaccaatctttccattttccaattgattgttgcagagacagcttaaaagaggttacaatgagtcagtgtttggggagtgggaatttggagttgggggggtggcatgtaacatagatggcccagttttttagctcatttcctctatttagaggtgggtggttgggtggagtcttgggggtcagcttttattggggcaggcttgtatacttgatagggtatggagggagtcaggattgatggcccagcatgcatctcaggacagcctgtgtctcaggcagggaggagctctaacaagtcacaggctggagccagcacaggtcttgggagatcctctaggtagttgctgtgcccccttgggactcttgtgaaggagatgggagctttctgggtctttagcccctcacaggttggactctctgggcatttgaggacaaaaggactttcagtgcttcccctgaagaaaaaacacgagtggcttctaggctatccttctactcctttttaaaataaattttcaacttttgtgggtacatagtaggtatttatatatttatggggcatatgagatattttgatatgtcttttattcttatgcaccaaagtttatctactgaacctcccctcccttggctcccaccagttgtcccagctccactctgccagccatttcccctcgccagccctgccagagaaacttatgtccactcagagcctctacaactctttatttttccatttcctttgactttgatcattttctgccttttattattttttctatagtttctctaccaagctctgaagtccctgaatgaataagctgtcattcattcactcacttactcattcacgcattcattcattcattccactggacgtccaaaatgccaggtcttttcctacactgtgatgacaccaagatgaataagacaggtccttgtttctaaggatttcaattctcaattaaaaagttgaataaaaaagccagtgattcttagccttttggggtatttgtccccttagagaatttgataaatgttttcaccagtgaagatatgcacaaaaaatattgtctactactcgggatgtttccagatcttcagaagccatgggtaccagggttaacagagatgaggagagcacctaataagtgtcggttcctgcagaaggtgccttgtttgtattgcctctaaatcatcacatccaccagtctctcccgctacccactgcagactgacacattggtggctcgggatgagcaaacataggcatgtatgaggggcacagctccccctggccatgcagccagtgcccagcagaagatttgtggtatctgggaaaaaaagaaaggaaaaactattaggtcttgaatgtaaaaccacgggacttttaaaaaaagtgtttatttttctgcaaaaaacccgtgaagttggtattgttactatttcacaaatggcaacactgaggctagagaatgtaagtcatgaagattccacagcagccaagtggtacagctgggacctgaacctaggtgtagccagattcccatacctgtgctttagagttctgttatttagtgtctctcaagtgacacttgagagacattaaatatgcaagttactcaacctttctgagccttggttttctgatatataaaatggatactgcagagtttttctgaggatccaatgagaagataggtgtaaagcaacttagagtagggcctgtaaatcgttactgtgtaagagtttgctctaataaaagtaattattagtgctacattctaacagacttgtgcttgacaacatggtattgagggacagatgaagaaggacattggtctttgtcctcaggttgtgcatagtctggttgcacagacaagccccacctatttggtcattaagtccttcattcacacatgtgtaccccctccccagcatgtgccaggcctcaggtcattgcagggctcccagagtgcccctctgcctggctaattcctccatctttcagcactgactcaggtgccatgtcctccaagaagattttcccaacccgggcttcacccccaacccccatctccaagctcctggtgctcccctctcccagtcttgtggtcatctactcctccgtcattcccatgccgggtggggactccggtgcctcaccctgaccctagcacatgctcagggagtttttgctgaacttctgtgactctcattttttcccctcaaggcagcattttgtttgtgagacttacacatattgctgtatgtaactgcggtttattattttcatttctgtataatatgcgattgtatgaatatgctacaatgtattaattcattctactgtcattggacatttaagttgttactggtttggaactgttacaaatactattgttatgaatgttcttgagcatgttttttgcttcacatgtccatgtatttatgctggacataaatacctgcctatgagtgaaatttctgagtaatagggcatgtatattctcaggtttagcagataatgccaaacagtgtcccaaagtggttataccaatttgagctcccacaagcaatacataagagttctaattcaaatcctctccaacactcattactattagttttgtttgttataaattttagccattttgatgggtgtgtactattctcattgtggttttaatttgcattttcctgaggaccaataaggttgaataccttttcatatatttattgaccatttggatttcctcttctgtgagttggcttttgaaatctctttttaactttttaattggttcacccttttcttgttggctactagaattctttaaatattctgaatcaatttctttgtcagttatacatgttgcagatatcttcttccactctttagcttgcctttttgctctcttaatcaagtcttataatgaacagaagttctggattttaatgtaatccaattcattaaagctttctatttatgactagaacttttgtgtcctctttaagaaatctttccctatgcctagttcatgatgatattcttctatgttgtctttattgcttcttgtttcactttagatctataatttgtttttaattgattttgtatggtgtgaggaaggaatcggttttaatcccctccctccctgcatattatacacatttgactgagtaccattcgtgaaaaagttcattctttctctaatgatctgtggtgtcatctttctctttaaagaagcccccatataagcacgagtctttctgaactttgttctgttgatctatttccctatccttgtggccaattagcaaaataatttctgtagggtactgtctctttgtaatacatttttgtatccacagaataagtcttctaatcttactattcttcctgaagtgaatcttggatgtttttagctctttgcattctatgtaattttagaatcagcttgtgaactttcataaagcaattgctgggaattttattaaaattccattgactctatagatcaaattgaggagaactgatatctttgcaacactgagtttttaatacgtgaatttgttatgtccttccatagggtttctttaatttctctcaacaatgttttatagtttttgatgtagagattgtacatgcctttaattagatttatttataggtaataaacattgtttagtactataatatctgtcacctttgaagtgtttggtaaagagatacagaaataaaattgaattttagattat

SEQ ID NO: 472746 - DNA, 1126 bp, Homo sapiens
gtcttccaccatgattgtgaggcctccccagccacgtggaactgcgagtccattaaacggaggtggcagtgatggtgatggtgatggtgatggaggtgatggtgatggccatgttggtggaagtgatggtggtggtagtgatggtggtgatggtgatggtggtggtcatgttggtagtgatggtgttggtgatggaggtaatggtggtggtcatgttggtggaagtggtggtggtggtagtgatggtgatggtgatggaggtggtggtggtggaagtggtgatggtggtggtgatggtgatggtggtggcagtgataatagtgatggtgatggtggtggtgcatgtggctatcgcagcagttgtaatggtgatggtgatggagatgatggtggtggttgtggtggtggaagtggtggtggtggtagtgatggtggtggtggtgataatggtgacggaggtgatggtggtggtggtggtggtggtagaagtggtggtggtggtagtgatggtggtggtggtgataatggtgacggaggtgatggtggcggtggtggtggtagaagtggtggtggtggtagtgatggtggtggtggtgataatggtgacggaggtgatggtggcggtggtggtggtagaagtggtggtggtggtagtgatggtggtggtggtgataatggtgatggaggtgatggtggtggtggtgttgtaagtggtggtggtgttggtagtgatggtgatggtggtggcagtggtgatagcgggagttgtgttggtgatggtggtggtggtggtggtggtaatggtggtggtggtgatggtgatgaaggtggtgatggtggtggcagttattatggtgatattgatggtggtggccatgacgggggtggtggcagtgatggtgatggtgatggaggtgatggtggtggtcgtgttggtggaagtggtggtggtgatggtggttttagaagcagacccaaactggtttctccagcctcctggcaattctgtaagccaaccaagtatgtgcgcacctgttaattatgtatgtatgtatgtatgtatgtatgtatagctttaaaagtacactttattgaggtacaagtcaatgaattttgaaaaatgtgt

SEQ ID NO: 472747 - DNA, 696 bp, Homo sapiens
aagctgagggtcgaagagcacttgtcaggcctgtgaggggtattcagacatcctatggggaactgctgtgtctgggtggaaccagagattctgcctgctttagcagcctttaccagctgctcctctttggaggctgttagaacgcaggacgtcagaaatgaaagtgccccaggtcttcagctggacagctcagctctgccatgaacagcgcaaagatggcaatgggctgcgagagcccactgagtcccagggtccccactgcccggcagtccggggacagaactgcaggggcccccaggtgggtagccaggatgaggtgggcagctcaagctcagaggctctgtccagcttggaaattcttgggtggaaaggagatctgctgtgcagagtgggccatttgttccaggcatggctgagccaggagaagtggcagctgccagcaggatctgcacgtggctccagatctgttgtttttggagagtggattcatgagagcggaggtgagtctccctttgccctgactttactgctggcctatccttataaattcaccagcccagaggagaacaggatgggagaccctggtcaacgttcatttcttcactcattcattctttcattcactcagcaaacttaaagcctattacatgctaccaaagacacagcgatgattaagtggtgccccacctctgaggc

SEQ ID NO: 472748 - DNA, 1629 bp, Homo sapiens
catctggcataattttttttccaagatggccaaccacactggaaggttggatttcatcctcatgggactcttcagacaatccaaacatccagctctacttagtgtggtcatctttgtggttttcctgaaggcgttgtctggaaatgctgtcctgatccttctgatacactgtgacgcccacctccacagccccatgtactttttcatcagtcaattgtctctcatggacatggcgtacatttctgtcactgtgcccaagatgctcctggaccaggtcatgggtgtgaataaggtctcagcccctgagtgtgggatgcagatgttcctctatctgacactagcaggttcggaatttttccttctagccaccatggcctatgaccgctacgtggccatctgccatcctctccgttaccctgtcctcatgaaccatagggtctgtcttttcctggcatcgggctgctggttcctgggctcagtggatggcttcatgctcactcccatcaccatgagcttccccttctgcagatcctgggagattcatcatttcttctgtgaagtccctgctgtaacgatcctgtcctgctcagacacctcactctatgagaccctcatgtacctatgctgtgtcctcatgctcctcatccctgtgacgatcatttcaagctcctatttactcatcctcctcaccgtccacaggatgaactcagcagagggccggaaaaaggcctttgccacctgctcctcccacctgactgtggtcatcctcttctatggggctgccgtctacacctacatgctccccagctcctaccacacccctgagaaggacatgatggtatctgtcttctataccatcctcactccggtgctgaaccctttaatctatagtcttaggaataaggatgtcatgggggctctgaagaaaatgttaactgtgagattcgtcctttaggaaattataaagtaggaaatttggatataaagatttattttccttttctctacccatcagatacttaggattttatccctgttattccttagactctcatacaatgatgcctcatctcatattcatctcattttgaggaattctttcactgtgtggaaactctattttatagtctttgtccatccaaaattcttttacaattgtgttatactaatgtaacatttttggaagttgataactgttctctaattttgtgaaaaaatattcttaacctcaggaaatacttaatatttagagacaaaaaggtcatgaggtgttcaaatgatgagagggaaagagggagggagatagagaggggcaatgaaacaaactgagttcaatgttgctgccacacatgagtatgggtaaagggtatataggtattaattgtactattgttttttaatgatttttgtgaagttgaaatcatttacaaataattaaataccaggcttttctccctttttgaaaatattctcctttctgcttggtggcagtgtgacatcttagaaatcatgctcatttcattatatctaatcattaccgagaaaatccagtcatcgccccttctttattgagggctacatttttctgcatggtccaattctgatggcgtctagtggatttatctctcc

SEQ ID NO: 472749 - DNA, 1385 bp, Homo sapiens
tcagttaaggcaggaacaggccattttcacttcttttgtggtggaatgtcatctgttaaggcaggaaccggccatctggatgtgtccaagcttcatcatccaccgatgcccaattcaaccaccgtgatggaatttctcctcatgaggttttctgatgtgtggacactacagattttacattctgcatccttctttatgttgtatttggtaactctaatgggaaacatcctcattgtgaccgtcaccacctgtgacagcagccttcacatgcccatgtacttcttcctcaggaatctgtctatcttggatgcctgctacatttctgttacagtccctacctcatgtgtcaattccctactggacagcaccaccatttctaaggcgggatgtgtagctcaggtcttcctcgtggttttttttgtatatgtggagcttctgtttctcaccattatggctcatgaccgctatgtggctgtctgccagccacttcactaccctgtgatcgtgaactctcgaatctgcatccagatgacactggcctccctactcagtggtcttgtctatgcaggcatgcacactggcagcacattccagctgcccttctgtcggtccaacgttattcatcaattcttctgtgacatcccctctctgctgaagctctcttgctctgacaccttcagcaatgaggtcatgattgttgtctctgctctgggggtaggtggcggctgtttcatctttatcatcaggtcttacattcacatcttttcgaccgtgctcgggtttccaagaggagcagacagaacaaaggccttttccacctgcatccctcacatcctggtggtgtcagtcttcctcagttcatgctcttctgtgtacctcaggccacctgcgatacctgcagccacccaggatctgatcctttctggtttttattccataatgcctcccctctttaaccctattatttacagtcttagaaataagcaaataaaggtggccatcaagaaaatcatgaagagaattttttattcagaaaatgtgtaagaaacccgagaggctcaccctaggctgttttgtgatattcatgttttcaggaataagttgtaataattgattgtggttattagataaaattggtgtaaatttaataaataaggctactaaaatgcatcatgtatcaaaatcgatatttcctttcaaaagtttttgaataattttaatatgccattgggtaaaaaaatctggtgttatgaagaagacaattctaatagtacatgttttcaagttaatgactcactaaaaaaaatcataaagcctaaaatattatctttaaaagtattttgtgttaaagttctgttctatattcatccactcttcaacttttg

SEQ ID NO: 472750 - DNA, 2346 bp, Homo sapiens
acctacacctcgctcccgtgctggatgattcctgccctcaaactgtcccgagttcttcaactttgggactcgaactggcttccttgctcctcagcttcagaggaccgactgtgggaccttgtaacaggcatattcatcatggcatgggagaatcagaccttcaactctgacttcctcctcctgggaatcttcaatcatagccccacccacaccttcctcttctttctggtcctggccatcttttcagtggccttcatgggaaactccatcatggttctcctcatctacctggatacccagctccacacccccatgtacttcctcctcagccaactgtccctcatggacctcatgctcatctgcaccactgtacccaagatggccttcaactacttgtctggcagcaagtccatttctatggctggctgtgccacacaaattttcttctatatatcattgcttggctccgaatgctttctgttggctgttatgtcttatgaccgctacactgccatttgccaccctctaagatacaccaatctcatgagacccaaaatttgtggacttatgactgccttctcctggatcctgggctctacagatggaatcattgatgctgtagcgacattttccttctcctactgtgggtctcgggaaatagcccacttctgctgtgacttcccttccctactaatcctctcatgcaatgacacatcaatatttgaagaggttattttcatctgctgtatagtaatgcttgttttccctgttgcaatcatcatcacttcctatgctcgagttattctggctgtcattcacatgggatctggagagggacgtcgcaaagcttttactacttgttcctctcacctcatggtggtgggaatgtactatggagcaggtttgttcatgtgcattcagcccacatctcatcattctcctatgcaggacaagatggtgtctgtattctacaccatcgtcactcccatgctgaatcctctcatttatagcctccgcaacaaggaagtgaccagagcattaatgaaaatcttaggaaagggcaagtctggagattgagttacctcataaatttcatgttttgctgtctgctaacgtcttctttttattgtctctctttttctattaagtcctaaaaatatcactaattgtgtgcattgctcaacatattgatgggtaccagtataatttatttcagataaactattttagattttttaatattcaattcagttatgactacaatataaggcattttcaataaagacattccatttttatttttaaatttcattatcattttgggaaacacatagtgtttggttacattaataagttctttaatggtgatttctgagattttagtgcagcgatcaaccaagcagtgttcgctgtacctaatgtgtagtcttttagccctctccagtccccaacatttcttccaagtccccaagtccagtgtatcatttttatgccttggtgtttcatagcttagctggcacatatgagtgagaatatacgatgtttggatttccatgcctgtgtgacttcactttgtataatagtctccaattccaaccaggttgctgcaaatgctattaattaattcatttttatggaagaatagtatcccatggtatgtatataccaccttttatttatccactcattgactgatgatcatttaggctgattccatctatttgcaattgcaaattgtgttgatataaacatgcaacatatgatcatgtgatttttctgtttaattctgtttatgtggggtatatcacattgattgacttaggaacatgaattattcttagatttggacatttaacacagttcaaaacttcttggcggatttttcattatttaaaattcttttttctttgtcttggatggattggtataattcaaaaacatcgtcttcatctctgagggtctttcgtctgcttgttcaattctattggtgagactttcccatgcattttgcatttctctcagtgttttcttgatttccttgaagttgttattgttttttattcatgctatttcactgaagaattttcctttcatattcatattctgcattatgtttttgatttctttaagttggacttcacctttctctgatgcctccttgattagcttaataaccttctgaatttttttttctggcaattcagagatttttatcttcgtttggattcattgccggcgagctgctgtgatcttctgggggtattaatgaaccttgctttgttatattatcagaattgtttttctggttccttctcatttaagtagactatttcagaaggaaaatcc

SEQ ID NO: 472751 - DNA, 1443 bp, Homo sapiens
gcgaggcccccgtgttggtgcgtttggcttgtgctgacacttcagtcttcgaaaacgccatgtacatctgctgtgtgttaatgctcctggtccccttttccctcatcctgtcctcctatggtctcatcctcgctgctgttctgctcatgcgctctacagaagcccgcaagaaggcctttgccacctgctcttcacatgtggctgtggtgggactcttttatggagctggcatttttacctatatgagacccaaatcccacaggtccactaaccacgataaggttgtgtcagccttctatactatgttcacccctttactaaatcccctcatctacagtgtgaggaacagtgaggtcaaggaagccctgaaacggtggctggggacgtgtgtaaacctaaaacaccagcaaaatgaggcccacagaatgggtgaaaattacacaagtacatgtagtcgtggaaatttcattactcataccaggttcatgcaccatcagagaaattattttagaacacgttgagttacaaatgcttgaatgttattggtgtatagaaatgctattgatttttgtctgtttattttgtattctgaaactttgctgaagttatcagttctaggagccttttggctgtgtctttggggttttctaggtatagaaccatatcatcaaagaagaaagataatttgacttcttctttttttaaaacattttacctcccccaactagtgtgagtgatgatggagaggtcgtattactctccatcatcactagcatttggcatttgaatatttttaattttaatccttctagttgtggtatctctatgtcattttaaaatattgcattacctggagaataatgaagttcagcaccttcttagatgcttacctgtcattgatatatgttattttaagaagagtatctttatatattttgccaaaatatttttgtttttatttatttcattcagtttaaatttttttatttattctgggcaaaaatattttgtcaaacatctgtactataaatattttttcctcccttttggctagcctgtttattattttaatggtatgttttgcacagcagagatttttatttttgtaaagtccaatgtataatttttttcatagaattagtgggcttttcttatgtattttctctacaaaaaaaatacgcttcaagaattaaagggtagcgtcttattttttagtgctttatagatttattatttatattagtccatagatcaattgagagagattagtggtttttcaagtgtatcattatttaggcaaaacatgttatctacatattaatttttctatagtatatctaagcaaatttttatggaatcaaacataaacatcttgcatagattttcatatatttatttttatgcattttgttatttggtttaatcaaaatgtttatttaaaaa

SEQ ID NO: 472752 - DNA, 1428 bp, Homo sapiens
actaggtaaaaagcatacacatcatggcaagggagaattcgaccttcaactccgacttcatcctcctgggaatcttcaatcacagccccacccacaccttcctcttctttctggtcctggccatcttttcagtggccttcatgggaaactctgtcatggttctcctcatctacctggacacccagctccacacccccatgtacctcctcctcagccaactgtccctcatggacctcatgctcatctgcaccaccgtacccaagatggccttcaactacctgtctggcagcaagtccatttctatggctggttgtgccacacaaattttcttctatacatcactgcttggctctgagtgctttcttttggctgttatggcttatgaccgctacactgccatttgccaccctctaagatacaccaatctcatgagccctaaaatttgtggacttatgactgccttttcctggatcctgggctctacggatggaattattgatgttgtagcaacattttccttctcctactgtgggtctcgggaaatagcccacttcttctgtgacttcccctccctactaatcctctcatgcagtgacacatcaatatttgaaaagattcttttcatctgctgtatagtaatgattgttttccctgttgcaatcatcattgcttcctatgctcgagttatcctggctgtcattcacatgggatctggagagggtcgtcgcaaagcttttactacttgttcctctcacctcttggtggtgggaatgtactatggagcagctttgttcatgtacatacggcccacatctgatcgctccccaacacaggacaagatggtgtctgtattctacaccatcctcactcccatgttgaatcccctcatctacagcctccgcaacaaggaggtgaccagagcattcatgaagatcttaggaaagggcaagtctggagagtgagttacctaataaacttcatgttttgctgtgtgctaaatcctttttttaaatggtcctatttttccattaagccttgaaaatgggattcattgtgtacataaatctgcaatgacatatttatgtgcacctatataatttatttcagataaactattataactatttattattttatattcatttctgctatgaccacaatgttttttttcttgtcttgaatgaactgggttaatttgaaagccttgtcttcaagctccgaggttctttcttctgctcgttggattttattggtgagaatttccagtgcatttcacatttctctaagtgtgtccttgatttttagaagttgtgagtgtttttatttatgctgtttatttcactgaagaatttttcttttattttctgtatcatgatttttatttctttacattagacttcacttttctttggtgcctctttgattagc

SEQ ID NO: 472753 - DNA, 1007 bp, Homo sapiens
caccatgtaaagggagcacccagtgggtcaaagaaatctgaacagcaacatagtttaccaaaatgagaagggaccaggaaaacaattctggtaacgtgacaaaacaagattcattaatacccccagaagatcacagcagctcaccacaaatggatccaaaccaagacaaaatctctgaattgccagaaaaaaatcagaatgaaatagatagcataaacaatgtcataacttctggaaatcaaggaaacactgaaagaaatgcaaaatgcactgagattgaagacaaggttttcaagtcaacccaatccatccaaggcaaagaaaagataattttaagtaatgaacaaagcctccaagaagtttgggactatgttaaatatccaaacataagaataattggtgttcctgtggaagaagagaaatctaagagtttggaaaatatattcaagggaataattgaagaagacttccctggccttgctagagccctagacatccaaatgcaagcagcacaaacatcacccaggaaattcattgcaaaaagatcattgcacatagccaacatgttaactgaagtcaagatgaatgaaaaaattgtaaaagctgtgagacaaaagcatcaggtaacctatgaagaaaaacctaccagattaacagcagatttctcagcagaaaccctacaagctagaagggactggggtcctgttttcagcctctttaaacaaaacaattatcagcaaataattctgtattcagtgaaacgaagcctcacaaatgaaggaaaggcatcctcttttctaggcaaagagaagctgagagaattcaccactaccaagccagcactacaagaactgctaaaaggagttctaaaccttgaaacaaattcttggaatacaccaaaatagaacttccttaaagcataaatatcacaggacctatataacaataacagaatgaaaataaacaaaggtattcaggcaacaaatagcacaatgtatagaatagta

SEQ ID NO: 472754 - DNA, 1301 bp, Homo sapiens
actaggtaaaaagcacattcatcatggcatgggagaatcagaccttcaactccgacttcatcctccttggaatcttcaatcacagcccaccacacacgttcctcttctttctggtcctgggcatctttttagtggccttcatgggaaactctgtcatggttctcctcatctacctggacacccagctccacacccccatgtacttcctcctcagccaactgtccctcatggacctcatgctcatctgcaccaccgtacccaagatggccttcaactacctgtctggcagcaagtccatttctatggctggttgtgtcacacaaattttcttctatatatcactgtctggctctgaatgttttcttttggctgttatggcttatgaccgctatattgctatttgccaccctctaagatataccaatctcatgaatcctaaaatttgtggacttatggctaccttctcctggatcctgggctctacagatggaatcattgatgctgtagccacattttccttctccttttgtgggtctcgggaaatagcccacttcttctgtgaattcccttccctactaatcctctcatgcaatgacacatcaatatttgaagaggttattttcatctgctgtatagtaatgcttgttttccctgttgcaatcatcattgcttcctatgctcgagttattctggctgtcattcacatgggatctggagagggtcgttgcaaagctttcacgacctgttcctctcacctcatggtggtgggaatgtactatggagcagctttgttcatgtacatacggcccacatctgatcactccccaacgcaggacaagatggtgtctgtattctacaccatcctcactcccatgctgaatcccctcatctacagcctccgcaacaaggaggtgactagagcattcatgaagatcttaggaaagggcaagtctgagagtgagttacctcataaactttatgttttgctgtttgctaaattcttctttctaatatccatctttttctatgatgtcaaaatactagcattgattatgtacattgcctaacatatttatgggcacctatacaatttatttcaggttttttagtttatgtgcagaaaggtgttcacagtagccttgaataatcttttgtgtttctgcggtaccgattgtaataccgcctgtttcatttctaattgagcttatttggatcctctctcttctttcttcgttaatcttgataattgcctattaatgttatttgtcttttcaaagaaccagctttttgtttcacttacc

SEQ ID NO: 472755 - DNA, 1426 bp, Homo sapiens
atattcatcatggcatgggagaatcagaccttcaactctgacttcatcctcctgggaatcttcaatcacagccccacccacaccttcctcttctttctggtcctggccatcttttcagtggccttcatgggaaactctgtcatggttctcctcatctacctggacacccagctccacacccccatgtacttcctcctcagtcaactgttcctcatggacctcatgctcatctgctctaccgtacccaagatggccttcaactacttgtctggcagcaagtccatttctatggctggttgtgccacacaaattttcttctatgtatcactgcttggctccgaatgctttctgttggctgttatgtcttatgaccgctatattgccatttgccaccctctaagatacaccaatctcatgagacccaaaatttgtggacttatgactgccttctcctggatcctgggctctatggatgcaatcattgatgctgtagcgacattttccttctcctactgtgggtctcgggaaatagcccacttcttctgtgacttcccttccctactaatcctctcatgcaatgacacatcaatatttgaaaaggttcttttcatctgctgtatagtaatgattgtttttcctgttgcaatcatcatcgcttcctatgctcgagttattctggctgtcattcacatgggatctggagagggtcgtcgcaaagcttttactacctgttcctctcacctcatggtggtgggaatgtactatggagcaggtttgttcatgtacatacggcccacatctgatcgctcccctatgcaggacaagctggtgtctgtattctacaccatcctcactcccatgctgaatcccctcatctacagcctccgcaacaaggaggtgaccagagcactcaggaaagtgttaggaaagggcaagtgtggagagcagctggtgaccagggctgacaacttgccccagaccatgggcctgtcttttgagaaagcaaacaggctcacaagttctgagcgtctcagggagcctgcatcagtgatccagttccttcaaagggtctctggattctctcagctttcctggtatgttcctgtagtagttcttggtgcaaacattcacaatgtgagtttccacacgctactctgtccatctgagtgggagctgaaagctagtcctccctcctatccatcatctaaatcaagatgttaaagttccatgttttttcagtattataaactgcattgtatgcagccaggtagcaaagaaatcttcttttccaaaggtataaactcaaaattttattgaacgtcttgaaattcactttgaaataaaagttaatacaacgatttttacatatttagtcagtgtttcttcttgatttttttatttttggtggctcttggaagatactgcc

SEQ ID NO: 472756 - DNA, 504 bp, Homo sapiens
gagttaatgggtgcagcacatcaacatggcacatgtatacatatccaggccccacttctggaggtctgctatagtttgctgggggcccattccaggccctgttggcctgggtatcaccagtggaggccataaaacagcaaaggttgctgcctgctgcttcctcaaagcttcgtcccagaggagcaccagcttgttgccagccagagctctcctgtatgaggtgtctgtcgacccctattgggaggtctctcccagtcaggaggcatctggtgctctgtcccaggacgatgacagttctgtctgtaagcccctgaatggagcttctggatttcctgcagagatgccctgccctgtgccgttggagtctgaaaaatttcctgcaactcagcaccagctccaacagccaccccgttttgtgttcgaaacccagggccctggcagtgtaggctcacaaggaaatatcttattctgtggattgcaaaaatccacggaaagagcgtagta

SEQ ID NO: 472757 - DNA, 1109 bp, Homo sapiens
catctcaagcagtaacagtaactgcggtagtgaccgtctcaagtagcaattgtacagagctatggagcagagcaattattccgtgtatgccgactttatccttctgggtttgttcagcaacgcccgtttcccctggcttctctttgccctcattctcctggtctttttgacctccatagccagcaacgtggtcaagatcattctcatccacatagactcccgcctccacacccccatgtacttcctgctcagccagctctccctcagggacatcctgtatatttccaccattgtgcccaaaatgctggtcgaccaggtgatgagccagagagccatttcctttgctggatgcactgcccaacacttcctctacttgaccttagcaggggctgagttcttcctcctaggactcatgtcctatgatcgctacgtagccatctgcaaccctctgcactatcctgtcctcatgagccgcaagatctgctggttgattgtggcggcagcctggctgggagggtctatcgatggtttcttgctcacccccgtcaccatgcagttccccttctgtgcctctcgggagatcaaccacttcttctgcgaggtgcctgcccttctgaagctctcctgcacggacacatcagcctacgagacagccatgtatgtctgctgtattatgatgctcctcatccctttctctgtcatctcgggctcttacacaagaattctcattactgtttataggatgagcgaggcagaggggaggggaaaggctgtggccacctgctcctcacacatggtggttgtcagcctcttctatggggctgccatgtacacatacgtgctgcctcattcttaccacacccctgagcaggacaaagctgtatctgccttctacaccatccttactcccatgctcaatccactcatttacagccttaggaacaaggatgtcacaggggccctacagaaggttgtggggaggtgtgtgtcctcaggaaaggtaaccactttctaaagaaatttcatatgctgctagagacttgaaatgaaggatacaagactttatcattgcccttgaatttaaatattctctgcctggaaacaagtga

SEQ ID NO: 472758 - DNA, 818 bp, Homo sapiens
aacctacacctggaagatttcacgtcagaggaaggaattacgatggtgtctgaggaggggaggcctctggatgcagggtttactgtaaaactgaaggacagcaaggctgatgctcacaatgtagacctgactcatcataatgggctcttcttcaaaggaaatgagagccagattgtctccttggcagcaatggaaaacaaatgctatccacagaatggctcaattctcaaagcactggattgcaatgatgccctgttgacagcactgttcaaaagtcgacctgttgttgctggaacctccaagaatacagtgtttgatctcagccaggatcctgtcttggaagaggagagggaatcccaaaaactacttgtgaagaagatcccattgttcaatcaaatcctcgtcactgtagcaatccatgcatgccattgcagttggcattctgacacgtgtacacagtgttttcatctcttccctggagttgcagccaaagcctgagattcctttcgacacgaccctgaaaaaactctgggtttgtgctcccctctgctctgcaataacataccagctctgtgatgtggccaatgtttacctagttggtgggaggactttttaatatcaaaaggaaaacatttcttctgcattccacataggtaagatgtggtttgctgttgtgcagggataaggatttggggtggggaagggatgaagaaaagaaaaacaatccccccacccatgtttttttttgaaattttcagggctaaagtgatgggtcagagtaggtgagcaaaaaaaaaaaaaaaatcatcaagcaatgc

SEQ ID NO: 472759 - DNA, 788 bp, Homo sapiens
aactgccagggcaccgagccgccatggggcgatactccggaagaagcttccgtttaatcctcatgtgcgtcgttagcatcctcctctttgtgatggaactagtgatcgcttacgttggcaactccctctccttggcctccgatgcttttgccgtcctttcccactttgtgtccatgatcataggtttttttggtgtaagggccagtaacataaaacagcacaagaagagcacttacggctttcttcgggcagatgttgtgggagcatttgggaacaccatttttgcggtggcgctgatgttcagcatcctggttgaagccatcaaaaggtacatcaatccccagaagacagaggagccgatactggttctcagtgctggaattatcggtctgttcttcaatgttcttaactatgtcatcttcttggactgctgttactgcgcagcacccaagccccagggagacatggaagcagggaatgaaaaagtgtcttcaggcacgcagagaggaagtaaaggcactaatcgtagccacagagagagcgattggaaagacggtggatgtggcagtcttctttaagtgattcactgttgtttacccatatgtgacatggctatgtttgaattaaaaaaaaagttaatgtctccataaaatatgtttaaaagtactgggctacataaccaacttacaaagagcacagtatcagacaatcagcatggctgttatggacctcagaaatactgaaagacaaggttatgttttacaaggctaaggacaatgaatagggct

SEQ ID NO: 472760 - DNA, 729 bp, Homo sapiens
gagggttcccttttctccacatcctcaccagcatttcttatagcctgtcttttaagtaaaagtcattttaactgagaatatggatatccagttttcccagcaccatttattgaagagactgtcttccccaatatatgttcttggcatcattgtcgaaaatgagttctctctagatcttagaggaaaggctttcagtttttccccattcaatataatatctgctatgggcctgccattcacggcttttatcatgttgaggcacactgtggccatcacacctagaattgccctggctctgactggaagccagcacaacactgggtctttccaaaggcctgatgttggtgagttcccccaggccctgggcgggtccagagatgctgtctggcagccaggaatcagagtcaaaaaccttagaaatttacctggtcatatgctgccccattccattggctctaagtccagcatagcaccaggacttgcctaagattttcagtctttatgtcctagactgcctttcaggttcacttgggaccctagtacgcttcagcctgttgtgttgccattacaattcttggttggggttactagtgtttgtttttaatctttaacgatactgtccctttctttggctgtttgtgaaatctcatccaggaatctgatgcaaagaagcacgaggaccttcattttcactccagtggttgtggtgactgtggtgagtctggggga

SEQ ID NO: 472761 - DNA, 1557 bp, Homo sapiens
gctagcagaagacaagaaaaactaagacctgagaagaacaggagatagagacatgaaaaagcctccaaaaaagcacttccaactcccagtgctggctgctgctcctcccacaaggatctcaaaaggcttagacagcaggcaaccgcagccagtgctggttgcctctccccctggggagttggctggggtcttcaaggtcagcaacgttgcatcctctaactcttctcccacagtcacataccctctgaccagaaccaggaaaggctctcaatttttaagcactagtgtgattgtggccacctggaaacatccagggaacttctgcatacttcatagattttctttcactctaaaatgtgtacatggcaaagaaataaagagtacttcaaaacatgaccctaagaaacccagttatctgccatcactgtttttggagaagataaaaattattttggtaccattctaatctcaagctagtgtttctcaaggacagaaagtacatatagaaccataggtgaatgtgaatctgggaaatgtagtttcaaaacctccaacccgtgttaaaaaataaaaagagagagagagaaagaatagaaaaatagagagataaatactcattactgtaaaaaaagcatatccctagcaattgaaataaattgaaatcactaatgtgaaatataagtcaagcctcaaactataaatttaataaatgatatttatttcagttatgtttgcaatataaaatgtttcaggtgttaagtggttaacgtgctgcaaatttttaaaatatcagtatagacagtgtgtgtgcgtgtatatatatatatatatacgcacacacacagtgtgtgtgtgtgtgtgcgtgtgtgtgtgcttatcagtttcttttaaataacttctatttgtgaagctttgtttttgagaactatacttccttgagaaattgtggcataaacaatgctatgagtttaccaaaccatttcattttcctagacatagaactaagctgtagttttgaaccacattgcatcttggtgggctaatgtctttaattctcaagattagaaggtaagcaagatgcattatttcttatctgaattacatttagtaaatgaaagtgatatttgcatattgtttttacctttcatgacaagttacagacccatttgttcatatagggcagtttcaaaagggaggagggctgcttaacctgaatttgactttaaatgaaagaacaataaaagtttttattcttaaatcattactagttgagaaatttacctgataccacaaggtagcttattcttttctgattatagtagaaatactttcagatttttaagcaatatatagtacagaaatatgttgattggtaacaaatatatctaacacttgtcatttcacacattctatatttttctctttactttctatttcgtgcatgacattgtgctaagcaccaatgtaccatattagaaactgacctctcagaaattacacatttttgtaattacctaatataacattgccctggtgctgtggcattaggtattttac

SEQ ID NO: 472762 - DNA, 700 bp, Homo sapiens
tttaatttatgttaaagtggatccaaagatgctatctgggaaccaggacctggattcagaaactttaggaatctacctggcactttattctactgtggctgagctggcatccaagacacaagacaaagttcttcccactcttccctcaccaactccccaggcagaggaatctccttgtgttcaccactaccacctgcccacggggagcaccgccagggcactgccaatttcacttcagatccaagggctcttcagccagcttagatgctgtccaagagcaatggcccgaatcagagacctcacgagtccacctgatgccctgtccctctttggccaagctgacacccaagctcaagacaaagtccccttcatttctccccttgcttttctcaaggagaagggaccactccctgtagccatgatggctgtgaatgaagccagcatgtctcatactatcactcaagacccacagcctgtaccacctgtaattcaatgactttttatagattactgacattgtgccaagcattatgtcatacatagggtggagacagggaaagtagtgataaaaagagattagactcttctgatgagaaaccataatcactagaggtaaaaagatacacataattaaaaagtaataattctgtaagaaaggtataaacaatgttctgtgggaacacagagaagcaataattat

SEQ ID NO: 472763 - DNA, 921 bp, Homo sapiens
ctgacgcattataaaaaagcatgaccttccatcaaaatccaaggaatgcgtgctctttatttgaagacgatgaaaacactgagggaggagtcgttcatctgcttggactcggtaaggaagttgtgcaaatgtgcatgataatggatggccttgatgaagatggctttgctgtacgtgttgctgcttatgaggttgatggtagtgctgggtgcatctcttgtaatgaagctgacctgatggtgtctatgtttggtgtccactcacctccagaggctgagaggccaactgaggagaaggccactgtgattcactctgcgatgcatgcaaaatcgggaactgtctcctttggaccagttttgaatttttgtccagcctgtgtcatgctgcttccaggtctgcacagagatgctgggtctgcatgtgggtatcactcacattccaagtgtggagctttgcaggctgtatcagccatggcacactcttccctgggggcaggcctttcacccccttcactgtccctgggatctggatcagcagcagcccccagaaccgtggcagcagccagagcccccgccttgctgaccactgcccctgtcacaggagttggacctctggcgccggcatcggtggtggcgcctgtggtggttcaggaagcagccgccctcggagctagggccacagcccccagagcttggggcacagccagaggaagctggaggcagacactgtactgggttctttgggggacacttgggtgaggggcacttggtgaacactctaatatttttgcaagcctttggtaaatctccagagttttgcaaaagttgattttcacaatttttcattttcaaggtgtttttaatggaagagcagatttttggagatccttgctcaatcattcccaaccttgtcttcttaagt

SEQ ID NO: 472764 - DNA, 948 bp, Homo sapiens
gctgctgctgcaacagctctgcagccaaggggtcacacaagaagattcggaggtgaacatgggctgtgcactggagtggcactgtggagggccctttgaaggcattggcattgctggtggttttttggaaagaaaaagccaaggctgtagaagccccctgggatggctggatccacagcaggacatggaagagaaactgctcagggtggagggagtcataatggaacatttccacaaggtcagggaaagctgtggctcagaactgatgtttcctcagaggacacgaatacaaaagatgcagggaacaggatcttgtccaggcatgggtcccttggagccaagcctgggccctataaaagacacatccagcttcagcacctcatctgctctgactccccagggacgtgtctgtgctcctgcgtgtgaccagggtgagtggcaacctgggataccagaggggtatgagcaaggcagagggatggggaggatggaggtaggctggagaaagagttgtgtgcttgtgttctgccatactgaggaggaatgggactcagtctgcctcgaatctgttgaggctgtgaggcctaccggaggtcgtataggtggggaaagctaactgtgcacatcttttccaattctgtgttcagtgacttcatgttggtaacttcaaaactgctgtgttgggcatatttacaccatggaaactggcaaatacttcaagccaggctcttttatctggaggtttcattgcaaaatctttttccagaggacctcctggtgtgtcctgcaacacgcagctggtccttagggcttgtattaagggaatcggtacttcatggagtgtgaatactctattcaggcttgtgaggatagagtaatctcagcttcccctgaaaggaagaatacgaagctcattcggttggttttttaatgtatgtgcttttattt

SEQ ID NO: 472765 - DNA, 768 bp, Homo sapiens
tgctttaggcttctttctttgctcctttttcatggctcatccgaggcccagccccaggatccatacaaagtgtgttcctgctgctggcttctcatctgctctgcttcctaagggacgtatctgttgctgcgtctgaacccacggtgagtgtttctataggaatccagagggggacgctagcgggatgaagatggagatggagagtaattctggaagtcgaacagtgaagcgtggagtttatcgaaattccaccaagatgtcctgccagcagaaccaacagcagtgccagccccctcccaagtgtcctatccccaagtatcccccaaaatgtccctcaaagtgtgcatcctcatgcccacctccaatctcttcctgctgtggctccagctctgggggctgtggttgctgcagctctgagggaggtggctgctgcctgagccaccacagacaccataggtcccactgccacagacccaagagctccaattgctatggcagtggcagtggccagcagtctgggggttctggctgctgctctggagggggctgtttgcgtctcatcaacttcaggccttggatttgcattattttagctttatgtcaatatttatatttctcagattattgaaaaattttctgatgtgctttgcaacagtaaatttactttcaagtaattttctagtcccagtttgatggtggtttttattccacttttcttcacttttacctaaatcccaatccttttcctagatagaaagatagatttat

SEQ ID NO: 472766 - DNA, 503 bp, Homo sapiens
ggtgacgcgaccctgagtgcctggagccgtctcctgattgttcatcaccttccctgggatgtggtgtggctgtgatgagaccctgagtgtccagatctatctaccaattgctcgtagtgggatccctgccttcctccactgcttgaccccgggtgtccatgaatggtgtcctgaccctcttgggacgttgagtgcctggagctgtctcgtgcctgcttgtggtgggatccttgtcttcctccagtgctggtcccggtccgtccatgggcggactcagactgttcatgagtgctcacctggtagaggaaagaccctgaacgtccagaccttcctgctgaccggccacgtgtggactcttggtggctctgctgatggggcccagcctgtccgtgggctgacactgactgtgtgtctgagtcttctgaatgtccctcactgtcactggcctgactaccactggaccctcggtgtccactgtctctgactgcagatgaagcttgtcc

SEQ ID NO: 472767 - DNA, 698 bp, Homo sapiens
tgatgggtgcagcaaaccaccatggcacgtaggccaatcttggctccactgggtggaaaagttgagctcagttgccagctgtctccaccacaaagcgcagaacacatggaaatacgctggttccagagtcactacacacgacctgtttacctgtataaggatggtaaagacctgtatggagaaactatctccaagtatgtggagcggacagagctcctgaaagaagccattggagaaggtaaagtgaccctcaggatccttaatgtcagtgctgatgatgacgggcagtaccactgcttcttcaaagacagaaatgtctatgaagagtccatcacagaagtgaaggtcacagatagctcttcagagattagcagtcaggaacatttcaaacttgacctttgccaagctgagtgtgcccagttattcaactgtttctcatgggcataatttgagtttctgaaaatctcttcaactttatctaaaagaaacagaggtatgtggattaaaaggatgggaatgtcctgaaaatatctcatttcctaaacgcccattctctgctactttaaaacatataatacattgttattgaccctactctgtagttgagcaatagaacttatatttttatttacgagcacgtgcgtgcccattaagctacctctcttaattcccccttgaatcccctcatcccagcctct

SEQ ID NO: 472768 - DNA, 483 bp, Homo sapiens
accaaggctcgggctcatgggcctggatcaagcataaggcatcttccctgtggatgccctggtagagtatgaaggattcccccagcctgggaaccttccctgtgcactcttcactaagcactgcatccctaagccgtgggccacttcagttcttccacagcctccacacttccagcaggggcaggccaatcccaaaccaactactcccaactacccccacctgcatactccaccaggacatccacagagaagagtcagccttctgctgttcaggcccaagagccagagccttcttaggagcatcctactcaagtcaaaacattcctgctccctacaactcctcctccctcctcgaaccacagctcctggacgccagacttaacagttctcaagtgggaaggaatccgaccctggtccacagtgccccaactgaggggtatgcctcccagctctccacgtttccctgccaacgctcctgaaccc

SEQ ID NO: 472769 - DNA, 801 bp, Homo sapiens
tctgggccttcagctggcatgactccaacagctcgttttaaggatggaaaacaggttgagagcgggcatagggaaggggcccactggaactgcatggcaagttaaggaacagatcttttctgaacacctccactgggccaggtcctgggaggggaaacacagctgtaagactttgagttgggaaactgtttttgttgtccttgttgcaaaagggcacttcataattcaatttgcatttgctaataagcctgaaactaaacctggccatgggagatctgagcctacgggagggaatgggggtgtggaggatgctaacgagtcgggaactgaaaataaatcttgccaacaccactattttctcaggacggcccagaggctcagaagtgcagagcagatgctgggcatcaggcagaatggatctgagttgtggcttttggtcctgcttgaccaaggcagcaaatgatttatgaccagatgagggtccagacagtgaactgtgaattcagaggagggtgaggacacagtggtctggagatatctggagaggctttggggaggagttaggaaaatatatataaagtctgggaaactgaaggtttgcttggagagttaatgatgaggccagtttgaatcaagtataatattcttgtaggagagtggttcttgactgggggctattttgcctctgaggagacatgggacacttggtaacgtctgaagatgtttttcattgtcataactggagggagaggtgttactggcatgtagaggatagaggaaagggatgctgctgggcatcct

SEQ ID NO: 472770 - DNA, 609 bp, Homo sapiens
aacactcaacatgatgacttgttggcagagaggagctacccactccaaggtcccctctgagctattctgttactcaataaagctcctgttcaccttgcttaccctccacttgtctgtgtacctcatttttcctggacacaagataagaactcggaacctgttgaatgccacggctgtgactccctctttggggccctgcagttcctggagtctccaagcctccatcacatttcctggtgccagccatggaagttgcttgtgttgtgcctggtccagccacagccacacagagagccatctgtgctggcacttggagctgcctgcctcactgcagcagctggcatgtctgagtgtgtgcagtggtcggactccatgctcactcactcacacactccttgccactccacgcctggcttgcccttggcaggcataggatccaagccaaattcacctttcttgtctcccttattcaagtcattaaaaaaccttttcatctttttcatctgaatggttttatacataggaggcttttacaatgcaagaaaaggatctgttcaattgctgagcatagacaatcctttacctgcatatttcctggttccaagaaat

SEQ ID NO: 472771 - DNA, 1276 bp, Homo sapiens
tctgaggtgtagtaaaacaagattgaccaagtgttgaagatggccaaataggaacagctccagtctacagctcccagcatgagtgacgcagaagagggatgatttctgcatttccaactgaggtaccgggttcatctcagtagggcttgttggacagtgggtatagcccacggagcccaagggaagccgtgacagacggtacctggaaaatcgggacattcccaccctaatactgcccttttccaacggtcttagcaaatggcacaccaggagattatatcccgtgcctggctcggagggtcccatgcctgcggaggcttgctcactgctagcacagcagtctgagatagaactgcaaggaggcagtgaggctgggagaggggcgtccgccattgctgaggcttgagtaggtaaacaaagcggccgggaagctcgaactgggtggagcccactgcagctcaaggaggcctgcctgcctctgtagactccacctctggcggcagggcatagctgaacaaaaggtagcaggaacttctgcagacttaaacgtccctgtctgacagctttgaagagagtagtggttctcccagcacgcggtttgagatctgagaacggacagactgcctcctcaagtgggtccctgacccccgagtagcctaattgggagacacctcccagtaggggctgactgacatcttatacagccgggtgcccctctgagatgaagcttccagagaaaggatcaggcagcaacatttgccgttctgcaatatttgctgttctgcagcctccactggtgatacccaggcaaacagggtctggagtggacctccagcaaactccaacagacctgcagctgagggtcctgactgttagaaggaaaactaacagaaaggacatccacaccaataccccatctgtatgtcaccatcatcaaagaccaaaggtagataaaaccacaaagatggggagaaaccagagcagaaaagctgaaaattctaaaaatcagagtgcctcttctcctccaaaggaacgcagctcctcaccagcaacagaacaaagctggacggagaatgactttgacgagttgagagaagaaggcttcagacgatcggtaataacaaactctgagctaaaggaggatgttcgaacccatcgcaaagaagctaaaaaccttgaaaaaagattagacgaatggctaactagaataaacagcatagagaagaccttaaacgacctgatggagctgaaaaccatggcataagaactatgtgac

SEQ ID NO: 472772 - DNA, 724 bp, Homo sapiens
ctcggagaaaggagaaaggtgtcacacaatggatggagtatgccagtcacatggtgtggcctcgtgcaaagaggggccctgtgtagacgactgtcctcttgtacctctctgggtcaggtccctggctgcttctcatggccgtgacccaaaaggggaggatctgcatcccaggcccacatgggggcgtggacgataccggtgctcagagtgggccactcctggattgaagagagatggcatttggggcagtgtgagcctgaaagagaaactgtctcctaggaaaagaaggcaattgggccacgactcagacaggatgtgcagaaaggaggggaggaataagaacgaggatcccaagcaacccctcgtccactgtgccggcccggggtcatctctgcagcaggaagctgactggtacttcctcactccccatatggaggagtcgcactggtcagcttttccaagtcacctatccaggcccccagcctttcatgtaccccctacttccctcatcaaatctctgtgcccagaacgccatcttccctttcacagagaactcaacccacccactggactccaagcttctggcctctgtggtgaaccccagggaggtgaagccctctttcctccctgctcctagagcctgggacccttccaagatataacactctcacattgtttcatacctcttgtgtgtatgtgtctgtttacacccttgattgaactt

SEQ ID NO: 472773 - DNA, 1857 bp, Homo sapiens
ccttcctcgcccactccagtgacactatgcacccccaccgtgacccgagaggcctctggctcctgctgccgtccttgtccctgctgctttttgaggtggccagagctggccgagccgtggttagctgtcctgccgcctgcttgtgcgccagcaacatcctcagctgctccaagcagcagctgcccaatgtgccccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagctacccaaactaacgctcctggatctctcttctaacaagctgaagaacttgccattgcctgacctgcagaagctgccggcctggatcaagaatgggctgtacctacataacaaccccctgaactgcgactgtgagctctaccagctgttttcacactggcagtatcggcagctgagctccgtgatggactttcaagaggatctgtactgcatgaactccaagaagctgcacaatgtcttcaacctgagtttcctcaactgtggcgagtacaaggagcgtgcctgggaggcccacctgggtgacaccttgatcatcaagtgtgacaccaagcagcaagggatgaccaaggtgtgggtgacaccaagtaatgaacgggtgctagatgaggtgaccaatggcacagtgagtgtgtctaaggatggcagtcttcttttccagcaggtgcaggtcgaggacggtggtgtgtatacctgctatgccatgggagagactttcaatgagacactgtctgtggaattgaaagtgcacaatttcaccttgcacggacaccatgacaccctcaacacagcctataccaccctagtgggctgtatccttagtgtggtcctggtcctcatatacctatacctcaccccttgccgctgctggtgccggggtgtagagaagccttccagccatcaaggagacagcctcagctcttccatgcttagtaccacacccaaccatgatcctatggctggtggggacaaagatgatggttttgaccggcgggtggctttcctggaacctgctggacctgggcagggtcaaaacggcaagctcaagccaggcaacaccctgccagtgcctgaggccacaggcaagggccaacggaggatgtcggatccagaatcagtcagctcggtcttctctgatacgcccattgtggtgtgagcaggatgggttggtggggagattctgccccaggagaggtaatgcacccctgaaggatatgaggggatggaagagagggctggctgcccaagggaatggattcctcctgacctcaagggaattggtcccaggagccacactggggaaaagctgtagtatcttctttgtttagcaagtcaaacttcacagctggggaagttgaaaacctttggaaaatgagtcaggaaaaggctgagacctcaatcgctgtgctgctatagcttgagtgtagccacagacaggacaaaaatgaatgactgtggctgtggtccaaaaaagatttgacttatggacattgaaatttgaattt

SEQ ID NO: 472774 - DNA, 873 bp, Homo sapiens
cttttctcctggcaccctgtattcatggccttggcggcctccaagccagacatgaggcttactggctctctcctatgttcacagttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttccaggcccagatcaaaggtgcggcctggtacctgtgcctggcactgcccgtctatccagccctggtgatcatgcaccagatttccagatcctacttgccgaggaagaaaatggaaatctctttggtccaagagggggctgagtttggtgccagctggcaaatgagggctggactctcttccctccagagaccaccccgctccttgctgcagctgaaagtagttccccaggctgccctcggtgccagtgctgagaggctccttctacctgccgcagggccccccaaaagcaaactatgaccaagtgagggagcggtgggagatgaaaaactatataaatgcagagtatgggagtgctctgacatcaacagctgtcatttcactgactgccaaggttgacttgtctga

SEQ ID NO: 472775 - DNA, 920 bp, Homo sapiens
ggggatagataagtcaaagtggtagtataagaaagttaagttctcacctgctgtgaaaagtacagaatttgatgagaaagtaaaattgcttcctcactgtcctcaccggattcacagggggaaatgattcagaggcttttgcctttacctcctagagcatgttcttgcaactgttgggctagtcttatctggccaaactctgttactaacagaatgtctagttattttgcaggcacagagttaagaagtggcaagttaacacagccagagcatgcacagaagaaaacttcgacctcaaataacacctagaaccaaagtccctaccgcagaactaaaagattgggatgtggctggaactcaagcacctaaacactttcaaaaggctttgccttccagtgtctacttggccttccagtgtcagacagcttcttgcacctgacccactcagctgaggacacagatgtcaaaaaaaaaatcataaatacagaattccagaaaattttaccaatatgttatatttgctgtggttgctttatagatttttaaaaattattggtccagtaacaggtctgaaatttaacccttctcctgcttttgaagcattttttagccaagggcttcaactgcagacaatcagaactgttcagatcctggggccccactgtacatccttccccctaaatccctgggtgccaaaggtaggtgccagtcagcacccaccccctcacccccagcaactggaggcccatgtcagcttcagcataaaaatctccttatgcccaagggctccttgttcaccagtagttcaccatcctgactgcacattagaaatccctggggggcttttaaaaatatcaatactgctatactacccacagattctgatagaattgggctgctgtaggacccaggcatgatac

SEQ ID NO: 472776 - DNA, 987 bp, Homo sapiens
gtgaggtgaatgagggaccagccttggaagaaaaatttaggagggacaccaacaaacttaacaagaaaggtgcagttgagtgatgcagaactctgcccagcatctcttgggtggaaagggactgtgatggagtaccaggggtcttcgttctcggacccaaagcacctttcacaccttccaggctttgcagatcctggttcctatgctggaagaatatcttctcatcctccacccccgaccttgttcaatggtcttcatgcagctatcctggatgctcaaaatcaacattgctctatctgtgaagttttacccaaattctccccacctggatccccagtagagttaaccactgctctgaatgcagcagtgcacaatggtgctatggcctatgccttcatgaagtttataactcagagccccaagtcctgtgtagataaaccttcatggagctctagtctagtgggagagattgacacactcaatggtaattatactacagcattgaatgtaagaaaagaaatatgctgggattgctttgatgaggagcacctaagccagcagagtggggagttggggagtaaggtgagagtggctctttctcgaaagcaaagctgtttgtgctccagtgagtctggtgtcaatggcgaagtggcccttgccccgaccactgggacaagctggtatcactgccaactttgcagaggccctggcatcccctcagggatctggacagctggaccccacctcctgctggccctattacttgctgcatcgaccaccattgctggggcaggcgacagtggtaatttcctacaagtggaatttactggtttaaagggcactctggtttacaccaacaccagcagcctctgcggctttgcaaagggttgtcaatagttacctaaaataattcagaagatgttctcctgtggctgttcttttaaatggtgtgtaagagaacacaatcaaggcttagaattgcttgaa

SEQ ID NO: 472777 - DNA, 914 bp, Homo sapiens
catgtattcattcagccacatggagcaagaagtgaataagtctcacaaggtctgatgcttttataaaggggggtttccctgcatatgccctcttgcttgctgccatgtattaagatgtgcttttgcttctcctttgccttctgccatgattgtgaggcctctccagtcatgtggaactgtgaatccattaaacctctttcctttataaattacccagtctcagaagaaattcctaagtggaagaggcttcaagaggaaacagagcatgaaaattcagaaaaggtacagcctgatgatgcaatagaaaagaaaaacacattttctgaggagaaatccaatccagctgcagaaatttgcataagtaatgaagggccaaatgttaatcaccaagacaatggggaaaatgtcttcagggaatgtcagaggtcttcacctcagcccctctcatcacaggcctggaggtctaggagagaaaaatggtttcatgggcggggtccagggccttgctgctttgtgcagtcttgggacttggtaccctgtgtcccatctggggctaaaaggggccaacatagagctcaggccattgcttcagagggtgcaagccccaagcctcggcagcttccacgtggtgttgagcctgcaggtgcacagaagtcaggaattgtggtttaggaacctctgcctagatttcagagatgtatggaaatacctggatattcaggcagaagtttgctgcaggagcagggccctcatggagaacctctgctagagtagtgcagaaaggaaatgtggggtcagagccccacagggtccccagcggggcactgcctagtggagctgtgagaaggccaacatcctccagaccccagaatggtaggtccaccgacagcttgcactgtgtgcccaggaaagtc

SEQ ID NO: 472778 - DNA, 546 bp, Homo sapiens
tgctccccatggtaatgaccagagattgatgtcttcttggaaaagaagtcactcacctatgaatatcctgaagtggaaattagtactgccttttcctgggacctatgttcccctccgagccacgcgagggcagcaacgcgcgcactctgaggaacacccccttcctcaggactcgtccgcctgtgctcggtggtttctcccagaatcctccaaggcgcgggagggggcggagagcttaaaaggagggagagcggcctgggtcctgggtgttgtgtgcggagctgtggcgtcgcgtgtgaggcgcgtgcaggccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggctttttgagtagatgtatccaaacttgcttagcctttcacctctggagaactggagtcaattc

SEQ ID NO: 472779 - DNA, 891 bp, Homo sapiens
cagacctgagagaatagaagcacttctgatgattgacaagctggcaacccgagctctaatcagagattacaaagatggcattcttcatgaaaatgaaaccagtcgtgaggatgagaatgagtcaccttttcctgatattccaaaagtttctgaacttattaccaaagaagatgtagacttcctgccctacatgagctggcagggggagcaccaaggagccatcaggaaccaaatagctagttttggttttgctgctcctcccagacagtttgatgcatctcaattcagccaaggccctgtgcctggcagttgtgctgactgtatcccacagttggcgtcttgtcccacaggacctccccagaacccctcttctgcaccctactgtggcattgctctttcagggagctcattgagctccacacagtctgctccactgcaacctgttggaggccgtacgaccaggccttctactggcacctaccctgagctggattctccccagcttcatttctctcttcctacagaccctgatcccatcagaggttttgggtcttatcatccctctgcttcctctccttttcattttcagctttccgcagcccctttgactgccaataacctctgccttacctgagcctctttacagtcagtcctggactaccccagtagatctctgtcttctggacgaatcagtaggcagtcttgaaggaagtcaatgtcctgactatggttttcaaagttgttctgaaacagaaagtcatgagctatgagaagtactgctttttacaaataaaatgtgatacaacagacaacagtatcccgtgctttctggaggtaatagaggaggatgaaacagtgtgcacacagcactggcaggatgctgtgccttgg

SEQ ID NO: 472780 - DNA, 5971 bp, Homo sapiens
acagtgttctaaaatcctttgtgatggacaaaaattcagaccgtcatagccgttttctggaatccaaggtgagggacaaacactcagaacccagcagcagtgttctggaatcctatgtgagggacaaacactcagatccagcagaagtgttctggaatactctggaaaaacattcagaccctcgaagcagtgttctggaatcctatgtgaggtacaaacactcagaacccagaaacagtttccttgaatcctatgtgagggagaaacactcagaacccagcagcagtgttctggaatcccatgtgagtgtcaaacattcagaacccagcagcattgttctggaatcctatttgagcgacaaacattcagaacttcgtacctgtgttctggaatgctatgtgagggacaaacactcagaaccaagcagcagtgttctggaatcctatgtgagggagaaacactcggaacccagcagcagtgttctggaatcctatgggcaaacaaacagaacccagcaggagagttctggaatcctatgtgagggacaaacactcagaacccagcagcagttttctggaattctttgtgagggacaacattcagaaaatcatagaagtgttctggaaaccagtgttctggaatcctatatgagggacaaacagtcagaacccagcaacagtgctctggaatcctttgtgagagacaaacattcagacactcagcagtgttctggaatcctatgtgagggaaaaacattcagaccgtcgtgcattgttctggaattctatatatggcacaaacactcagaactcagcagcagtgctctggaaccctatgtgagggaaaaacactcagaacccagcaggattgttctggaatgctatgtgtgggacaaacactcagaacccagtagcagagttctggaatcctatgtgagggacaaacactcagaacacagcagctgtgttctggaatcctttgtgatgcacaaagtttcagaacctcacagcagtgttctggaatccagtgttctggaatcctatgtgatggacaaacactcagaacccagcagcaatattccggagtcctttgtgatggacaaacattccgaccctcgtagcagtgttctgcaatcctatgtgagggataaacactcagaagccagcagctgtgttctggaatcccataaacactcagaaccctgcagcagttttgtagattccactgtgagatacaaacattcagaccctcgtagaagtgttctggaatcctatgtgagggaaaaactctcagaaacctgcagcagtgcactggagtcccttgtgagggacaaacaaacacaactgagcagcagtgttctggattcctttgagaggcaaaaatattcagaccctcgtagcagtgttctggaatcctatgtgagggacaaacactcagaacccaccagcagtattctggaatcctatgtgggggacaaacacaacccagccacagtgttctggaatcctctggacaaacattcagacaatcataacagtgttctggaatcctatgtgagggacaaacactcagaacgcagcagcagtgttctggaatcctatgtgagggacaaacactcagaacgcagcagcagtgttctggaatcctatgtgaggaacaaacacttagaacccagcagcactgttctggaatcctatgtgagggacaaacactcggaaagccgcagcagtgttctggaatcctatgtgagggtcaaacactcagaaacctgcagcagtgctctggattcctttgtgagggacaaacaaacagaacccagcagcagagttctggaatcctatgtaagggacactcagaacccagcagcagcattctggaaacctttccctgttctggaattctctgtgagggtcaaacattcagaacctcgtagcaatgttctgaaatactatgtgaggtacaaagcctcagaactcagcagtagtgttctggaatcctacgtgagtgacaaacactcagaaaccagcagcagtgttctagaatcctttggacaaacagaaaccagcagcagtgttctggaagcctttgtgagtgaagaacattcagaccctcgtagcagtgttctggaatcctacgtgcgggacaatcactcagaagccagcagcactgttctggaatcctatgtgaatgacaaatattcagaacccagaatcaagacaaatattgagtctcaaaccagtgttctggaatcctatgtaagggacaagcattcagagcctcgtagcagtgctctggaatcctatatgaggtacaaacacgaagaacccagcagcactgttctggaaccctatgtgagggacaaacactcagaacccagcaacagtgatctggaatcctatgtgagggacaaacactcagaacccagccacagtgttctggaatcctatgtgatagacgaacactcagaacccagcatcagtgttctggaatcctttgtaagggacaagcaatcaggacacagcagctctgttctggaatcctatgtgagcgacaaaccttcagaacttcttagcagtgttctggaatttgttttggcatcctatgtgagggacaaacatacagaacccggaagcagtgttctagaatcctttgtgagggacaaacactcagaaaccagtagcagtgttctagaatcctttgtgagggacaaatattcagaacctcgtagcagtgatctggaatcctatgtaaaacattcagaccctcatagcagtgttctggaatcctatatgagggacaaacactcagaacccagcagcagtgttctggaatcttttgggagggaaaaacattcacaccctcgtaacagtgttttggaatcctatgtgagtgaaaaatattcagaccctcgtagcattgttctggaatccaatatgagggacaaacactcagaatccagtaacagtgttctggaaccctccgtgagggataaacattcagaccctcatagcagtgttctggaatcctatgtgagggacaaacactcagaacccagcagcagtgttctagaatcctttgtgagggacaaacattcagaccctcttagcagtgttctggaatcctatgtgagggacagacattcagaacccagcattagtgttctggaatcctatgtgaggaactcacattcagacccttgtaccagtgttctggaatcctctgtgggggacaacaattcagaggcttgtagcagtgttctggaatcctttgtgaaggacacatgttcagacgacagcaggagtgttcttgagtcctatgtgggggacaaacacgcagaacacagcagcagtgtcctggaatcatatagggacaagcactcagaatccagcagcactgttcgggaattctatgtgagggacaaacccagagaacgcagcagcagtgttctggaatcctttgtgagggacaaacattcagacactcagagcagtgttctggaatcctatgtgagggacaaacactcagaaccctgcagcagtgttctggaatcctatctgagggacaagcattcagaccctcataacactgttctggaatgctctgtgagtgacaaacattcagatcctcgaagcagtgttctggaatcctatgtgaggtacaaaccctcagaactcagcagcagtgttctggaattctatgagagggaaaaaccctcagagcctagcagcagtgttctggaatgcagcagtgttctggaatcctatgtgaggtacaaacatgcagacccttggagcagtgttctggaatgctatgtgaaggacaaacagtcagaacccaatagcagtgttctggaatccaattatgtgagggacaaacattcagaacccagcagcagtgttctggaatccttggtgaggaacaaactttcagaacctctgagcagtgttcgggaatcctacgtttgggacaaacactcagaacccagcagctgtgttctgcaatcctatgtgagggacaaacactcagaacccacaagcggtgctctggaatctttggacaaacactcagaacccagcagcagtgttctggaatccaatgtgaaggacaaacactcagaacccagcagcagtgttctggaatattatgtgagggacaaacactcagaacccaaacccagcagcagtggtctggaatcctctgtgaagaacaaacactcagaacccagcagcagtggtctggaatcttctgtgaagaacaaacactcagaacccagcagcagtgatctggaatcctatgtgagggacagacattcagaacccagcagcagtgttctggaatccaatgaatcatatgtgagggaaaaacattcagaaccctgcagcagtgatctggaatcctgtgtgagagacaagcattcagaccctggtagcaccggtctggaatgctctgtgagggacaaacattcagaccctcgtagcagtgttctggaatcctatgtgaggaataaaccctcggaactcagcagcagtgttctggaattctatgtgacagacaaaccgtcagaaccaagcagcagcattctggaattctatgtgagggacaatcactcagaaaccagcagcagcgttctggaattctatgtgagggacaatcactcagaaaccagcagcagtgttctggtattcgatatgagggacacacactcagaacccagcagaagtgttctggaatcctatgtgagagaaatacactcacaaaccagcagcagtgttctggattcctatgtgagggacaaacattcagaccctcggagcagagttctggaatcctttgtgaaggacaaacactcagaacccagtagcagtgttctggaatgctatgtgtgtgacaagcattcgggtactcattgcagtgatacagaatcctttgtgagggacaaacattcagaccctcgtagctgtgttctggaatcctatgtgagggacaaacattcaaaccctcggaacagagttctggaatcttttgtgaagggcaaacactcagaacccagtagcagtgttctggaatactatgtgtgtgacaagcattcaggtactcgttgcagtgataaggaatcctttatgagggacaaacattcagaccctcatagcggtgttctggaatcctatgaatcctatgtgagggacaaacattcagagcctcggagcagtgttctggaatcctatgtgaaggaccaacagtcagaacccagtagcagtgttctggaatcctatgtgaaggacaagcattcagacactcttagcattgatacagaatgctttctgagggaaaaacatgcagaccctcatagcagtgttctgaaatcctatgtgagggacaaacactcagaagccagcagctgtgttctggaatcctttaacccacaagcggtgctctggaatctttgtgagggacaagcattcctacattttagcagtgttccggaatctcatgtgatagagaaacgctcagaacccagcagcagagttctagaattctacgtgaaggacaaaccttcagaacccagcagcagtgttctcatactcaatgacagggacaatccctcagatcccagcagcagttttccggaatcctatgtgagggacaacactcagaacccaacagcagtgttctggaatccaatccttgtagctgttttctggaatcctatatgtggaaccaacactcagaacctaggagcagtggtctggaatcctctgtgagggacaaacactcagacccttgaagcagtgttctggaatcctgtgtgaaggacaagcattcagatccagcagcagtgctctggaatcctttgttatggacaaaccttcacaagctcatagcagttttctggaatcctgtgtgagggacaaacactcagaaaccagcagcagtgctctggaatcctttgttatggacaagccttcacaag

SEQ ID NO: 472781 - DNA, 1384 bp, Homo sapiens
tggagaaaactagatttttataccacaaagtaaatttctgacggaatatagattaaattttttaatatacaaaatgatagaagcaccagaagagaacataaatgcctatttacacaggactgctctacactgggcctgcgccaatggccgtgcagaagtagtaacacttctggtagatagaaagtgccagcttgacatccttgatggcgaaaacaggacaactctgatgaaggctgtgcaatgccagagggaggtttgtgcaaatattctcatagattctggtgctgatccaaatattgtagatgtgtatggcaacacagctgttcattatgctcttataagcacagccctcatgcttgccatgtgtcatggatcatcagagatagttggcatggttcttcaggaaaatgttgacatctgtgctgaagatacgtgtggaatgattgcagaacgttatgctgttgcttgtggatttaatccggaagaacccgatccagcatctcaaattgaaaagtcagatgagcggactcccacacctaaagccagcacatgggatcccctataccattttgccctgctcagtgcctctgacccttcccctcgggcagctgctgccaccccagatcccaccccagatccttctcctgctcaagctgttcctcctccttacaactctaattcttgggagttatcatcccatgagcctgtcccctgtcaacctaaatacctctccctaaaggggttccagcatgagccctctatgtccccttataacacctcaatattgccagtcaagaaatcagatgggccataccggctggtacaggaccttagagctattaaccgaatagtccaaactacccaccccattgtcctcgatccttacaccattctcagcaagattccatataataatcaatggtttactgtgattgaggcaaaaagatgcaatgggtattcagtaattgatggagaaactcttgaagaaattgaggcaggaaaattgtctaagaattggactgcccaaacgtgtgagctatttgcactcagccaagccttaaaggacttgcagaaccaggaaggagccatctataccaattctaagtatacttttgatgtggttgatatttctggtatccaagaagaaatctcccaagatcatacctaactttttgtaactaaagcagcatacatacacagggagtgggaaaatgtctagactggttttttaattgtgatattaaggggtcgattttagatctttccagctttctgttattggcatttagtgctataaatttccctcttaacactacttcaactgtgtctcagagattctgttctaatttgtacatgtacaaattagagtacaacatggaaggtt

SEQ ID NO: 472782 - DNA, 756 bp, Homo sapiens
ctgctgctgtgtctgaaggtttgttcctcacacaggactccagaaaaatcctgctctggactgaatgtttgtccctcatattggattccagaacgctgctgcagttgtctgaatggttgaccctcacatagaattccagaacatccctgctttggtctgggtgattccagaacacggctatgaggggatgaatgattgtccttcacatgggattccagtatactgctggagggttctgagagtttctccctcacatacgattcgagaacactgctacaaggctctgaatgattgtacctcacatggaattccagagaactcttgctctcatctgaatgtttgtccctcagatagcattccagaacactgctactgggttctgagtgtttgtccctcacataagattccagatcactcctgctgtggcccgaatgtttgttcctcacatagtattccagaacactcctgctgtggtctgaatgtttctccctcatataggattatagaacattaccgctgtggtctgatggttgaccctcacataggattccagaacactcttgctgggttctgggtgtttgtgcctcacatgggattccagaacaatccccctgtggtctgaatgattgtccctcacataggattctggaacactgctgcagggctctgagtatttccccctcacataggattacagaacattgctactggggtctgaatgtttgtccctcacaaaggattcgagaacactgctac

SEQ ID NO: 472783 - DNA, 1865 bp, Homo sapiens
tctgtgttctgaatgttcttcctcacataggattctggaacaatgatacgagggattccaaaacattcctgctgtggtctgagtgtttgtcccacaaataggattccagaatacttctactgtggtctgaaagtttgttcctcacgtaggattccagagcactgctacgaggataggattcgagaacactgctacaagggtctcaattattctcccacacatgggattccagaacactcctgctgtggtctgaatgtttgtccctcacttaagattccagaacactgttgttgggttcggaatgtttgttcctcacgtacgattccagaagactgctatgtgggtctaaatgtttttcccttacctaggattccagaacactgtttcgagggtctgattccagaacactgctgctcagttgtgagtgtttctccctcacataggattccagaacactactgctgtggtctgaatgtttgtccctcacataggattccagaacactgctacgagtgtctgaattattctccctcacataggattccagaagattcctgctgtggtctgaatgtttgtccctcacttgggattctaggacactgctgttgggttctgagtgtttgtcccttatgtaagattccagaacactgttccgtgggtttaaatgtttatccctcacataggattgcagaatactgctgtgaggttctgaatgtttgtcccgcacaatggactccagaaatctccttctgtgttctgaatgttctgcacgtttgtccctcaaataggattccagaacactgctgctgtgttcaaaatgtttgttcctcgcataggactccagaactcacctgctatggtctgaacgattgtccctcatataggaatccagaacattactgccttgaacactgctacaagggtctgaattattctccatcatataggattccagaacactcctgttgtcgtctgaatgtttatccctcactgaggattccagaacactgctgttgggttctgagtgtttgtccctcatgtacgattccagaaccctgccacgtgggtctaaatgtttgtccctcacacaggactccagaacaatgctacgaggaatactgctgttgggttctgagtgtttgtccctcatttacgattccagaccactgctacgtgtctctaaatgtttgtccctcagataggattcccgaacaccgctacgagggtctgaatgtttgtcccacagttaggtttccagaacaccccagctatcgtctgaatgattggccttcatataagattctggaaaactgctgctggtttctgagaggttctctctcacataggatttcagaacactgctgctggggtctgaaagtttgtccctcacataggattccagagcactgctacgaggttctgaattattctccctcacataggattccagaacactcctgccatcatctgaatgtccctcacttaggattccagaacactgctgttgtgattccagaacactgctatgaaggtctgaatgtttgcccctcacataggattccagaacactgctacgggtgtcttaattattccccatcccatcggattccagaacactccacctgttgtctgaatgtttgtccctcacttactattcgagaacactgttgttgggttctgtgtatttctcacttacatactagtccagaacactgctacgtgggtctaaatgtttttctctcacataggattccagaacactgctacgagggattccagatcactgctgcttggttctgagtgtttctccctcagataggattccagaacactgtggctgtggcctgaatgtttgtccctcactt

SEQ ID NO: 472784 - DNA, 599 bp, Homo sapiens
aggcacactgtgcaaatattgggaaaattcgaatgccggccaactaatgcaggtgggtgagggacatgttgtactccacagatgcagaggcggtggtggtggaggagcataagctggcagtcagcaggacaggccaggggtctgctggtggcagcagggccccgggtactaccacaggaggcaccccctgtgtgcaggtccacgggttcccagtaccattgcctctcaccaagcatgttaaaaattccaaggggttccggtctcagacgtgggcccaggcaagaggtgcatggcctgtggtccttgcaaaggttggcacctgggtccccaacaggcataggagcacagctttggccagaagagattggcaatttcagccatgggacatttcaggtggcaactggagctgtggccaccctggtgacactgaatcaggctcgctgtgcccttcacacagacacccaattactaagatgaggggctttgcactaaatatttgttcactaagttaaagtccactgtttgcatccaattatttttgttattgttttgcaaacctaaaagtctgtatcaatatctcatggctagatttctgaagc

SEQ ID NO: 472785 - DNA, 1024 bp, Homo sapiens
cagcagcagtgttctgggatcccatgtgatgggcaaacattcagacattcccagcagtgttctggaatcctatgtgtgggacaaacactcagaccccagcagcagtgttctggaatcctatgtgaggtacaaacattcagaccctggaatcagtgttctggaatcctatggaaaaactttcagaccacagcagccatgttctggagtcctatgtgacagacattcagaccctcgtagcagtgttctggaatcttatgtgagggacacgcattcagaccacagcaggagggttctggaatcctatgtgagggacaaatattcagaccctcatagcagtgttctggagtcttatgtgagggacaaacattcagaccccggcagcagtgttctggaatcctatgtgagggacaaacattcagaccccagcagcagtgttctagaatcctatgtaatggacaaacattcagaacctcgtagcagtgttctggaatcctatgtgaaggacagacatttagaccctcgcagcaatgttctggaatcctatgtgagggagaaacattcagaccctcgcagcagtgttctggaatcctatgtgagggacaaacattcagaccccagcagcagtgttctggaatcctatgtgagggacaaacattcagaccacggcagcagtgttctggagtcctatgtaatggacaaatattcagaacctcgtagcagtgatctggaatcctatgtgagggacaaactttctgaccccagcagcagtgttctggaatcctatgtgagggacaaactttctgaccctcgtatgtgttctagtattctatgtgagggacagacattcagatcccagcatcagtgttctggaatcctgtgtgagggacaaacattcagaccccaggagcagcgttctgaaatcctaagttaagggtaaacattcagaccccagcatcaatgttctggaatcctttgtgagggacaaacattcagaccctcgtagcagtgttctggaatactgtgt

SEQ ID NO: 472786 - DNA, 697 bp, Homo sapiens
gggtgaagtgactgaaggctgtagatgaaaaggttcagcatgggggtgaccacagcatacatcactgacaccaccacaccattcctggggggtggtgacacagctgaagtcaggtacatgccaatgcctgttccatcaaatcagcaaacaactgccagctgggaatccaacgggctaaggaaaaaggacaccaagacgaagaagacacagagtcaggagcatgtcttccatgcatgcaaaaaggacaaagaaagacatccgtgtcaggcagccctcataagagatgactctgctatgcgactgcatgttcacaatcatcttgggaaccatggccaaggtgaaaccgatgtcagctcagcagagtttggagaggaagaagcacatgggggtgtggagcggggagtcagagctgacagccaggatgctgagcaggttcctcagcaccgtgaccatatacatggacagggacagggacagcaaagcgaggaccggctgcagttctggatcctctgagagtcccaggaggaggaattctcagacacctgtgagattccgtggctctgtgtgacttggacaccttgagaagtaaagaggattggaaaaataaaagataaaaaccagcccttaatgctggatgcaagcaattcacaaggaacattttcacacttgtggaccatacaccgccagcaatgtttct

SEQ ID NO: 472787 - DNA, 1688 bp, Homo sapiens
gttcagtgactaaaagtgcctaccatgagcagctggaacccactccctgagagcttcaagatgcatgggtacctcttgtacctgtttgtaattacagccaaggaccagcaggcagcattactgcatccacatggggcttttactggaaccagtaagtctctgccagcccctcacaggctcctgggatgccactcgttctgggtctgtggacagacaaccaggacacttgctcagtgcccacccactccttgtggcccacagcccatcactcaaccccagccccaccatcccctgcttcctaagccgttcctcatgccagaagaaaaggcaatgcctttgtcccacagcctctgccttgtgtcatgtcatgtggggggagctgtcagtgggggagagagcagccctggaagagaggcccacctgcttctgtctgacttcagggcagcctctcagggcaagaacccagagcagatggaggcctcacagaagcctgtggcagggctctgggcttggtggctgaacatctccctctctgctgccagccatggggcccagaaccacccattcaagagggtcaccaccacattgcagagccagggctggaacaaggacctgtggataatgagggaactgctctgcaataaccggcctgagcagctgcttcaagaaacagccacaatcaaggcacctatagcccctgatcagggcagcccagcaccactgatggtagaggggggctacctccgatcaagctgtgtctccacagctgacccgtggagccaggaggtgatttacaacttctgcaaggcagtcagctccgtcagctgtatgcccttcaacattcacttcaactcaaacatcccaccagaaagcagtggggactggcgaatgcagcagccctgcaaagtggaacagagcatcctgggagcccaacatggaggaggaggttgccgtcctgggagcctgagggagctcttcccttgcctgctggcagagcccaacgtggaggaggaggttgccgccctgggagcctgagggagctcttcccttgcctgctggcagagcccaacatggaggaggaagttgccgccctgagagcctgagggagctgtgtctgtctggggcttctgcctggggttttgcaaagagctacttatgaatatagtctctccagattccttgtttcaaaggaagtgagcatgagctagcaagtgtagcaaccccacagctgataaacaactttgtcttggttttaaaccatcacatcttcatttcacattggaataaagtaagtgaaacctgctaccccagccttgcccgtgtgttctgtaacccagtctcctttggttgtgagggctgttgtcagaaatgttataagaaaagattatgcataaatgaaatcaaatgtaaaattatgcttataatgtcacttgagtgaaagtgaaaacggttcacatggctaacaccacttcttaagatacgggcaccatgtaaagctgagaatggattgggtttagttactattgtgcctcctcctcacccgagaggcccatttttcctggttgattcattaagtgtattagtgctgtcagtcgcctttggacaactcaaatgacaagtggctgttgtttcataaagaaaatgaaggctttagatgtgaaaccctccttttctcttctgcttctctt

SEQ ID NO: 472788 - DNA, 1279 bp, Homo sapiens
tctcctcttaatgaaaacatctcaattcatttttaaggatgagaaaatcacagagactgatagtgaaccagaagaaggtgaaattacagactctcagaccgagggtagttatgatgaaggcattaccagtaaaggcaatgcaactgcaaaagatactgaggaggcagatgaggaaaaagtgtggccctcatatatgagagtaattgtcattagatcacctgtgttacagacaggatcattcttcatcattactgctgtaaaatctgctacaattggaagagaaaatgacatggagcatactcttcgaatccctgaagttagcagtcaaaatggaacaattgttaatgtaaaatggattgttcagctgaaaactaaatgtgacccttatgaacctgagcatggagataaagtgaaaattggagacactgtgttatcttattacattcaccctggcagtaatagctgtgttggatgtgaaccagggcatgttagagctcaccttttccttgataaaaaagatgaatcattgaatacagactacaaagatgataagatactggagaatccaaaatgtaaagatagagctggaaaacatagggagcagattggaaatgaaggaaatttccaaagagatgatgctcctgcatctgttcattctgaaattactgatggcgacaaaggtcagaagatgttgaaaaagatctccggcaaacacatgcaggattggagacagacaaaccgtcttcaattaaagagactcaccttctccaaaacaagaacaacaacaacaagaacaacaactgggacaaagcacaggagaggtttgctgaaaactttcaacaacaacaacaacaacaacaactgggacaaagcacaggagaggtttgctgaaaactttccagaaactaaacttcaaaaagatgacctaggaaccattccttgggtaaaagggactgaggagtgaaggttaatcacaaaagaaaactcaagcttttttataaatagagtttggaaactcttattgcagaatgtctctccccaaaaaagtcagtggcacaagaaagctgtgtcacagtttaccccttcctgattcagaaatgtgtaataaagtgtggtttgcagcttttaaaaaacactttttaaactaattattagtgactgaattaagttatacaaatctgaatttgttgatatatactatacattcagcatttgtatttggtttgtttcatagctaatcaaatgtttatacatgaacaaatgagtacagtattgaaat

SEQ ID NO: 472789 - DNA, 2609 bp, Homo sapiens
cactctgcctttggacatgtgagagagcgcacctttcacttgagcttcaacatgggaaagggaaatgaagaccccgatctccactgttcctccatccagtgctccactgaccagccccctttccaacagatctcctttacagaaaagggctcagatgagaagaaaccattcaaaggaaaaggcaagaccgccttctcccattccagtgagaagcacacacaaaggcaagcaggatcagatcccaatccaaacaaggagaattctgaggaaaccaagctcaaggccgggaacagcactgctggatcagaaccagagtccagctcatatcaggaaaactgcaggaaaagaaaaatcagttccaaggatatctgccaagacagagcagggaactgtccagaagaggagtgcaacttgacgttgaataaaaaatcaagatcctccactgctgtgcacaacagtgaaatccaggagacctgtgatgcccaccataggggaagttccagggcttgcactgggcgcagcaagcggcataggtctcgggccctagaagtccaaacaccgtcacttcgaaaaagcttggtgacctctgtgcgagctatgtcggaggctgtttatcaagacctagcccaggtgtgggcacagcagatccattctccactgacctgtgagcagctgacactgctcactcggctccgggggcctctgtgtgcccaggtgcagaccttgtattccatggccactcaggcagcttatgtcttccctgctgagagctggcttgtcccagccacactgcctggtcctggggattcagccctggatagagaagcccatcccttccctgggcaggagataactgagcctgtcagtggatcagatgaggctaagctgggagcaccctgaccctattcagcagagatgcagctctgggaatgagaacaaggacctgcttcttctcagattcttccagacgaccagcagtgacaattttagatgcactgtgttaataaatgacagaacctgaagaagtcataggaaagaaacttgagcggtatactcagaatggtgagccctgaattttgcagaccgctaaggctatagacaaattttatatttcatgttagacatttgataccttttggatgtctgatgacagtcgtgcatttctatataatcagaaaaatattaggttgcaatcgtgaattttcatattttagattgtagaaaagtaaatataaaattatatgctctttttttttttgagacagtcttgctatgtcactcaggctggagtgcagtggcacaatcttagctcactgcaacctctgcttcctgggttcaaacaattctcatgcctcagcctcccaagtagctgggactacaggcatgtaccgccatgcctggctaatgtttttttcttgtattgttagtagagttttgtcacgttggccaggttggcctcggactcaagtgatccaccagcctccacctcccgacgtggtggggttacaggcatgagccgctttaccaagaaattgcttctcttttaattcggaaaaggttgtaggctcttccagcctgaacccatggagtactaacatccacaaaccattaatagcactccctgtgggaaaatgtttatacatttttacagtttgcatagtaaaattactatgcaagctgtttacttttaatatttctacataaaatttaagtcaagatatattaaatggtaaatgattgtacttatttattcatctgcctcatgttttatttcattttaaacatcctgaatttatattttattgtatttcatacatttcaattgattgtactgtattgcaggatatggagatttcatcacatactacaatacagtgtattttgttatatttgacgtatattctacttgtattttgtactgagatcatacaatctttcattatctaagtgtattaatgacttgtttggttgctttataattttcattttatgtaataatgaaataaacattaatgttgtttggaattttaaatttctttcatatggaatttgtatttaataaagatgtgaaaaagagaatgtcttatcttcacttctgcatcatcctaaccctgacctccccacagcccacagctcttgtcatagtctgggaatagtgttctatcactacaggaaatggggccaatttaatggtaatacacagatataagttggagatatagagattttattctcgaccactgcagtataaaagaatcacagtaacgcgagtcacacaatttttgggttgacactgcttatgagttatgcttacactatgctgtagaataactctgaaataaatttatgtctattaaacaaatgcacacacataaataacatgtctaaataacaatatacatatcttaatgaaaatgaactttattgctaaaaatgttaacacagatacacacaatgggatcatataatgttgaaaaatagagatggggagaggaacagaaacagagagaaagggaggaatggagcgagaaaaggacagatggacagagggatattggaaaggagaaagtagggagggggaggaagggacgtggggggggaggaacgcc

SEQ ID NO: 472790 - DNA, 627 bp, Homo sapiens
atagtgttggaccacacggggttcagaagaagacagaaaaatgttaggaagtttggaacttcttagagacttgcagaattgttttgaggaaaatgctgatagtgacatggacaatgaagaccaggctgaggtggcctcatatggcgatgaagaacttgttgggaactggagtaaaggtgactcttgctatgcaaagagactgacggcattttgcccctgcctgagaaatcttagcaaagtgttcaagaggaagcaaagcataaaagttttaaaaattttgcagcttgatgatgagatagaaaaggacaacccattttctggagagaaattcaagccagctgcagaaatttgcataagtaacgaggagctgaatattaatcaccaagacaatgggaaaatgtcttcagggcatgtcagagaccttcacggctactcaaaccatcataggccaggaggcctaggaggaaaaaacggtttcatgggcccggtgcagggacttgcagctctgtgcagtctcagggcttggtgccctgtgtcccaatcatggcttaagggccaatgtacagctcaggctatggcttcagagggtacaagccccaagccttggcagcttacatgaggtgttgg

SEQ ID NO: 472791 - DNA, 1290 bp, Homo sapiens
ggtagtgtcgcccgcagggacgccgacatgctggaggttcatgtcagcatgggctctggcagccacgtgggccagcaggagggtcccgctgcacagctgtccgtgcctggggctgactgcggcagaaatctggggaagtctggagaggagctgggagacacaggagagtccctgaaggctgggggtgaagaggtgaaagaaatgggggagggttgcagtaaggtccctggtgaggagcttcctcttaagtctgagtttctgagaggggagaaggagaagctgggtgaggctagcatggattttggggagtccgggctgggggaccgttcattagaagagccagacaagaccccactgttcttagatgcagacatgattaggaaacctgcagctcccagggacccctaccaattttctaacccccagaatgaaggagttttttgagactttattttgccgctagcattttgtttttgttttgttttgtttttaagttctggggtatatgggcaggaggtgcagatttgttacatagctcccactgtaagtgagaacgtggtgtttggttttctcttccgggattagtttgctgaggataatgacttcacatcgctagtgttttcttaaatgtattcatcttatttatgaactctttgtgtgtatttttttctaggttttgatcttttttcttctgttatatgtattaacaagaaatttactttcaatctgttgattgacatttgttttcatggtgatatgttttagaaagtaatatttcttaataagatgaattatattgctaaattttgttgtactagattgtttagtagttggtctgccttttactagacatgttgttctctgtacctcagtgtcctcatccataacatagcaatataatagtgcccattttgtagtgtgacatgagaattaaatgaagtaatacacatgaaagacttagaacacacaaaccctcaatgcatataagctaccactgttattaccactttcttgaaatggaagttaatttattttcactcttgtgtttcataaatttaacgaatgttacaagttttcctctgagtatgattttaagctattttcctctgttttggatatgtacttcttttgcttttatttatttccaaatggtatgtgactattattttgatttcctctttaatccaagcctgcatttaaagagtgtcctcgggttcctttcaatcttgaggtgaataaataacttacagaacactctttatgtccttttgtgaatttaattgcattatg

SEQ ID NO: 472792 - DNA, 533 bp, Homo sapiens
ttctgcgatgctgggagcgcgagcgggctcgggggttgctaggcagctgctgcctgcacacagagggcgactgcagcttgggcgcccaggcggcggagcatggtctgggtgtcgtctggaatgcgtgcgcgccaggcttgagggccccctggtggtgccacctgcctcgctgctgggcgcctccctgcccctgcgcctgcgccggcgctgggcctttgcgagggctgagctgagttctcctcagcacagacccggagagcatcgcgagggcgaagctgagttctcctctgcacagacttcggagatacagcgaaggcggagcagcgttctcagcacagacccgggcgggcgggccgggagcaccgcgagggcggagctgcgttctgctcagcacagaccttgggggcactgcctcgctttggtgagagatgagaatgcagttttattcccctacatgtggctcgccaattatcccaaaatcatgtgttgaaaagggtgtcctttccccactttatgtttttgtttactttgtc

SEQ ID NO: 472793 - DNA, 844 bp, Homo sapiens
ctgcctgctgcaaatccaagtcggaagtctactggggtccattgggagtaacgaggagccgaatgttgatcaccaggaccaaaggggaaaatgtctccaggacatgtcagagaccttcatggcagcccctcccatcacatgcccagaggcctaggaggaagaaattatttcctgggctgggcctaggctctgtgcagccttgggacttggtgccctgcatcccagcacgtgtgattgaaaggggccaaggtacagctcagaccattgcttcagaaggtacaagccccaagccttggcaacttccacatggtgttaggcctgcgggtgcacagaggtcaagaattgaggtttgggagcctccacctacatttcaaaggatgtatggaaatgcctgggtgtccaggcagaagtctgctacatggacgaagccctcatggagaacacctgctagggcagtgcaaaggcgaaatgtggagttggagcccccacatggagttcccactggggaactgcctagtggagctgtgagaagaggaccaccatcttccagaccccagaatgggagatccactgacagcttgtaccatgcacctcgaattgctgcagactcgcaatgccagcctgggaaagcagctgggaggggaactgtacactgcaaagccacagggttggagctgcccaatactatgggagcccccctctggcatcagcttgacccaaatgtgagacatggaatcaaagaagataattttggagctctaagatttaatgactgccctgttgaatttcaaaattgcatggggcctccggcccctttgttttggccaatttctcccatttaaaa

SEQ ID NO: 472794 - DNA, 1384 bp, Homo sapiens
gagaaaagtcactcaaccatggggtgcttgctgctcccaccccagctgcctaagccaccaggggccggggcacaggtggaagaaggtggcctcagtcctgggccctgatgcctagaagggcatggtcagtgccctccaggcagccttgcctgatcgttggggctcgggaccagctcccactctgctccactctctgctggctggactggccacccctctgtctgtggaattcacttggtgccagtgcccttcctggaggatgatggccggcccccatgctcctcgtcaccaggtcctgctctttttacctccattcatcgccactgctattaaagagtcgccctcttgctagattacagttggcttgacaagtcagttgactgttctgatggaagcttcttcttgggcagggccccagggccttggtgggacccgggccctgggtgggggcacagaggtgggacacaatgatggctttatggagcaggccctgcccgcccctgtggcactgtggggagggggctcacctgtccctaggccagggctcagcacggcagcggtaaacctggctggccttgacacttcctggaatctctcagtgaccacgtttctttttgcaccaaatagctatggttcttgctgttcgtttctctccctgccctcctttaagaaggagagttcgtgggaattagacactcagggttgggggagggtaaccttggctcctggtgggaggagtctgcgtccttctctgggcccagggcctatggggcagcaacagcatctcctctattctcagagcatccagggacagggtcacaccatgggtgtgtggtacaccaggtcgtccacctggctgaaggcctgggctggtgacaagtgctgtggtgctgttcaggccagcagaaaagagggaggcacatttctgtcagcagacgggatggggtatggctcacacctgctgggctggaggctgtgctccacccagggcctcaggctgtgtctttgacaacaataatcaccctatgggcaaggtctgcgtgctgagcccttgtcagtcacatctcttataatccaacagcagctctgtgggcctctccttacagatggggaggctgagccccagggacatgaggccacttgccaaggtcacagagccagtgggtgctcagctgaggccgcgaggctgggagaggcacccctcaggattttacttccccagcagggctaggccctgggcaaagagaatcagatggataactttgaaatgctggctccagggccagccagagtctgtagggggcctcttgtagggggcctgggcaccaagtttgaaatgctttcaaatccatcaatttgctttgttttctcatcttggggtcac

SEQ ID NO: 472795 - DNA, 1379 bp, Homo sapiens
tgttgcttgatgcccccacgaggatctgtgtctgtgatcatgaaggcgatgcccttggctcccagagaatggcattcaactgctaagatcgatgaggctaatttacacctgggatctagctatcacacaggtgaacagagctgcactcattcagatgtctaccttcggagaacctttagaggccctaccgctgtggttcccaccacactgtggctgcataaaggaatcactggggccaaatcactggggccggtcatagtcagctcaggctaccataagaaaatatcacagactgggaggcttaagcaatgcctatttctcatggttctggagtctgggaaatccaagatcaaagtgctggcagatttggtgtccggcaggggcttgctttctggctggcagacagctgccttcttgatgtgtcttcgtatggaagatagaaaactctgtctctcttcctcttcttataaggacactaatcctatcagggggtctccatcctcaaaacttcatctaaatctaatcacttccctgcatccaaacaccaccacattcaggattgcggcttcaacatatgaattctgaggggcacacaaacattcagctcacagcatgaccccagtgctagggcagtgacattagaacccctggaggcagagcccagatatctggacttattagcagctctccactgtcttccctgagaggtgaggtccttctcagggaatgaagacatttcctgagagaaacgtgggaagtgagattcaaagggaaaaagacagacactgggtgggtgggaggaagaggcatattaacacaaagcgactgtgatacagttggctatggccataaaacaatgaccaaattacccttttggtgtttaggattgctaacagtcatgggcctaatactcctgaagcctgaggtcacctgaaagttcctgaacctcttcccagattttgcagcatggcaaaacaggttttgctgcaggatgggttatgggagcggggggagaagaagagggaaaatgtatgaggcaaagatggtcttgctaaacagatgaaacttcacaggtagcagtcctgctctcaaggaggaaaaatatagacggtagtctgaggaaaatgtttctctgtcagaccttgaaaggtgtcaagctctcagctaatctttcgtagatgcagaccaggagggttgtggggtggcataagagaaatcctgtttgcaccggctgtttacttcactttacttcctccgcaggtgcaaatatcccccacaaaagacagcttttcaggagttttcttgtgtctgcaggaggtccttaatcttctcttttcaagcatttctctatttttatgtatttaagtggttataaattt

SEQ ID NO: 472796 - DNA, 1075 bp, Homo sapiens
gcgttcttagcaaagttgaaggccagtgatgaacaggactgccagaagggcttgcattttgcaccctgagtgtcctccaaaccctgcgtggactccaagcttcctggacatttctgaaacaggccttaaagaggagagagatgagtacacagatgaagccccacattgctataaaagtcaatgtcttgaactgagttggaatccacatcaacatgcccttcccatccccagaagaaagcagagaacgtgctgtcagggccctagactggcaaggaaatacttgcgacttcgggatggtttctctgtaatatctgagaagggatcatcccccagacaggatgagaggaaggaggtgccgctgtgggtcagcaaagaccagggaggaaggaaggcccaggaaagagaccgcagcccatgccccccactgtccaggatggcctcggacaggaggggagaaagtatttcaaagctgcaaggcactgcacgtataggtgatgatgttttcagttgtttcataaccagaatatttttaaaataaataatacttcagaaacattcaaaagccatttggtagcatgcttaagatggaaaggtttgtaactgaatatctaaatgagaccattgccctgaagatcttcttttatttctttcaacagtgtacttttctacgaacaagccttgcattgattttatgtaatttatttctaagtattttattctctttgttgctgtggtaaattaaattgcattcttagttgcatttttggattattcattactagtgtataggaatacaatggattgtttttcaatttctgatcatggcaaaacacacataacataaaatttaccattataaccattttaagtgtgcctttcagtgatattaagtgcattcatgttgtgcatccatcaccatcaagtatctccatatatcttttcatcttgtaaaacaaactctatacccattaaacaataactccctatttcaccctctcctgaacccttgtcaaccaccattctattttctaaagttgaatagtattccatagtattccattgtgtgtgattgtgc

SEQ ID NO: 472797 - DNA, 506 bp, Homo sapiens
acatcacacaccgggccctgtctgggggtgtatttggttcacagttctgcaagccgtgtaagaatggtgccaagcatgcttggcttctggggagggctcggggagcttttagttgtggcaggaggaaggagagccagcgtgtcagatggcaagatgatcagccaggacgcatggcgaggaggaactgtccagtatgacagtaaggtcagcttggatgtctgcaatgagcccacactgatcagctctatccaggcccaccctgggtatagctttacctcaagttttcaacaggtgaggtttattgaaacatgtgaacacaggtctacggcctacagaaacagatgtgggtgcaagtctgtcatactactattgtctgtggaaacagaagagggcacaggtttacagtccatggaaacatgtggatgcaggtctaaaacctgcagaaaaagatttaagcacaagtctacaaaaatagatatgggcaaaggtctataatctatgaaaac

SEQ ID NO: 472798 - DNA, 902 bp, Homo sapiens
tcccaggatcaatgcagctgcctggatcatggaactcggatctcaggatctattctcgaccctagttatatcagtttccttccctgcagggactaattctgagacaagagatggagaagaagaacttgttgggaactggagcaaaggttactcttgttatgttttaacaaagagactgggtgcattttgcccctgccctagagttttgtggaagtttgaacttgagagagatgatttagggtatctggcagaagaaatttctaagcagcaaagcattcaagagggcagtgcagaagggggtcagagccccagcacagagcctagtggagctgtgagaagagggccaccatcctccaaaccccagaatggtagatccaccaacagcttgcaccgtgagcctggaaaagccacagacactcaacgccagcctgtgaaagccgccaggaggggggctataccttgcaaagccacaggagtggagttgcccaaggcaatgggagcccacctcttgcatcagcgtgacctggatatgagacatggagtcaaaggagataattttggagctttaagatttgactgccctgctggattttggacttgcatgggacgagacttttggtctgtggacttttgagttaatgctgaaataagttaggactttgggggattgttgggaaggcctgattggttttgtaatgtgaggacatgagatttgggaggggccaggggtggaaagttattggtgtgatgttagatcattaattggaagtgttttaaactttttgtggtaagcatttagcactataaattttgctcttaatactgcttttgctgcctccctgagattttgatgtgttgtgtctgtttttatttatttcaaaggagattttcatttctgcctt

SEQ ID NO: 472799 - DNA, 531 bp, Homo sapiens
tttaaagacctgcctcagcagtccaggaatgaaggaaggtggcttggaccaggtggaggtggtggtggcagtgaagaacaaaggagagattcatatgttcaggaggcccaactcagaccctctccttccaggaaccctctgcagccatcacaacccttggtgcctgctcttgcctctgaactatgtgagagattccaggttcacttctttgcaactcacctcagccccgagagctggaacagtctgggtgcagggcacggtcctgcctgggcctcgctttcctcctttgtcaaacgaagaggaaggaccaattttgcttaatgtttgcctagctgtgcagttggttcttctcatgacaagtgtgcactttgaaggccctgtggagactcgtgtgcccttctctcttaatctaccttttgaaggcgtgcccagttccgtcatagctgtatctccttgtgcatattatttgggttaacattctaagcactggggaatatcttttttcttccattttataagtaaaatgaaaaa

SEQ ID NO: 472800 - DNA, 556 bp, Homo sapiens
ggaaaacagtaaaaccacactctgtattttaatcttctgaagacaaggataatgactgcatcatctctcagccacttgcagaagtctccccagaacgtggtcctgcagacatcacaggtgcctgcttatctcaccttgtgtgtccaccatgagactgtgaattcctccaaagcagaggctgttttcacctgctgtgtgtccccagcttcaccagtggggtccagaacagaggagatattcagctccatcggatgtctgaccacccttggttttcggctcgtgtttaagggtacagcactgaaatctgccaggaagctctgggcactgcagggcagaaagtcctgcaaaactgcatggggtctggagtgggaactgtgggcacttctcctgggtgacaccattgctgttggaatgaaactgattcaactgacccatcaacaattttttaaaaaataaatatagaaattgacacttctgctcacaggcatgttccagctcataccctatgccccttccttatttggaaatgttattgcttccttaaacctttttagca

SEQ ID NO: 472801 - DNA, 853 bp, Homo sapiens
cagtgacctggaagatcagggagaggcagtgtttccaatctcaaaggaaagaatgagggagaaacagagggacccagaggacagatccaggatatctagcacatggatagcaagagctccagaaggggaagaaggaacagatggggaagaggccagaagaagggtgtttctggatgccaaggattcaaaggagagatgttcagatgtgtccggagtttcttccttccggtgggttcgtggtctcactgacttcaggagtgaagctgcagaccttcgcagtgggtttgtggtctcgctgacttcaggaatgaagctgcagaccttctcagtgagtgttacagctcataaaggtggagctacaacattctttgctatgacctgctgctcctcctggggagagcctctgcagaagatagctgtcatcctctctgacatagctgtcctacaatggggcactagcagcccaggatcctatgatcctatgatcctgtgtgatctcctacacagtaagcacttgactagagttggatttaatcaggggtgggctcctgatgggaaaatttctttgtccttacctggcatatgttatgggttgaactgtgtccccctcctaaatccatgtgaggcccctgaacatttctgaatgtgatcttattagaagatagggtcattgcagatgttagtagtaaagttgtataatacagttgtgtaattagtaaaattgtggtgctgcccaggtgcctaaaagtgagcctgaggtcatgagggtggatgctaatccaggatggctggcatgtttataagaagtggatacgacccacaaacatgcttaaggggaagatgatgtgaagac

SEQ ID NO: 472802 - DNA, 497 bp, Homo sapiens
gtttgatcacagccgtcaaaagcatgtggaaactcccagatcatttttttaaattagagcctttaaccaaggaagtaagccaaccactggagttcccaagtcccatgggaatttgccaataccaaacactcaggctcagttcaccctcaggacacccccatcccaaagtggaaaatcctagagatgacattttaagtttacaagctttatctcatggtgactgcaaaacaaatctccccccaacagcctgctccccgaaccccggggaagtgttgagaaactgtcttgggaggagcagagcagaagaagtaaaagaacgtgaaagaagaagtcctgagaagttctggcctcacacattttcacctggaaaagtgtggcccgaggttgctgaggagccacagctgcacatttggtctgaagtggtccccactgtggtgcccacaagatttgaaagcagcgaacacaatccttcattaaatgagaggcacctgtagtag

SEQ ID NO: 472803 - DNA, 766 bp, Homo sapiens
agagagttcatgcttaatggggacagagcttcggtgtggggacagtaagaaagacctggaaacagagtgtggtgatggccgcacaacaatctccagaaaagatgttgggtggcaggttccctgggaaagatggcatggagattccacagagcaccaacagcagcaagttgccctctactgagagcagcagctcagcaaggagcaggcctttggccacacgaaatgaggggtcatgacaggcagtgtggagagggagacaggtgtgacccaggactgcaaagagagtcctggtgggcagcatggaaaggggacaggtgtgacccaggactgcaaagagagtcctggtgagcagtgtggagagggggacagagtccaaggcccagccccaccacagacagcgatcagcagggctctcccaaagaaggcagattctagcaccacagcagaacagatgcagtgtgattggaaagtgccaaagacgagcgaggaagatgaaagggaaagtgtgcctctgctgttcttcactcgtgctggtcgaatggaggaatcggaaggcatccaggcatgtcttcatgtaaaggagcacaaacacacccttcagctgcattttcctctaagacagaggtcttcggggagtacagcagaaatatcttgctttagaacctgtcagtaaacacttgggccatgggaacacattgctatggcctctgcagcaccttggaaggggcccttgaaagtcagtggcatgaagtcactaccttccatg

SEQ ID NO: 472804 - DNA, 398 bp, Homo sapiens
ccgtgttgtagtaattatgtctccagccagtacccaatgtgacaagattagcagagagcacggttattcatcatcagaactgggccgcacgcgtgtatatttagaagtgcctgacatccttccagggctgcattctcctgcattatcatatcaattggagccctgctcctgtgcagctgagcacctactctgtgttagacactggaagtacagaagtgaggatgtgcacctgccaccgctaaccaagaactgtgggaacacagaggtggggtccccacctacgcctacagcacgggaatgccaggaaggctgtgtggaggagcagaggggcccgagcatgtggactgggccccggtgtccctgaacgccctgatgagcatcgcgtctcacacttaaac

SEQ ID NO: 472805 - DNA, 751 bp, Homo sapiens
tgccaacagctggtccttcccagctctgccctgcaagcagcagtgtggcccaggtggatcttccaagtcccccctagctgcctggtcattcctccttagcctcagacctgccatcattcctggctagaaaagaggcttggtggcaaaccagaatgtctgccctggagagctgggcatcaaacctcacagggcagaaaagctcattggaagccccagagcacacagccagcagggctatctgtcagcctctcctcctcctctcctccacctgccacggcatttctctggggaaaaggctttccctccgggtcatctccattaactcacaggatggagtggggattagatcccagctgacggaacccaggctcctcttcggtcctgccctgacagcccaggggaagcctcacatgctgacagagaacaaccacagccatgacaaggaccacaatgtctgccactgcctatcctcctattcccgctgctcctcagagcacaatgcaccacttcctttgtgccaggtgagagcccacccttggcccaaattcacgagttggtgagaggcccaatcagcttccagcccgaagcgctgagctgggagccaggaaaaggactgagtagacttgaatttgagtttagacaaataaagaattgtgacatctatagagcagagatagaacagacaatagaaaaacaagagaggaaaatcaataaaaccaaaagttggcttctagaaaatatcaacaaaatc

SEQ ID NO: 472806 - DNA, 680 bp, Homo sapiens
gtagcagccggagcatctgcatggttttttggtttccttgtccccaggtcccacggaggcggtgcaatgggcccacatgtatgtcatgcaggcagtggtggtcatggtgtgctcgccctgacctacttagatgccacggagactgctcagcctctggagactgatcggcctctagagactgatcgtataggtgctccctggtgccgactggcgctggtgcagtctgctggtgcaggcccctgggaagagtctgcccagctgatgtgggtctttcctttggtgatcctgcatcccctccatgccagtccatattccttccgtttccatggctgtactgagcatagtattgtgtccggaatttactccttctggtgggttcttcgtcttgctgacttcaagagtgaagccacgggccctcatggagtgaagccacagaccttcgtggacctttgctgcgagtattacagagtggtgattggtccccactcgacccaggaagtccagctggcttcacctctcagtatccaataggtagtttttcaacccttactctcttccttccctctccactctagtagttcccagtggctattgttgctatctttatgtccataagtaccctatgtttagctcccatgtatagcctttgtatgtatgtctcattaaaaaaaacttccagc

SEQ ID NO: 472807 - DNA, 620 bp, Homo sapiens
ctgttctctttttttccagccatgtcctgggtctctcaggcccttccttcttattgctttttccctcaggaggatgtctctactttaacagaactgacaagaaacagtgaaccaccctcattcctacttccctccaggcggaaccactgggagggcgctggcccactgggcgaaggctgcctctacttgggatgccagaagagagtgcggctctttgcagcatccacgtctggtttggatggctgctgcagcttcaagcctgggctgctggatgacaatggcgatgatgctgatgaagaccctggggattgcactgggaatagaacagatgcggtttctgaccccacggagaattctgctgggggagcaagatcctgtgggttccgcattgccttgtcaagactggactttctccgagagcccgtggaactgctgacctgttccaagcagggcatgagcaaggacggcggaggcagtggggatctgtacttcaacctgcactgggtggtagtgagccgtggaccctcgcggtgagcgttacagctcttaaggtggcgcgtctggagtttgttccttctgatgttcggatgtgttctgagtttcttccttcgggtgggctc

SEQ ID NO: 472808 - DNA, 1002 bp, Homo sapiens
ggtcaagaagatttctagatgctaggcctgaagacccttcagctggagcaggcagcggcaagtgacagctcttcctggtttgcagcttggaggtcccaaatccaagattgggatgtgtagggcaggccagccatgtcccagtccatgtaagctgccagaacagaaagccacagatggggaggccagtgaactacagagattcctttctcacggttgtagaggctggaagttcgagacccaggaatgtgctcgcagatcccgcccttcgtgggcactgggtgtcattgacttctggggaaagctgtttccacgggcagcattaccagtgcaaatgaaggctctggagtcctggttggaaccccaactccacttcctaccatctgcagcacagcaactgtctgagctctctggttgttcaaataagcctgtggacctccctcaagtgatcctccgggaattgaattgggccactcaagcaagggccccagcacagtccctggacactcccagaatgttactccccccagctggagggctcccaccctggcaacgagggctctccaagaagccatgagcacactcccaccacccaatccccacaatatacaagttggcaaaacaaggcaaggaggctccaatagaaagggacattcaccagctcctgcccccatctgaaactgtccccgcctttcctctctgaatttgggccgtcacttctcacatgcctgacatttgacaggcttgtctccccaccccagtctcagagcaccacccagcccagcgtctttcagggagtcagtccagtgtggccacactgggagcagcatgtagacggtgcatgctgggcaaggcagggaggggtggccagggcttggccactcccctgtgctcacagagtgacactcagtcccccagccttcccttaatgctaggcactgaggccctctgcactgtcccccttgccgcctttgtgattagtgggatgaagcaagccagcccctc

SEQ ID NO: 472809 - DNA, 640 bp, Homo sapiens
tgcactcgggtgcatgggaatgcgtgctggggaggcctttcccagcccagcagggggcacgtcctgtctcacaggccctcccaaggaacggtggggcggggccctcgggcgagtgtggccaggctttcctgatccagcagggtgctggtctggcctgccttatagaatgatcactctggccattgtggtgcgggagatgctctgtgtggagggtggaagcatggaaatgcgttcggaggcggaagatgagggcgggtgtggaccagctggcagcaggacagtgctgaagaaggggttggatctgggtatatggtattggaagggcagagcccccagctttgctgatggaggaatgagtgtggaccacagagcttccgtggaggcaggaggtggcagagcgctgcgaggcggctgttccagggcatgggggtagtagtggcaatgcaagtcctgcctgccccagttgccaagagtgagtggggagacaggaggggtctccttccaagcccatggttttgagaggcaaggacacactgaaaccaccagagtctgtctctagcctggagctgtcccctgagccccagagctggcatctaacttggatgtctccgggcatctctgacatcacctgccctcatcc

SEQ ID NO: 472810 - DNA, 726 bp, Homo sapiens
ggagggctgggggccgtggggagtttgagcacaggcgagaagcggacggttggcccaggggtgagtggggaaggccagagggagcagaggcccagtcctggctgtgtatgctgatggggagtgagggaagaggaaggccaaaaggctctgggtttggatctcagcccctggaagaacgaaatggcttcactgagaggagattcctgggacccaccaccaacacccaagatcctgttttcttccttctggaaattgtgtggtttttggagctcctcctgggccttggagtcactgacagcaggtttgtgtgctgggaggacacaacgggagagctgcttcatctttctgagctgccgcagtgggataagctctggagaaccttcaccgccggccattccagcaccaggggttcttgtttctgccagccccaggtcccacaccttgtcttacctgagatgatgcctgaggaggacaggtaccagccacagctgactgagtgcatgaagaccaaaggccttcctggaaggggccactgaggggcagggtccacccagggacagggtccacccagggaccggctcattgggcttcaggtcacagtaagatggagagggcgctgagttcacatcacattcaatctcagcaaatgcttatctctactgaaaattccacaagagcattcgtgttctgcactttcccataatcagcttagtgttttgcagccac

SEQ ID NO: 472811 - DNA, 702 bp, Homo sapiens
cattggcatacaagtgtctatggagagaatgttccaggcagaggaggcagcgagtgcaagggccctagggcagagtgggacactgaagtggcgaatggaggtcaccgtggagggacagggtcagagatgcctgggccccgtgagcctttgtgaggacttgggctttccccctgagacaggcaggagccttgctgagattgtaggaacggagtggggagacagttgggaggactatgctgagggtgatgggagtgtgagctgtgagggtgatgggaagtggccagatcctggatgtattttgaagggagagctggcagagtttccaggaagaaatgtgacaattgcttcatggaagttaatttgtgaatggcactcagctgctttggatccacaacatcattgcccagtgagcaaagcagaggacttccacactggctgggtgcttgggcccggagaagaacgtgtctggaacatggggtacctctttgtgctagtacatggtaaaaacgaatggaaggatacaacaatccaatataggtcatggcttagatccttcaggaatgaaggtttgggtcaccttgccagggtcccctgctttggtgctgtgagcagctgagataatttttggtggcctccttgacccttgcatcccagccttccaacaggtgaaagctttgcattcccctcgttaaagccatttcc

SEQ ID NO: 472812 - DNA, 977 bp, Homo sapiens
cccactctgctccatgggctctgctccctggcctcccattcctgctcgccctccagctttttgtgtctgtgtcgcccactcctcccaccatcagtctccatctggatgcaggcttctgggcttccgttcacgcagagttttgggcagcagctcccccagcagccctgcctgccacctcttctggggaagagggttcagatggaaggggcctggaggatgaggataagccacgagggagagggaggggctgatggcttagggaggacttctacaggtgaagctgtcctgggtgctaagagaacaggcagcggccctctgtggcaggaagaactctgttcgtctaagacagaaaccgtgtttctcctgtctgggaaacagccttctctgatgctgcctcctcctccagacactgccaggcatggggcatatttggagctggagctggcagggtggcagagatacctcctgcaagaagccagaagagcaaagaaggccgtgtgtgtaaagagcccagtgctggttcccgaactctgtgggccctcgtcttatctccccggccagcccatccatcacgtgacctccagcactgtggcctgtgtgtgccaggccctccaaggagctcagctcatcagcaagtcccactggttctgctttcacatgtacccccaatctgtccacgtctccctacttattgcctgggtcccccatgagatcaaggagccctgcagagtgggactgggccccacttcctcttgggtccacgtaattatcgatgcttcccaggttctgcccttcagcctcgacctctccctgggccctcggcctggttacctgactgtccacttgagagctcagcagggatgtccagcagaatgtgactgtatttggagataggggcttttttttgtgtgtgatcacaaagaggccacattttttttaattgacaactcaatctctacatacatacagtactgcac

SEQ ID NO: 472813 - DNA, 661 bp, Homo sapiens
atgctcagcattacttcccagagaccctctaggatgagccaccatgcccagtcaggcacactggctgctgcagcagggtaggcagctccgggtgcaggcatgggcactggctctctgtgaggttgtggctggaccaggcacaccacaagcagcttccacggctgccactggggaacacagtagcacctggaagcttggagaatccaggaactacagggctccaaagagggagtcacagccctacttccaggaactcctagtctgggctccccaaagggctgcagctcttctcaccttctcacctgcaatgtgtccccaggaaacaaaagtgaactgcaaggtgacttgtctttactcctacatcctggaagctgtcttgattcttaaaattccaactcatcagcacctcctcatgcataaaaactaagtttgtgtgattgatgcatggtgattggtcagctgacatgagcttgcctccttcctttccactgggtcagtcagcaggtcacaggtcacatcagaggccctgtggcaggtcccatagctgctggggagaagcatctgaatattcctgtcccgagtgtcacaagaaggtctgcagatgtctgataagcagccaaggaaggggaatcagagtgaaggaaaggcaaggattaaaaaa

SEQ ID NO: 472814 - DNA, 676 bp, Homo sapiens
gagccttcgttgcacattgccctggattagttttctgtgctgtgtaacaaatcgccaggacacagcagcttaaagaaacacctatttttttgctcctccttcttgtcagcggcactcatgcaaagcattgtgctgtatataaatgactcgattattgctggtctgcttcttcagcattcaggcatacatggccctctttttactgacatatggagcaactggctcccagttccgaggtggtggaggcagggcactgcccccagcatggcgtccttcacgcatgactggcagatggtgccatttctgggccatcctggcagctccccactgcaggagcccctgcgcaaaatcctgaagagcaggggctgtgggcacctggactggcactgcctcctggtgctcgtctcctggtacccatctcctggcacccacctcctggtgcccatctccgtcccccgccaccccgtgccaccccccagtgtggagcgcagcctggtccgcagaggccgtccgctaaccactcccgaggacacggctgctctccacacggttccgtgactgtcctacaggggtctgccacttcgtgttgcacaagtgggtgtgtgagtgtgtgaatgtgatcgtgtgtgtatgagtgtgggcatgaggtgtaggtgtgaatgtggacatgaggtgt

SEQ ID NO: 472815 - DNA, 816 bp, Homo sapiens
cagccctcagagtgggctcagcagatcatcctggtcttcttgaggccctcgctagaagcacatgctggagctatgctggtacagcctgcagaacccctggcttctgctagccttcttcgtggggctcccagcccctggaccacagctgactggagtagatgcttggaaaaagcttggtggccgcagctgggtattcctttacagcaacacgaagtggattggccgtcggttttggggtcagtggaccacgtcaagtctaacctgtttgactcagtccactcccttctggaggggcccttgccctgtcagtctgcaaaccaccaggcttcttgctgctccacctgtgtccctgctcagcatgcctggcggccgtgggaccctgagtgtccagggcactgatgccaatggggagatcacagccgatttcaccagaaagcagggcatcctgacaacagagcccaggcttccccatggcaccagcgcccagctgatggccctgatgttattttggtggcttaacatcgatcatggtgaaaatatttacaccacggaaagtggcaaatactgcatagtggggccctatggcttggagagctggtggtttaacatcttccagcactccgtggttacaactgtgttcactacattagagtttaaaactgataaatttgcaaaacacgggaagacagaagcacacgttttgtcagccatcagggtgaggctgcgttatgcatcaagagcctctgaaagccccctggatacctctgtgagaaaatgcatgagaaaggcaaatcagggctccgtgttactgtgaaa

SEQ ID NO: 472816 - DNA, 1076 bp, Homo sapiens
tggttcacggaacgagggactatggagttggatgaatgggagagaattggcagagattttaaaaacgcgtataaggatggagcaaaaattccagtctcagtttggtcaatgtgggcgctaataaaagcagctcttgagccatttcaaacagatgatgaggcagattcagatgaagaagaggaggatgagtgtaaaaatctaacttcagattctgaatgtgaggaacagaaaatggagaaaattaaagaaaagaaagggaaactgaaaaaagtatgttttactagcccgtcggttccaactgctgaattaagtgaaaggccacctcctttctctccccttaatgggccagaagatgaattagctacaaaacttactgctcctgtagttgcaacattaaaacctggagcaattggtggtgctatacaaaattctattcaaaaggctagagccgagggagaccttgaagcatggcaatttcccttaatgggagtcagacctgattggggtcgattagaaaatcaagcagtaatggaggatgttgccattgttcagctttctgtccgacaaggacctaaagaatcatatattgattttattgctcggctccaagaggctgtgtataaagccgtaactgataaaacacctcaagatgctgtaatacagcttcttgcatatgacgatgctaatgcagagtgtcaaactgctattagacccctgagagggaagactcatttaactgaatatattaaggcttgtgatggcattggaggtaacttacataaggctactcttttagctcaggctatggctggattaagagtagaaaagaatatgccccgtttctcaggctcttgctttaattgtgggcaatttggacacacaaaaaaggaacgtagaaaaggaaataaaaaggcaagagctaccatcaatcaacagaaaagtcccagtgtatgtccccattgtgaaaaaggccatcactgggcaagtcagtgtcattctacatttagcaaagatggactgcttttgggaaatgggaagagggagctgccttgagcccctcaacaaactcaggcata

SEQ ID NO: 472817 - DNA, 1501 bp, Homo sapiens
ttttttttttccaacatccacatctgtatagtgcgcggtcggaaggagaaccttcagggctattctgcagtgtcagtacaggatgtgagagcagaaacaacagggtatagaagctcctcgagctagcatgaggttacatcctgatgaacccatctgtcccatgggtcctgactcagacatcctggagcttgtccaggatgtgattaacagggtaacagatgtctttgcaaagcactggagagctgatccacacctaacgagtgtcacatcaaaggcaccatgtggatctcttgttgtgggtcttgcaacccctttaagaagggaagtccacttgaccgcccttccaaactgcttttttgttttcccagaggagacagatgattccagcccccagcctttgaatgacccaagcgagctagagttgaccagagacaagctgccccaaccaagccttgcccaagctgaagatttctatcctcatgatggcctgactattcttccaaggtctaacttcaactacaactcaaaccattttccaccctccatgcaggcacatgtgttattctgaggaaccatcccaaaatgtttcctagtggtggagactcagggaggattatgtaaaagaaaacagacaccagattgggaaggatggtggagatgacaagtgagaatcagaatctctggggcatttgaaactgacccttttaatttcttcatatgcaaaacgagaataccaatacctgtttcatggggtttttgtaataaaaaaataaaatgatccatgtgcatagcaatttacacatactcattgttagtcaattattacattattattaaaaaaattaaatttacaattcatacttctaccaggaatgtataagattatctatctcattgccctcagcagtgctgagcataattattttaaaatatattttaaattgtatttaaattaccaaaatatctattaaatttatttaaattatttaagtgattttaaatattttctaattcaataagtgaaaagtagtagtccagtattttaattttcttttatttgattactgttggaattgagatttttttcaaatatttattagccattgatatttggatatttgtgtgtgtgtgtgtgtttcagaaagagagagggagaaagagagatcaggatctatatttatttttacaggtgtctttgttttgtaattatttttctttttgagcatgggggaagaggttgctcattttgatagtaaagatactatccctagactgaccatgtcttattcctactgaactagttttgtctccctctggtcgatgtatatttctaaaggcttccgtgccatctgattaatgatctattttagagttttctccaagagcactgttaaacttataggcctgtggtccccgagctttatctttttttcatgttaaaaaaatctgaaaacgttagacagtctcttctctttagggcaacatgaaatctccataatta

SEQ ID NO: 472818 - DNA, 2113 bp, Homo sapiens
ggccgaataggaacagctctggtctacagctcccagcgtgagccacgcagaagacagatgatttctgcatttccatctgaggtactggcttcatctcactagggagtgccagacagagggagcaggacagtgggtgcagtgcactgtgtgcaagccaaagcagggtgagtcattgcctcacgcgggaagcgcaaggggtcagggagttccctttcctagtcaaagaaaggagtgacagacggcacctggaaaatcgggtcactcccaccctaatagtgcgcttttccaataggcttaaaaaacggcacaccaggagattatatcccgcacctggctccgagggtcctatgccatggagtcttgctgattgctagcacagcagtctgagatcaaactgcaaggcggcagccaggctgggggaggggcgcctgccattgcccaggcttgattaggtaaacaaagcagcagggaagctctaactgggtggagcccaccacagctcaaggaggccttcctgcctctgtaggctccacctctgggggcaggacacagacaaacacaaagacagcagtaacctctgcagacttaaatgtccctgtctgacagctttgaagagagcagtgaaaatttgcagcctgacaatgtgatagaaaagaaaaacccattttctgaggagaaattcaagctggctgcagaactttgcataagtaacgaggagctgaatgttaatccccaagacaatggggaaaatatctccagggcatatcagagtgcagtgcagaatgaaaatatggagtcaaggcccaaacatggagtccctcctggggcactgcctaatggagctgtgagaagagggccaccctccttcaggacccagaatggtacatccactgacgtcttgcaccgtgtgcccagaaaagctgcagacactcaatgccagcccatgaaagaagctgggagggaggctgtaccctgtaaagccacagaggtggagcttcccaagaccatgggaacccacctcttgcatcagtgtgacctggatgtgagacatggagtcaaagatcattttggagatttaagatttgactaccccactggatttcagacttgcatgagactggataatttcaactaatctcttttcagtttaattgattctttcttctgcttgtccaaatttgcagttgaaaccttctagtgagtttttcacttcaggtttgtttgtgttgtttgctataggctatacctctttgttttagcaacttttctaaatgatttttgtaaagtctgtgtttttcttcctgtatgtttttttaaattactattccttcagcttgcctttagctgatgtcttgacaaaagttttcttaaatgctatctgccaacagagaaagagaggattggggtggggggagagagggagagtgggagagagggagagagggagagtgggagagagggagagagagagaaggaggaaggagaaggaaaaagaagaggaagaagaggaagacgaaggaggaggaggagaagaagaacaagaagaagagaagaaggaggaggaggaggagaaaaagaaaggagaggagaggagagggagagagaatattcacagagaatattctctttgaagagatttggttctgtgctggggtactcttggggcagtgctgcattgcttagcctggctgtttacaactctgtcttaggcttcactttctgcttgtgctgagattggagatcagccaaaggtgaagccttagggcttaagatatattgcatatttatttgttttgatttatattgactatattcccccctggaatacaatcttcatgagaatgagaatttttttttccactgatacatttccaatccctagaacagtgcctgacacacagtatatgctccataaatgtttgtggagttaaagaacagatttggatatattttgtaggaattgaccaaatagactttcttttgttattatgtaggcactgaataattctagtacttgcttctaagcaatacattaacatttgtcttgtgctttcatcttctaatcagttcaaatattattttctcaatatctatgatatgtcaggtgctatgt

SEQ ID NO: 472819 - DNA, 473 bp, Homo sapiens
catgggtgggagtgatgtcgaaggcagcaagttcacagagagtaggctctgtagatggcctctgtgacactttccaaaacctgctgggctgctcagaaaattattacttggctctgcccaggttcaagggatctaggagatgtagtctccagggtgtccaggaaggtgagaacttggtgttgatgagtgctagtgacgtgtaccacagtgtgtgtccatcacctgaggccatgcttctctctgctgctgaagagggcatctcagactatattgatgtgtggcatagaaccatcacactgaatggggctttggtagtctccagaagtaaatggtattcccaacctatcactgatctcccaagcaatgctgtccagggcaccagtgctgactgcacaatccagatttctgggaagagaaagcagtccaagacgctggcatgctgtggggtttaggccatatgaatattaacacct

SEQ ID NO: 472820 - DNA, 1419 bp, Homo sapiens
atgaataggaaacaaatcttcattgtagtaagcgcctgacagtccattgagcggatgatggtgccattgtctgtgataaagaagaccgaggagcggccaggggaaggaagttctgttttagacacgtcaattgagatgcctgtgagacatccaaatggatgtgtcaatggggctgcactgaaggcaggcctcgcttattcctgggtccctcccgtgtttctgctcgctgaagaaagttctgggatacatgtgcagaacgtgcaaaataatcaaggtttgctgccagttatgcgcaatggtatagtcgctgtgggaaacattttgatggttcctaaaaaggggacttttaatcctgcagaagatgctggttacaagagaggttctactaggcagaaaaatctgcctggaagatgtgtccgtagatgccccttattttgtcttgctcaaggtgatgggaaggaggatgaagagggaagggagacaagagccttcagatgacctgacacccttctgtagtcatttaatcactttgggagagtggggagaagcgtttgcagggtggatggattgttggataagtgagttggtgaatagatgagtggatagatgaatgtatggattggtggatagatggatgggtggattggtgagtggaaagatgaatggagggagatatgggtggatggattgatggatggatggatggaaggagggaggaagggaaggaggtggtgggaatgaatgacacaggaagggagaagcagcaggctgaagtggctctttagggagacacatacctccacaggaagagcagtctagattgttttagcacattccacttaaggattgcagtgtgacagcagagaaaatcctctccagtcaagtaattgcatccatttcatcttcccagccctcctctagatgggaggtggaggtgtgtgtaccaatctcttaattcagaaatgagacaagaggaggaaaaaggagttccggaggacagtggggaccccagccagagcctggggacttggctgccttggaaccagaacctggcccctcagaggagttgcagaatttcgatagaggagtggcaggaggtgtactggctgaagaggaggcccaagggaagagaacgttgccctcattggtctggaatcagcaggtacctcatggctggaggtgtattttcagactcctttggcatctggtgaggcctgtggattcattctcagaatcacatttttaaatgcacataataaaatacatagaattgcaaaggaagttaattatattgaaatacagttatcaaaaatataaataaaacaagtatgtggtacagtcatatgtgtgcttctttattaagtcattacaaagcaagatctatttggaggtctaataactgtcatatgcttgaaaaaa

SEQ ID NO: 472821 - DNA, 647 bp, Homo sapiens
acaaagaaggatgtggagtgttgatcaaagtatcaagtggagaagccagaaataattgacagaaatatggggaacccctggcctttattacatcctcatccaggaaagaaaaacttcctgtccacagcagcacctgagtggatcatggtctatgtaagaacattctatgatgtttccacagtgacaaaattactcagtgacgcatttctcagaacatatccatgtcatttagtgacacatgactgtggtacaatgtggcaggatttggtagcagacaggccagtgaagggatcctacaaagataccaaaggctgtgccagtaacaatgcaaatgcaggagtaaaaaggaggaaaaaagcattggaggaagatgcaggctacagaccttcaagcctagggcaaatctgttcaatctttgtcattctatgtggttttcttaggcacctctctgttatctcaaaagtcagcccaattttcagtcaatccaatattgacttactgtttaatcccttatttgaaagaaaactttttctctctgaaagtccattaagtcactgaccctgagaagccttcctgaatctttttggcatttggtcttctctgtcttcttggctcccattgccctccatataaactcaaatggtcaa

SEQ ID NO: 472822 - DNA, 551 bp, Homo sapiens
acccatttgcttttttttttttttttttgagacagaatcccatacacccattccatctgctcagccttgagcccgtgggagaatgtaccatgactagggtcagaggctgtcctatgcccttaaaggaaaacatgagggtgtgcaaatgtataaggagaaaagcaggggagaacagaattgggttacaaaaaagaaataaagagaagaaaggggaaagggaaaaccacttaagtcaacattgctcatctctcctccaccttcccagccccagagcccagcagggctcacttggacaatgcaatgtccttctcatcaaattccctgctcccacactccccagctgcaacccaagctccagccagggtctgcaggaatcttttaaagcatacatcaggttgtgcagatgtgtccctcccctgcttaccatcctccttggcttcctctacattgaaaataaatccaaaattcatgctcactctaaaaaaatccctatctgacttggtttctgcctctctagacactccagccatgctattctgctttttgtaccc

SEQ ID NO: 472823 - DNA, 540 bp, Homo sapiens
tgagctgagcttagtgtcttcgtctagaagataatgggagataggccccttaaccacagacccaagtcagacatccttgactacaattttgtctctcagttctcaattccacatcaagggcttttgaacttcatatgtgcttccaaaatgaaaagcaaatctgaaagttaccttggaatacagccttctcatatcctcagcccagaacactgtgcagtactttaccattcacctcaagcaaaggtacagctgaagctgtgtgaaggtcgaaagcttagtcatttgataaaaaggagaggctcaaaaagggcctggaagtgggacattctggtttgggaaactgggctccagagaaaatgttctcaaaatgtggtccccagaccaagagcatcagcatcatttggggacttcttaagaaattcgaattcttggactccactttggatctactaaattagcaaggctctgtggttgggagctagcaatctgtgtttcgacaatcccttcagacaattgcgatacatgctcaagtttgagaac

SEQ ID NO: 472824 - DNA, 721 bp, Homo sapiens
tgcctgcctagacctgtgcaccatgtctggcaccaacagagacccaggcagtatggcccaccacaccctgtctgccactttgcattctttcccggattttcctctttcagaacctgtcactcggttcctgcttcaccctgtggtggtaagggctgagtcctcctgggtagcactgtcttcaatttcaggcagaagtgctaatggtgaaatctccgagccctttgaggaggttatggggccactaaatcatttcgtgaattatctagtcactgcttccagccctctaggaacccactcttatctcctggccctccagcgggctgctccactgacctgtggctggctgcctggcccaaagagggctcgacatccaccttccccagacgggatgcgggctccttccggaggccagagcttcttaagtgtaaagtgcacacacaggtcactggataaacatcttttggcaacttgtaagataattgtggatggtttttgaagtattccaaacagcaaagtctttctaacatgtattttggtgcttctattttgtcagtgtctggattatggcttagatgggctgatgagtggcccatcagagctgtaaggcgtgcatgggtgaggggtgacggagggagaagagcactccaaggaggcattggggacttcattgctggtccctggtgtgaggtcactggcttctgcatttcagaactcctgggct

SEQ ID NO: 472825 - DNA, 998 bp, Homo sapiens
tccaacaagactgagggtgcccagggcaggcaccagcccaatgccatcaccatcacagagccccagaatagaatccatgaaactgcaaatgattctacagatggagccccaaatgaccaccactagcacctgctatcgaggacccctagactgacccaccaatctgttcttgcaccatgacactgaagactcccctcctgaggaaggctcaactgcagagccccttctacaccccagctcagcaggaatttgaggagcagcaggcttttgagaagagccgcaagttccttcggcagctggagatttgctttgcagagaacccctcacaccaccagaagattatcaaggtcctccaaggctgtgcagactgccttccccaggagatcaccgaggacacctttgacccagaagatcatccctgtgggtctgtgacagcaaatcctacaagagcaaggagccccatgaagccacccagaacaggactgtcaggaccaccagaaagagagatgcctatttcaggaattgacacctcagagacttctcccaaagcccctagagggggtttggctaaagacagtggaacacagggcaagggtccagagggggaacagcagccaaaggccacagaagctacggtgtgtgccaataacagcaaggtcagctccactggggaaaaggttgtcctgtggacaagggaagctgaccgtgtgatcctcaccatgtgccaggagcaaggggcacagccacagaccttcagcatcatctcccagcagctgggaaataagacccctgctgaggtttcccaccattttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcacc

SEQ ID NO: 472826 - DNA, 534 bp, Homo sapiens
aaaccataccagacagcttgccaagaatttctgcataggctgactgtctgtatttcctcatgattgtggccatgttccctctcaattctctgaagttgctgttcctctcccacttgagtgcggctgcagatcttggtctgagggcagcaagggcagtaccacggcagtggtactggcagaggggcttctgggagctccacttcagagaaatgcagagctgctgctactcagaatgttcagccagggaacaagggcagcaggaaaactgctgctgtggctgtagaggagggacttttggttgcctctgggagcccatccccagggaatctcagaaccacttccacctgagggtagttagggcagtaccactgcagctgcaatggcagatgggttgtgagttgactctgggatttcctcttcagagaaatgcaaagccacctccaactgacatgttcaggtgggggcagggtagttgtactggagtcccagacccatccagtgagaagtggggatggggacctatatgaacagtca

SEQ ID NO: 472827 - DNA, 484 bp, Homo sapiens
aggggcataagggtgtttggagggtattgggtttctgctgagagatctgctgttagtctgatggacttccctttttttccttctaacagtcaggcctctctgctgcaggtctactggagtttgctggaggtccacgccagaccgtttgcccggatatcaccagcggaagctacagaacagcaaagattgttgcctgtcccttcctctggaagttttgccccagagggtcacccaccagatgccagccagagctctcctggtgtacaagaaacacagtaccagcatcttctcccggtgaggcttcaggaagcttccaatcatggcagagggcaaagtgggagccagtgggagccagtatttcacacggtgagagagcaagagcgaggagaggagaggagagagagagcacacgagagggaaagggaggaggtgccaagctcttttaaacaaccagatcttctgtgaactcatagagtgagaactc

SEQ ID NO: 472828 - DNA, 623 bp, Homo sapiens
gatcagcgtccgagctaaactccggtcgcagtgtgggacccactaccactcttttgtggtgtatgtgtgtgtgtgttgcggaagggggtccccctcactatggtccttcttccagcctcaaagcagatagctctcttacctttctccgggtaccgatgcgcatcactgagcatcttgctctccagtcaaactgtcagcacccttgcttcatctttgtctgtggccaccattaccgcacttcctgtagtaggaaactggctgaaaaagaaaggatgtttgtcacggaggaccctgatgtgggacgttctaaaatttaaggttttcaaacagggtgtgtttgaaacagacagcgccctgagaagtggaggcgctctctgggcctggcgcaggtctttgttccagcgcagcaccccttctccaaaggcactggcaaagtctattccgcacacacagttacactgtcagaaatctgcggatcttagatttgtctccagacaaggctggagaagagagctcactaccagacaaatggcaattggcatgttgccttcctatgagcactttgagatcccacagcccctggctagtgcaaaaggaacctcgccctccactccttgctgaca

SEQ ID NO: 472829 - DNA, 561 bp, Homo sapiens
tttgagccaggatgagccaggagaaggaatttcacaagacaatatcatcaattaaggcaggaataggccattttcacttcttttgtggtggaatgtcatcagttgaggcgggaactggccatctggatgttcaacaacttgttcagtatacaaatgtgaaagtaatgcacttattcaatgctagtgaaagtgccaatggacatggtggaagccctggaacgaggtctttggagggactgggaagtgagaagggaagttgggcattagattacatgattatcattagatgcattataaaaagagttagcaagcttcccaaatcgatatggcacatacaaaccaattctgttgattttgcaatggtggtggtgatggccaatcagagtggagttagcagacaagagtgtgtgagggactgaagtgctgggacacttccccacggatgtcccccatttctgcatattttttaagcagaggcactgactgcctttgtttcagactatcatttcaggggtcgttcgtagcgagcatctttggaaggtactgataatgcttccctct

SEQ ID NO: 472830 - DNA, 732 bp, Homo sapiens
tgaggagtgcctaaagtttgtgtggtaactgacatacaccaggtccctggcagaatgcttggacaggggcagcagtgcctgtgctggagtcctgctactggacagatggggttgctttcagtggcagcagttgtaggcaggtggctggaaagcatgcacttccctcatgttttgaatctagcagtggaagcccatagcagcagtggctgcaggcaggttaactgccaagggcttaagctttggtactggtggcagcagccagccacagcagtggctgcaggcaggaggtatcaacagggcttcagggatgtggagacaagttctgctgctgccagaaaaagaggacaccccaagagcgcattcttcaatcttgcacaggaaggaattcaaggcgagttgtggggtgcagtgagaagaggtagtttattgaaagctactcagttacagacaaaggcatcctcgtctttgtcttaagtttttcttagataggggtcttatctatgtaaaagctaaactaagctgtatctacatgcaagtgggctgacggcatgacaaaatttattattcttttgatttaaagaaagctatcattgttttcttttagtgcataaatacttcaaagcataactataattatcttgaaagcacatactgttacgggtattaggacatctgggctttctgttgttgtaggaatgcatccttgcaggatgaggactgggtagcaaggct

SEQ ID NO: 472831 - DNA, 577 bp, Homo sapiens
ccctgtgtctcagctgctccagccatggctggaaggcgccaacgtagagctcggtttgaggcttcagagggtgcaagcctcaagccatggcagcttccacatgattttgagcctgcaggtgaacagaagtcaagaattgggttttgggaacctttgcctagatttcagaagatgtatggaaacacctggatgcccaggcagaagtttgctgcaggagtagggctctcacagagaacctctgctagagcagtacagaagggaaatgaggggttggagcccccacacagagtccctgctggggcactgcctagtagagctgtgagaagagagccagcgttctccagaccccagaatggcccctttttcctgcagtgtgcatttattctttaccctacaagaaaacagaatgtgaccagatggttgttactaggaaagaattatcctgaaaagaaactagatgccagtttctgattcttaattctcactctgtaacttatgggttaaaggccctgaattttaagcttcattctttttggagggataagtgtgaccacgagttctccttttctccaaagac

SEQ ID NO: 472832 - DNA, 877 bp, Homo sapiens
gagttaatgggtgcagcacaccagcatggcacatgtatgcatatgtaagaaacctgcacgttgtgcacactcaggcccctcttctgccggtctgctggagcttgctgggggtccactccagaccctgtttgcctgggtatcaccagcaggggctacagaacagcaaagattgctgctgttccttcctctggaagcttcatcccagaggggcacccgccagatgccagccagagctctcctgtatgaggtgtctgtcagcccctgctgggaggtgtctcccagtcaggagacatggggagccggcaggcagggatgtttaagtctgctgaagctgcgcccacagccgccccttcccacaggtgctctgtcccaaggagatgggggttttatctataagcccctgactggggctgtttccactgtgagaagaaaacggcctactcaagcctcagtaatggtggacaaccctcccaccaccaagcttgagcatcccaggtggacttcagactgctgtgctgacagcgagagtttcaagccagtggatcttagcttgctgggcccctggggtctaaatattatgttaacctcatagaagggatttgacagatttctatctctttctagtctctaaaccagtttaaataacataagaagtttctcaaatcttcaagcaatgttttgcagtttttagtgtataagtcttttgcctactttgttaagtttattcctattttattctttttgatgctattataaatgggattgttttcttaatctccttttcaaattcatcattgttagtgtatagaaatgcaactggtttttatgtatttattttgtttcctgtaactgctgaattcagctattggttctaacc

SEQ ID NO: 472833 - DNA, 711 bp, Homo sapiens
ctctggggatagtgtagcagcatttctcaaaatgtgttccttcatttcatgggtgtttggtaatccagttgctgaaggacatggacagaacacagaattggtatcaggatttgcccacagcagcaacagcagtagcagcaacagaaacagcagcagcagaagcagcatcaggaaagcatattattttcacagcctgacccactctggttcatctactgggctgagagctgaaggagggatggtagttaccccaggcaaaattccagagacttttagtgacaagatcttcaatgaagatgagctggtccatactctttgcatggagttctcttggtatcaacatattcaaagaaaatggaagaaggcagaactgggcagagggaagaaattgagctatgatgcaatttcagctgatttctcagacaaccctatagggaatttggaagcaaggatcacctttccagagttgggatagaattataccagactatgtttagaagtttttaacacttatgaagtcacaatgaccagtgtagcggactgtggtggaataagtaatttttattttcttctttataattttccaaattttatgaaacaagtatttctgtgggttggatgtttatccccaacaaatcttgtgttgaaatttaatccccagtgtggtggtgttaggaggtgtgacctagtggaaagtgtttgggttatcac

SEQ ID NO: 472834 - DNA, 713 bp, Homo sapiens
agcgtggcacagagcagggcaatgttatgttatcttcactcttctgcttctctccagtagcagagagacaatgttgtttctggtttccatctttaataaacagaagagaattattaggaattaatgactggataaatgtccccttcatgaatgcagtattctctagagaaggccaggttggcacagagggctcagggagagacccacaagagctactcttccacaagccccaaatctctaaatctgaacccttggaccaaaccacgggttacagagatacttgcaatggtacatgcacttatgatcagtttcaaaccactgaccagctacaaatctggccctttgtcaactaccagggcaaagaagatttaccaaaaccagagtctgagaaaacaaatgggacagtgagcaaagaaccttggaacactactggcaaaaggaagagaaggaacttcacgtttgttgagaacctacaatgtatcatgaattgggtacacagatgattgaatgaggaaattgtccttcagttcttaccttacttggacaatatgaagattagttgtaaaagtgttcagagtcctgcatagcaagttcttgtctcagctcttactcaggctatgaatgcgcttggtgagtgtttactggaccaattagctcctttccttgctaaaaaggctgtgtttttctggagtgcctaatctatttgtagagct

SEQ ID NO: 472835 - DNA, 507 bp, Homo sapiens
cagcatgctgtcacctctcactaacaggatggcctttggggcactgaggtggaggtgggacagggtcagcggctgtgttcacgttgtcttcgctaccattacctccaaccaagcagctggaaatgcagcatctgagagatcatccaataaacattcactgaatatctgtttgattccaggcactgtgcctgacactggtccttcagaaagtattccagaagaaggcattgaaatcatgggacatgagagctccatgcatgttattgccgctgaagaccttccagtgggacaagatgcagaggtggaagacagtaatattgataatcttgaccctgtggaaaaatccatgggaaaatcagccttggtacatttgttggttcagcaaattcttatgcaacaccgtctggtgttctgtactggcagtgaagatacagtgatgagcacagtgcaatttctgcccatacagaacaaagaagcaagggaagagagacataaatgaacatttgc

SEQ ID NO: 472836 - DNA, 577 bp, Homo sapiens
tctctctctggggtggagccaccagtgggaggggtggccactgtatctgcagcttagctgacagccgttcctgcctgctggctctggaaagtctgggtgaggatgtgtggaaacacctggatgttcaggcagaagtttgctgcaggggtggggcttttatggagaacctgtgctagggcagtacggaaggaaaatgtggggtcagagcccccacacagagtccctaatagggcaccacctagtggacctgtgagaagaaaggcaccatcctcaagactccagaatggtagattcactgacagcttgcactgtgtgcctggaaaagccacagacactcaacaccagcctgtgaaagcagctgggaggaagcctgtaccctgcaaagccacaggggtggagctgcccaagaccatgggaacccacctcttgcatcagcatgacccagatgtgagacatggagtcaaagaagatcattttggagctttaagatttgaatgccctgctggatttcggacttccatggggactgtaggccctttgttttggccaatttttcccatttgaaatggccgtgttt

SEQ ID NO: 472837 - DNA, 888 bp, Homo sapiens
acgccactgaggtgtgggctggtttgtttcatacaaatggaaaaatgatacgctgggccctgtggatctgggttttgctattgggaataataagggctcatttcatggttgtggtgaagcttaggttcagggccaaacaaacaccctgttatctgcttcacacctccttctgcaaaacgccctgttacaggtgccagtctctgcagggggccacggggagcagctctaacccagggactgcggctccagagacatggaggaaagcaggaggtagatgtcatcacacccacttcactgatgagaacaccgagcccctgagattcaacaacttgtccaaacttgcacagctggaggacggtagagccaggacagggcccagggtggtccggcttgaaaacccaggccccatctgctgtaccaagctgaaaggacaggtcagacaagaagttggaagaattttcttgaagaattcgacacactgggggctccccagcgaaagagcacagccagatcaccctatagtgacaatgtgtcaacagcccctcccatacactctgagctaccagggcagctcccaatatgagcagccgctgatgccccctctgcactctttcaatgcagatgctctcttggtcttaggcagagatttcatgtgtgtgcaggcaatgtcaaccacattaccaaactgccaaatggcagaggcatcaccaactgtcagaagcatcctgatttcagagacatgaaaatgtggggaaaatgtgtgttttagaatcagtgaaatacactggctccccaaaactgtgaatcctgtctttttcttaaggtcaaaatttggggacattcttttggttctgtacacaggtttgtacatagcatgtttgtacacaa

SEQ ID NO: 472838 - DNA, 667 bp, Homo sapiens
gggaccctcctcccacctctcagccagagacaggcagctgataatgaggacagatcacagagagcctggcagagccccctgcttctgtcagggatggccctggtcatggctttcatcttccacaagcatgtggaacatccgtggccccgtgggaagaaacttgaacgctgggcaaggagagggagctcaggggtcttcgtttctcagttctgtgaccaccacgcagcacctactgggtaccaggcctccggggctgtgtgcaggagtggaggaagagtaagattccaagagaatgatcccagagaggtccctgctgagaaaagaaggcagcagggagccggccagggccaccctgccacaaaggccaagaccaaggactgctgggtcaacctaatagcgcctgtctctgtagaaggcagctgtcttaaattggagggagctccagcaagcggcaatgccatccgtcgtggggaagagaaggagaccctgctggatggcgttgatgagctgagggagagaaaagggtggtgatgccagggtgtggggctgatccccgagtgggacccgtttcctcatccgtcaaatggggctcagaatgtgacccttgaggagagccgtgaggacagagtaaaataacagggcacaggtccctgcacaggaatctgtt

SEQ ID NO: 472839 - DNA, 1110 bp, Homo sapiens
ttttatgtccttgagaacagaatgcatgtgatgattatatttttcaaagatagccacaacatcatatcttacctcacaagttattctacaaacttaccactctctcatcaagaagtggagtctaattcttctcccattgctggcatttgcctatttctattaatagaacgcagaagaattgacgctataagatttctgaggttaggtcactggctgatctactatagagatgacatcacattaattggaccagatgagaaaactgaggcacaaacaggtcaagaaacttgctcggtagcacataccaacagcaagagcagatgtgcttgtaagaaacaaagatcttgttttcatacaaatgcgctcaaaataaaacacaaaggaagaaaaatacccagagcacataatgcaaagaacaagaattgcttctaaatagaatgttttacaaagttttccataaagcctcagctgctcctcaagccacaaccggcttgaacatggatggcagacatgaaattacagtattcacaaaattagtattcagtttgcagaatctctctttccaaagccttcaggcatactttatgcatgcacaattacagaagcagcctgactctttgatcattctctggtattatcccttcatttcacataggaagaaacaaggacaagagcaatgaagtcacccaatcagagtaaaacagtcaggaaaatcacatggagagtgaaaatatcagaaagtcgctaatgttgggcttagaactgatcaaagagttttgtgtacgatagactgcctaatggtaccaggcctgacagcctgcagtgtccccctcacatcaagaatgacctctgaaggcaatatttccaaagacttgcggcttaacaggattgttaagcaagtgattagactttgctttactgtgaaagaattttggtttataaagagttgaagcttctcacaaacactggtgccaatctaggtcaacaggagtaagtgagaccattgttccatatcccgcttaaaaagagaacactacttcaaagacaagaacaacatcacctgacaaaaataaaagaagttatcggttttaaaacattgtgcttatgtgt

SEQ ID NO: 472840 - DNA, 642 bp, Homo sapiens
gctgctaaagcagcgttcttatgccatgaagctgagagatgactgggttcttcatgacttaaaagaactgtggctggaaatttggattaagttgcagcactctttcatggagaacctgtacgataatcctggtgaggatgcccccatacaatccaaacaggagcctgacttggaagaaaagaaaaggtcaaaaataaatggcacgtccagagactgggaaagagctagaaagacgacaaaatattacgtgatgatatctattaaatatatccaagttgaagtctacacccttgctactgaaagtgtggcacaagaactagcaacatcagcaccagatgggaacttcttggctttcccacatggcccaaaagttcatattacacctttaaacatccaagattttaatgctgatttttttcaatgtttcaaactatagactaattacctgagtatcttaaagacaaacagctctgcctattttttcaataaaaatgttattttgtatgtttaaaaaacatttatatgattttttaaaataacttttttgtgtatgtgatgaatttttaatattttcaaaacagagggaataggtgatttatagttacctattatagtgtttataatagtaaatgttgcattatc

SEQ ID NO: 472841 - DNA, 519 bp, Homo sapiens
tttgttagaagagaggtgatttctttgaactgccttcttcctatgccagccagttgctttctttggattagtcttccagttcacaaattaaaggttgtgactgagttcttcattttctgcattcttgttggtgagtttctaatgtccatcatttctcctggagatctgtggaactttgaacttgagagagatgatttaggacatctggtggaagaagtttgtaagcatcgaagcattaaagaggaagtagaacacaaaagtttggaaagtttgcagcctggcagtgtgatagaaaagaaaaacctattttctggggagaaattcaagccagctgcagaaatttgcttaagtaacaaggagctgaatgttaatcaccaagacaatggagaaaacatcctcagggcatgtcagagacagtcttggcagcccctcccattacaggccaggagctctagaaggaaacatggtttcattgaccgggcccagggccccttgctgtgtgcagcctaggtcttggtg

SEQ ID NO: 472842 - DNA, 2232 bp, Homo sapiens
tagtgttgagcctgcagatgtacagaagacaaaaattgaggtttggagacctctaactggatttcagagtatgtatggaaatgcctggatgtccaggcagaagtttgctgcaggggtggagccctcatgtagaacctctgccagagtagtgtggaagagaaatgtggggttggtgctgcctagtggagctgtgagaagagggccaccatcctctagactgcagaatggtaggtccactgacagttttccctgtgtgcctggaaaagccacagacaatgccagttgtgaaggcagctgggaaggaggttgtaccatgcaaagccacaggggtggagctgcccaaggccatgggagcccacctcctgcatcagtgtgggaactgaacaatgagaacacatggacacaggaaggggaacatcacactctggggactgttgcggggtggggggaggggggagggatagctttaggagatatacctaatgctaaatgacaagttaatgggtgcagcacaccaacatggcacatgtatacatatgtaactaaccttcacattgtgcacatgtaccctaaaacttaaagtataataataataaaataaaacaaacaaacaaaaaaaagcaacctatcatacattaatgattgaactttaaatatagtaatatgtttttcaaggaaataattactagatggtatttaagacaattcatacattgttgtgttattttattaaaatgatcacatttttataatttaaaaaaaaaaagaatctccaagggctggtagtggaattctgctctatataagttcagtgatactgcacttggagagtaatagggagcagtgagtggaagcactgccaagcatatacatcttctttctccacagtcaggtgtttttggtttttgatgtctctatttttggcaaagccacctcttaacatttttttttctgtatcttgatttcagtttggtttagtttacaatctacatagtcattgtgcttgtgttttttctgcttcttggttttacagtctgttaaggaatagaacctattgatgtcacaatgtcagttacctacttctctgatgtttcggtcagttatgtttgcttgagtgtttcaggacacctgcttcctgatgttaacatacttggcagcagacctttctcaagcttactcttatttccaattattgcttcttaatacagaaagtatcagtggggtttattcactcactctttcattctttcaatcattcgtgtattagttcagtactgacagtatcaaaagaatgtttgctctacttttatgaggtttttgtctataagattagaattaatcagcatcatttattgaacaatgctacttttccaccaatttttaaattctatggttatttatattcaaagtcctagtcttctttctattatagtctgaccatctgacactattttaacactattcaaattatgcgcttttaatgtatatttaaatatttctccttatcttaggattttcatcttcaagaaaatctttagcaattcatttggttccttgggaaaacatgctgctggtacttttatttggagtgcattttatttacaatattcttttagagaatttatgtcttttcaatattgatcaatctcatggaagaatatgtcatggcattccacttactcaagtatacttttttatctctcaagaaattcttgccattttcatcatatcagatctacaaaattcctttaaacttatatgtagttattatgcattatattcactgttacaaatattatgttccaacttttatattccttatttcacttaactgtctaaatttattggctatggggaataaaaaatagtaaagctaaaaatgatcacctttatatcattgctgactttaatgggaatgtacctatagttaaaataataagtatgatattacctgtgaatttggaacagccatttttaatcatgattatgaattatacttttatgcatattttaaattttctttttaaatcaaagttttttttacttttagcattttaaatatatctaataaatactttttatgtattactataattgagagatagctcatgaaatcaagatattttagaaaaattcagaattttcctaaccgtaatagtcagagatttggaaagcccaactcttaattttatttttctttgcttattccttcttttcttctattgcagacag

SEQ ID NO: 472843 - DNA, 574 bp, Homo sapiens
ataccatctcatgctagcagctgtgcacatgttactggagcagtctgcacagagcatgcaggaaccagagtgggcaaaaaaaggacctgtcatccaaatatcggcaatctttgctctgattgctgattgctgtttctggtcacaaagatggacgcaaagaggaggaatttcagaagaagatatggttattatgggtgatgacagctgcatgcatgttatttctcctaaagaccttttagtgagagaagatgtggatgtggaagaaagtgatattgatgatcctgacacgctgtgcaatgagatgaaaaatacaacagagactagccagaaagagaataaggagcattgtcccaaccgtctgctgagaaagaaatgcattcttcccagctacggcattcagtcagaagttctgcttcacttaaaaaatgagaagccttataagaatgtcactctaacccctaatgaagagagcaaagaagaacagtgacacgataactttttctgaacccctcagagaactgaagtcacaaaaaaatagatgaactgaattccaaaggggccataaacaccttca

SEQ ID NO: 472844 - DNA, 2531 bp, Homo sapiens
tgctctctctctcctgccaccatgtgaagaaggtgcctgcttcccctttgccttctgccatgattaaggcttttcaggtatttgaagaggctttggtgttttggtccaagtttttggtcactagagccatatctgcattagggagtacccaaagccccgtaaagctgtggttcttgaagacttgtaagggtatcaccttggtggtcttggataagattcaaaagaatgatctggattgccagaaagatgagctggtgtcatccaccaccagctcaggcccacagggagtaccaccagggcattgccaatgtgcacataaggctcaagtgtctcatcgggatgtgggctccctgttgcccctggtaggcccagaaaagccatctaagagtcaaggcctgaaattaaggaccctcagagcccacttggtgcccttccccactatggccaagcaagtacctaaggtgtcacacgaccccaagtccactggctccattgccagcacagcactagaactttcctaggagtttcagtctttgtggcctagactgcctttcaagtttatttggaaccccagagccgtttagccctctgtagcaaggcttgccgaaactgaagttccaaccagtgggatggcaatttctctgtggctagggctggtctaaattctccctccatggacatcaactgagttcttcctggtgttggcagcactgagttccaatgcaaaatcccaccactgtgtggtccctccctaaagcacacagattctctatctgggtcactcattcactactgtgggatgggtgaggggtagtgttggcaaatcaagactgtctaccctcttcaatggtctttagtgcctctttcagtgatatgaaattaaaaacagaagggtatattagcaaagtatttttggtgttgtagtttgggctttcatccagaagatagcatttattagtaatgaccagtagatatggttatactcaactgcatggctcctttatatttcctagtatttgtagccatgaactatagtgtgttgggaagagagttcacctcctcaccaggtccattcttgggcctttgaggagcctctgctactgatttgtgcacattgattttgtttccttaaactttactgaatttatttatcatatctactagtttatcagttacaaaaattaattagttacagttggtgttcttttccgtgagacttttctttcatttataactggttttcatttcctttctaatttaaaggagcatatttaacattccatcttaaggcaatgtgatagccatgaggtctttgtgtgataatggtaaaaaggaagttaatctataatggaagtcaacagtagataaggaaggagtattccttggtacccttccatcatttacaacgtttcacaaaacaattcaggtgaattcagatcatagtaatttttagcaaaatattgtaaaataatatagagtatgactaattttaataaaaatttttaaaattatatatatatgttttctatgtatatatctacatctatttccagctgccaacatgtaaagaaacaattctaagatccattttaggaaatattgattatagatattaacggatggtagagtttgttatgtattattaaattgtactttatcttttccactttttctatttaggttgttgcaaagtaatcttattgtatttttcgtgacattcaattatttatttgcaccaagaaatattgttcaggacttgaagactgagtaaatgtgcgtgagctacacaaaatatattttgttattagtaaatcatctattataaaactgagaagtctcaaaagtaggtaatgggaaaaaagtgtttccattgtttgctttcttatttcaaatatctttatgaaaaattcagcattttaataataaagagcaataattaaagatgactgttatttattattttggtagacagaaaggatggtttcatttatatttgttcaattattttctttaactcttattctatatataggccagttgtattttttgttttgttaattagctgcctattaagttttcttgcataattatattcagtttgtatgaactagttataaatcaaatatatttctttttatttataaaatagcagggtgttgctttgctcatctatcttttcattagttaaattttgatgtgttaaagtttggcatttgatgtagtttaattgacatcattttgaggaggtggggaatgaagagatttttctctatgagcatacagcttagaaagtcatcattccaacttaacacttgattaatattcaatcacttttttaatgttattttaaaatcatgttttctttgaagactttctgaactttgaaatacaatttttaatttagaaatcattggtatttttctttttgttttaatttttacactttattaaacatcattttataaacacagaatatacattaaaaagcataataacaattttactatggttatttctgtcattaatgggtc

SEQ ID NO: 472845 - DNA, 1538 bp, Homo sapiens
cagccagaagtgctgtatcaaggctaaggggcaacaggagcctgcctgcacccctcagcaaattcagggaaaactaggactgttgggccagcagccctatcagatgtggctcacctgtccaccagtggcaggggttggtggggatgcttgtcctgctttctgggagcttcctaggacaataggagtctacccactggttgagttcccacagaagtggaactgctgggccaaaagctccagcaggcattgcctacctggctgccagtggcagtgtcaggcagcgtcgtgtgccctgctgtctgggtgtttcctgggacaacagaaagctgccccctctagatcagtccaaacagaagccagactgctgggccagaagccccagcaagtgttgcctgccttgcaggcaccttctgtctcctctgctcttggtgggatccaagatatgaaacagaaacaagaacattatgtcagccctcaggtagcacccaaacaggttagaacaaagaaacaattatttttcaataaaccctgctctgctccttccagaaccagaggccagggttccatgctgagaacaccggttaacatcttcaggactgcagcaaagccatggagagaagagtatgctcagcgtgaaactaagagacagcttacagagaatgacaccctgcaggtagcagctgctgctgacacccaacgggcagaatatagagaagtaatttatgttggaccacattcagagtcattctgggctgcatgcagcccatgggccatgggttggacaagcttgttttgtaacaacacagtggaaaaatggaacccttacattgataccatcaagaatgatgctccagccatggctgaaagggtccaatgtagagcttgggctgtggcttcagagggtgcaagccccagtccttggcagcttccacgtggtgttgagcctacaagtaaacagaagtcaagaactggggcttgggaacctttgcctagatttgagaacatgtatggaaatgcctggatgtccaggcagaagtttgctgcaggggcaggatccactggaagcttgcactgtttgcctggcaaagtcacagacactcgatgccagcccatgaaaggagctgagagagaggctgtaccctgcaaagccacatgggtgaagctgcccaagaccatgggaacctacctcttgcatcagcgtgacctggatggtggccattcggacaagctggaaagcatagcctccagccagaagccagaaatagatacttcgagggaggagcaaagggaacaggaatttatgctgagttgggtgggaattgaacaatgagaacacatggacacaggaaggggaacatcacactctggggactgttgtggggtggggggaggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataat

SEQ ID NO: 472846 - DNA, 649 bp, Homo sapiens
ggtgtcatgcagtggccgctgatatccatatgcagaagaatgaaactagaccctgtctcttgccatacacagaaatcaaatcaaaatggattaaagacttaaatataagacttcgaacaatgaaactactacaagaaaacattggtgaaaatccccaggacattggtctgggcaaagatttcttgagcaataccctacaagcaaaggcaagcgaagcaaacatggataaacaggaacacatcatgttaaaaagcttctacccagcaaaggaaataatcaaagtaaacagacaagtcacagaatgggagaaaatacttgcaaactacacatctgataagaaaaacccctggaatacaaccaattcactcaacagacatcagacatcaggctatgaagaactatgctacttgagtgatgggaacaatttagggaagtcccataaggagtcttcagctaaaaccttgagatagcttttgggaaatggcatatggcagactctctaagaggagaagttgaaaagtgactcaagtttgtgagacagagtactaagagagaaagacaagtgattctaaaattcttatggcaatacaaagggtcagggatagtacagacaagctttaaaaagaacagagttggaaaacttacacta

SEQ ID NO: 472847 - DNA, 657 bp, Homo sapiens
gaatgcaggcacactctgaggtactggggttaggacttcagcatatgaattttcagggacacagttcagtctatgacatatccctttttaatctcagtggggtcccacagggagctgatctcacatcaccacttggaagcgatgagcctgtacaagttggtgctgcagggaaagtgctcatggacatagagggaggagctaaacttccacctcactcaccctcaagggtcagtgtgagtcacagccctacttctgtggggctgctgtcagtcatctcccaatctaaggcgaaaggtaccatagtcagtaacctaatcacgggagtaaaattcgtcatcttaaagttcctggggatatgcaagtggctgaggagcaaacctagaaggctggaaagcttcctagaagccctcaactttgagaaactactcacacccttaagccctgggattgtttgtgcctgaacactctgaccttttttttttccttaaacctttccaaactttcagcagagtgttgtccagtcacacatgcagccttttctctaagcaaactttcagcagctatttatgacatttaacatcttttgccatctggagaaggtgatagttttcaaaaccattctgccctggttccttttgtttagctgttttcccctca

SEQ ID NO: 472848 - DNA, 1776 bp, Homo sapiens
gtccaggacagctttgaatgtggcccaacacaatttctgctgggaatattgtcagcagacagccccttcaaggattgcctcaggttcagaaagcctgcttgctcatggttatgtcccttccctgggagaaattgccacagccactccaacctttagcaaccaccaccctggtcagtgagcagccaaccattgaagctctaacagtggaaaccacagtcactcaactacaacatttaaatacagtgggaataattggattccgaggtggcaggggccaagtggcagcagtcaactgtcaaaagcgagatatccagccttttaccagggtaactgtgcattggggaaagagaaatgatcagacatttcaagcactagtggacactggccttgagctgacattgattcccggggacccaaaacatcattgtgatcctccagttaaagtaggggcttatggacatcaggtaattaatggagttttagctcagattcaaattacagtaggtccagtgggtccctggactcaccctgtggtcattttcacagtgcctaaatgcataattgacatagacatacttaggtggcagaactcccacactggctccctgactggtaggatgaaggctattatggtgggaagggccaaatggaagccgttagagctgcctctgcctagaaaaacagtaaaccagaaaccatatcacacccctgtagggactgcagaaattagtgccaccatgaaggacttgaaagatgcaggggtggtgattccaaccacaaccctgttcaactctcctatttggtctgtgcagaagacaggtggatcttggagaatgacagtggattattgtatgcttaaccaagttgtgtctgcagttgaagctattatcatcaagtcaccatgcaacctgaactgggtgctttctgacccatctagccatagagtgggtcatgcacagcagcattccatcatcaaatggaagtggtacatacatgatcgggctcaagcaggtcctaaaggcacaagtaagttacatgaggaagtgaggcaaatgcccatggtctccactcctgctaccctgctttctctcctgcagcctgcaccaatggcctcatggggagtttcctatgatcagtggacagaggaagagaagactacggcctggttcacagacggttcttcacgatatgctagcaccacccgaaactggacagctgcagcactacagtccctttctaggatatccctgaaggacagctgtgaagggaaatcttcccagtgggcagagcttccagcagtgcacctggttgtgcactttgcacggaaggagaaatggccagatgtgtgactatatactgattcatgaactgtagccaatggtttggctggattgtcaggaacttggaagaggcatgatcggaaaattggtgacaaagaaatttgggaaagagagagataataaatttcctgaaggcagaaagggtatggtattcattgttataaatcctgaacctagcatgtgtctgattaatatatagtaaatgctatatgattgttgaattaatgtctcctttcttaagatagatatctttttagtcttatgttataaattaagtcataatatattaagaatgaaagtttatatagttatgttctaatgattgatgtcactatttttatctttctaacagctgttaatcaacatagatttattcttctatcatttcatgttaaaatcatactttttaaatatcagtgattatatcttacatatc

SEQ ID NO: 472849 - DNA, 619 bp, Homo sapiens
tgtaggcctctgtaggtgattgattgatccctctaatctttatgaagcaattcctgtactgtcttgctgtcatatacgagttatacgttataaacgatggcacagaaacagtccttaagtcaaactgttattgtgacaccaagttttctaaaaattttatgcaaaacgttggtggcaagcacttttcacagaatgctgacctgaatctgttacaccacttcccatttttttgtgacctggccaatgcaatatttggtttagggaggcccttcttgctaaaggactataattcttattatcaccaatttctgatattagtattatttagaatatggcagaatggtataggctcaggaccaaaaattatgaaagaaaaagaaaagaccaaggaaaaatgggatggatgcaaaacctatcggtggtgcatggaatcacaattgccaagtctgcaaatcccattccaattttcaattccattcccagcaccataaatcttagaggaagctctaatttgtcctgctatggaccgtccctcaaccaatcacttgggaaagaagtttccgactggctgtccctgggttacacatctacggttgtggagggattagagggggagaga

SEQ ID NO: 472850 - DNA, 513 bp, Homo sapiens
agcattgggagataaacctaatgctagatgacgagttatctctaccccagctctgagtcctgtgaatccttttctacagacccatctaacctctcccctccttcccaggctgctccttgcaaggccacagcaagtccctcagcctctgctcccccaccctataatccttctatcacttccactcctcacacccggtctggcttacagtttcgttccgcgactagccctcccccacctgcccgacaatttcctcttaaagaggaggctggagctaaaagcacagtcaaggttaatgctccttttttatttatccgacctctcccaaatcagttagcgtttaggctctttttcatcaaatataaaaacccagctcagttcatggctcatttggcaacaacccttagacgttttaccaccctagacccagagaggccagaacgctgtcttattttcaatatgcattttattatccaatctgcttctgacattagaaaaagctcccaaaattagatt

SEQ ID NO: 472851 - DNA, 1188 bp, Homo sapiens
agcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccagtgcatttttgaggcccaaactggggaagcaatatgaagcttcttgtgtgtcctttgagcgagtgttggtagaaaacaagctgcatggcctctctccagctctctctgaagccatccagagcatttccagatgggaactggtgcaagctgctttgcctcatgtcctccactgcactgcaaccctgctttcaaaccgaaacaagctaggccaccaggataaattgggtgttgctgagacaaagctccttcacactctacactggatgcttctggaggccccccaggactgcaacaatgagcggtttgggggtacagaccgaggctccagctggggtggaagcagcagtgctttcatccaccaggttgaaaaccagggttctccagggcagccttgccaaagcagctctaatgacgaagaagagaacaaccgaagaaagatcttccagaactccatggctactgtggagctcttcgtgtttctgtttgctcccctggtacacaggatcaaggaatctgacctcaccttccgtctggccagtgggcttgttatatggcagcccatgtgggaacacagacagcccggagtctctggctttaccgcactggtgaagcccatcaggaacatcattacaggagatgttccagaagaaggcattgttatcataaaagatgacaattccatgtgtgttattgcccctgaagaccttcctttgggacaagacatgaaggtggaagacagtgatacagatgatcttgatgccggctaagagaagttctcctatcaacagtcaaagccggacctgtgaatcaccaaatcaagatgcaagacacttagagggctgctcataacatagaatctggtttccccaaaacaaattattcaagaaagaaagggagcatcaaaaatggatgcttttataacctaatcttctataacctaatcttctataacctaatcttttataacctaatcttttataacctaatcttttacaacctaatctctgaaatgacata

SEQ ID NO: 472852 - DNA, 447 bp, Homo sapiens
gggttttgtttacttttaactacaaattatgttccaagatggccgaataggaacagctccagtctacagctcccagcatgagcgacgcagaagacgggtgatttctgcatttccaactgaggaacacagctccttgccagcaatggaacaaagctggatggagaatgactttgacaagttaagaggagaaggcttcagacgatcaaacttctccgagctaaaggaggaagttcgaacccatcgcaaagaagctaaaaaccttgaagaaagattagacgaatggctaactagaataaccagtgtaaagaagtccttaaatgagctgatggagctgaaaaccatggcacgaggactacgtgatgaatgcacaagcttcagtagccaattcaatcaactggaagaaaaggtatcagtgattgaagatcgaatgaatgaaatgaagtgaga

SEQ ID NO: 472853 - DNA, 1389 bp, Homo sapiens
gcctgcgttggatctgatggaaggactgtgtaagtaggtcggatctgcttctaacccagccttgagagacatcacctgtcttcttgtgcaggaacattccctctcctctcacgtgtcctgagcaggatatcgcatgatctgctccttggcgcagataacagagccaccactccccaggctctgtgtgtctttaggggcgtggggagtgtgggccccaggcagcagcgcacgtgctcagtgacccacagcagctgatccatggggtgtggggtggatcctcagaacaggaaggtggcagaatcgtgtttcaaagtgggacttgaagatgcttggcaggagactcgtccagatggaggggcagtggggaaaagctttattgcctttaggacttctgtgtctcccttgccttacaacgtacccaacattcaatccagtgtcctggtggtggcagatgtggaagccgagtctggagatgtcaaggggcttggcccaggtcacacagcccgccatagtagggctgcccttggagcttcatttcccaactggaagccaaaccctgtgccgcctctgcttgtgcagatcctagaaccagagaagaagcggggcaagttgtcctgtttctcttctcccaacctgacaaacattcctaccaggggtgacttctgttctgactcataaagatatttctgaataatagcactggtcactttatctctggaatgtatccggcttttaaaaaaacaaaaaaccaaaaaactggtggcagggaagtaccctcttcttgcccgcccccctcccccacccccaccagggcactgattccactcagtctcctaggggcctcgtgggggtggccagaaaggcctcatttgcatatgctttctcacaagtcttgcctacacttcaatgtaactctaaatgtgttctaaggaaataaaaaggttttgttgtcattgtttgcttcttgttttttattaaattgagggtaacatacataaagtaaaatgaagaaaatgctgtaatcctaagggcagagcctgtggatgaactttaacatacccacagatgtgtaataccccactcagatagagattgttgttttaaaactatgattatgattgcctctagagtgatatttcttgtcttcatttcttctccattggcatatagcccattcatgaaatgggaatcatgttgggtgaaggcttatgtgtcacatctgagaagactttagctgggagggttgctcttggaatttcaaggaggttgtgtaaagccacaggagagaaagtcatacttgcttcttccccaggtgtggatccctgttcatcagtgggtatagccttttctctgctccacacctgagagatacaatacatgcctcagtgg

SEQ ID NO: 472854 - DNA, 1836 bp, Homo sapiens
ggcatctgccttctctctaccacctgaattgcttgcagagcctctgacttaagtccttgaccactctggcatgcaataatttagagcctgaagatctgagttcaatccctggtgcttcaatccctggtgctgggttcaatctccgatgtgcttgtcagatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcataatctgtattctgcagccaactttgttcaccatctccgcaatgccttggacgtcctgcatagagaggtgggtggggggcttccacaagctggtaacagctcaagcatggaggtgccattgccgctgcagcccctttgggtggcacccatggagttgtgtgatgtacggcctgtaaggccctacgaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggccatgccctttgcctggcacttccactctgaacagaagagatctgtgagtggaccaggaagctactcccagagaagcaaagcgactggcccaaaaccccacggctggcaactggcagagccagaagtgggagccaagccccctgaaatcgagttctgagctttccccactgcaggattctgccagggaatgttcacttccatggaaacaaactactacacccgtgtctctcttttcttccctgatcagcttgaaccacttggaagcaaaacagagaccctggacctgagagcagagatgcccatcacctgtcccactcagtatgtacacttaatatgtcaattaaaaataataaaagcaaaactaataaagtggccacaaagaggctttacctgggagctttttagaaatgcagagtcctgggcaccaccccaaacctgctgaatcagaatctgcagcttaagatcttcaggggatttggatgcactgattttgggtgtggtgcatggttcttcccttgtgacggatgagcacgtttcaattccaaccaggatctgttaatctacatggaatatgcttatctctggttcaccaactatctgagatatatctcatgtgctgatggctgaataactttttacgttgcattttctgtgagtatttgtcatctgcacacaagcatgctcttgagttcattaaacctttaaacagaagaaatccatcagaatgatgaattgagcaatcccttgggaaaaaaccaaattccataggattaagcaaataatatttaaaagaagttccatttttgctctctcatgataggaatatttcaacaagtcttatcttcatcatctgactgaacagatgagatgagttttcatagcatctggcagtcagactcctggacagtcaatctgctggtcaagccctactccatactcagtatgcatatatttgagactttgggaagatactcaattttcccccagatttctggtactaatcatttctatgccctctgcttcccatcccactcctttccc

SEQ ID NO: 472855 - DNA, 989 bp, Homo sapiens
atatcatgctgcctcttccccagagggcttaggaaacaggagaaactgcctacaggaaatatgcttcaccttcctccacagacacaggcttctaggagaaccaagctccatggaaacggagagagagagtgtgtatatggcatttcttttagggccactccagttctcattagaagctgatgaaccacagcatattttcatgatcattcgcactggggcaagcaagctgccatgttgtgggcaactttacagagaggcccacgtagcgtggtgattcgtagaaacactgctcttgtaggtgcccaggtgaaagttgaaaagggcagtaagcaagagttggcagactctctgggttgcatgagggccatcgggagcatcctgattcctgagaagaaaaagctcattcagaaggaggagccatggacagcaaaggacagacaacagttatacataactatcaacaacacctccatctccacctacattttactactgctgcctctaccccttctgcagctccaccacctccagcttgcattcatacagtgctttggcagttttaatactgctgtcacttcagcctatgaagtaggcaccattatcaccatttgaaagaagtataagggcccgagaaactaagtcctacgtctgaggtctcacagctggccttgcctctgctggcctgtttcctcttgcctgtgcctaacagagatgctgggatgaaggcccctcagctgccagtgttcatgaaaactcatcactgcaactgggctgcaaaagttcagaagaacatatatttgccctttgattagttttaagatggtccctacctgggtatattgtttttttctctctagtggaagtaaaaacaatcacttgtaatttgtcaaatgttgattttttttttcaacaataatcctatgggatatcattagccccattttatatgtgctcagaaggtttaagacatttacttgtgactctaagtc

SEQ ID NO: 472856 - DNA, 942 bp, Homo sapiens
ctgcgcttttccaacagtcttagcaaatggcacaccaggagattatatcccgtgcatggctcagagggtcctatgcccacggaaccttgctcattgctagcacagtagtctgagatcgaactggaacgtggcagcaaggctaggggaggggcaccctccattgctgagaattgagtaggtaaacaaagcggccaggaagctcgaactgggtggagcccaccgcagctcaaagaggcctgcctgcctctgtagactccacctctgggggcagggcatagctaagcaaaaggctgcagaaacctctgcagaattaaatgtccctgtctgacagcttggaagagaggagtggttctcccagcatgcagcttgagatctgagaacagacaggttgcctcctcaagtgggtccctaaccccagagtagcctaactgggaggcaccccccagtaggggcaaactgacacctcacatggcagggtacccctctgagacgaaactttcagaggaacaatcaggcagcaacatctgctgttcaccaatatttgctgttctgcagcctccgctgctgatacccaggcaaacagggtctggagtggacctccagcaaactccaacagacctgcagctgagggtcctgactattagaaggaaaactaacaaacagaaaggacatccacaccaaaaccccatctgtacatcaccatcatcaaagaccaaagcaatggaacaaagctggacggagaatgactttgaagagttgacagaaaaaggctacagacgatcaaacttctccaagctaaaggcggaggttcaaacccaatgcaaagaagttaaaaaccttgaaaaaagattagatgaatggctaactagaataaccaatgcagagaagtccttaaaggacctgatggagctgaaaaccatggcatgagaactatgtgatgaa

SEQ ID NO: 472857 - DNA, 569 bp, Homo sapiens
gacttaaagttccacatggctggggaggcctcagaatcatggtgggagtcaaatggtgcttcttacatggtggcagcaagagaaaatgaggaagaagcaaaagcggaaacccctgataaactcttcagatcttgctctcttgctctctgtggcagcaatgctgttgcagaaccagtgaggagggacatcatcttcatatgcaagtctggatttcgaggccacaccatatccaaccagtgtggtcacagtcatcactcaccactggacagtatagcctgtgctgtgctgctgcagccctctgagtggacattggggaatgccagcaggagtttctgggatgtgaagatatgggagcagtcattcccagggccgaatgcagtcttgtacagcggcactcacaaaatactgccctactgcagtcattcagttctcaaagagggaatttcatccaatttttaatataaccgtgctatgtcttgattaggtatttgtaagtcaaccatcatctttctttcagttttgtgcatcatctttcatattcagttttatgcatatgtaaatgcctatac

SEQ ID NO: 472858 - DNA, 747 bp, Homo sapiens
ggccagttcatccatcttttttttttttcatggattgcgtttctggttttttttttaatttagtttgactttcctcaacatgttaagacaccagcccttgatctgcaatgactctcctaaggagtcagaaccccagttccatggaaaacttcctctaatttcttccttccgctgggttcgtggtctcactggctcaggagtgaagctgcagaccttcccggtgagtgttacaactcttaaggcagcgcgtctggagttgttcgttcctcccggtgggtttgtggtctcgctggcttcacgagtgaagctgcagaccttcgtggagcccagctggcttcatccagtgcttcttgcatgggggccgcgggtggagctgcctgcgagtcctccgctgtgtgcctgtactcctcagcccttgggtggtcaatgggactgggctcatcggggaggctttgggtgcacaggagcccacaggcccggcgagaaattgagcacagcagctgctggcccaggtgctaagctcctcaatgcccggggccggctccgctggctgctccgagtgcggggcccgccgagcccacgcccatccagaattcgcactggcccacaagccgcatgggcagccctggttcccacccgcgcctctcccttcgcacctcctggcaagctgagggagccggctccagccttggccagcccagaaaggggctcctacagtgctgcggtgggctgaagttctcctcaagc

SEQ ID NO: 472859 - DNA, 1006 bp, Homo sapiens
tacaggaagcatggcatcagcatctgctcctggggaggcctcaggaagcttctactcctggcagaaggtgaagggggagcagctctgcgtgggaatcctgcttcagggccagcggcccctccctgcccctccatcttccctggtacagcacgtggccctgggcctgcgggattttcatgctcgaccaactgccatgggccctaagccctcctggttcaggcctcggtgtggggcagcccacaaagcccaaagtaaatcagaagtccccatcgtcatctgtaaagcctatggattggttttctcacatggcaaagggaactttgcagatgtgatcagcaagaaggtggctgcctacaagccaggaagagagccctcaccagaacctgacagtgctggtcccttcatcctggacttccagcctccagagctgtgagaaataagccactcagtctatgatattttgttatggcagctcgagcagatgaatacagatgttaagaagctcagaacgcacagtaaagggtgatactacttgtccagattatgtagaagggtgttttaaaatttccaactatttgaggactttgcagatatcttcttggttttgatttctagtttaattctgctgtggtcaattaacttattttctattatgtaaattcctttgaatgtattgaatattacttattctattttatatctattactgggttatttttatttcattttaaatttatttataatacttataaatattcatcacagtctaacttcaaatactatcatatggcttcatttgtacagttaatgaatgtagtttggtgtcattatttttaaaaactctgagcaaccatccttacaaatactgtttctgccctgttctctccctcttcaccttctgggatttcacttccatccatgttaggactgtttcatattgtcccataggtcttcaattctgttccatttttcacttgtttttctctttgtgttgctgtttgaataa

SEQ ID NO: 472860 - DNA, 783 bp, Homo sapiens
aagctagtggcgaggtgtttgaaaaggcagctttcctggacctttctcatggactcaagctgcccctccaccttccaccatctccactgctcccattctgcactctgctcgccaacacccctccccagtagctgcacaggagactccaagctcctgtctgctgtccccatgggtgttcttctcacactaaccagtgctccctcccttcctagctcctttctcattagcgtagcacttgctttatctctgctagcaggttttaagggtcttatgaacaggactcctaacttgcacttttttctcctgcagagctcagtaccatgcactgcacatagtagggagcttaaaaatagcttgttgaatgaaagatctgaacaaagacttggaacaaaagcatcacctaggcaggggcatggtcctttagtaagttgtgtctgcctcttccagacaactccttggcctattaacactaccaccaataatcagtgagttgattgtttgcatttgtgtagtgttccccactgcccagcaaaccctctcacttggtccttacaataatccttctcatctaaatgttaaccaaacacaggggtgaaagctcctgtccccgcagcaagttgaccagtcttaggcaggctccgtgcacctggccctcattattcttgcttctcccttttgtggcatctataccttgcctcatgcctgtggggcatcttagacaggggagagctgcctgcctcactatggtcccaactccagtgatatcagacctgtgctttttat

SEQ ID NO: 472861 - DNA, 792 bp, Homo sapiens
gagacagtccttaatctttttggctcatagacccctttgagaacctgctgaaagtattggtattggaccctgtccaataccacagaaaacatttacctatgcatttgcaacactcaatttcttataccacaccagatgtattctcagattccagcaaacccatctgtggatcaccactgatggttctgtggactcagggaaacactttccttagagtttctgcttctcaagaattaactggaaatagctcagcatccctaccctgtctccagcccacttccctggatgcaggacagccaccagaagtggacatctatgcccagcagagaggtgggacagtgcacgtgccatggaggtgccacacatgtggaacacttctgggagaacccaccaaagcctggggagctggggactcacccaggcaagggcacctgcaccaagccaaccaaataatccatccaatagttcaacttatttatggaacccaccgactcttccatgaagatgaaaaagcagctgaggaaaaatgggccctgaatgcagggttagattcccgataattcactgaaaataagtaaaaccaacagtgcaagaaattcttcatcagatgcagatccttaatcttggacttgctagccttcagaattgtgagccaaataaacttctattacttgtaaattacccaggctgtgatattctgttatattaacacaaaacactaagacctcacatcaacagatatctatggtatttccaatattttgctactgctgacaatgctgctatgaacgt

SEQ ID NO: 472862 - DNA, 1792 bp, Homo sapiens
ctgcagctgagagtggaggagagagggctccatctctctctaaatgagcagcttcaaatacatgctagcagcagtgaacactgacatgagtgtggaagattttcaaaatgagttaaacatgaagggtgccatctatgctgttgccaatgttcggaacacagtgactatagacacagttgtgcatgcctcgcacagcctctggcttgagactatgttcagtgatgatgatgaacaaggtggtaactttgaaggattctatatgtcagaggcctccatgtcaagaggagctacaatcagaccaaatacagatcacaagattctgaactttgagcctaatgctgtgattagattagacttcgggatgactccggaggttgcaatcaaggtattggcaggaactgtcttctcatctgaactcttaatcgaaggaatatatgcttccaatctcactcccctggttggtaggtttcaattctttgagggctattggcctgttctctgtcatgtgggcagctcatcaaatggcagctgtcttcccttggagcaatccggagagcaatagagtgggtgcctcagataaagccaaagtttctgcctttatttttattaacttatttaaagcaaaggatttgagatctttttactactatccctttttgacatcccaaatgggttaatgcctgcatcatgtctcccagcccaatcgaagtttaacacagaatatgatggatcaagaaatgtaggtgaagtggagagtagcaaaaacaatatggtgagaaaattgtggcttcactctagactagcaactaaccgtcctggctaatttactgaactgccttattaattcaactgggttttcaattgattctctataattttctgattatacaattatattatctagaaataatgaaaattttgtatgcaattttccagatttagtgtttctaaattattttttctatcttgtttcactggagctaacagactctttctaatgaaagcccctcactcaccaacctgttttttcatgttggctagaaggaaaagcagtgtgatactgtgaagtcagatttctgttctctatttctgactccattcctcatttgtttggaaaccgttggcaaaagtgggcaagagataatatggaataataaagtttgttataaaggaatacctgagaaaatcaaggacagaggaagtacagcatttaagtgaggataaaaacataagtggccaaatggaggaaaaatgtgtcttattctttccacagattacaaaggcgaaatgagtactgaggaatttaggtattcaggtatctgctgaattatctgagctaaatagcactcaaagctaaattctgtacttcttgattatttaatttctcagaagttagagttagaaacttgatatctgctactttgaacctaatttggggctagtcaattaattaaatattctagaacttggaacagaatgactaccacccttgaagatctcatgcagtcctggaaaaagaatggtgaacaaagggaagtgccttaattttgggaaagcaaattccaagtaagagctaaaataggcatactcttgtagcctgaaagcataaaaggaaacagtctccaaagcttgagagttttcaagagtaaaattccaaatataaaagtaaaagattcatatgactcaaaagagatggaagcaaatatggtgttgctcatcttcgtagagccttatgagattttaaatatttataaaaggtgaaggagatgcataactaagaactaatgtaaaa

SEQ ID NO: 472863 - DNA, 923 bp, Homo sapiens
agctgctggcagaaagcactctagcaaggactctggctttgactgaccagcaagcagctgctctctgccactctcccctcccagctggggttgggatgcatgacacaaaggtcccacacagctgactggatggtgttttccaccatgtaccaccagagcctaccccttccccagccaaagggctttactctatcagagacaatctctggctgcagctcagaaagaacgagagggatgggtaatgtagaaatctggataaatattctagttctgagcagttatcctggaaatcctgccaggaagactcagttccacagtttcaccttagcattcagctataataagaagtccatacaactccctgagacacatttttatctaaaactcaattccaagctttgggtcaaagccctagaaaggaaaactggatctgagggatccagaggcaaatggtcacagaggttaaaagccacagccaaggcctctgagggagctcagactgctgtttcccatcggcaggaagcagttgagattggttttcgtccttatctttattctaatggcagttagatgtacttttttagagaggggaatgagacaaccaggagaaggaaagaaagaatttaaatgtgtgatcatcttcactttaagattctcagcaactctaaacttgtgatctgggggaattcctcaagctgcgttggtggggaagtatctcttcttgatgctctttttttgcacatttagagttaataatttgtccatgtttttgtcaattgtacttatgtgtctagaaatctcagggaagtcatctactccttaaagaagagtcattttctcttttctttttctttttctctggtacattgcacaacatctacaatgttagcagggggtctttaatccacagtgccactagcaaa

SEQ ID NO: 472864 - DNA, 538 bp, Homo sapiens
tcttatttttgactttatgaatttaaaaaccctgccagtattttctctatataaatacttctttaaaatgcagacgcttgggtataatctgatcaaaatttccaatttagaaataatgtcacaatttttttctatatatgccatattgaaagggatcaagcaagcagagctctctttcctgcctaaaactcttcacaccaatttatttccatttgcttttcagacaactggaaggaatggcttgtccgtgaattttcaattcaatgtccaacaaaaatatcaacagccacaacgaaatatgttcatgctccaagacaaaacttactcctccatatccaaaaactttgtcttcctgccattctcttttccaagagcactaagcaccgactgaagaaggttgactaatatctactcatctccaacagttgtaatttggcttctagattaataatacttagacatcaagtaaatttctgcataaataaaaactatgaacttaagcaacatttaaacctttatcagaatagcaaagaaatat

SEQ ID NO: 472865 - DNA, 1672 bp, Homo sapiens
ggcacagggcgcgggagtggcaggcagctccacctgcagcccccctcagggattgtaaacgcaccaatcagcgccctgtcaaaacagaccactcggctctacgaatcagcaggatgtgggtggggccagctgtaacactcaccgcgaaggtccgcagcttcactcctgaagccagcgagaccacgagcctactgggaggaacgaacaactcccgacgcgccgccttaagagctgtaacactcaccgcgaaggtctgcagcttcactcctgagccagcgagaccacgaacccaccagaaggaaaaaactccgaacacatctgaacatcagaagcaacaaactccggacacgccgcctttaagaactgtaacactcactgcgagggtccgcggcttcattcttgaagtgaacactgtgctggctgtgtggcacaaactcctgattggtcagactgaaatttccttgcggaagaaagaggagtatgtttttattgaatcctattatttcttaactcctaggacagacttctgcacagtaagggcctatcaaatatacctattaggataattatattagcttttcagaagacagttaccaggactgtgtgatttgtgcttttctatatttttccctttgtgcttagcttaaatctatttggcaatgttggtagtgactttcttgaatacttttctttcctttgaaaactacaatgaatctttttctgcaaagacagatcttaaaaaggtcagccatttttagccattcatgcagaagtacatctcacattgacatcaaaatggaaaatattttaattatttcttgtttcacaaataaaaataataatcattggactgagaaaggtataaacaatttctggtaaacttttgctgagaaagctgtgagaaatgaaactatcagggtaaaacttataatacctgcttagatttcagacataaagtaaatttcccagtcatcattttaaaacagctgtgaagttcattataaataatgttataaattatatgcgataatctttttttttttgcaattgtcagtgtgtttatctcttgtgatccttctttttttccaaaattctattagccctaaggaaatgtttacattttgtcagaagctgttgagactaaagtttgtggctttttaacatatacaatgttagcattattctttgttcactgaacatccatagctctccctgtgacaggctgtcaagaaatatgtctctgaaaagacaggttagctcctcaaagacaatcactgatgcaattctaaacgatgttctacaccccaccagagtgccccttactgttctcgtgtgcagtgatgtgatgtctgaactatttgtttgctctgccataagatagcattagcagatgtaatgtgaacagatcactcatttgcagaaatatttatggtagtgctttcaaaggatcattcaatctgcaagttgcaattggtgaagcatgtagcaaggactgtttctaaaaccatgtaggctaaaatgtcatactacaaggcagttaaaatggttaatatgtgtatgtccagagattagaaaacacatgctgtcatatttgagcagattcaatacacgtgcattttcagtaaagcagaagtaatcatcttatgttgaaagggctaggttaaattgcttt

SEQ ID NO: 472866 - DNA, 1913 bp, Homo sapiens
agtgagttctcatgagatctggttatataacgatgtggcacctcattcctctctcagccttgctcctgctcctgccgtatgaaacatttcattgctgttttcctactgcactggacttctttttaatgcaaatatctgaagccttcttgaagtttccccctgaaaatggacttctttttcttctacattaccaagcagcaacaaagatagctgaaaatgtaaagcaggttcagaaacccaccaagagctttgtaccctctgtgggtgaaaactacaggcactcaacaccagcacagcccatgagggcagctgcgggaactgaaaactgcaaagccacaggtgcagacctgcccaaggccttgggagcccagccctcatgcccttgtgccctggatgtgggacaaggattaaaaaaggatgactttggagctgtacgttttaataactggcctgctgggttttggattttcatgggatctgctgcaacaaagatagctgacagtgtagaagcaggttccaaattgggtagtggcgagaggttagagagtttggagagcttggaagaagacaggaagatgagggaaagtttggaccattgcagagacttgttaaatagttcagcaaagctcaagagttgtctggcctacatcgaacagcctgtgctcctatgtgtgatgaaagaaatgaccataagttggaacttatatttaaatgagaagcagagctttaacatttggaaaatttgtaatctggacaagtggtcaaaaagaaaagctgattttcagggggaaaatcaagaaggcttcggatatttgcataaaaaggagcccaatgctaataattcaagacaatgggaaaaaggccttgaaggcatttcagagacctttgtagcagcccttgctgtcactggccctggggtttaggagaaaagaatattttcctggcccagcctcatggctccactgctgtgtgcagcctcaggacactgctgcctccatccctgcagctccttttccagctccagccatggatgaaagatgtacaggtacagcttgcatcactgcttcagaggatgcaagctccaagccttggtggcttctacgtagtgttaagccagcaggtacataaagcacaggactagaagcttcagagcctttgtctggactccagaggatatatcagaaagcctgagtgtctagccagaagcttttccaagagtcagagcctcatggtaaacctctactcaggcagtacacaaggaaagtatagggttggagtccccatacagggaggcaccattttccagacctcagtttcatagacccaccagctgcttgcccccttagtgttgaaaagctacaggcactcaacgccagcctagccaatgaggtcagctgtagggggaagattttgcaatgccacatgtgcagagctgcccaaggccttgggattccagccatcacaccaacctgtgctctggatgtggacatagattccaaaaagatgacttggagctgtatgatggaatgactggcctgctgggtttttgacttgcagggggttttaaagtctcatctggtacctaaaaacttctttctggcaaatttcttctttttggcttggaatgcttacccaatgcctgtacaatcattgtaccttggaagtggttaacttgctttgtatttcagaggctcagggcagaaggtatggcagccttgtcccagaagagacttcgggctttggacatttgagtaaatgctgggatgagttaagatttgggggactctagggaaggcatcattgcgttttgtaatgtgagaaagacatgaaccttgggggaccagggacagaataatatgttttggctctgtgtctctaccaaaactcatgtggaattttaatgggaaatgtta

SEQ ID NO: 472867 - DNA, 1774 bp, Homo sapiens
aaaccacaagaggtcaggcagatatcatgtgtgccgaagtcccaaccccctaatcacatggttggtttttctggtgtgacttgccctatcttgagctatctcattagcaacaactatgataacttagaagattttgacctgaacaaatggaaagatggggttgtcatgaactgtgctgaggaaggaaacagcaggcttggggagcctgggagtgtatttggatatgctcagtttgatgtgattttttttttctgtcacctaagcagagatgcaagtagacagttggtgttcagggacaggtcctggttggaggatgaaaacttcaagaaagagatgggattcacattagagagatatttgaggctgcaagtcctgagaccttgtggcactggaggaaagaagcgctctccatctggctctttgggcagctcatctctgtcctccaagtagaaacaaaaatggagctgctgtggcccatgtctaggggctttgttttccttactccccttttccttttctctctctttgttttgcaatgcctccagcacataccacctgcatgctcttcatcagtctgattcctttccccagtcccattctccttcctgccttgtgtctctttttttcattcaccttcctttgatttaaatcccaatctgaaattcttctttcctcccctccttctcccaatctttatttttcaactctttgtctctcatgtggcctctacctctatttttccactgtccctttgcccaaatgcttcttagccttggcttggaacattatatcacccgagaagttttaaaaacatcccaatgaccaaactgaaccctagacaaattaaatcaggatctctgggaatggaacttcggtagaaatgtttctaaaaagatcccctgttgatttccatgtatatcccaggttgagaaccattgcctggctttttgattgaacatgtttgttgtgcaaagccaactttatattgctgtggctatctctaggtggcttaactgatgtttccgtttttcatttagtggaaagcattttccttgtgtcagttcccagtgtgggtcctgtgacctttgttcttcctcaaggccataaagagtccaggtcaaaaatgaaggagaggtgaggacaggagtagcatggggaactgggatgggatctaagctaccctaaatgcagagagacagtaaaggcacagccaaggactggagcttccagtttctagacacccaagtggaaagctggcttgggttggggtcaggctatgtggaaagggtaagtgcccctgatccaggcagctctgcttacattggcttccagaacatcagcttcccagcctgggcagcaagaacagtgctagcttctaaacttctgcaaaccctttcttctgagcttctccctggctctggatttcaccacctcattctctgtcaggcatgttgggatgatgcactggggactctggagcaggctgttccttgacagtctcttcactgaacacagagtaaggaatttacttcatgtaggggacacctcagaagcaaatcaaacacctgctcagtggactctaaaatttctagcacttgtcaagtagagaaggaagcagcagatccagaagcactcttggaagccctgcctcacattctgcagtttttaccaggcttaacctggaatgagccctgctaaacactgtaaagccataggcatttggcatgtagtctcaccattgtataatatatgtgttcatggaccatttataaat

SEQ ID NO: 472868 - DNA, 1124 bp, Homo sapiens
atgaatacgtttgtaaaacgacagctcagcatctcaatttaactctaacaaaattcaatttcactcaaggaatggtctccctttggcctctgctaccctgccctgatgtctctcttatttaaatgtgtgcagctgcaatcttctgctgctcagccgactgaacacccctcagggattcttaatggggagcaaggcactgctggattcattaaatcccactgccaaatagcatccgtcctcacccaggaatgctcgagcagggatgcttctggggccatcaatgagatgttcatttgggctttgccaagaagcaccaggccactgagcagactaatgggccgcatgaatggctcactccacatcctcgttcccacacatacggctttgatcatggctttcctccatgcctgggatgtctactcatctcctcttactccagcctacccacatccacttcatttacctctttctgatgccaccttctccctgaagccacatcaacctaacctttgtcatgatcaacttgcagaactacaatatgcacatccaacagcctaacggtgataggcacagggtctggtgtcgggctgtctgaggtcatgtcccagctctaccatttatcttatgtgaccttgggaatgtttctttcctgagcactcattgactgtacctcaatttctccaacagtaaaataaggcaaacagtacctatatcacatgtatcttataaagagtaaatgaatatgtaaagcactttgtatgatatctgacatgtgctaggtcgttattggtgtataaagacactactgatttttgcatgtttttatcctgcaactttattgaatttgtttatcatttctaagttttttggtgaagtctttaggctttcctatatgtaagaccatgttgtctgcaaagagggacaatttgattgcctttttttcagtgtatatgctttttcttttatctaattactctgtacattgaggtgcattgttaggttgtttatttgaaatctgtctactttttaaatgtaagcacttattaccataaacttccctcttaccactgtttttgcagtatcccataggttttgtatattgtgtttctattttcattcattac

SEQ ID NO: 472869 - DNA, 601 bp, Homo sapiens
gacgattcggatggtagtacgagtcataaactcaaattccaacagcatccagccagcgccgctaggttaggctctccccgaccgagctggtctcggcagcccttgttgaaggaatacttatggcaatggtgatcaccgctatggtagctaccattaaattactcgttgtgattggttgtcccgctttcctcaggttttcttctgccatctgtgacagcttcttggtctgtccccagaaacacacagtgatttctcttactgtgaaccagattgaattcctggaggacacaatgagaagtcagcagtttgcaaccaaaagagtgtcctctctagaatctgaccaggctgacacagcaatctacaacttccagcctccagaactgtttatacacctgcagagagtaaagacagacactctggaagataagaatagcatcaaacagtataaaatgaggttgctgatcttaagaaatggacactatagttggagagacagggtttacaccaatggaaagagaaataacaccgaacaataattcaagtggtgttgcaaaaccttgtatgattagttaaataccaaattattagtcagggaaggctt

SEQ ID NO: 472870 - DNA, 726 bp, Homo sapiens
actcattgaggagccggttatcaatgctgctcaacggatcatcgtggggccgcctctgctgctcatacctggattccacgggttggctgtgctcagctacagctgcagccgcagccagtggagaaaaggaaaatagaactggagggaggtgtcaaaggggagtcttcttcactaattcctcatttgcccatatcattccttcaccttctccttatgtaaccagtagagcaaagacacccgagtggttgatgcccaggctttctggggtggcaggctccacagaacacagtctgattgccattgttctaaggaaaggaggtgacaagtccaaacaaattgttgatgttcctcttccaaaggccctcttacgttcttgggatatatccaaaacgtcggccagcctgctgcatgacaagtgtggccatggatccgggtggggcacgtgctggtgggtgtctgccgtgcacactcacagtttgaccagaagggattatgggggcggcaccaccctctgctctgttacctgacgccaccagtcttgggggctgcagccggttgaggtccacccccatgctggttctgcagttggtagcttcaggggctgaggtccgctcctgggtctgtttctaaggagctgtgtgaggttggtcaagggtagacatgcttactgtccatgataaaaacagtgtctccctctggagtgaagggcagacacacttactgccc

SEQ ID NO: 472871 - DNA, 1417 bp, Homo sapiens
cataaaccaccagcccatgtgcatctaacctctaccaaagaatggaactttccctgcaaagcaggtggtaggaggagccctgggactgtcccacggagattgggggatgcctgaagaaaggaacgctgtgctcatccccacttgggcggtggctggagaagccgacttactgttccccagtctatctgagcagaggaaaggacagttggtgccggctgatgaaaagccagagaggggcaccgctagcagcagcaatcttccccagtttctcgcagcagggacacctgagcttcctgagaatcggggactattcagcaccttgggccctcgccacgggaggctgggaggtggatggcatggctgggcagcccccgatggggaagagggcgagcaggagtctgaggactgggtaatgaggggatgcagccaaacctatggggtttggacacacacagggcacccacacagctaccaagcccagggaggacacacacagcagagccagtgcaccatcagcttcaaattcctctggaattacctcctgctagggcacaggctgggtggccagagagtttctctgaaggccggtgctgcatctcagtgttgggttgttcctgtgacgcatgtcacagaagatgcctctcccctccttcttgtccctcccctggtggaaatgtcagagacaaaatgggtcttcatcagctttaaacctcggtttctactaattaaagtaacagggacagcaggatttgctcctcctccaccaccccacccctgccccccagcagcttaaggctctcgtttcccaagtgagaagttccctgggggcctctgggcctttcccttagtggcagctgctcctcccaccccacccccatttttcttgtgagcaattgcaatcatatgagctctacgagttgcatgctgtttttcttgcacattattttaattaaaagaaacaagtttaaagcagttaggacacttgctcagagcagaactcactcttcaatcaataatgatgtatagcataccccttgccaagcatcgtattaggctcagaattaatattcaccgaggtctagctttaagtcgggcataggctagactccttcattgtcagcccttttaattctcaaaacagtcccatgagctagaaaccatgacatccatttaaaatgtaattttaaaaaattcctaaagtaatacatattcatggtactttttaaaaatcaagctgtatagaagtatataaagtgaaaaataaggtttctctcctttatcccaattctatgttccatagaataaatgatccatttctgttaataaaattcacatgtttactcattgttagtgggatgtcattgcttctagactttctcagcagacaaagctgggaaagatatgtatgtgttaataa

SEQ ID NO: 472872 - DNA, 534 bp, Homo sapiens
ggacagctgctgactttggagtcgctttagaggaagaaaagaagggctggtcactgcagaaacgacgtaacaatgtccaactcggattaccttcccgactacccactcaactcagatttagtgaagagattaaagtctgccctggatgccaaagatgaggagagagtgagggatttaatctgcactgaaatcacgcctgtggacgctgtgatagaactggccaatgacgactggatgaaagacccctcggctcagctgcccaccggcatgctgctagaagattgccctggggggggtttaggggaggttgtcatcacaagcagtgattggactgggagtgctgagctgtacatcttgcattcaccctttaggcccaccgtgcccaagcacccccccgaggctgatctctgcaaactgcatcagtcccacttgccctctggctcctgttgggtgccactaatgataggagttggaggaaagtgagggtagggcaagtgcttccccggccctccctgccagatcgctgctgggttt

SEQ ID NO: 472873 - DNA, 767 bp, Homo sapiens
gaggccacatcgtttctcggaatgcttataagtctcttcatttgccccttgctgcaatctagcaaactgcatactatctggaaagagcctttccagtgccaatcaaatgtgcctgccaacaaccccaccactccccctgcctgctgggcgaagcccacactgctctcttcaggacccaggacacatcatgatccagctcctgggggctcaccgggttcacctcctgaggcgccgcctctccatgcttcaattctgcctgaccagtttgatacaagaaccacaacagaggttattaataacaaaaccatccccacctgctccagcaacagctcctggatcctaagaatatccctttggctttccaggttcccagaatacgcttgaaatttccatcaatctgtttaggtataagcagcattttggaacgtatgtatggcaatgcccatgagaaggtgaggagaggagaggcctgggctggctgggagctactcagtgataacaatcgtggggacctctcagacctgaccccaggacccaggcccatccttgaaacactatcatttcaatccctcctatcaacgtcaccagtggaagaaatggcccagtggggaaagcttactgtttgtcatttcattgccttctctgtatcaatgccaccagtggaagaagaaatagctcagtagggaaagcatccctgaagcctttgcaggtctatgtctgggacccagccttggctgagccttttactccaaggcaagattttgtga

SEQ ID NO: 472874 - DNA, 682 bp, Homo sapiens
gcagtgttggaggtggggcctgtctttgattaaggagagaaccagatgcaaattttgccaacatgcaggggaagtctgtggtcctactctgtgcccagccgggagacgtggagggagggggacgagggcctggcccagccccgttcccgacccggaatgcaatccataagtctcaccctgagaaaaccacctttgtgatcatggcatctcctctgccaggaacacctgtgaaggaggcagtggagggcaggggtttgagccctggctgcgtgctgctactgtcagctctgtgtcccatcttggagcggggctggacttacatcttcccacacgctttgatgctccatcattttctggggtcaaaccagaaatgtgctcctcaaagaggagagaagagcaaagtagtgcttccttggaaaaagatcacatgggacttcatgactgtttcacagattcgtattccaggtaaggagaggctgaaggagagagacccctgagcacagccttttatccagaccaagcatccagcccaaaaagtcacctgtggcagatgccaaacaagttcaggtccacgtctgtgtgtgcttctctgccttcctacctgctgtccaacaggcccagccccagcctgccctgacatcttccagaatccaaacctgccagaatccacagcctgccccct

SEQ ID NO: 472875 - DNA, 1089 bp, Homo sapiens
tgggggtcgcaaggtgctcagtgggggagtttttgagccaggatgagccaggaaaaagactttcacaagatccattcctgtgcttttgtgattgaacaagaggagaaaaagaaaacagaagctcataaagaaggagatggagtgaagagggctgataagattctgggggttaccaaagatcctggaaccattgctggtctcaatgtagttagaattatcaatgagccaactgctgcttctattgcttatggcacagacaaaaagtttggagctgaaagacatgtgctcatctatgacttaagagatgaaatttttgatgtgtctgtccttactcttgaggatgaaatctttgagatcaaatctacagctggagacacccacttaggtgaagaagattttgacaaccaaatgatcaaccattttattgctgagttcaaatacaagcataaggacagtagagcagatatttatacctccattacccatgcccaatttgaagaactgaatgctgtcctgttccgtggcacccaggaccccatagagatagcccttcaggacaccaaactagacaagttgcagatccatgttattgtcctgcagacccagaccttcactacctaccctgacaaccaacctgatgtcctcattcaagtttatgaaggtgagagtgccataaccaaggataacaatttgcttgttatccagggcaagtttgagctcacaggcatacttcctgctccctttgctgttcctcaaattaaagtcacttgtgatattgatgtcaatagcagcctcaatatctctgctgtagaaactgtatcaggacccgaatgggccagtgcctaagctggagtgtggctgcactgttttgcagaaggataaaattatgttaagaaagagccagtcataagatttcctagtggatctgatactaaggtacatctaagtgcatctctaacaaagtagcaattaagcatattccccttcacaaccactcacacagagatattcccatttttgcagaatagctttaaagaacaaaaacttagaatatcaaagaaatatttacataattgtaaagtaggttgt

SEQ ID NO: 472876 - DNA, 609 bp, Homo sapiens
cagccatgttgctcacacaaagcctgtttggtctcttcacacggacctgggaatgaggatgatggcccagggcacattcttctttacagaggaggctgggcaagagcttgggatacagaaagctgtcacactggccctctgcccttgtgaaaaggcagagggtccattgagctggttaacacttaagctgtctgaggatggcaaggctaagaaagcattagccccagtgttacaacactggggccacaagcacccacacctagacactactgcagccctggagcccaaaactctcaccctggctcctgcatctgcctgtctctgtgctccccctcctgccaggggtttgagcagcagcagcagcagcagtggtgaccgattacaggcgagccacacccctgtcacatgtcctgcaaggaggatgagggaactctcctgtttcaccaggacctgttatttttttactttttagttccttcatacctagtttattgacagtttttaacatgaatgggtgttgaattttaacaaaagcattttctgcatctatttagatagttacgtggatttgtttttagttctgtttatgtgatgaatcacacttctgat

SEQ ID NO: 472877 - DNA, 572 bp, Homo sapiens
ctcagcacacgagttcacagacggaatgaagaaagagaccaggagtgtctcttctgacttcttcctttacaaggacagaaactccaagagaatgttctttgcccagccagggttgactgggcccagaacttccagatgcttctgtatctttgcactgtgccacactgccccagtgccacaaaatgcctcgtggacggccacaacatggaatgtgaggccacagcgagggcagcccctcacccagcacagagacctggtcacctgccgtcacaggacacccacaggcctcatgcacaagggtactgggctgacttgtcttctaagaaatgcggaagaagaaaaagcacaaggaaaggtgcttgttacctctgggcacccccgagaggggcatctccagcatctgcattccagtgagaagaagagagaaggaggtgtcagggccccaggagtgggaaacggaatcaccttcccagaccaaggtacttaagccaggtgctctgggaagctctcaggtcacaaaagcaagactgaatgtttagatttcatagccaagacttgtattgtgatcacac

SEQ ID NO: 472878 - DNA, 842 bp, Homo sapiens
aagccaaagcctaacctagaccaaggtcctaattctcttcaattatatgaagctgcgagaggtgaggaagctgcataagaaaagttggaagggaagctacctggaagacactcagatgtatggcaatattactcctgactgggatcggtatctgaccaaccgaaaaaactcctatagcaaaaatgatagaaggaaccagaagtttaaggaagctaagcggttcttcaacagcattcagaaggaccccagcgagtttgcctggcgtgatcctgagttgcctgaggtcattcacatccttcagcaccagttcccatctgttcaggcaaatgcagcagcctacctgcagcacctgtggtttggtgacaacaacgtgaagatgaaggtgtgtaggttatggggaatcaagcttctggtttaccttttgggccacagagttttggaagttcagaagaatgcttgtgatgcccttcgaaatctctttttcggcaagtctacaggtgaaaataaaataacaatgaaggatgttgaagctcggaagcaaatgcgggcctgtgaggggctggtggactcgctgttgcatgtaacctacacgtgtatgaacacatccgattacgacagcaagatggagaattgcgtgtgcaccctgaggaacctgtcctattggctggagctgcaggtgccccaggcccagttactgggactgaacgaatgggatgacttactagaaaaagtttcccagcgaagactctgagccaacctgctgggggaagaaaaaagaaaaagaaaaagaggactccacaagaagatcaataggatgaagtcggtcctatcccagcactgtc

SEQ ID NO: 472879 - DNA, 622 bp, Homo sapiens
acccctcaacaggccccagtatgtgatgttcccttccctgtgtccctgtgttctccttgttcaactcccacttatgactctgcttcttgtcagatcagctgcagcattggattctcatagaagcacggaccctattgtgaactgtgatgctctgctgcaggtctgctggagtttgctggaggtccactccagaccctgtttgcctgggtatcaccagtgtaggctgcagaacagcagagattgctgcctgtttcttcctccagaagctttgtcccataggggcacctgccagatgccagccagagctctcctgtatgaggtgtctgttgacccctgctgggaggtatctcccagtcagaaggcacagggagctggcaggcaggaaggtttacatctgctgaagctgcacccacagcccctccttccttcaggtgctctgtcccagggagttggcaaggctctcagtcagagtccatttcttacctactcccatcaggaagctattttaattcccttttaaagtaaagtaagtggagtataaataactttgtcattgccttacatgattgcacagatgcccacactagattagaataaaggaaaacctgagcgccttcaaaat

SEQ ID NO: 472880 - DNA, 873 bp, Homo sapiens
ttgcaagttgctcagtgggcaggagtgggggtcgcaaggtgctcagtgggggagctttttgagccaggatgagccaggaaaaggactttcacaaggtaattttcaggtattctgttataagcaacagaaaacagactaagacaagtagtattgctggggactgtgattatgtttcatggaattcaggagataaagataatgaacttgaattattaagtgcctgtctttctacctgctacaacacgtacttcaaaacagaagaaatttttataaagaataagtctataaccacatggaaagcaatactcaataccatcaatggatctgacattgaggaagttatacggaatacatgtgtagcactcttagaggtgggaactgtgtgggaaatctccaggcccttgtatgtgaaaaaaattgtcttccatgaaactggtccatccctggtgccaaaaaggttggggatcgctgttggtacagacatgaccaatgtaaagaaaaaaaatcagtaaatagtatgaatacctaaatagacagaacttaagagtaatgtatggagatgaaataatgaaccaagtgaaaaaattttcaggaatgttattcaaaagtgtgaaaagaatatataaaaacaacaaaaatgaggcattgagggaaaaccaggtccctaagatgtgaaaatacagaatgtggagagaatgaaacaaaatacatactaaaagaaactttctcagagtagaagaaatatacttttctttaaattgacatcaaagacttaatgggcaaaatggaaaagaccagtagcaaaacaggttaaaatgtttgaaaattaaggagaaagttgtaaaagcatctggaagtaaaactttacaaaat

SEQ ID NO: 472881 - DNA, 795 bp, Homo sapiens
agcaaggttcatacatacacaaacaatgctgatacaatgtgcagcccatcatagaaaagatgtggatgcaagatgcagaaaatttatctatagacatccttcagtttctacgtcagtgatgaagtgtagaggaagaaggaaagaagagacagaaaggagggatgggtgcaggatgacttgcaaaattaaaatgcacaataccaagtgcaagcaaagaaggaaccagtataaactcttatgtattgttgatggagccagtgatgaaaactggtgcagcaggggtgggggaatcttcaatacctgctgcaatactctggggctgtttctcctgattgaaaatagttctgggtccatgccaaatttgaaagaaagaaaaaaaagagcacccaagtgcatttgtacaccagaaatcgtgaccgtgctatgccattatgaggaattaacaaagcatgtttaactaactctcttgatgatcatattttttgaattttaaatcaactttattaagacatcatctaaatacaataaaaaagagctcattttaagtgtacagttcagaaagttctgataaatgtagttgcccatggagtccatctaccgtcaaggcttatttctgagctgtacttctgaattggttctgtaatacaattgactattgctttacaagacgtctaaatatggtaattcttccagtaatgaatatttacttcatttatagtcaatatatttgataaatctaggttcatttttctgcatatggaaaactttttatttcaaagatagcatatgtgagtt

SEQ ID NO: 472882 - DNA, 1270 bp, Homo sapiens
gatgcactgctgacgtgctgcggacgacgagtggctgccaccgggcaggaagggtggtgacctttaacccagggaagccccaaccaaaagcgcaccttgacttgggtaaaactgaaggagctccatcgtctcagtctcctctctcgatggcatgagaaagtgtgagcacaatgattttctgacagatttattttattatgagagaaagattggagactcgtcctccttaataactgtgctgacaagtgacaacttcactccattacttttcaatgggaacattactcacacaatattgaaaatggagaaacattttcacgtgcttttcaaatctgagatgatatatgaaatgaacagactttgtggtgtccactgctacaatgaaaagctaatggaatccagaagaggctgctaccaaattaaggaggaggacaaggagaacagttcccatgatggaaactcagatctagcacttcaaagggtgctactctcctgggcagctgtgctcattaggaaacatgcttctcagatggtgataagagctgatgcttattgaacacctactacgtgccaagcactgtgcacttgtttcccccttaggttggtggatgcctagaatgagatgacagggaataaatcaagcaacaaatatgaagttgcagaagaatataaaacgtaaggttaaccctttgggctagaaggaaaatagagatatttatcaattctttgtcaagggctcatttttctttttaattaattcttaatactgtatagtaagagctacacaatagccttaaattcttttctccacatcacagttgatgagaaaagctggctcctgaggttcctagttttaaaatgaatttcaaagcacacagtgataacattaaaaaaatttttttttaattaacaaaaaatatttaagagtactttgggaattttacaaattctaaatttctaaatttggaaatccatcttcattattctggttaattaaaccagaataattaacaaaacaaactttaaaaaaattaacatcttcctgtaacaaggcagctcatctgtccccccagccaatccattctcagagcagaatttcagattccacttgaaatgggaagaaatagctcattgccctgctgtaaacaccttagaacatgaactgtgaaccaccaaactcaatatctgatcacacactctgagataaaagagactgaaacttcggtaagacttcattgcaaaaataaaacaaaaatttcctgacaacttt

SEQ ID NO: 472883 - DNA, 565 bp, Homo sapiens
caccatcacaccatcccactgtaccatgatgcctacagaatttcacattgcaggagcctcattaatttctttagcaaactttgctgtgttccttcactgttccaggttcctagatgctggcaatgccaggatggatgaattactttccttggcccggagagcctcaccgtctagaaagagatacagacgtgcaaataattgcaagagattcctccaggcagctgagtgcaccttctgcatacctttgatatctaatattcaagtcatatcccagcccttgctccccacaagcagacagaaccaagaattcttcaacctcttctgtcctgagaccctgcctggggctctcctgattctctcagccaccaagctcacctcccagtctgtactttgggcttttcctctctctgcaggtatgaagtggtctactctgttgccgcatcttgtcttgggctctattaggggctgaaccatgtcccccacaatcaatcctgagtacctctgaatgtaaccatatttggagataagatctttaacgaggtgattaagtcaaaatgaggccttt

SEQ ID NO: 472884 - DNA, 1013 bp, Homo sapiens
gttcaccttctgctgtgcagcccagttcctaacaggccatggaccagtcttgtccaaggcccagggaagaggaaattcagccacagaaagaaatagcagggatgtgtggatgcagaggagagatcgtgtggggacatagcgagaaggcagccacgtgcaagtcaagagatgaggaatttcctcatgaatacttctactcagggacaggatttgaaggaaatgagacaaacacagccagcccttggtgggggccgtcctctgtctttcttcaggcccaagcccttccttcctcatttccagatctgtctgtcttagagcagagaatgtgtggattcagcacaagtctccccagagacatgcaaatgcaaaaaagaaatgagtatttcgacagaacacgtcaagtcaatgaagatggcgtgaggatgtttgaaggattaggaggacagtggagctttgtggggtctggaggccagaagttcgagatcaacgtgccagcagggccggtttctggtgaggcctttcctcctggcttgcagaccaccgccttctcatcctgtcctcacgtggacctggcatttcctgtaaagaaggagaggattggagaggagaagggaactggacaagcccacgcagctggcatatggtggagcagggacacgtctgtcttactcaacattattttgcctctcttctaccttgccaggagttatctgctggagatccccatatttctctactttgaggaggacagaggtgctctggagggtgccaaggtgttagccatcaaaaactctgagacagcttcctagcgtctgcagcagaagttcttattccttgaaagaaattcaatcaaaccagcttaagccactaaaaaagggcaggcaatatggcaactttctgaaatttccacttgaaattgctgtgaaactgaacctgttctaaaaaataaagtttatttatgcaagaaagatgccaaggctggaaaaaaaaaataaagtctactttaaaaaggg

SEQ ID NO: 472885 - DNA, 1284 bp, Homo sapiens
cagcaggtgttcgacaatggcagcatctacaaccctgaagggcttgacatcacagaggaaactgcattctcactttctggagagtgtctgcgatgtttccagggtctgtttgcagattggctacccaactgttgcatcagtaccccattctatcatcaatgggtacaaacgagtcctggctttgtctgtggagattgattacaccttcccacttgctgaaaaggtcaaggccttcttggttaatccatctgcctttgtggctgctgcccctgtggacactgctgccatgactgctcctgctgctgctgctaccccaactaaggttgaagccaaggaagaagctatgtttgaatctcagagtgaagatgagttgactccttttgacatgagcatccaggagttggataatccaggggcaaaacgaattctagagcttgaccggtttaaggagcagcagggacaaaaacgtttccaagacctgatgggcatggatctgactactcactcagtgaagtgcttgctctctgtgggcatttataatccgatccagaaggctctcaagcctcctccaataaagccctatcgagaaatagatgaatcagtgaaaaccaagacctggatatttaatgaagaggagttggatgatcagaaaattcaggtgcctcctgcaggcttccagctggtctttttatgttatgctgataataaagggaaggtgccctttgctaaaaaagtcatggcaaccccagagcagggggacaaggtgaaggctattgttcagaagctccgattcaaatacagaagtgacagctttgagaactctgtgctgcagcagtgttccaggaacctggaggccttggccttggatttgatggagcctgaacaagcagtggacctgacattgcctgaggttgaagcaatgaataaaagactgggctccccactggtggataagtttaaggaacttctctacccaccagattacaatcctgaagggaaagttagcaacataaaacacaataatgaaggtttcagaagcaaaaggcccaaggtggagtattcagaagaggagctgaagacccacataagcaacagcatgctgggcaagtttgccgtgcccatgctgaaagagacctgctggggactaatttagcccttcccttaaagtgtaacctttctgtgatctcatctaaatattcagagtatatagaatggtctcttcactctgattggttagaatttaaatgcttccccagcactgtgtatcctccaggatctccagtc

SEQ ID NO: 472886 - DNA, 841 bp, Homo sapiens
gcaaaataagcaggtcttgacgcgcagatttgttcactcaatttcccttttctaaagcccttatgctcccaacagttcactcagtgcctatgccccatggtgggaagattaacaaaaagctcaattcaggtgtcctgggttgtagctcttcaggcagtggtgttgtggtgatgtttaacaaccggtttgctgaaaaaaaaatcattattcttcaccatctaaatctggtttgccatgaaaaccagttctgggaggaggaagaccttcagtatgtccccccttctgctgagccccaggcctcatgtccccatatcccccaaaaggaaaaagtgcaaccttcaacccatggaaagtcctctatactcaaaagcacagtccctttagcgctgagccttcttccagttcacaggcctttcacaacagtagggaaagcagcagcaaagtgccatgatggcctggaaacagcaggatttacagggaaggcaaaaataggggaggaggattccacagctggaatacgccaagcagagactagagtgttgcagagcctgcacctgctcacctcttttccaggtgggaatgttggaagagaagtggaaagggcttttgacccatttgatgatttgaacgtgaaaatgaatcctactttctgctttgagaaagatgtaggggatctagatttagttcattgatgaagtgtgttcaaagatgtagacagagtccaagaagcaatggcatgaatccaatgtggcttgataagacatcaaggggctttgggtcagaagctcttttatctgaaatctgcctgatagtgtgaaatataaattggaattgagatcca

SEQ ID NO: 472887 - DNA, 711 bp, Homo sapiens
ccacttcaggccctattcatctggttcgttcttgtgcctggagatgtcactcaaggaggagaacagcaaagatgaggaacaggacctgtttaatgaagtactttgtcccttggtggaggggtgtgctttgctgggtgggaaacccactcctctgggctgcctggattcctcagaactaccaggaggaaaggctaagtctgctggtccagagactgtggcaactcctccccctaggggctcaggcccaggagatccgggttctgtccctgagcctctggctggagttactggagtccctgcagggaagccctgcccagtgaggaaggatgagtcaggtggcatgggtttgcgagtgggatcttctgatctgtgggccgcccagttctgtggaaaaagcactgtttccccagctggctaccatgcccactcaccacctcccttggctgtgggctggggactccactgccctgtgtggctctcagaaattcagcagatgccagctgctatgcttcctgtacagcctgcagaactatgagccaattaaacctcttttcttataaattactcagtttcagctgatgatcttgctttctgttaacacttcactgaaaaaaagaagcaactagaagagaaccttcacaacttctcaccactaattctactcacttacctgcatcttaccttcccttctactatgaaggttgaaatatt

SEQ ID NO: 472888 - DNA, 1140 bp, Homo sapiens
agacaggtcctttgtttcaaaagtatgacacaagttaacctgtaagccaaggcacccagaccaatttccgagctgtacgtggataggagcagcttcgccaacccctgcaaagtgactctgaagaaggtgacaagccctgctccagtcacacccggaaggtgactagtccatgcacggccgaagcactgagggctgttcccagtatatacatcaagtcactgagacaaagaggtttattggactcgcagttccatgtggccggggaagcctcacaatcatggcagaaggcaaaaggcacatcttacatggcatcagacaagagagaaatgagagccaagtgaaaggggaaaccccttataaaatcgtcagatctcatgagacttattcgctaccacgacagcagtatgggggaaactgcccttatgattcaattatctcccaccgggtccctcccacaacaacttttactgccctttggctgtgggaaatgaaagcctctttatatgctgccaaagaggcctctgactttatcacttcacctgcaatggctgattggcagtccagtctttcatcttctttctcaaattcatcaatagcacccaggaagaggcattgtccttataattagtagttcccctgaatctctcaaaatcttgagataatgcacctgccaatttattcccttccaacagtatcccctcccaattcaacaccaggcaaaaatttaacaattgtgccattacagtttgccaagggatattaatgttccattactgccagttatgaggtccacattgcctggtaatccagtgccaaaagtctttttagagtttaattcctctatcccctactgatacaaatggtgttaggtcaagtttctaacagaatactgggaaaagacactgaaatcaagatttatgtgcagaaagttcattgagggagtgccctctgcatcaatatctgtgggagaattaaaaccaccatagagcatggtttacccttgctaatagacttagtcatttttggttttttaatccaagtctctgatatgatatgcatatattttgatctttatgttatgctatagaactgttgctgtagtcagttgtatttaaattaataaacagttatcaggccttg

SEQ ID NO: 472889 - DNA, 657 bp, Homo sapiens
agcaggcccaggaagagagtcaggaaagaagagaaaacaagatttctaatggcagggccaaaccagctgtgtcatgggagtttggtgtttttttctatttcttttgagtcaacagttttgagtggaaaatgcactagagcagtaaaggaggaaggaaacaccagagaacctcagtggaacacaggcctggggaagaggcccatgaaggccctggaaaagggactggaactatttggacaaggagttctgtatacctggagagaggtctccaaatattggaaatctgaaaccaagggatcagcaggcacatgcactgctgtaggaagaagaatattttctctgaaggctgtaggaaagaattttttcttgcctttctctatcttcccgtggctcttggcaatccttggtgatcccttggcttatgcatgcaccactccaatctctacctccatcttcatattattctcttctctggctctgtgataattatgtatttattcatgaaatatatatctttttgggctatgtaccttacaaaatgttctttcaggacctttagggtcagatgtttctattgtataatctaaacactgcttaacaaaatgcaccaattctgcttgactttggagaactaacctgcagatctgtacccttgaa

SEQ ID NO: 472890 - DNA, 1574 bp, Homo sapiens
ggagaggagtgcagcagggccatggtggatggaacagctctggtctacagctcccagcatgagcaacgcataagatgggtgatttctgcatttccatctgaggtaccgggttcatctcactagggagtgccagatagtgggtgcaggacagtgggtgcagcgcactgggtgcgagccaaagcagggagaggcattgcctcactcgggaagcacaaggggtcagggagttccctttcctagtcaaagaaaggggtgacagacggcacctggaaatttgggtcactcccaccctaatactgagcttttccaacaggcttgaaaaacggcacaccaggagattatatcccgcacatggattggagggtcctacgcccacggagtctcgctgttagctagcacagcagtctgagatcaaactgcaaggcggcagcgaggctgggggaggagcgcctgccattgcccaggcttgattaggtaaacaaagcagccaggaagttcaaactgggtggagcccaccacagctcaaggaggcctgcctgcctctgtaggctccacttctggggtcagggcacagacaaacaaaagcagtaacctctgcagacttaaatgtccctgtctgacagctttgaagagagtagtggttctcccagcactcagctggagatctgagaacaggcagactgcctcctcaagtgggtccctgacccccgagcagcctaactgagaggcacaccccagtaggggcagactgacacttcacatggcagggtactcctctgagacaaaacttccagaggaacgatcaggcagcagcatttgtggatcaccaatatccgctgttctacagccaccaatgttctgcagccaccgctgctgatacccaggcaaacagggtctggagtggacctctagcaaactccaacagacctgcagctgagggtcctgtctgttaggaaaactaacaaacagaaaggacatccacaccaaaaacccatctgtacattaccatcatcaaagaccaaaagtagataaaaccacaaagatggggaaaaaacagagcagaaaaactggaaactctaaaaagcagagcgcctctcctcctccaaaggagtgcagctcctcaccagcaacggaacaaagctggatggagaatgactttgacgagttgagagaagaaggcttcagacgatcaaattactccgagctacaggaggaaattcaaaccaatggcaaagaagttaaaaactttgaaaaaaaattagacgaatggatacctagaataacaaatccagagaagtccttaaaggagctgatggagctgaaagccgaggctcgagaactacgtgaagaatgcagaagcctcaggagccgatgccatcaactggaagaaagggtatcagtgatggaagacgaaatgaatgaaatgaagaaatacagagaatgccacaaagatactcctcgagaagagcaactccaagacacataattgtcagattcaccaaagttgaaatgaaggaaaaaatgttaagggcaaccagagagaaaagtctgattacccacaaagggaagcccat

SEQ ID NO: 472891 - DNA, 552 bp, Homo sapiens
gctgcagggtcaaccaacttgttgtcgggaccccgaagctgaatggctttcttctctgttgacccttggctcagcccagaagtacagggaaagcggaatctggttccaggaaaaccaacgctcccaactccaaagagtcagggatggatcctgctgattggtgcgttttacagagtgctgattggtgcattttacagagcactgattgatgcattttacaatccctttgctagctacagagtgctgattggtccattttacaatcctagctacagagtgctgattggtgcctcttacaatcctcttcattcttcatctccaaatgtagtacatccatccgataagcctttccttaagagtgatctacgacactccccaaataagcctacacttgcctatccagaaagcaacagcagagctatattttgtgctcttaagaatcttaaaggagttggcaactgttgaactgaaagacaacttagtgtgagaatcggaggcattagtgggaaggatggaggcaaaagccaaccaaataactaaagtttgaaaata

SEQ ID NO: 472892 - DNA, 598 bp, Homo sapiens
ctcaggtaaaggtgccaccagccatagaggtttctcttttctctctgcgcatgcgccgccccgcccacttcgccattttcctccggaagtgcggatcccagcggcggtcctgtagctgagcaggcctggggcttggttctatgtccctgtgggtaggtgcgagggcgaagaggaacctgtgggcctcgggggatcccggggggccagaccagtgttccccatttgtgggggcagacgcgtgggcgcatcgcgggcaggaggggcctgacgtgcatttgcgggccgtggaccctggcggggtctgggaggacaggcgtggggtcccagcagtgaagcgggttccagaggggcaggagtgggtaggcgaggctggtggccctgggcccggagtctgcaggccgcgctcctgtcctgccactgagggacccggttaccaaccctcatgtagctcagtttgcccatctgtcccggtgctaacacacagttctcgggagactttccccattcccagaggagtagtgcgaaatgcgtgtacctctagtcttaagctgggcgtttgtattagttgggttttctggtgtctatttagcaagtgaag

SEQ ID NO: 472893 - DNA, 671 bp, Homo sapiens
gctagcacctcaccatctcctcctgccggagcctcttctctggtccattgtcagtcatgctctcagccatgctcggtgtggaagaactgcggtgtatgtcagcattcacactgtacaacctgagttcaaggatcccagccggagaggactggtcccatccaacccagcctagcagtcggctggcctgttctacttggaagtctttgtcccagacacaggacagggaccaaggggttctggcaagcccagctttcaacagcaacatggagcagatgacagtggaggaagggcctgaggctttacctgaaaggaagcccaggaaaggtctaagtgataaaggaatctttatggatggggtccatagttgctgtggctttgacacaaattgtgcaaatatcacaatccatgagcttgaaaaccaaatggggaaaatgaaaaggactctagtgactgggtccaccaccaccatggcctatgggaagggtgctattgctggaatgtggttgtggctgcaacttaacttggatttgcagatggagacagtacaaagtggaagaaacctagatcctcgattgatctcatagaacagagcttctctgtcagccagggccaccagactgttatgtgtcttttacttactccaatgtaattttggggtctctttgttattg

SEQ ID NO: 472894 - DNA, 521 bp, Homo sapiens
gcgcacacacacgggtatatgtattccatacagacatcagaagaagacaggaagatgtgggaaactttgaaacttcctagagacttgttgaatggctttgatccgaatgttgatagtgatatggacaatgaagtccaggttgaggtggtctcagatggagatgaggaacttattgggaactggagcaaagaagaaatttctaagcagcaaagcattcaagaggtcacctggcttattctgaaagcattcaattatatgctttcacaaagagaaggtttgaaattggaacttatgtttaaaagggaaacagagcataaatgtttggagaatttgcagcctgaccatgtggtagaaaagagaaacccattttccggggaggaatttcagcttgctgcagaaatttgcataagtaacaaggagccaaatgttaatagccaagacaatggggaaaatgtctccagggcatgtcagagaccttcacgacagacaagcccttccatcactggcccagaggcctaaga

SEQ ID NO: 472895 - DNA, 518 bp, Homo sapiens
gctgctctgtggacctctcctgtcaaatattaatcaaggttatcattggctatttgtctctgtgacccttgggctgaacaagaagcatggcatcagcatcggcttctagtgagggactcaggccacctccactcatggtagaaagtgaaggggagcaggctgtgcagacatcacatgaagagagaagaagcacgagagggggaaaacataaagagctgtccattttgactctatgtggctcacagagtaccagattattatttctgccctgcactgtgctgcctttaagggctactccacagcactacctgcctggtgctgccttcaaatactgctctgcagcattgactgagcacctgttgtgcaggcatccacttgctcagctcaggatggggaggcagcaggcacccatgactcagcagtgcctgtggcttatggccagcatttaccctgagtggatttgggatagtttaaacatcattcttggatgaatttttttttattatactttaagtttt

SEQ ID NO: 472896 - DNA, 585 bp, Homo sapiens
aactgcaggaactgaggaggacagcggagggcagctctggcccgggcctctgaacgtctgatccattgtcctgctcctcacagtccatgccccagaggacctcacagctacagagccatagttgggaaacagatccagggcctggctctgagaccaaggctgaagacccaaaagagcaaaagggaccatttataaggcccttcgatgtactcaaaaacccaccagagaggctcctcttcaaatcccacacggatgttaggcagtgcacaggaactggtattgatcctggagatacactagtgagcaatgcagacaataatatagtgagaacttcaatatgggaggctcagagtaccatggaaacccacaaagggggaagtttagcaagtccagggcctaaaggagaaaaagaatcagcttttttggtaaaacaaagagttcagtttcaatgcatggaaactgtaagaagattctggctagaaataaagaaaaagtaatagaactgtttggaaatgaaatatattgttcatccatgcatttaacaaacatttagtcattgttaattgaatatttattatgtgtcag

SEQ ID NO: 472897 - DNA, 1027 bp, Homo sapiens
ttctcacatcatcatcaccccagaaggaaagggtccagtgttctcctgatccagacctccatggagatgctgctcacgctttgtgccccatctgcattgtaccagctcaaccacgcccatggcttccctaacacccatgtcgtgatgagtctcaaatccaaattcctacgcctgatccatggatccaggccagcatctccactttggtgtcccacagacacctcaaatacaacatgtcaaaaacggagctcattcctccccagcctgctccaaaccctcccttcctcctcttttcctttccttgttattaacacctcactcccccagactgccaagccagcaacttgggctcctgggcctgacaccaacggcttcgagagccccacgcccgacaggccttccatggctggcaggcaggcatacctcccaaagagaacagatctccagctgcatccaattgcttgcagcttccccaacaagctgcattcttctgccttttcacatgtaaattgcctcttaaatgtctgtgcctaaacctcatcgccgcttggcacctggtgaattcctgctccttcttagaaattcggcataagcattgctccctccaaaagccttctctgacgcctgtaggcctcaccacattcatatccatgttacggaacttagcacactgcaacactacccttgaatatctttctccaaaggggaagggctacagttctatttatctttagattcccagtgcctgacacatactaggtttttgaaagcttgatgaataaataaatgaagaaacaaataaaggaactcatgaagggcaaacacaaggggacagctgtggagaatgatttgatgtataatacccatattaattgggttttattaactacagaaatgattctaacttttgtaactccagaacctctttagttatcacatttcttggttatacatgtaggttggaacatgcatgtgaaatttttattccgtaaaccatacttgattagacaaataatgtaactatatt

SEQ ID NO: 472898 - DNA, 1840 bp, Homo sapiens
tatcacctccttcgatggttactcatctgttttgaccacaccgacgtgggccagagtttgccttcagtcacacccatgaaagtctgggttttgttgtgttacttccgcagaaagcctacagaagtggatgaaaatagaaaggagctgaaacaaggtccctggcactcagtgaggggttgccatagggagaattggagggttctgggcatgctaagcaccgggcttggaaaacacagaggagagccagcacccattggctgtgggcctggaaccaaggctaggaaaaaagtcaaaccaattgttccaaagctggtaatagaggagtttctcagcacatccctcctgctctccccgcaccccaccccgggctcccacagcccccggggaatcatcagcccagggcgtccacatggaagaaccgggtcagaggccactaatagactaagaggcattgctgatggcagaagtttcatccccagatggaggcgatctgctccaccgtcgacagagaaggatgaaaatgaccaatggttccaacaaaagcttgactgttttagtaatgatagtgggcaagtctggcaacaggtaaaaaacaatgaccacggcatggtgggatacggaggtttaaaagaggccatctcttcatctcttggttctgccttctgcattggccttgctcctgggcaggcttctccctatagcactaagatggccccaggctctccagactaacgggtgcttgtgatttccaagtaaaagtcagggttttagtgttattgagggaggagtttgtgcttaaataagattactcaggttctaatccaggtttgccaaaattaaaatttgattttattaagtaaaaatttggctttattaaaatgtataactttaataaattataaatttagaaacccagttcttccttaagctttgaaaattaaattatgaatcttgtcatctatttataactctagcaagtttcaaaaatcacttttaagggtgctttttataacctaataaaattcccttaaacatttaaactgtgtttataaatgtaatgtattttattttctttgaaatactttaaatgcctgattaacgcacaaatcttctcaaatcttagtctgataaatcagatgcattaaaactgtacatatggagaatcttaacttctcttcaatgtttttatgccttttatgaccttagtcaatttctcttattcctttcattttaaagattcaagcctaaattaattactcaaatgcccttttacattggaatgactagactaatctgttaagtaagcaaattctcttaagcattaacagtgtttatactactcaatgtgcacagattgtttttacttctatacttaatgaggctgcatacaaccagcagtcttgattaaatcagagttcctcaatcttggcagaactgacatattgggccaaataattctttgttgcagggtactgtcctggcatcatagggtgtttagcagtgtctttcatttctaccccagatgccagtggcaacctcttccccacccctgtgacaaccaaaaatatctccagacactgcccaatggcccctggggtggggtctgggcaaaatcacccatgttgagaaccaattgaccaggccttctatggatccattttctttgtgtttgtgtttgtctaaatgcctgggttggagcctcatttatttattaccattcttacctgtcccctgtggtgtcaagagagatgcagggggcttctgcatcccctgacccataaagatctttctgtatcatacaagaggtcactgacttgtcccacgaatgtttccgcacttc

SEQ ID NO: 472899 - DNA, 864 bp, Homo sapiens
cgatagtgagggagtgcttgtgagatctgattgtttaaaagtatgtggtacctcccctgtcactctctcttgctcttgctcctgctcctggcaaagaaaatgggacttgctgacaacctgtgggttgtgtttggtggttcttgcgcaggatcccttgaagtgtggttgagaataaaatactccaagttgtttgctgcagtcgtggacagcagtgcatcactcttagcaaaagttgatttttatgtgaatgcccagaaattgtggcaggcttctgacatcatggtggagatgctgaaaagctcagcaaaccatgatgagctgacgaaagatttcaagggtgctgtaggcagaacccgagagggtgttcagccagagtgtgagggctacaactgctgccagtttgcagaaggagtaggcttaagtgcaagatgtcttagagagggtgaagttaaagctgtgctgaacatgtgcaagaaggtcggagaagatctggaaatgaaacaggaagacagtatgaagaaagggtggatggaagagaggatgtacaagtggagaagatgtctgagtaaggagtctgggagggcttacccgactttccttccaagataaaatctcctctcagataagtcaggatccttaattccattttcagccttaattgtcttttgccatgtaacctgatatattcacaggttgcaggaatctttgaagggaccattattctgccacaggttcctcgttagattccaaagaatctggaggttttattcctcaatgtttctcctaccgagcctttgagcataagaggtgcttaagcaagatttgttgaatgagcacatttattctaaatggtattttagggaa

SEQ ID NO: 472900 - DNA, 779 bp, Homo sapiens
agagtgaggggatagccctccagcagctggtagcagcgcccagcaggacacgggctcggaagtatgcaactttcacagttcctgagctgctgtgcaaatgaggcgacacaaatgagcagctttcctgagtttgaggggccagctcagaatgactcctagccttctgctatccctaattgtctacctgccttctgcttacttccagaacacagaattaaagggcacagccaaccagcagggtaacctgaaggcttttcttttcatgactttcatgtgcatccgtgtgaagagaccaccaaacaggctttgtgtgagcaataaagctgtttgtttcacgtgggtgcagggggcttccgaggtgatcgggcagcgtcagtcttcagctgctaagccaagaagatcttggaaggagtcagagagccttgggccagagttccaggggctctgggagtggctgccaggtgagttggacagtccgatttccagtggggatggaaaaattgaaagtgccattttctggctatttggaactactgtagagtttgtattggggtcaagcggcattgcagaagaaaataagatgcttagattttggtcaggtgagagttgaagaggttttaagttcttaagaacacaggctaagggagaagaaggaggaatggagggtggaaggttgcccatagtgaaggaggcaagcccagagaaaagagagggtagagacacagagggaaggggtttgggggtttttaccctccagaaaagtgggaaaggggtcgggg

SEQ ID NO: 472901 - DNA, 638 bp, Homo sapiens
tgaatatctgcacgctattttgtctttccaagtgggagaggcacgctaacatgtctgcatgcctaacttttcctggtcatgtgacaagaaccaggtttttttctacaacagtgatacccatcatatccacaggttttacccacactgaaggggagatgaagagggttggaaataaatcagacaaaaattcaggtccttctaccttggcaaaatgtctaagggtccagtggtatattgcatgtcaagatatcttaacaaaggtgaaggccactcctgctattggtcaatgggctcatgaacaaagtggacatggacgtagggatggagaatatgcatggctccagtatgtggattttcactctccaaggccaacctggctatggccacttctgagtgcccaactgctagctgcagaggccaacactgagccctcaataaggcaccattcctcacggtggtcagccaatcccctggtggcaagttgattatattgggccacttccatcatgggaaggatagtttcattcttactggaacagacatttagtctgatatggatttgcctttcctgcatgcagtacttctgccaaaccactgtctgtggacttacagaatgccttgtccactgtcatggtatt

SEQ ID NO: 472902 - DNA, 582 bp, Homo sapiens
gcgggaccccactgaaaaccagactgtcttctcagcttagcagctgaagactgatgctgcccgatcgcctcagaagccctgtagaccatcacagatgccgagctttgggtaactctcacagtggaggcaaccgatcacatgccctcaccatcccattaaaacctaatcacccttaccccgctcaacgccaatatcccatcccacagtacgctttaaaaggattgaagtctgttatcactcacccgctacagcatggccttttaaagcctataaactctccttacaattcccccattttacctgtcctaaaaccagacaagccttacagactgaccctgacactcatcaggctcagcaaattacctggactgtactgctgcaaggcttcacagacagcccccattacttcaaagctgctcccacactggctttccataactcatcccaaccctttttcatcacacacagccaaagtgcagggctgtgcggttggagttcttacacaaaagccgggaccacgccctggagcctttctgtccaaacaacttgaccttactgttttagcctagccctcatgtctgc

SEQ ID NO: 472903 - DNA, 616 bp, Homo sapiens
tcccctggatggcccgtgttccatgggatgggcccagggctcagatattcttcacggacaaggaagaaatctctggattgccaacatccaattccctaactcaaaacatacattcagatctctgagcttaaatgccccttctgtcgaaagtggggagctaccattagtcttgcctgtaaaatgggaattgagaagagttcattctaattccacggttatgcaggtggaactgtctgtgtacattctggagttgtgtgaatgcattagtctatgttgtagcctcacaccaggagtttctctttctaactggtttatgtacctcatttttcacagagcagcttgttttgacccgaggcatatctatggccaaaacggaacaagcccttattggaaaaatatgtctgtataattaaattccagtattcacaatttccaaaaccactttacagagagaatatgatcagtcagtgtagcaatccccaatacaaattaaattaagcattagggtccatttgaaatggttacaagcgatacaagaaatccaaagcttttgtggtccattcaaaatatttcaaatgcttgaagaaatgacagtattgactgaggtatcaacttg

SEQ ID NO: 472904 - DNA, 546 bp, Homo sapiens
gaagatcagcctgcagtcaccccttggcatgcaggtggccgtgccagagttgacagtattgtgcttggtccagtcagggcggtgtgggctggagctgggaacaattcaaaggaggggggaaagcccacagacatgcgatgaggccaacgatgaggtctcccaaaggaaagtgattgaagacaaagacccattctgccagtgggatatgctgggaataccaactatacttgttactgagtgtgcatggctggtgttggccagccttcctgatgccagcaagaggagacagaatggaacgaacattgatttatctgtggccaccaacacttgttcccctcctcaccttttgatagtggaaacacctcttctattttatgcagcattttgttgggaaggaaatcaaggcatttatccatctatccttctgctaattgccttaaaagaaaatcctggttaatcttgaccaatcatgataatttcattctctttgccaaatgtttggcttaggggtggaaatgtgacctaattttagccaattatgtatac

SEQ ID NO: 472905 - DNA, 745 bp, Homo sapiens
ttccaccgaatgtacaggaagcatgatgctggcatctgcttggctaccgaggaggcttcgggaaacttgcaatcatggcagaaggcaaagagggagccagcgcttcacatggctggaaaggaggaagagagagatggtggaaggaggtgtcacacacttttaaacaaccagatctgatgtgccccgagctttctccgggaggtggtcaaaggcctgccctggcacccgaggaccattgtgtcatctttctctactcctaccttgttgtcttgccgcccactccaagctgcccctgtgcctgtgaccctgcgccagctctgcctgcaggggaccactgtctctgttggaaattgcccttattcctcctctgcagcttccaaagcacggtactggcccttctaattcttcacatcacagttcaaagctggtgtattataaagtctattaactattcacaagaccctctgaaggcttggaagagagaggagggccaggggagagcagagagagagaagcatccaaatccgcacccttccaaaacaggacacaagaagcatttgaaaaattacccacataggggccaggtgaagtgaaaatcaggttaatttaataaacattcacggataaacaaaatgtaaaactaagccttgtcaggatcatagtgccagtagtaaattaacttcttggcaaaataaaacacaaccttttaaagaaaaaaccataatccagatgttttataacatat

SEQ ID NO: 472906 - DNA, 559 bp, Homo sapiens
tgatttccatagtgagtcgcagatttcctgcttctgtattcagctgcatggaaaatggatggaaagcgaatggttcagggagtacatgtgcaggtttgttacatgggtaaattgtgtgtcacgggggtttgttgtacagattattttgttacccagggtgagggaaggcagggaagaatgaagcaaggatgcaatgacctggggccagttgaggtcagctggagtaatggtttaacccaaggacttgatggtgtgaagcaggcttccacgggtgagggcatgagcacactaatcaaggaccaagagtcttctcttgccaacaatctgtctgcaggtctgttggagtttgctggaggtccactccagaccctgtttgcctgggtatcaccaacagaggctgcagaacagcaaatatcgctgcctgatccttcccctggaagcttcgtcccagaggggcacccacctgtatgaggtgtctgttggaccctactgagaggtgtctcccagttaggctacacagggatcagggacccacttgaggaggcagtctgtccattct

SEQ ID NO: 472907 - DNA, 498 bp, Homo sapiens
tcaaggctgggaccaggtagagaatgctcttactattcaatttcttagtccttcaagctcccttcaaatcccactgtgcacagccctcaaacttctttctcaggaaaatctactcttccctgtgtgaaacttctcgggcctgtctctattttgtgaattctagtgaaagtttacgatggatgctagaggttgatttcctcatgcccttgtcagccccaagtcaggaagggaggaaacttacactcatggtggaaggtgaaggggaaggagacaccttcttcacaagatggtgggaaggaggagtacaagcaggggaaatgccagatgcttataaaaccatcaaatctccctcttctctcttcttccagaataagcaagacctgatcatgtcaatcccctgagtaaaaacctttgatgatgcccctttgtccacaggacctagtcagactctttactgtgacaatcaagactcctccatgtgggtccacatgcctctcc

SEQ ID NO: 472908 - DNA, 1694 bp, Homo sapiens
gggtggtcaaaggggcaggttggagtgcttttcctgtagagactggtgaggtgagagttggtccaatcccagctctcagccagatcctctcctgagtgcagaagtggatggcattgagaaagaagcagccacaacaaaacgggcaaggccccagagggaagcaccttgggtgactttaggtttaggaggcaggctctcagagctgaagcttatatggttccaaaacctccttacaaccctctaggtgaggccagagtgttgcaaatgtccagccccgtcagcacaggctgcccggctgcccggctgccagctgggtgggaggcagcactgagctgctgctgtttgtcgggattcaggaatggctgtgacagatctcttgtcccttctcctcctctgctgggattctccttttcaggaatgtcctactctaggtctggggctggctgtggtctgctcctgctgtggagcccgtcttccccctgccaggtggccctggctggggacaacacccaggagtgcactgcgggggttgtgaattgggcccacaattgtgcccataaatggtgctcctgggctgccagccagccaggcatcttagcggcagaacccacacacaggccctggctctgctagctggagtctgacttcttgccccctcctctctgctacttgtgggtttggccaaacttccctcactcatggcccatcgcagctgccccgcccaatttctccattttataactgtccagcttctgtccttgttgctaacttgcttggtctctctctacttcctggtctaaattcctgaaagaagggataagtgaaaggaaccagggctccttggagaaatggttgattccagggctgacgtgggaaagatacagatgagtctggaatatactgtgatgctggaaggtaaagatgtgcttaggaaaggtcgaggatgcactgaaaggtcagaggtgtaacctgaggggctcccaatggccagagctggaacaatttgagaacaaaataaacaacggtagtgttggattataacctatataataaaataaatgtccatgattccatgctgatataaaaatctactgaataaagaagtaactaaatgacggtgagggacagctcatggacattatcattaagtggacatcatggtaatggttgtggcagacaagacccactcaccaatggatgctaaagtgggaattcatataaagatacgtagatacagagtgggaaaaaagctgaggagaaacaggatgtttgcataatctcaaagtctctccccatgattatattaatgtcccagtggagaaacttggcagacaccactttagccaagcaaccaaggtaaacatcaccagtaagaagacatatcgacatcacaagccccttgataagatgcaccaagaaggacataacgcttctgtggaattcttgcaaaaatgcataacctcaccctagtcttgggaaagcattagacacacacacactctgaaggccagtctacaaaacaactgtcaaaggtgtcaaggtcacaaatgatgagaaaagactgagggactgtcacagatgaggagaagaaggggacacgttgaccaatcgcagtgtggactcctggaacactgaacggacattactcaataaagctgtaccgattgtaatttcctgtttctgatcattgtcac

SEQ ID NO: 472909 - DNA, 607 bp, Homo sapiens
cattttgcctacatttttcccattcaatccacacaacaatacatcatgaggtaggatctatttacgttttactcttggagaaggtgaaactcaaagagaccacattatttccccaacatggcacacctgcatgtgggagtcataggtccactcctcagcagccttgctacaggtggtcggctgcagcgaacaggaacagatgaagtctacataaatgagcatctggtcaatgtttccaatgaagacacacgtgttcatattttacccccgcaaaccaaatactttgagatcaattatgtaagaaaggaacaccacctggtccctggcttgtccctcacggtcaccgttacattttctccagatgagtggcgatactattatgactgcatccgtgttcactgtaaggtcaccagtgtgactggcgtgcaaagcttgttgcccagtgacatggcccaagatgggaaagtgttaggctgcagaggacctggacagagtcaggagacgcggtttgctgcaggcttcccactgccctgtgcctaaagcttcatctatcatgtggtgctggcagttgccgaagccttttcaaataacttcaacatactccctt

SEQ ID NO: 472910 - DNA, 1015 bp, Homo sapiens
tgtgcactggccgggcatgcacagcaggaagtggcagggacaggaccggagcccaggcaagtcttgccatttccaaggcagtgcctgaacaacatgctgctgctgaagatgctgctgatggtcatgctgtctcctgttactcattctttatacgttcaccttgtcctcccaaatagagtctcaggtcctcctcgcgggtatgagtggttccgtgggcctcctgtaaactctcatgttgcccagcacacaggcctgtggacagtaaatgttgatttgccccttttcttggatgtgtgtgaaaagacatgcatcctggtcttgagggacaagccgcagttcagaccctgtcaagttggaggaggggagagttcagatgagggctgtgggtgtgttaggaaggtgaagttgaaaacttgcaatgggaaacacaaaatacagtccaagatcatggaggcctctccaaagctccaggctaggcagaaaacgagcttctgtgagaagaccagtgcctgctttgaaaggagcctctggccagaggtgtcttctgtccctgccgcccctgtccttcccacgtgcttcatcagagtccctgcatcgactgtcatctgtgtacttggctttctctgctactttgggacccctgagggcagggcttgtggctcagtctttgctccccagagcccaagcactgccattggtggggacagagcaggcacccagtgcacaggcagcattagtggcctggagccactggagaaggtttcctccaccttttctcctgtgttctctgatgtctgtgcatccggggcttcccagctccaagaggaactcagcaggtgtgcagacgacacacacccaatgcagcaggaattctgtgctggggttctccagcagttcccctcttgcagcatttactaaagcagatacaggttgagggcccacagacccaaagatctaactttcggatgcaaggattcctgtttgagaagcaagctaaggttaagagaggacctct

SEQ ID NO: 472911 - DNA, 1100 bp, Homo sapiens
gaagcccagcatggcccagctgaccaggatgaggccagcctggcagcagctgctgggagagaatgcagttctgggctgggctcagttttcctctaactctgtgtgtccccaagcaggctgtgggggccttgatgcccacaaatctatctactccataaatggtctcatcagacaaagcccatggccagcctgggctggcagaaccattgcaggcttttcagtcagacccacggaactgatggtcaatggaggaaataagtcatgtacacagataattataatgacaatgcaaggcagaaagcactatatgccagcagaggatgacacagctcttctggaagaggtatgcagaatgatcctggaggagcagcagggagaggtgtgggccaccaacctgccagctgctggggacctccaacaaccttcagctcgtatctgggccagctggggctgcagagcctggatttccagctgacattgcaggtggtccttggcctcagctgcctgtgtgagacggcatgcaggtgactgcaaggcaagctttcattcctcttcatttttcaaagcctttaacctcccttgcagctaggatgctccactgacaccacagagtagtatgggaaacaggacaaaaaaaatgcatccttcctcagggtggcttttggttgcttggtatttgttatttccaattaggcccaagttaactggaccatggcatatgggtgttcaccatggatgtttcttgtcctttctccactgccactttctgaatccagggccttacctcctcagctctgactcctgcaaatagctttctgactgtgtaactgcccctgggatcagccctttcattgcccccatatgctgctgacaggatgtttctaaagcacaatttgatcttgtcactttccaagtcagagcattttggtaatttcccacttcctaccaagtcaggtccaaactactgtctgcttccaaaactttccatcatcctccattgtccctagccccttaaaattttagccccaactaattgaaaaatgtatccctgtttcagactgccagtgccctcatttctcccctctacttcccccaccttc

SEQ ID NO: 472912 - DNA, 782 bp, Homo sapiens
tttgtgctgcctgttccccctctccacaccaggagatagcatggatgccacatgccttgggggcttgggcttgattcagcaacctgactcccaggggtgtccatttttgaaagatcactctggctgcagagaggaaaatgaattggagagcaccagactgcaagtggaagacccagaaggaggtgattgcacaatccagcaaagagatgataaaactgtggacagaaactggcagattgacaagatatttagaagatctgctccacaggtcttgggcatgccattctcattgcagctgcaggagcacaagagggccagcttaaatataccagcatatttcaaacctctgcctgcatcatgttcaccagtgtatctttggagaagagagtcacacagccaaattcaagaagtggaaaaatatacttcacctctagtgggaggaattgcaaaatcacatgacaaagaatgtggacatagggagggtgaagaattagggccaattgccctatttatcgcatcactcttcaacacctctgcttttccacgaagaatcatttgggatcattcagggatagaaaaatggctgttgagacccaagtctcttttccactctagtttctttcatctccatgttcctcccagcaattctttttcagggctgtgactttgtgttcctttcaaggagggtcagtcaagcttctttgattgtaagccaaagcaaacaactcttgccattctatcaaaaagggaatcaaatgaaggctatcaggcagctcaaagac

SEQ ID NO: 472913 - DNA, 730 bp, Homo sapiens
gccaggttcctcgggggccaagcatccgtgtgtaccaagcaccttctgtgtgccatggagcacctgctacgttcttcccaagccccgccaaaaggtgtggagatgaaatgggacttaaccaggaggctagccacggcaagacttggtgcccagctgggtaggaaggagaggaagcacgtgaaggtgctgcgcaggtgtcttcagcaggatgagtggaggaccactcagctctacacacacctgtgttcaaatcctgcctcggcctcctaccagctgtgtaactgtgaacacacagctcctcatccatccactggtgactgcatctttattcatagctttgccttccttactgctgtactagaaaaactattcctgttcccaccgattgctcaggatcctttgccccctcgtcctcataacaactctgctcctgaaattatgccctctctcttgaattattgatttctccctctctactgggtcattcccatcagcatacaaacaggatgtattatattttgctctaaaacatcaagttctctcctgcaccccatctctctctcccccaatcttcagtcccatttctcttctcagcccgcccagcatccatgttctctggacactgtacctcctgtcctagaatgggcccgcccaccagtgacacacagcagacccacgacgaccaagaccgaaagcctgaactcaggaggaggaggtttctgggttcttc

SEQ ID NO: 472914 - DNA, 1110 bp, Homo sapiens
ttggagaacttggaaggcagtgtaagtgtgaaatgtcttacagaagagtatgacgttggaatggcccccatatgtgacccgaagaaacagaaggataaactgctgaagctctatagtgatcaacagaagtatgctgatcataaaagagcaaagatctatcacaatgaactgcaaattgaagagagctgtgaatattcaacaggctggtttcagaaatctaagaaaagacatggcattaattttaaagtttgtggtgacaaagcatctgctgatcacaaagcaggagagaaattcattgatgagtttgccaaggttaaggtcatccctgatgaaactctgatgtcagaagaaatctattatatattgctgataaaacatcaatgtgtcggcattactgccccagaaagactgactacagctgatgagacaatccctgtaggaattaaggatgccaagggcagaactgtgctggaatgtgcaaatgcagcaggcttgcataagtgtaaagttgctgtgatagaaaaatcttgtgtactcactgttttcaagggatgactttcttaccatttcattactatgttaacaaaaaggcatggatcactagggacatcttttccaattgttttcacaacattttgtaccagcggctggtgctcactacaggaaaaccagattggatgatgactgcaagattttgttataccttgacaactgttctgcttgtccgctagttgaaattctcatcaaaaataatgttcacgtaatatactttcccccaaatgtgacttcattaattcagccatgtgacgaggatatccttgggaaaataaagagtaaatataaaaacacattcttgaacagcatcccagcagcagcgaaccgaagtgtgggtgtggaaggttttcaaaagaagtttagcatgaaagacgccatatatgctgttgccaatgcttagaacacagtgactgaagacacagctgtgcctacctggcacagcctctggcctgtgactgtgttcagggatgatgacgaacaaggcagtgactttgaaggagtctgtaagtcaagtgagaatgaaatgatgtttgatctcgtatatgcagatatata

SEQ ID NO: 472915 - DNA, 681 bp, Homo sapiens
agaaagatctggttaggtggtagcagctcttccagttcagtttacctagccctagctgcatgaccaagacaggggtttcaaagcccatcccgctctcatgttgttcagctctgatctgtatgtggaatcccagacccctttcttatgcacacttggctgggggcagggtgaagatacttccagcccattattatctgcactctcagaagtgtgagcaggctaacccgggtccagagcggcggaaggaatcagcgctccagggctccgagagtcggacgattggccccggggaagccagtttgctgggaggcctggtgaccttggctgctgagtacccctccaagcacagtcagggaggctatcaggcaagtctacaatgggtcaaagaagcggatcctctgtcctcttggtctgcgacttttcccatgaaggacagacctcgtagcctacatccctccataaattcagatctaccccgtgagtaaaaaagagagagaagggctctaggggagctggggctcacaatcttctgctttcaataatgcttttcctaaacatgaagaccataatgtaacgagggcttctggctacagcaagcttgcacatccaccagtgaaccagggtaacaggacagcagcagaaggggtcctcaccctctgagcactgcaaaatgaacagctc

SEQ ID NO: 472916 - DNA, 585 bp, Homo sapiens
tatattttctgctaatgctgaggctttaggcacatgctgttccccttggctggaagcgcctcctcctcctccacatgctgggcccttattcatccttcaagaaccagacagaatttcctatcagaaaggcatccccgccatactttcgttgctacaacaaggtgcgcgttcaagaagtctgcctgttggaggggattgggggaggagtccatgttgcatatgggagtccagctggcaagatgtgggaggaaaggatgttccatggcctccacttgagggaggggcagatagagatgcaacctgagaaggtggtgggcacagaactattgataagcctgtccgattactgccaattctggctcaggccctcctcttgttaccttgttactgcagagaaagtcacccccaaacacactgcacaacaacaggctttctgtctgcaggctccgttccagtcacaaaggaaatggagttggacagacctgttctgaccccgtcatgtgttttaaaatatagtgtgctaatggaagagttcaggtacgataaagccaacagattaggagactgctgccattgaaaagacag

SEQ ID NO: 472917 - DNA, 522 bp, Homo sapiens
tggttcctttttgcatgctgtcatgtgtgtggttgaacctgcaacatactctctaatctcattttggaaaaccgagaaatgtcctggggttatatcagattttaccaaagcagatcccaaagacaggactgcaggccagaacacaggataccgggggctccaggaagcaggggtcaggctagggaaagccaccctggcccagcctctccagcagtcccttcagagagacctccccttcaagagcaggaaacccagagctgggatctggactcaacccctgaaccccagggacacccatacacaaccaggcagctcagccccatctgaaatctgcttgcttttcagtgtcatgcttcccattcatcctcataaaagactccaaacagcttccggtgactgggtccaaagcagcccaggtgttggattatgaacgggtttttgttttcttctttagctatgtctgtactttgcacattgttgttgttgctgttgttgttgttgttgttgttaataagtgagtgc

SEQ ID NO: 472918 - DNA, 1466 bp, Homo sapiens
cttctgtttacccatattgcagcatgagtgttttatactggaaaacacaggaatggctcccttgggtcagcctcatggatatccggcttcatgggataaacccaactttggggcaagctgtcagggacaccaagtcacctccaagtcccccccattgttggtgggggtaccgtatgggactggataagaacttgaccccagcgaccaagtcccctggagcagagtcagattgctatagtggccgcaaaggagtccacggcaggcgcttgctacctttctgtgcatcagggagcatgcctcccagggatctgatctttgccttggagaaagtgagtggaccagagagcgtctgccatgtaaaggaaattcaggcagaactgaagggaaccacacagacaccaatggcggttgacatgaagtccatcaagttggctactgaacaaggcaagaggccttgatgaatatatattaattttctatgcaagtgtatactcagggccttgagacagttggtccttcaagagcttcctggtaaccatgcccaaagatcacaggtgtaaagttaggttgttgatttgagagctttcttttttattgtgggcatttacagctataaatttccctctgagcactgtttttgctgcatctcatatattttggtatattgcacttccatttttattcatctttaattttcctagtatttcctgtttgactcatttgttgtttgagtatggtttaattttcatatgcttgtgaattttccagtttttcttctattattgatttctggctttattctatcatggtcagagaaaatgctttttatgattgtctttttaaattaattgagaattgttttatgatctaacatatagtttatcctggagaatgttccatgtgtactgcaaaagaatgtgttttctgctgttgttgggagagtgttctgtatatgtgttagacatagtcagtttataatgtcttaattcctccatttctttcttgatcatttgtctagatgttctgtccattattgaagtggagtactaaagtctttaaaccctattggaagaaaaagaggaattacaaaccaaaagtacaataatattagctttatttatctatgtatttatctttatcagatctttatttctttattacattgagttactttagtgtcctttcatttcaacctgtaggactacttctagcttttcttatagaacaggactgctagcaataaacacctttagtgttgtttacctgtcttaatgtctctttttaaaaaaatttctaaaattgacaaaattatacatatttttatgtacacaatgtttcaaaaagtatatacctgtgtaatacctaaataaaactaattaatatatgcattagtttacatacttacctttttttgtaatgaaacacttaaaattacttttagtgattttcaagaatacattgttatt

SEQ ID NO: 472919 - DNA, 724 bp, Homo sapiens
gcgtagggagtcatagagtctcacgggctttcgagggctaaatgtgattttctttggaaagagggtccttgccaatgaggtcatactggattgggtgggccttgaatccagtgattggtgttcttatacagagagatgtagagatacagagactcagacacattcagggaataaggccatgtgttgaagaaggcagagattggagcactgcaggtacaagccaagggacactcaggattgctggcaaccagcagaagatggaaggagcaatggaagatacttccctagagcagcagtccccaaccattttggcaccagggaccggtttccttgtgatgcaggaggaacagtgtcttgtggaactcgtgtttaagatgacaccaggatcttccacagccctggctggtcttaataaagctatagcagaaataaagacatccaagtggattctgaaaaagtcctcagaacttcctgagacactgtcaagatgctttggaaggccactggtagtcacgcagtcagactgccctatttgcaaataagtgggggtggagcctgaaccagaagactaactgttccttaatcttatagtcaagaaagagtaactagaaggaggttgctgactggttatccttcctgtgggaaggatagggttggagttcaaacaagaggaggtttctttagcaagaggtgatgtgaggaggttaaatcaaggtaggcttgc

SEQ ID NO: 472920 - DNA, 545 bp, Homo sapiens
cgctatgtgttatatgtcaggattttggactcaatcctgcaggtgatggcagccactgaagggttgtggctctgttttaaaacaaaagaaggagaaggagaagaaggagaaggaggagaaggagaaggagaaggaggaggaggaggagaaggagaagaaggagaaggagaaggagaaggagaggaagaagaggaagaagaggaagaagaggaagaagaggaagaagaggaagaagaggaagaagaagaagaagaagaagaagaagaagaagaagaagaagaagaagaagaagaagaagaagaagaggaagaagaagaagaagaagaagaagaagaagaagaagaaacaatgctgctagagcaggaagaggccgggagccgcagcctggaaaggccgacccggggcccactgggccaattagggcatgacccacaggtactcatttctcctctgggtctttcctgccacatcggccaaatccctcctcaaataggcttgcagtgcttgtgtaagcagagtatcaaagggagataatggatgtgaac

SEQ ID NO: 472921 - DNA, 512 bp, Homo sapiens
gggaggaagagaatgaggaaaagaagtggtttctggaaaggactgaaggagataaatatgagaggcatcgggaaatgtgaagtgggagcacgtggcatcacactcacctctcccatgtgctgccatacaggggcttcttcaccagcctgccctgctctgttaccaagtaccagaggccctggaagctgtcacagcacaactaggggaagtcagtttgccctggctgacactgtccacctcattcagggcccctcctggatgctggatctgcttctgttctgctctgaaatgtcagtgcacacatgcactgactctactctctgcccccaagacccttttgagggaaggggcttcaccgtttccacctctgcatcatctgcacttagcaccatgcgtggtgcagcagtctgcaccatgggttagacggactggaagcagcagggatcgggccccttgaaactcagcctggtgtccttgactcattggcaacttacaagcctgcctcatggcag

SEQ ID NO: 472922 - DNA, 498 bp, Homo sapiens
agacaagagagtgaaattgctaggtccagaggtaaaattgaaatataattcatagagcgaggacaagtcaccacactgatggcatggtctgatgcagacttagatttaggaacttcatttctagaggacaaagaaggctccagtggattctccattccccactccccaaagccctattcttgcccacctttgctcatgccctcctcctgctccttcctatttaaatctgctgtcacatcaacccctagtgtcaagtttggtcctcaccaacttcatgaagccatcagcagcaactctgaatccttaatacaagtggaagcagttactgttcacatagtcccattccttaatatcttcggctgctacgctttagatagtcgattacagggggatgagattgtgaccatgttaaatacatcaacatttgtatctcccagtggccgtagaaatagacaggcttgcaattcctttattcatcaatgattttactgtgcattt

SEQ ID NO: 472923 - DNA, 736 bp, Homo sapiens
aagctgagggagccggctccggcctcggccagcccggaaggggctcccacagtgcagcggcgggctgaagggctcctcaagtgccgccaaagtgggagcccaggcagaggaggcgcccagagcgagcgagggctgtgagggcggccagcacgctgtcacctctcactgggattacagaatgtcatacagttggtatagtacagtgttggtgtttgtcctggccatacactaccctggatgcaaagccgtcattgtgaagaacattgatgatggcacctcagatcgcctctgcagccatgctctggtggctggaattgaccactatccctgcaaagtgacagctgccataggcaagaagatagccaagaggtcaaacatcaagtcttttgtgaaagtttataactacatcaaatcatctactgcccacaagggcccgaagagaggccaaggtcaagttccaagacaggaacaagatgggcaagaacgagtggttcttccagaagctatagttttagatgctttaactttaaatatggcatctcattgcctcgtggcttctgttgtttccagtagaaatctgttgctaatcttattaaagattccttctacctgatgagtctcttctctttctgctttcaaaattctttgtctttgggttttgataatttaacatatctgtgtgttgaagagagtttatcctgctttgtgttgagttttctggtttttgttatatttt

SEQ ID NO: 472924 - DNA, 703 bp, Homo sapiens
cagcatagattcctttttgcgaagatgggcatgaccttgacctggcacttccacctccaggaatccatactacagaaaaaacttgcacatgtgcacagagatgtattcaaaaagatagttcacttccgcattattcgtaagagtaaaaaatcaagactaaaaaaggaagctgttaaatgttggaaaaccaggaagacccctattcctaaaaaggttctagatcaatcattttcaaccagggttgatcaccccccagggcacatttggcaatgtctagagacatttttggttgtcacaattgtaagaagaaagtgctactgtcatttagttggcagaagccaggggttttgcttaacatcctataatgcacaggacagccccacaacaaagaatcatctggtccagtttgtcaaccgtgccagggttgaaaatcctgttctacacataaacaaggcctctgttttaaagggaaactagaaactcataatgccaacacaggtggaagaattatggccccaagggaaggaaaaaaaaaaaaagcaggggcattggaatttcacagtctgtttttccaccccttttagcacaagagactgttattggaaaaagtgaccaagtcaaatagcatatgacaaatctcccacatgacaaagggatttcccagctacccacgcggtcgtaagagattagtcctaaggttccc

SEQ ID NO: 472925 - DNA, 555 bp, Homo sapiens
ccaggccatgactttagtgttaccaggccaatcacaatgattacaaggagcagagagcctggtccagtcaccttctttaaggtcaattgccaatcagccttgcaagggcctcaggctagagaatcagactttctggctctccccttctggggtgctgcctccctgctgggggctaaagctctgaagagcagacatctgtactggcaagcacagcctctctcaactggcttccagggaagacatcctcaaatagatacagctggtgccctgatggcaggagagcaaaaggattgtgacctaaaagccccacctaacaacctggatttatacgaaggaggaaaaaagtcctttcaggagcacacaggaaagtatatcaaagtagttatactacctgatggaatctgtgctccattctttccgatgatttgccctcaaagacatttacctaaggtggaatcccacctatgaattgagggggaagtttcctcccagaccaattacatccatgtggttgtctttatcttccttcctcaccttttttttttttttttttta

SEQ ID NO: 472926 - DNA, 1848 bp, Homo sapiens
ctctcctcctctggctttcctgcttcttctgttccctcatggctcctcctcagggctagtgtcagtgggcggctatcgccagccctcatctgagggggcaggagaaaggaatgttcctcctggtgcctggggctagctacaaccctgggacaggagctgcccaacagaagctgtggctgttaacagaggaattcagttataacccaaatcatgaccaggcagggcactttaatgaagtattggagacaactacaatatgcccttttaatgtctgtctgtggaccaagtttactgtttgcatttgtagccatgggaaagaacaggggaaacaaggtggacacaactctcaggggaaaattggcccctggttgccaaagcacaggaaacctgaagactggagaacgagcaaagagagtgaggagaagagactgtggggccatgctaaggattttggtctctccggtttgccctttcagaaaatcatccaggttgcaatggagaaaaagaaattgtagggagcaaggactgatggcaggaatactagttaggagtatctcttaattcacttgctcttggtctccttgttgcttttgtgtgtatcagtcatgtcactactttaaggtctttgcacgtgctatctctcagtctggaacactcttccccagataaacgcatggctagcatcttctcttattttaggactgtgctcaaaaatcattagagaagccactcaaaatgattagaaaagaagccactgaatataaatgacaacatatcacttctgcattcctgatcccctttctcttgatttgttgtgagccgtagcaattataaccacttgattattatatgtttaattgtttattgttggtctctccatattaactctaaaccacatgaaagcagaaactttgtttattttgttcactgtaatatccccagcatctcaaacagcacctgtcactgttaaatacgtgaatggataaagttaaatcagagtgtaacctatcacaggactacttgttattaggatttaccttaataataaaataataaaatctgcaatttactttattgcagaaataaagacatttcttctgtcaaagaacttcaggacctaaatatggtgagggtgaatgtatctgtggaattattcttcatggggtccctaaccctaccttcatattgatttatcctgaaaactgtttctttaaagattcacttataaattaaaatcaatgatagaaggatgaccatatttctttggtttggtcagggctttttcaggcgttaaaatgtgttgataattgcggctgtgtaactatctgttgacttgactagagtccttgtgacatctgtatgttttgggaaatctttttttttttttttttcacatcccttgaggaaaaacatgaagacctgagagtacagtggccacagctattctctgggaaccaacttaagggctgtcttccttttaaaaagcacaccacatatacccactcctattatgaatatgatagccatgagtgtgactgccatggagacccagctgcaccacagacctcatgtcagatgaacagacagttaaatgaatgaatttgctgaagagactgaatgtttggtttgcttacagactgtttttttaacctttgcccattcagcaactgttagtaactgttttgtctccttaccccacagtacagttggtcctccatatccatgagttctgcattggcagattcaaccgtgtattgaaaatatctgaagaaaaaggatggtttcatctgtactgaacgtgtatagactttttatcttgtcatcattccctaaacaatacagcataac

SEQ ID NO: 472927 - DNA, 703 bp, Homo sapiens
gacttggctttctgcgagtgcgcgccccttaagtcaatgtcctgcagcacaggatgggtactttctccgttctccctcgaaggtggcctggtagttccctgtccgttaaaaacttttggcccacaaaaatgcagaaaccagttcaagatttacataacagttcatggcaacagaatattgatcacgaggcagtacatgatgagttgccaaatgaactgcatagccctgttgctataggagtggagcttcctcaggtcctctctggaagtaagcagatcatgcactgcgagccagccgaaatgaacaagctgacagaggggaaggagatccaagcagacagagggaatagagggaatctaaggaatttgtctctgaatgaccaactgtactatacaggaaatattgggccatcaaaggatgtcatcactttaataagtagacacagtcaccaagaacattccagacagaaagagcagcctgaacaaagatatgaagaaggaagaagtgggatgtgtccagagatcatgaaaataatttggcccgattggactgtggggcatagaaaatggatgatgtggaaagaggctgtcatccccatcgtgtcaatgtggctgaactgcttcaagctttacatccacaaagcaaaccatccaggagagatatttttcttgtcaaccatttcagaaaaggccacatagccatc

SEQ ID NO: 472928 - DNA, 765 bp, Homo sapiens
cagggctgcaactctctctggcctctggacctttgtaaatgctctttttaagattcagactacctctctacaccacaaacttgcctatttctcaaggcttattgttaaaacattcaggttcacgttcactcagtctttcaactccacccatttttgttgatgtatctctgacccacactcctattagaggaataaggcttgtcattaataattcctcatctgctaattctttaaagaaactagaaagaggaggatgtatggaatctactcctcgtgaagatgctgtgaacattgttgaaatgacaacaaagagtttagagtattacatacacttaactgataaagcaatgacagggtttgagaggattggctgcaattttggaagaagttctaccatggataaaaaactatcaaataacatcaaatgctacagtgaaatgtttcatgaaaggaagagtcaatcgatgcagcaaacttcattaacatctgtggcaactatggaggtgcaccctcagatctcccttcaagcagaatctgctagaaatgattcagttaactgacagcttccaagtgtggggtggggggaggggggagggatagcattgggagatacacctaatgctagatgatgagttagtgggtgcagcgcaccagcatggcacatgtatacatatgtaactaacctgcacaatgtgcacatgtaccctaaaacttaaagtataaaaaaaaaattaaaaaaaaaaaagaaatataccttcttgttaa

SEQ ID NO: 472929 - DNA, 807 bp, Homo sapiens
cagcaaggtggtggcttcattagtgtttgcatagaggactctgcgggaggagcttctggaaagttctgaggtaaaatcaacaagattctggtgacagtgtagaggaaaaaggaacagagggaggacgtgtttggaaactacttcgatactcagcaagagatgatgtggacctgcactgtgggagcagcgataggagcagagaagagggccaaatttggggagagaggtgctatttcacctccatatccaatggctgtggggagacagagtggctcagcagtgaaggtgatatgtgcaggccagcaccctctgcctagagagcacgatgaaagaatcatggccctggaatcagaaaatcctcggtttaaagacctgggagggagtgacagtaagtcagcccgagtggtgaaggaaacatttggcactgtagtttttattgtgcctgtcttcagatgcattaccatcagtggaagtggcagctccactcgcttcgagcccagatctacagaatcagcgttgaatctacacccacaacaatgtggtatcagcatggaggatgctcaggattgcatccagaatgttcatggtgccgaataagagcttcttggccactctgaaccccaggcaaaaccagaggagctcatttcatgtcaggatacctaatgggtgatattaggagtaaataactcattcaataaacacatttggagccccacaatttgtaaaactttgagcaaagaattgtaggacatgcaaagggtaactgagtactggctgtagcaactgccatcgtaaaattgtaaactt

SEQ ID NO: 472930 - DNA, 731 bp, Homo sapiens
tctctccatggtgatgggtacattttccccccggtccatcatttcatcatttgctgaggtgctcagctctaggtggggagatggcagtgttgtgcagtctctgactcatcaaggctcccacactgacttccctgagaccctggaagctatcgagctggaccttgacctctcaagccagactggcagtcccccaatccaagataaacaaccctcctccccaactcgaatgatggatctggtttggtgttctgttcaagaactctctttccaagagtggctcaaaggctcctttgcagcttttaaattttacaatctcttaggagagaagacccaggccacagagttgctacctcctggtgctttggaagattctccctattcatactttctctcaaatcccacagctgctacttgctgtgagtgcagactagcacaaccaccaacacggacccacagtgtgactgtaaagccagattaaaaagcgcccatggtcattggaactcgccccagtcaaataatccacgttaccagtgccagacatcacacatccatttccatgacacattgcctttcatattatttctcacactcagaacagcatccctcctcctctgtctgtccaaatattaccagctctcacgtgccattcagattcctcatccgcactgaaattttctctccctacattaaatcaaataatttcagtccaaatctggatttgatgtaatatt

SEQ ID NO: 472931 - DNA, 867 bp, Homo sapiens
aataaggttattataataacaggtaattatgaccaaaagaaaattagagccaaaattaagtggtcattttcatatgaagcacacccctgcttgcagcatcagcagttcagctgcagaagaatctttccctctgtccatcatcatcacaggctggtgggaagtactatcaggctactgccaatgttcacttaaggccctaggtctctccagtcagtttgtggtgaatgctgccaggcctgagactcactcttcagagaagtgggctcccctctgccaacggcaggaagaagaggaagaggaaagaagaggaggagaaagaacaggaagaagaggagaaagagaagaaaaagaaggaaaagaagaaaaggaagaggaggaaggggacaggggagggggaggagggagagagggagggaagggaagagaaaaggagtagagtagagacagaatgtacttttctttatgtctggcttctttcaataagcttaaatattttgctatccatgctatggtgtatatcattattggttcatttcttttgattgctgagtagtattccactatatgaatgtaccatagtttgttattcactcacttgttgatgaacatttgggttgtaccaggtcttctttcatgtctgtcaataatattttgtagattttcagtgtaggggtctttttaattctttcataaactttattttcccacatgtctcctgtataaaatgttgaggggggtgtactagttaatttccaaagccctttccaggtctcacattccttatgtctatgattctgtgattaagttcctggaagtttaagtactgataaaagtgccattaagttctgtatactcagcactagcagc

SEQ ID NO: 472932 - DNA, 1248 bp, Homo sapiens
aaggcagaagagcaccaccttcttgagcttcttcacctcctctggcattgaagacttatgcaacttcatgtcgttgaacatgttcatgacaccatcagacagccacaccagaggccatgtttccagaagtgaaaaggagagggcatggagagccgcagaagacaagagcactgcagccgctgctgggacccgactgcactctccttcacaaagtattccccgcaagaactactcatccttcacggtctacttctatcgtagcagttcagtcttctgctgtttcttctggtaccagcctatggattgggtaaggagaaagatcagagactcctgtgctctaggtggtggtagaggcttcctgccagaaggatctgaggcagaggacgtggatggtgccatgctggcgtctctgtgcatctggcagcgcaacaaaggacttctgtctgccctgcgaggctggaagcataacacaaatgctttccagtctttctttgtgtggagagcagaccaagtgactgcaataagatcctgttacacatttgaaaaaaagacttttgcagagtggagaaaacctaaaggtggagccctgtctgctccatctgctgccctggttactctcatccagggcattcattctctttttataagtactgatatagaaagctgggaaggcagtcaaattggttcccggccactaaggccctgcatgcataagtatcacatgagggctatggacaccaagaccaatcaggccaggcttttcaggaagctctgctcagaatcaggtggagaacattcttaagcagtagtcaattattattcttgaatattaatcacaattagtgcaaaagactacctcttgccactaccagaattattttgtatatagagatcttatatgagcatgggaaaatttattttttaaatgctactctctgggaaacaaagtcattcactcaccaggtgtttattgagttaattttacgccagacactttgctaggcctagtgatacaaggtgaatgaggcatggcattgcccctaaggaaatataaaatagtatagagtttcaacttaagtgtcagatccaatctattaattggtagtggctgcctggaggattgtgttggggagaattctgaggctttgtctggacacagtgattgattagaacaatcttccttgaggatagaaaggggataatggtagatgtaccacccattttctgtacctagtcttctgagagacc

SEQ ID NO: 472933 - DNA, 679 bp, Homo sapiens
tgttgctcatctcatggacaagatttctgctatcctcagatgtgtagattagtcaaatatgggtgtgggacatggatcatcaattggtaaacaaacacatttggtaatttcagtgggtaacaattcttatgaactacaattgaagctgggggaggagatgacattcaagaagcgaactgaaggaagcaggagaacaaaccatgcagagatgcaggatgaagaggatggctccatcaacatcatcatcatcatcatcatcatcatcatcaacatgcagtgcaaagcccccaaggggctggggcctcagggaaagcacagtaagttttgggccagagtcattttgataatggagaaggcgatgatgccaagtctggggactctgcaactgaacccaggaccaggattttcaattgagaactaccctgctcaggagaattggacaatacagcttcttttaaaaatgtcccttctgttgcctagaaccaaaacgatttacttcccacttcctactatttctccagggaatctgttcacaacaaaatttcactctaaaaacaataagccttatctttcccagaaacaaatactctggagctgcctgtatggaccatctctcagaaagcaggtgcttgatcccaaggagaggcaccatgccaagtgaagtcttagccatcccatc

SEQ ID NO: 472934 - DNA, 602 bp, Homo sapiens
aggggccccttgatacaacagcgccttctctaggtgcatgctttatgtttcttctgagtcctttcttcccccaccttcatctctcctttccttctatctttgtttatttaccatcattgcaatgaatgctgagcaatgccttccaattgccaactggtgggggtacagagatgaaacggtcatggtccccactgtggagcagaaatggacaggaatccagggagaatttgtgaggctcaaggcatggcacagctgctttggaggaggatctctccccacctctgcctggaacatgaaggttggtggctttgcaaatctccagaactgccttgttgaaatagacaaaggccaccttatgaggggacacagacaagaaggaactgaggtgggagaggaagaacgggctggtggcaaacgatgggagaagctgtctggttttgtggaaatatgtgaagttccttttggcaactcctagaaaaaaatggggggactctttggggagactcatttctgtgacatgtaccatttcattacttaggtacttttaaatgtgctattcgaggttattggctgacttcatttttatgtttttttcccttccc

SEQ ID NO: 472935 - DNA, 1501 bp, Homo sapiens
tccctttgagcagtgtgagtggtcctatgaattcaaagcaggggcaatgcctcagcttaccatagctcccagggcccagccacatcacccgaagggtgctgctacctgcaggagctggtccttgggctccaacttgacagctgagcatcatatgaaaggtgacaagttgactcgagaagcttttccacatgtgacacaagtaacaggagataatgtgagcaaacgtggctacccctctaaatcctgtcatcagaaccactcaggggaacagaaggccgaaaagatgaacattaaagaaatattgaattccagttatgacaagtctatggaggaaaagcccagtgggggtgagtacatgtatcagggcaatatagaatctgctggggatggcagagaaggttgtgctgaacttatggcactgaaggtgagtcccggagcctgagtagaagtgtctggtcagggagcaggaggagggtgttccggatggaaggaacagcatgtgcacagacctggagctggagaggagcgcagcacagcagaaaaacacaaaggcggcccatgcactcgtaatacagcaagcacggaacagggtggcatgagatgggcaagccctcaaaagccatcacaaatatttcagactttatcttaatatcagggtcaagccatcaaacaaagcaaagtaacaggatcccgttagagttttatccctattacatgggaaacttattggaacaaggctccatgaaggcagaggggtcattaggaggcagaatcagcaggctttgggtattgtcttttttgaggtgaagatgaaaagggagaagtaattggaacgtgattctgaggatttgagcttagagaaagggacagatggcaacttcggatcaagagggagcacacaggagaaggagcagatgctggcagggaccaggaatgtctgcacaagaagaaatcctgcaaccttcactaccacagaactagagagcaaagatgagtttccaaagaggtgggagagggtctgggctggaaaagaggcccagagaggcagtaggtggaacgtcccctggcactccaaaattcactatttgtacctccaagggaagctgtcagggaggggacaggagcactctgagcccctgccctgaccccacagaggtgcaaacttacttcctgctggctaggtaaagtggaatcaaaggcagaaaagttccccactggctgacattttggggagctcacagaagggtgagtttcttaaatccaatctcagcaccaatgaggagctgaaacatattgtacccattagaaaagaaatgcaaatcagaaagtcaggcatttgtgtccatgacaacagggggaacgtattttggcaaatctgagttcatttatattcaaataaatatttcagtctatgactctggcacttttttgcatgagatatttcagaaccatattgaatgttgctctcatgctaaaaacttgagaattaaaatgaggtcca

SEQ ID NO: 472936 - DNA, 672 bp, Homo sapiens
ccacaggggggtctttacctccatggactgcaagagagcacacaaggagcctttccaaggcttcagctttcagtattcacctgaggctgtaaaactgatttgcaacttatacttggaggctatttcaggggtgaaaatgacagagccacaagataaaaagaacctgagaaacataatcactaatggaggagagcatcccactggtcagattagtcctccttttaggactttcagggactttaaaaaagccttatgctgcgttaatccactgagatttggggggttttatgctccagcagccagtattaatttaactaatatagaacttgttaccagaagtggggtgctgctgttacaaaaacctaaaatatgtgacattgacttggttgtcaggtggcaggcagcaaggaaactgattttggagctggacttatggaaaaccatgacaaataggggcaaaccatttggtgaaactcacctgtgacaacttggaaggcagaccaggtgcctcctgagcctgctgcattagggcatacagtttgaaagagtcaaagcaatagtatcagttggattttactttctgcttttgcaatgtgttaccagaaggaggtgagctcaagagcaacttggctggttagtcttaaaacacctcttgagtccctgaacttgcac

SEQ ID NO: 472937 - DNA, 1933 bp, Homo sapiens
cgccgcggcctgcatttccagagctgcccttcgcctggttcgtggcgccttgtgacccctgccacctgcaagtcggtaaccgcgctgtgctcctgtgctgcggcctgtggctggactgcctgggatgccctgcctgctgctgcccgactggctggcaagatgaagctctccctggtggccgcgatgctgctgctgctgctcagcgcggcgcgggccaaggaggaggacatgggcacggtggtcgccatccacctggggacaacctacccctgtgtcggcgtgttcaagaacggccgcatggagatcatcgccaacgatcagggcaaccgcatcatgccgtcctatgtggccttcactcctgaaggggaatgtctgatcggcgatgcagctaagaaccagctcacctccaaccccaagaacacggtctttgacgccaagcggctcatcggccgcaggtggcacgacccgtctgtgcagcaggacatcgagttcctgccgttcaaggtggttgaaaagaacactaaatcatacattcaaattgatgttggaggtgggcaaacaaagacatttgctcctaaagaaatttctgcaatggttctcactaaaatgaaagaaaacgctgaggcttatttgggaaaggttacccatgcagttgttactgcaccagcctatttcaatgatgcccaatgccaagcaaccaaggacgctggaactattgctgacctaaatgttatgaggatcatcaataagcctacagcagctgctattgcttatggcctggataagagggagggggagaagaacatcctggtgtttgacctgggtggtggaacctttgatgtgtctcttctcaccattgacaatggtgtcttcaaagttgtggccactaatggagatacttatctgggtggagaagactttgaccagcgtgtcatggaacacttcatcaaactgtacaaaaagaagactggcaaagatgtcaggaaagacaatagagctgtgcagaaactctggcgcaagccagagaagtgttggaaagtgttggaagactctgatttgaagaagtctgacattgatgaaactgttcttgttggtggctttactcaaattccaaagattcagcaactggttaaagagttcttcaatggcaaggaactatcccgcggcataagcccatatgaagctgtagcatatggtgctgctgtccaggctggtgtgctctctggtgatcaagatacaggtgacttggtgctgcttgatatatgtccccttacacttggtattgaaactgtgggaggtgtcatgaccaaactgattccaaggaacacagtggtgccaaccaagaagtctcagatattttctacagcttttgataatcaaccgttacaatcaaggtctatgaagattgaagtcacctttgagatggatgtgagtgatattcttcaagtgacagctaaagacaagggtacaaggtacaaaaataagatcacaattaccaacgaccagaatcacctgacacctgaagatattgaaaggatggttaatgatgctgagaagtttgctgaggaagacaaaaagctcaaggagtgcactgatactagaaatgagttggaaagctatgcctattctctaaagaatcagattggagataaagaaaagctgggaggtaaactttcctctgaagataaggagaccatggaaaaaactgtagaagaaaagactgaatggctggaaagccaccaagatgctgacactgaagacttcaaagctaagaagaaggaactggaagaaattgttcaaccaattatcagcaaactctatggaagcgcaggccctcccccaactggggaagaggatacagcagaaaaagatgagttgtagacactgatctgctagtgctgtaatattgtaaatactggactcaggaactttc

SEQ ID NO: 472938 - DNA, 717 bp, Homo sapiens
gcgatcaatgctagtcggaaaaagttcaaacaataccaccacccttccttctccaaatctctctagaggaaaccactgtttacagattgagattggggcgggcactgacagcagggagaagccaagcagtgggaacaggcacttccaagcctgtgagagcagaggggtccttcctgggctcctaagagtgcagagacgccggggtctgcagtctccatttgggcagctacagctgcgcttgggaaggatcctgcgctcctggcctggatcccccgaaggagaccccttgcggtggctgcgcttccggaagcttgcgcgcgtgtgcacactcacgtgtgccagcccggtcgggggcgcgaacactgagtcacggcggctgacccagcaaagtgctgggaaagggccagtcgaaaatgatgctttccaacttgcaaatcctgctgaagataacacatgtgggtgctgcccccagggtttggaggaggccctatcccggcctgcacagactctggcccagcacctggatctccactcccttttcctgctcttgctcccctgctacagccagggttcttgcttctggggtggtgaggaatgtggcccacgtgcaggagcaaggacttgtgggtagcagggggtggtggacaggacggatttttacgtggaagtttgtacacataagctagatttgcctctagaaacacaaagtgaccccct

SEQ ID NO: 472939 - DNA, 610 bp, Homo sapiens
tccctgcctgcctcagccccagcgacctccacccagaacccacaatggcaggtggaggcacccgcccatccccgcggcggcacctgggcctgcagctccagctctgggcgaacaagccgcctctgaagccgctggagaagtacccctttgacagcacgcaagggcctagagcagccgtctttattggcagccggagaggctgtttggggaaatggaaaaacttgtgtcggcggcgtcagtcttgtaaaggggtagccaagcagtttgcagcgtgttctgttcctcgcgctgctgccaccgcctcggctcctcagagcctgccggggaggagcgagggggaggaggcgggggagcgcctgcacagctctgcagggtgcgcgctcagactcccacacctggcgcagaggcttcagcaaactcccatgtcccccagtgctcggagagtatgagctctggaaaattttatatacatatcatttacataccatacaattcacctgttaacagtgcacaatgcaatcaatggtttttagtatacttacaaagttgtacaactattaccactacctaatttcagaacaatttcatcatctccaaacaaagctgtgta

SEQ ID NO: 472940 - DNA, 1865 bp, Homo sapiens
attattagtaccactgttttccatctaagctaatccaaaataatggtcaaaaaagtgctgtttagctggtattattttcatgttatcccttaccacagtttatctcaattctcacaggagcctcaatgcttatctcttagatccttttcttcttttaaaaaatttgggctagcctatactaataattgtactagtttaattaaaattatgattagcagtagcatgcgtatcttaatatttgagagcttacagcttgccagccgttgtgctaagagccttacttgtgccttctcctctaatccatccagtgtaatgaggttggagctattgttgtggtccattttacagatgagaaaactgaggcacagagaacctgcaggaacatattgctagttttattggcatagcttggaattgaagtcccatctgtctgatgccagagcaaagatctgccttcctgatagtaacagagcttcttagaggctgccaggaaggaaggaagaaggaacgagggaaaatgctacattgggactccgagcagcttatcccgggactttctgagagcagctgtacacacccgttgtggcagaggcagaataagctttcttctccttttgcatagagataatatttccagccactcttgcaattagggatggctatgtgagttctaccaatggaatgagcccctgaatttgtgtgcaaaattatatgtaccaactggacagagagaacctggccttttcagtctccaaaaagaagaatagatcaatatttctacagttaagagtttagttaaaaaccctgctgtgcaatgaaataatgcatctgctattggcgtagagcgactgggatgttaattccctggttttgtgtcagttaagggcaaattagccttccagcaccagtcatgactcattatgtcattatgtagaaggcacttactgtacctccactactatgcaatttagatccaataaaaattgtgacagcgtttttatccacttcattaagctactaatttcttgtaaaaaatgtacattaatctttttatagcttcatgcagagtggcatatttttagactctaacattgattaggtcctggttaagaataattttcacagtacttttaagaaatgtaaataaagttacaataatttaatttttcaacatagttatgacagtattgatcttaaaatgaacatgttggctgaattaaatgtgtagcccaaatgaaatacagactgaatatttaaacatgcaacaaattacaaagcacggcttaacaataccctgcaaacagaatgaagaaagggagcatgaaccttcatggaaaatatcaattgctcatattttaaaagaggtaaatggggatttttttgacatctgactttccctacccaaatgtttaaaaaatacagcaaaaaatagttttccccttttgatttttcattgcttgtgaagtattaatgactcttccgcctgaatgacttaggaaaaagtagaaaagaagaaagttccctctgccagctaattgtgatattagtgggtcggagtcagagaagacagtgcccagggttttcagagggcaccgtgggcggttgagggcagagtgttggcacctgtgtactcagtgacagaagctgcccccttcactctaacccttcatcaacccagagcttttggaacagggctgaggaagccatgagtcacgtcctcattggccgtaaagcattctctcagggtgggcctgctgctctgaattcgcaggcaggcctggccccctcatgccattaggtgaagaaggaggaggctgtgggctgccccctcccaccaggctgggaagccccagagcttgggtttg

SEQ ID NO: 472941 - DNA, 911 bp, Homo sapiens
tccaacaatgttagaaaattcaggctcttctgctgcaggtctgctggagtttgctggaggtccactccagatcctgtttgcctgggtatcaccaatggaggctgcagattactgcctgatctttcctctggaagtttcttcccagaggggcacctgccaggtgccagccagagctttcctgtatgaggtgtctgtcaacccctactgggaggtgtctctcagtcaggatacacaggggtcagggcagggatgtttaagtctgctgaagctgcacccacagctacttcttcccccaggtgctctgtcccagggagatgtgggttttatctataagcccctaaatggggctgctgcctttttttcagaaattccctacccagaaaggaggaaactagagagggagtctggccacagcggcgttggtctgcaggctcagaagtccaagatcaaggagctggcattggatgagggacttcttgctgcatcatcccatgacagaaggacaaagaaagggagggagagagacaaagagagaggatgccagtgatttgtagatttggcctttttacatgatcccatatttttagaaggttttgttcatttattttcattcttttttctttatttttatctgactatcttatttcagagagctagtcttcaggttctgagattcttcccttggcctggtctattcagctgttaatacttgtgaatgcattgtgatattcttgtattgtgttttttagctctgtcagatccattaggttctttcaaatacgagctattttgtccttcagctcctgtatagttttattgtgattcttagtttccttggattgggttttgccattctcttgaatcttgatgatactcatttctatccatttctgaattctatttctattatt

SEQ ID NO: 472942 - DNA, 907 bp, Homo sapiens
ttctgtggagctgagcccttaatcttttgaaatccgaaataatccaatgagcatttcctttgagcgtcatgttggtgctcaagaagttgcagatttagaagcatttcaaatttcagattttggattttctagactgtcctggttttcaggttttcttcagttagcttactttctttttctttctttctttccttctttctttctttctttttccttccttcctatcttccttccttcctccctccctcccttcttccttccttcctctctcccttccttccttcctttcttccttcctctctccctcccctcccctcctctttctttctctttccttccttccttccttccttccttccttccttccttccttccttcctttctttctttctctttctttctttctttctttctttctttctttctttctttctttctttctttctttctttcttaatggatatcagtgagtcgtatgtttggtctatatacttaatcacacattgtgtttattcttttttctttatttatgtctgattgagttaatttggtgaaccaatcttcaaactctgagattcttttctcaatttggtctatactgctgttaatacttgcagttgtattatgaaattcttgtagtgtgccttttcagctctattagatgagtttggatctttcttacaatgaccattttgttgttcagctccctttttgttttattatattccttagattccttggattgggtttcagctctctcatgaatatcgatgatcttcactgctattcatattctaaattctgtgtcatttcagccatttcagcttggttaacaataattgctgggaatctagtgcagttgtttggagaatatcattggtattttgatgaatattgcattgagcct

SEQ ID NO: 472943 - DNA, 953 bp, Homo sapiens
agccagcccagaaaggggctcccacagtgcagcagtgggctgaagggctcctcaagtgccgccaaagtgggagcccaggcagaggaggcgccaagaaccagcgagggctcatggcgttcgagctctgagaacaaacagactgtctcctcaagtgggtccctgacccccatgtaggctgactgggagacacctcccagcagcaatattggctgttctgcactatttgctgttctgcagcctctgctggtgatacccaggaaaacagggtctggagtggacctccagcaaactccaacagacctgcagctaagggacctgatcgttagaagaaaaactaacaaacagaaaggaatagcatcaacatcaacaaaaaggacatccacagcaaaaccccacctgtaggtcaccaatatcaaagaccaaaggtagataaaaccacaaagatggaaagaaaccagagcagaaaagctgaaaattccaaaaaccagagtgcctcttctcctccaaaggattgcagctccttgccagcagccgaacaaaactggatggagaatgactttgaagagttgacagaagtaggcttcagaagttcgctaataacaaatttctctgagctaaaggagcatgttctaacccatcacaaagaagttaaaaaccttgaaaaaagagaaaaaagagtaaaaagaaatgaacaaaacctccaagaaatatgggactatgtgaaaagaccaaatctatgtttgactggtgtacctgaaagtgacagggagaatggaaccaagttagaatactcttcagggtattatccaggagaacttccccaaccaagcaaggcaggccaacgttcaaattcaggaaatacagagaacaccacaaagatactccttgagaagagcaactctaagacacataattgtcagattcaccaaagttgaaacaaaggaaaaaatgtt

SEQ ID NO: 472944 - DNA, 701 bp, Homo sapiens
gctccggtacatcaaaaagccagcaagcccgacagcagcaaaaaacaagtcacctctaataactgagggactgtaaccttgatgccgggctggaacatggggatttcagtgaggcttcccatggccctgtcacctggacacagcccgcaagggcctgtccaacaattagaacaggagagtgttttcatgtcagtgagggctgagtgtccctctgtgcgcatgtgggcgtggctagatcttcgaggaggaattcaagataccagggcttctgtgtggggccgtgggtgtgctgatgcccgctccttgtgtacagtcttcaccaagttatcaacttcaagctgctgtcaaaacaaatatgatcagtgcattttgcctttgctctcaccagaaccaaataaggggctgatgtaccagttacaaaacaaggtcaatggcaagaagacgaacctcacacagctggacttgcagaatccagtgcctcacaatggcccccaagagttccagatgcatgtggctttcagtgtttataatcatagagaaagagaaaccacctctcatggcaagagtgctgggaacattatgatttggctcagtttggggaagggaccctttcctgacctaaccgccatgcccagggtgtgggctcagttccctgagtgacctagcctgggtcgtggctgcttcttcagcaggaaggtgag

SEQ ID NO: 472945 - DNA, 647 bp, Homo sapiens
tccaggaaataagcgcaacatgtggaactcaaacttgccttcatcttatttcccagtcctttgctgttttgccacttttggctacccagtttcatcaacattggaggcccacccaggggatcttggtgtcagcaagaaaagatgcaatttcaacatagacaaagagaagaaggccattaaacaaaagcaaaggttgcagctttgcagccataagccaaaggaccgctggagccacaccagaagtggaaagaggaacagtcaagacttagagttttcagtagaaggaagcaaacctaaacacgggagaagcaaacagtgggtccctatgttacatagagccaaaatcaaagtgaaacccttcacaggaaaccctcaccttttcttattggtggacctgcctccccatcctggcagggatcctcagagcgaggagcctggtcctctgctggcccaggagctggccaggttggctgtgggcagctgacatcgaggatgaccctggttgtctgtctcctgaagccacagagcatttgcttttggttttgctcagttgcctggccaatcaaatagatttctgttttaaacggcatatttttttcaaccttggcctctgaagtcttccagaatattagaaacctgttaaagca

SEQ ID NO: 472946 - DNA, 1892 bp, Homo sapiens
ggactcagtagctactctgttacttccatacttttcaggatttttagggtggggtgatgaggaataatgtctttttactatgatgtccctcagatctgggacagtccaggaatggattttcagccaattgcagcacttgcagctgcctggacagctgttgcagcaaggaaactagctgaaaacagaggtgcttctgctccaaaacagctcttagaagaactgcagcgccatcaggatgctttgtggctgaagtgggaccaatttggcattggacagtttgaggggatgccccggtaccgcctgcctctaccttgctctgcagaggcctctccaaagcgggccttccagccagatccctccggaagccaggatggtggcccccaactctgctccagctgtggagactgttgccggttggaaaaggtacacgtggcctcctgagggtactgactgtgtggctcccacagggccagccccctgtagctactcaatgtgaattctgaaggacaggacagctggaaagggccccggaaggatcccttgcccaaaattggccttttcccatctttaccccaacttagggatcatgatggcccaaatactaaaataacatttgttcttctagatttttttttctattttatcttttgggcctgtttaattctagtctttttttcctgtgaatatttatcctttccaccgttctccccttccccccaaactttacagattttagattgtatggtttacagttttgcatctcgtactttttacttaatactttttgataagcatttgtcgtagccctgacaaaatgattactctattttggacataaaagccaatttttctttatcataagtaattattctccaaacacgcttatatataaatactctgagattattagtgtgcataactttctcttttaaataaaagcagatcctttataaaataattatgagaaaattcttgaaaagaggaaaagaaggcattctggactccaggcccacgttggtgttctctgtgggtaatgccctagcatcttggtgagttccttctgggcctttttctgtttatgtttatgaataccttctggactcatgggatcatagcacacatattgttttgcaatcttcacactgtattagtgtgcatgttttcccacagatatgtctctgaccacattctttgaatacatttccagaggtagaattcttgatcaaagaagtattaaagttttaggttttaaatttaatatatgatatatattaaattaagctaatatttgtatataatacaaagtatgtatcaaagttcttttaaaaaattgttccagccccattcgttgaaaagattattctgtccgcatcaacttgcctttgcacctttgtaaaaaaatctgcttcccatatatgtgtgggcctattctggactttctgttctattcttttgatctatttgtgtacattgacagtgacagcacactttcttggttattgtagctttataacaagtcttgaagtcaggtagcttagctctctaagtattctttttctttttcagagtttgcattctaggtcctttgcattttcatatgaattttggaatcatcttggcaatctctccaaaaaccctgcttttaagattttgattgagattgtggtaaatgtagatgtatttggagagaattgacatcttaataatattgagtaatctggctcatgaacgaggtatgtccttccatttatttacatcttcttcatattctcctagcaatgttttataacttttagtgtacaagtactgtacatcttttttcagatttattctaagatattttatgtttttgatactgttgtgttattttaaaatttcaatttgctaatatt

SEQ ID NO: 472947 - DNA, 667 bp, Homo sapiens
gaaagctggtgggctgcactttagagcagcgtcccaaacatgttttcgtgggccacctccatgatgcttgccgtgactgcagaccacctgtgctcttgggccaaactactgcttttaaagcatttgtctgtggacacctacaggtcgtctcccctgccacctgtggtttgtgtgctctctctagggaaacagaggcccaacccaggggagcctgttcctacatctaacaggagcgagtcggacttgccgatgatttctggagccctgcctgcctctgagatttcaggctacctcagctattacaaagcccttgaaacaaatggtaccgatcttaatgctgatatggaaacgcatccaagaagaaaggcaagtgtcaaacaatatgtatgggagcaaggaagaccagctggccatgaccatggccaggggatgcctcaggagggcctctgtggagatttggggacagaagcactatgggtgccctatgagtgcaattcccccaaaggagatggaagcaccaggtgtggccctattgatggtgaatattgatcaagtctgggcagggctggtgaggaaccgtgagactcatcatcactccagcccagtgtcatggtctggactgctaagttgtattcatggacttgcatgacccggacagctttgggaa

SEQ ID NO: 472948 - DNA, 2065 bp, Homo sapiens
tcccagcatctgacgcttagtaggccttcagctcttgtctgttctctttcccaggacacttggctcccaggcctcctcagcagggacctgctgcctaattttttttgtatttttagtagagacgggtttcaccatgttgaccaggctggtctcgatctcctgacctcaggtgatctgcccgcctcggcctcccaaagtgctgggattacaggggtgagccaccacgcctgaccctgctgtgtgattttagctctgtcctcggcgtgctcatgaatcacactggagagccctgtgtggtccttccacggctgacgcatcatgagcctgttcaggcatttttctccgcttcactctgccatctgtgtgtgggatgacgaggaaagcccatgtgaagcgactgtctcctgcctgtttattgagggctccggagtgctcttcaaaaccatcttcctgcccttttcggcagacagcagcatctcagggatgcctttgcctcccagaggggccggaggtgggcagggaacagaaacctcaaagagtcctgcagctctctcagcgagaagccgccacagcccttctcgaggcgtgcgcccgaaatgcacttcttctagctggaggccaaagaggcgaggcaccgcgactcacacctgtaatcctagcactgtgggaggccaaggtgggcggatcacctgagatcagaagttggaaaccagcccggccaacatggtaaaaccccatctctaatagaaatacaaaaattagccagaaatcacttgaacccagaaagcagacatcgcagcgagccgagattgtgccactgcactccagcctgagcaacggagcaacactttgtctcaaaaaaataaataaataaaagtaaggatccccttgcctttgtccgccaccttgtcactcctgtgctctggggtgtcactcagacgtctgcctactgtgcccaaactgcagctctccagtcgtcacctgaacatcccttgtttttgacttctggtaaaaagaagagctgccagcaccccagtgacgttttccaaggaaacccccgtcccctcctccctgacctccacttcccgctaaaccgctttttgaatatgcgttctttgcaagtcctcgtggggttcttgcacctcacctttaccaggctccggggcgcgtgtgggaagcggcacaatggcggtgaggcagtgggctctgtgccactcctgctccgtgccggcaaggctgggccctgggcaggggctgtcaccaccccttggctcagtttcctcacctgtgaaccggtcacagtgatggcgttgacctcatgggccgtgcccaacacacccctgcagcctctccaccagcccatcaccccactgcagcctctcccccagcccagcacacccttgcagcctctcctccagcccaacatccccctgcagcctctcctccagcccagcacacccctgcagcctctcccccagcccaacacacccctgcagcctctctcccagcccctgtcctgaggaatgtcctggaacttttcatgagctaacaacccaatgaataacaagtcagcatttataaagtgaacattttcactcaaaaaaatgctgcctggttttattcaacagagcattcgtgaaatgattttttcccctggaaaaaatgacaatttatagctcaatataagtgaagcacatcagatatggaagaaataaagagccagataaaccggatgctggcccatgttttgatcgtcagctgtaaatatgaaggttgggaaacaatttgtgtgaagtgagccttttttttttttttttttttttttttttacttgctgttctgtgcagtgggtggagattttggcaggatagataatgcaatccagttcatttatgttatgcttctgattctccagaaagttatgtaaacccctgtgaaataaaacatgctagtctccagatcacggagaagaaactgattgtgactgaattgttcagcagtcaggcctggatgcgtagggagctgacagagtgggaaaaggttaaatggacctaactcaccaaac

SEQ ID NO: 472949 - DNA, 496 bp, Homo sapiens
cgacttaaattctatgagcttgcttgttcatctggaaaatgggcataataatgcacagagcaaggagagggttggggagcagcccaggggccggccaaatgggtcactgccagctattgagggttgggctgggcttatcccaaggggcacagccagtaaaagtgggccccaattgcaaagcccagatgtggagtgtgctttccttataagcctcaaggcccccattcctgtccacaattatacctcattagaaatagatgatatggccagtggctttcagagggctccaggggaggttttccctgtggtagtgagagtacacttgctcaccaaaggagagaaggcaggcgcgccccggctggccccaagagttttggattggggtttatggaccccgatccatgaggggcagaagttgaaaagatctccaggcttctccaaaatttgacgttcctagaactatttgtaacttataattctaattcacttatttctc

SEQ ID NO: 472950 - DNA, 1107 bp, Homo sapiens
gtatttggggaactttacatctcacgatgcatgacccttccttggtcacccctctcaacttctgtccaacttcccaggttgaaggcatggaaactgaagcccaaagaggggcagcatcgggcccaggtccccaccagatgtgtgaacggaatctttccacggtgcctgacagcatctctggattaggcaaggcccctgagggaacttggagctgtacttgctcagaattctgggagcagagggtgggcttatgtgagagaagaagggcccttagagccaacgccagactcacccgaatcacccatttaggagctgcagagtcactagggaatgagctgctccacgtccgtgaatgtggtagacggaacaatggccccatcaatgatgcccacgtcctactccgcagaacctgtgaacatgtcaccttacatggcaaagggactttgcagagtaagaggttatcccaggtgacccagctggcctctatgtcatcaggaggattcttactagagagaggtgagagggccagcatcagaggaaggaggtgtgacaacaggggcagaggttggagtgacgtgctttggagacagaggaaggccaaggagtacaggagatccgtagaagtaggaaaaagcaaggagacagatgctccccaacacccccagaagtagcctggccctgctcacctctggattttggccttctgaccttcagagctgtgaggtaataagtgtgtgtttttataagcattaaacttgtgattatttgttatggcagcaataggaaacgaataccatgatttttccagaatatgttatactcaagtattgtgatagtttgtatcaaaaatgactgtaacaacatttccagtcccactagcttttccagagttttgacactcctccattaatggtagggtctattctccttcctgtgaaactgtgtgggcctctgtgactgctttgaggaaagaaatagtgtgactttcaatactcaatcataaacattgacatggcctctgcccaggttttttttttttttctctgggacatgcactttgggagccctgagtcagcatgttagagatccacctgccccgaaaccccc

SEQ ID NO: 472951 - DNA, 761 bp, Homo sapiens
tctccacctcaagcccagcacttggtaggtacagggtctcagaagcccagcacctggtagattggctctgtggtgagcgcctaactgcgagaattctgtgaagctaggcatctgggaaggtgccatcataagaaacagaactggggacctaagtggggtgggacagggatgctggccccttctgaggatagaggccatgtgggctgagaggctgatgctccccatccatgggtgtgggaaggctgcccgctggcacagatcacggatgttaacatgcggccagaggaagaattccttaacgcctgatagccagaagggcccccagttccgagaaatgtgggaggtgctgcacatgcccttggtgaggactctctcgtggtctggctgccccttgccctgtgcctgcctggaccgagagctccagagggctcagaagctcttcaccctgctccacgctgatgaacagccggcaggggcctgcaaggaaaggaggggcaagctgtcaccacgaaacctttccttccacaagccgccctcattcctgctccctgccccatctccaggtgctgtcctgagtgatggggctgagcagagacggatgacgatagcagaccacagctctatttctggcaggaggagcctggcctccgtgttcagcccctctcttcacactatggggtatttaatgcctcctcgagttcacctatagactcagttaccaattcctgagcaccaggaaaggtgcccctggatgcagcatt

SEQ ID NO: 472952 - DNA, 661 bp, Homo sapiens
atggctgagtgatggcactgaggtacagaggctggggacacacctccaatgcaaatctctatctcagctgctttccagggaaccccacctgtgacataccaagcaggaaactaataaccacttcactaaaaactggcctctcgtccagtattgcccagtgcagagttccaggaaagctgagacagagaaagcactttggtccttcccggtggggaggcatcctatctccccacaaacatgaatccaaatctctctggccagccatgcccaaacccacacactttccatgcagaggaacaaaacaaagtctgagaataaacccggaccctcttcccatgcatgcagaatgccagaattgtggataatctttgttttgtaaaatcatttaatatgattttcctaaattttcaaaaaattaaattaaaaacttcagctttatttaaacaattgtaagattttgatatccattaattataattatattttctttcaattgtcacagagaattgtaaatattttaaagaagatttttattgaaaacataaattttttaaatgttttgattctatttaccattatttagggtttttgataaaaaataaattcaaattttgtacatattaaatgcaatcaacttttatttttcatcatataagctggc

SEQ ID NO: 472953 - DNA, 504 bp, Homo sapiens
cagtttctcttttgtgcagtgaatgtgtatttcacaacctcatgaggtcggaggtggggagaaaaggggagaaatctgtgaggcccaggcagaggctgcagagggtcctgcccatacgcattctcctggctgccctggagacacgggcctagtgtttcgcggagcacagggccgcccagtctccctagtggctgggtgtggccatatcactggggaaaacacaaaggcagacaactcgcagttccccacacttgagcagaaacttaggagtgatggtgagaggacaagtgccattagaaccctgttctgtggcccaaggtggcagttctgcaaacagttgatgaacatctgccctgtgcttcactcagagcccctgtgggctggatcatgaaaatatgctcctctcttttgctattgtggtgttaatagctttgttttttccttttacagacttcgtccatctgaaatgaatttggcagaatgacactctctttcttgtgaaat

SEQ ID NO: 472954 - DNA, 1102 bp, Homo sapiens
gttctgggaacaattaagaggccctttggcgcccggggccacgggctggcggcggcgaagtggcgggcgccccctcggggccgcgggccgggccggggcagggggatccggggacgcgcggcccccacctccgccggccgcgggcacaaagcggcctttgtgcgggcgccgggcagggcgtttccgcgcagacaaagcccccgcgccctgccctcccaccctgcctccaggcgcctgaagcctcgcagaggacaggccttcatgcccttccctccccagccccgcgacgtgggtgcgggcggcgcggggacagcgtgcctcgatccaggcctctcagccgacctgagccggagccacggagctggggatgcccgcgcagctctgcgccgtcaccctgtgtccaggcgcactgtagaagggggccgacaggaagaggcgctgcgccagaactcacaagggctccaactctccccagtggccactccggccctgtggtttcccatgcgggtgctactggcaggctttcaggggggctctgggcccaccagccactgctcccattacctgcctgttcactgggtcctgttggctcctcaggactcccagaccatatgtcccatcctcaggcctttaaagggcagtggctcagctgcttggtccatgaaggaataagggtctagtgctgccagattggtatacgttttcaggggaggcccgaaatccagattttgatgtgaaaactcccttgtaaaatatcagaccaaaataaaaactattttaacactggtagaaccagacaaatgacatgtagtgagagttgggttgtttgcatctcccctgccgcccccagcctgcatatctcatgttgaaaattgatccccagtgaaaggtatttgggtcacgggggcagatctcttatgaatagattaatgccctccctctcagaagattgggggatggcagccgggggagcagtgtgagttctcattctattagcttctgtgagagctggttgttcaaaagggtccagcaagcacctccctcccccatctttctagcctcctctctccccatgtgatctctgcacgcatggctccccttc

SEQ ID NO: 472955 - DNA, 818 bp, Homo sapiens
gttattaggtgatgaacacgaaaccattccaagaaatgtctcgggcccttgccaagccccgggccctgggtccctcgcggagccggtgccgcgacaaagggtttcacacagtcaggagcgttaactatgcatgctttcgcgttgcccgggctcagccaaatgccctgggtcaccatgcagccctggctctgggctccggaatggagtatagaggcagacagtgctggccatggatgccagcaacacgcactgcaaattcagcagctcaagcgggctggggtcatccccccaggaccctggcccaggtgccgaggcccagcttggaggacctcctctgtgcatggccgccaagggcagggcctctccggagtggctgattgggatgcctggcaagtcatcggccctgggcggtgggccagcccacagcccccatggaggtggcctcattaaaggcctcatggtccagtgggcagggcatcagactggacatctggaggcctggggcccggtccagcttgctgctgctttgctgggtgaccttaagcagattacttggcctctcagtgccccatctgccccctgcctcctccctgtctggcaaagcttcctggagggaatattaatgggataactcacagaagccagattctacggcccctcagttgtagccattgcagccatgccagggggtggcagggtcacgcagaaacccttcctcctgaaaccctccaagcctcacccagcatcgtttccaagggctggcctgagaggcaaagctgtgtgggggcccagagaggagtgctgcagcatctcggagc

SEQ ID NO: 472956 - DNA, 869 bp, Homo sapiens
ccctagggacgtccccgccctccctagtcagctggacacctgcagctcctccttcctgtctcagcttcatcgcggcttctccagggagctgcctgtggcccctgggtgaggtgagaactggagagcgcaggtgtggcttgggcaagcctgactgtggaggatgcagagttgccgccagacacggagcctggcatattcgtgtccgcttcttcttgtgcaggtgggcatggtggagctgcagcccccaggctccatgcagatcagcatcctctgcacccttgggcaccacgatgggcacatcaagtcatggcacgtttgccttatttgccaatctgttgactgtgcccccactggccctcaagtcctattcattgagcggcatgcaaggaggtcagacagcaccatcagctgggaaaagtatgggtttggtgttggaccaagccgggttctaagcctgactgcgctggttagcagctgtgtgaccttggaaccctccactctaaggacacgggaccacaagtgcaaagtggtcctgtatgagatcctggagcagaaaaaggatattgacaggaaaactcatctatggattgtcaacagtgtcataccataattctttgtgtgtgtgtgggggggggagggttgtcaaatgtgtgtgtgttcatctactaatacactcatataggcactcaactggcacacacatatgctcacagtcacatttttcatccatgctcacatgccattttacatctaaccatctaactccaggggtgcatagagtcccaagtccttccatgtacctgaggttaagaacccttgctgctttaaagagagggaatgatgttaatatagttaggaaccaaaatttt

SEQ ID NO: 472957 - DNA, 593 bp, Homo sapiens
cacacgcacatacatgaccgtgcacacacttccctcatctaaaagtttcctgtctcatggggttgtttgaagacggctgaaatgatacgagccattgaggagcccaaggctgccaaggtgttcatttgtgtggccactctaggacccaacctggagctgctgctccccggcatcaaaggtcttggcttgagactccttccctcagatataggtgctgatgtgtctgtcaatggctgtgccctgcaactggaggaagacagtggactacataatcacagggtcttcccaaacatgacaggaaccaagagaacacagataatgatcagggaccctaaggtaggcctcaactcactccacattagcacagcccccagatacaggagggcaggcaggctggggaactgctggccagcaagagggacctgtggcgtggagaagaaggaacttccttcagcctgcagggaggaaagacccagcctgggctgaacccttgctctgccaccatcagctgtgtgacctggggccattggcatcatctcgatgaatctcctcacctgcaaagaggataaacaatagcaactggtgggtttgtt

SEQ ID NO: 472958 - DNA, 665 bp, Homo sapiens
ccagataaagaagtaaagaagaggccaggacaatgggcaggaaccagcagacgacaccgaaaagcagaaatagcaaggtgaggaaaaagccagtgcgctgggctggtacaaaggatgaattgcacattgttgaagtagaggcaatgaattacaaaggcagtccaattaaagtaacactggcaactttgaaaatgtctgtacagccaaaggattcccttggaggctttgaaatcacaccaccagtggtcttacggttgaagtgtggttcagggccagtgcatattagtggacagcacttagtagctgtggaggaagatgcagagtcagaagatgaagaggaggaggatgtgaaactcttaagtgtatctggaaagcggtcggcccgtggaggtggtagcaagattccacagaaaaaagtaaaagttgctgctgatgaagatgaagatgatgatgatgaggattttgatgatggggaagctgaagaaaaagcgccggtgaagaaatccatacgagatactccagccaaaaatgcacaaaagtcaaatcagaatggaaaagactcaaaaccgtcaacaccaagatcaaaaggacaagactccttcaaaaaaacaggaaaaaacttctaaaacaccgaaaggacctagttccatagaagacattaaagc

SEQ ID NO: 472959 - DNA, 537 bp, Homo sapiens
tagctttaggagatatacctaatgctaaatgacgagttaatgagtgcagcacaccagcatggcacatgtgatgaccacagagaatgcaaggtgacagaaggcaagattggagactgggagagaccctctgatgaagtgctctggcccaggcttttaattccctttttctcacaaggaggcattttccccaatcaaccttttgcagatcaaatcccacattggcatctgtttcttggaggaccccaaatggcacaaccttcagaagaattcttctttattgaacaacttagcttggattctgtcatctccattgaagataaactgcttatgcaagcagtactgttcagtttaatacttaagttccccaactgtattaaattgcccccaaaatgtagtgtaaataaaaggagttttctcagttgtaactgggaaaatgagaggtcttatagacaaagtgaggtgtgattttatgtgtgtgtgtgtgtgatatatgtatgtaaaaaaggaagctgattcagaagctagggttaaaagttt

SEQ ID NO: 472960 - DNA, 567 bp, Homo sapiens
catacacacgtttcactcaactctaggaaccgtttctcatctcgaacggcactctacgggtcttgaatcttgtttgacacagtggaaggtaatgcagggtgtccttttgggaaactctctgcagctgaaaatatgccaggaaggcattgagagtggacgaagggaggacacagaagcagagctgaagagggaggaagctatgtactctgcacaggactgctgtgtactctgcacaggactgctgtgcacgagatttattcctgaccccaatgcctcttggggaaggggagactttatccacaggggtactcttggacctggacagagcagggtggttttgcccatgagaagtgaccagttcagtctgagcacccccctgtctcctggcttctccgggggtgctagcctgctgcatctgcttgcagtgcagcctcagatgcccaaccaggatgcttctcaggaactttcatcatacctgcgtgtgggtccattgctagaccaaacatgcacaggaacactggcagccctggctccacaaacaagcagcaactgctcctgttgttaaag

SEQ ID NO: 472961 - DNA, 1215 bp, Homo sapiens
ttcagcccctgcagctgccttcatgggccggcactgggtgcctgcaggttttccaggtgtagggggcaagcagtcagtggatctaccattctggagtctgaaggacagtgacccttttctcacaggtccactgggcagtgttccagtggggattctgtctgcctggaactggatgaagggtgacacaagcagccctgtggcccccaccattgggactgctctggatgaaatcccaagccagaacaggactgagtcttttccaaggcccacagtgatcactgcctgtgtaccaactatgttcattcattgcccaagggctctagaattagccagtaatgaatccaatcagacttctatccttcccttctggctggtgagttttcgtaggtcttgggctcatctggagatgccacccaaaagccagagccttgagtcaggaaccttaagaatctaccaggtggtctattctactgaagctgcgttgccacacaaactgcaataccaagttcttcccctcttccctccccttaccttaagcagaagagtttctcctcatgggcaccagtgccccatgcccacatccagtactgcctggctattgcttatgttcactgaaagcccgaggactcttcagtcaccttatggtgaatactgccaggaccaagcctcttcctacagggcagtgggcttccttctagcccagagaaggttcagacataccatctaggagccaaggcctagaatcaaggataccagtcttctttgtggtctacccctctgtggtcaagctggtacctaagctaaaagacaaagtttcctctactcttctctctcctttcctcaagcagaaggagtctctccccatagccattccagctgtgaatgtactgggtctcacctgaaaccagcacagttctgagtctcacttaaggccacatgtctccttccttaatatgttaaaaccaggtactgttacctgatttttttgttcttatgtaggtgctttttcgtgtggatagttgttcaatttggtattccttcagctggttattatgcagacttgtttgtgtgattactttatagtgtaactggtctatgttagctggttattatgcagaattgtttgtgtgattactttatagtgtaactggtctacgtacttaagtgtgtttttgtggtggccagtaaatctctcctcttcatctctccatgttt

SEQ ID NO: 472962 - DNA, 733 bp, Homo sapiens
ggaagattgcccgtagtaaaaaggatgttcagcagcacccctggcctctactcactagatgccagtgacactccacgcacagttgtgacaaccaaatatgtctccagacattgccaaatgtcccccggggtaggggtattatccacacttgaaaaccactgggctaatagaaggctgaaggaaaaatgtttctggttgcaagaggcttgcattaaggatattctgagaaagtcatccaacctggataaggacagcagtttatcattccagagcacccaagttccagaaagaaggcatgcatcactagtgcaagagcagaaagctgtgtggcagcttctgtctagttttccaaatgtgtttcagaatgacacatcactaagcaatctatttgatgttcttcgaaaggcaaacaggtaagaaaatgtaagaattaaatgtaatattagtgttcacaaagaagtgtttaaaaaaatgttacctgtgatgattactgttatctgggttatttaaacacagagcaaataatccttcagcctcttattgcagattttagcagtgaagggtctgtaacattttctatttcattaaggactgtttagtatagtatttctctcaatatactttatagtccttagtgaccaaagggaagagtctttatttaacttcagggtcaagtctgtcattgataatataaagttaattttctattagttacttattttaatggcttgac

SEQ ID NO: 472963 - DNA, 1768 bp, Homo sapiens
ccgccatcggtgacacccatgacccagataaaaccatctgtccgcagaggagctattgtacagtcttaatgttgaaagagcctgtggggcatctcactgatgagagttgtgaaagtcagaggagtgaggtgtgttctggccttgctcttgctgctgacttttcccgtgacaagaatgacggttatttgatggtaacaagaggattccaaggtttacattgcgaagtaagagcttggtacctaagacccagaataaaccttagttcccatgaggaaccttactttcccagtgaggaaataaaaatggctcggagttctcaattagtctttctggttgatatgatttggctgtgtccccacccaaatctcatgttgaattgtagctcccataatccccatgtgttgtggaaggaaaccagcaagagttactttttaatggttgactacattcataaaatttgcatgtctactatgtggcaggcaccataatcaatagtctgaatgcatctttactcagtaggtttggtcactttacataatctcatacttctcatagacttcgtcatcttaatggaagacaaactcttatattatctagtctttcagcctgcaatctctttgctgtcccaggactcttccctgtcattaactagcatctcattagacatccctgaacctgtatgtgattaatggttatgtcatcatgtatgttaccaatatacctaatcagaattacattgtcataatataaataagacaagtcatttggatttactattattcactaaatcgttcctttcaaatattggtacaatttcaagatatactttgaagcaaaacctgtttatatgtttgttgtattgaaattctatgtcaactgaaatataaaggacttcaaaacttttatgtcgtactaagttactatctaatttagctaatttgtagagtatatctcagttttggtttgtctcatgcttgctcatgattggagtgagctttgcattattattgggaaggatagtacagagacaatgtacacttctcagggtaccgtatcagaagggtgcatgatgccacctgtcactatatcttattacctgtgatgttagctttgagtccttgattaaggtggtgtctgtcagatttctcccctgtgatgttactattttggaagacataatttggggtgcaaatatcctttttctccttaaaattttacccaaaatttcagcatccattggtgaatcttgcctgaaacaattataactgtagtgttgtaatggtaattctatatttaccacctttcctctagaattactaattggattctttttctgtaaggaagtgttatctcttgtctaccatttgtatatttattcagttatttatttatgtcaagataaatactttttcttttttgtcttcctacatgatgggtagcagtgttctagcactatttgttgaaaaggtgatatttccccaatgtattgtctttgctcctttgtctgcactgtagtcttataatagtgaatttatattaccaccttccttctacagttactaattggaactcttctgtaaatacatgttaactcttgtctaccatttctctatttattcagttacttatctatatcaatatggactcattgatatttattttattctttgggttaacttcaattatgtttaactaatttatgttggttttataaatccagagttagagatagctaaactagtagaatccagtgtgaatatttaagtca

SEQ ID NO: 472964 - DNA, 583 bp, Homo sapiens
gtctacaatctcctacctaatgatatgtactttgctgtaagcattttgggaatgaaatccatgttattgaagagagtaacagagatccaaagaagtcaccttcttctagggcagaaagaatcttttctgcgctcaaagagaattcagggctccttcatcttgagtgtctggggctttaaccagtatacatcggatttggtttttattctactccagaaatcttctgtgaagccctttaattcacagaacccaaatatttcccctgagagacagtcttgtggaccattaagcagttccgtcgttgtcctaaacacaaagggaagccattcaagggctttaagaaagggagtgacatctttagacctgtgctttgaaaagatcattttggctgcaatttggagaataacttggaaaggcaagagtggatgcgtagttgtgtgtagatcatgtatcactggtgataaaaggtaaaatctataaattgtttcagaaattaaattaatggtaacagtaatgttcttccctaaatgacgattttaattaacgtctcttgtttaacctgtatttgtaatattgactgcct

SEQ ID NO: 472965 - DNA, 623 bp, Homo sapiens
tcttccccttcgctttctgccatgattgcttccaggtagcttccttgggtgccagcagtggtagtagtgggctgggcaagtgagtgtgtcctcaggcccctagatagtaggcatggtgttggtgatggcagtagcagtgttgggacagctcttagaatgccaagcggtccgtcctggttttggcagtgtctgctacagtccaggtggaccagtccacagggccctgggaggagtccccaggtatgtatatgtatgggtactggctgtggtgagtattgttgaggtgatcccctgcccccgtcagagtgctcaggtggtgaaggcagcaggtgtgctgcagccctgctgctggggaggtcagagctgctgtaggttggtggctgtaggatggtggctggggatcacaagcttcaggcccaggtggtggctgcgggttgggtttcctggcttcaaggcacgtgaaaacgtgcaacagccccacttcttgggggtaggtttgctgccagtgactcctgcttcagcccaagaagtggcagccaacagcagtgacaactgtaggcaggggatgtcaatggggtaccagggatatagagatgcagggactattgggccctagggaagga

SEQ ID NO: 472966 - DNA, 753 bp, Homo sapiens
cggcttgcctgtgctccacaatgtctgggatctcaacggaaagccatgaaggccaagagtgcccggaggcatcttcattcacaactgtagctgggatctcagctatgcttttggctgaaacacttacatgtggcctttctacttgccctggtgatagggacaggaggcagagaaattctaggcaggaaaagggcaggggtcctggtgaagccccactctcaagcctggaaactgcagcccaatatgagaacatcttgttttcccacttgaatgttgtcttttccaaaaccacccctggcccaccccacttcccatcctgtactcataaaaaccccaggctccactggcagagagtagagaaggggagaagagaagaagcagctgaagatgctgcgtgtggagctgcacggagtttccacttgtcctggttcctgcacctgctcacctgcatgctccccctcctgcaaggggttgagagttgtgggctgagtaagccaggcacccctcatgatgcctgtgttcaagatcaagtggcccaacaagcaggagtggaagcttcaggcctggacctggaaactcataaagcaccaccttaccatattctattgatcaagcagtcacagacctcaggagctctcagtgaagtgctccaatgactaagcatctcatcaattctgctgccagttccatgctggtattgtgtcttggtgtgacaattgtgtttaggcttgtgccttgataagtgttccatag

SEQ ID NO: 472967 - DNA, 703 bp, Homo sapiens
tggaccaatcaactctctgtaaaatggaccaatcggctctctgtaaaatggaccaatcagcaggatgtgggtggggccagataaaggaataaaagcaggctgcccgagccagcagcggcaacctgctcgggtccccttccatgctatgggaggagcaaacaactcccgacacgccgcattaaatgctgcaacactcaccacggaagtctgcagcttcactcctgaagccagcaagaccatgaacccaccagaaggaagaaacgctgaacacatccaaacatcagaaggaacaaactccagacacactatctttaagaactgtaacactcaccgcaagggacacaactggagaaactggttattttaccaaggctttgactggaatggcatgctttcctttaaggagtcaaacttgacttatgcaaccaataaaagccccttggaaaaactggcctcataccttgtctacacagtccctgcacagggttcatgacctgtgtattttctcttcacaggacatgagacttcacaacctgctaaaaatgagctttctaataactcagaacctacccatctaggactaaaccaacttagtcataagagagaagatgaaacctgagaccagagactcattttcttctaaaatgttttctccaaaagactttttaaaagaaaaggggggaaatgtgaaaggcaaataaat

SEQ ID NO: 472968 - DNA, 799 bp, Homo sapiens
taatgaaagccgtatgcatggatgagtttgtatagagattatagaaaaaggaggctacagaaatgcagactttataatgagtcttcagaaattttaacacgtaataaccaagcaaagggagcagaacctgaggagagtgggatcaatgacagccagtatcttgttttgacgctgattcagaaagaatgtgctcagctttttatcactgatgtgaataagcagtcaacaaacagaaaaaattcctcctttttgggagagcatattctagggaaggaaatagaagacaaaataaaaaaagtgaagcatatggtgcatgtgatagcaatgaaggaaaaggaggaaaaatatagtaggaagagtactggagagacaacagaagaatgtggagcccaacaacctagctggaggttggagcctgagttgaagaaaacacagaacatgttttctaaagaggacgcttaatatttaatttaaaatctttcatgtttgttcaatataaatatcctgcatttttcaaatgttcagaatattactgtgtacttttggaaagttagcaatatggcttttgtgcaaatataaaatgaacatgtaaaaaatgtattcaattcattaatgcaggaagttgtatgctattaagactagttcagatgagaattgaagaacaggtataaatagaaactcaagatgcttaaatttaggtaacagataaaaactgtttaatttcttatctaacagtaatattttcaaatttacttgcattgctttggatgagaatctttcgtattactatccgtcttct

SEQ ID NO: 472969 - DNA, 793 bp, Homo sapiens
agttgatgagcagtggggggctccacctgccatttacaacttccatgaagatagaaattgctcctcccccagccttgggctctccacctccagacaatgaaacgccattgcacgtatcaatcagcagtaacacctccttacatcagcccaggtcttttgggctcatcatcacacttaggctcactacaaccctccttgttaatcaaagtttcctggtgcaaaaacatcctttctgccctgactccctgatggccgatgctgccagagcagccttgagcagccgagcagctccgcagctcctctccttcctggtatggggggccaaacttgctccttgttcagcaaatgcctggttcgaaggatggaagagaggagctaccaggttgcggcaccaaagtagaatcacagaaacctcatcgttgaaagggacattgaagatcttcacatcttaccctctgccctaatccgtaattctatctacagcctcacagcaagggcttgtccacactatgtctgaatacctccagtgacaagaaatgcactatccaccaaggcagcctttgtatctctacatagccttgttcttccctttacaacctgaggtgggtctccctttagcttcttccctgtggtccttccttggaaccatatggaaaagctcgattgctcttccacctggcacatgtaaataatgctcaataactgctgtctatgagtatgatttctgagccccatgaacccaagctccctgtgtaccgcttgccccttcattttgcagctcaccctcaagcac

SEQ ID NO: 472970 - DNA, 1985 bp, Homo sapiens
tgtgggttctgcctctcccacagtcactcagctggtgagtggccaagccaggcctctggtccaagccctctgaaggcagagctgatgccttgtaacgcagctctcagctgactttggcttccagctctctctgcagccgtcgtggacacagaggatccaagtgaagtgcaaatacagcttgacttttgtagcctgctgagcggtggtagatacctaatctggggagatctctgattccttgactcagaaattagcatctcatgcaacacttcaaaagaaatttgggtcgcttttctggatgctgtgggctcctgactttttacttaaaacgggaggggagcactcagaagcccaggtacaggggagcaccttgtccgaggtaacttaatgagccggtggaggatccatgggggccgctgcagttattcagcaatgttttcaaatcgaaggtggattcaggttggagccctgaaacagctgtatggtgtggtggatcaggaagatgaggcagagtgggaggtggactgggaggagaagatggacggggaggaggttgaggaggaggaaaaggtggactcggaagaggtgagggtggactgggaggaggagaaggttgaggagctggggatggtccagttcttgtggttatttggaggtggaatcaaggcaggaagccctggaagccagggcctggggaggtgctgcccgcccctcctttacacagaaggacaccgaggtctggtgaaggccggggagttgatctgggccatcctggtccaggcctgctgcggtcccctgtcctccaggctgcctaggctgggctgtggttgggtcaggcaggaggaggtcagagacctggtcatccagagagcgctggcgaaggagccccaggacaccggggaggctttgggagctgctctccttcagttatttcagcactcctgcgaggaaagagtgaggaagccctggcatagtaagaacttgcccagctctgtggtgaggctggagtttgatcctgactctgaaagcccgtgccgcctctccccacagtgccttggtaaacggagagggactagacccagacattcctctgggtaagaagcctttcagcacctgggtcggcctggcccagcccagctgccctgctccatgttcctcccgcttccacagcgggagctgctccaggctcctctcctgccatggctccgcttgtccccatttcccagcctaggcctgagctgcagttggggatgctgagggtctccagacttggtctcctgagctgcctgtcccactcttcaggtaactgagcacagtgctagcctggttcctgagctgcagctcctgttcctgctgcgtcctgcccccactggccagcctagggcctcagccccacaatggccaagactccagcttgctccattcagacgtctggctgcttgaagccagcctctggcttggcatccttgctgagattccacaacttctgggcaaccctctcttcccccaccacctccccccacatccctatcccactgctcagagtccacttggccgaggactagaagaagccatgcccagtgaactgaatatctgttgcatcagactgctcctgaggccccgtcctggctcctgcgctgctgcatttgtagacctggggctacatcatgtcccttccttagcatctggaattgctgtgtatagaatgctcagtgctattccttactgctcctgagatgtgagagccgccctgaacatctaaccatgttgggtgattctttttttttttttttttccatctgcctctctatttctgtttgcaggagccttatttagagttaaagggcccaggcccagggggaaaagatcagtgactcaggccacagctgttccttctgccctggacaaaggcaacagagtccctgctccctgacaaccccatagcaccaaagacagtcttggttctatcacagtttagcttattc

SEQ ID NO: 472971 - DNA, 4191 bp, Homo sapiens
ggcacctggcaggcacagtcatcaccacagcaaagactcttttcttcagagacctcaatctgctggtagcaaggactggacagttgtgaccaagccccttcctcacctcccagctctcactcaggacaaattcattctggattggaactgggaggacgggagacgttcacatctgcacctgcagtgaaaacaaacacccagcaatggggcagagggaggaagggaaggctcctgcccctgatccagcagctgaaagtgagaagctgataatagcgacaatgcctgaaatgcactccacggtaatcgagctgcatctggctcgagccctctgggaaaggaggccacatccggcctgccaggctgcaccatgcagacatggggtgtggctggtcagtgtcaacagcatgttcccaaccaccccctgcagccgggggtgggagggaggtccaatctccaggccacaaggccaattttctcctgccagagtgaaggagaacatccaaggccaccttttcccagccccagtttccctgcgaggctcaactttcctggaggtgaagtcgtcaggagccaccacactaacgagtgggaccaagcacctggccaggtcccaaagaggagtgtttggcctggcatggagctacctgtggataaaggagccctgctgggctgtcatcgcaggtagtggcaaaggctctggatgaagtgtccaaactggtttaacaccttcttggtacaatactcattgtggttttgacttgcatttccccagtgattagtgatgttggcatcttttcatatacttattggccatttgtatatcttctttggagaaaactctattgaagtcctttgcctgctttttaatcaagttatttttacttttgttgtgtggttattgagttgtaggagtttttaaaaaatatattttgcttattaagcccttatcagttatatggtttgaaaatattttctctcattccataggttgccttttcactctattgattgttacctttgctgtgcagaaactttttcatttgatgttggtccacttgtctatttttgcttttgttgtctgtttttggtgtcatagccaagaaatcattgccaaatctaatgccgtgaaggttttcccttatgttttcttctaggagttttatagtttcacataacttatgtttagatctttaatctattttgagttaatttttgtgtatggtgtaagataaaggtccaatttcattcttttgcatgtggttttccagttttcccagcaccatttattgagaagactatccttgctccaatgtgtagtcttggtactttaggtaaaggtcatttgactgtctatgcataggtatattttgaggctctctcttctgttccattggtctatacatgtctgaccttatgccattaccatactgttttaattactgtagcttggaatatgttttgaagtcaagaagtgtgaggcttccagtccttggaaaaactgtcctccacaaaaccggtcccttgtgccaaaaaggttggggaccactcttttaatctatgaaagatgtctttgcatttatttgtgtcactttaatttctttcaggaatattttatacttttcactgtacaaatctttaagcttatccctaagtattttattctttttgaggcaattgtaaatgagatttttttcttattttactgttggattgtttgttgttagtgcattaaaatgcaactaatttttgtatactcattttatatcctgcaactttgctgaatttgtttattaatcctaacaggtttttttggtgcagaatctttagggttttccacatgtaagaccatgacacctgtgaacaaagataattttacttctttacaatttggatgctttttatttctttttcttgcctaatgctctggctaggatttccagtactatgttgaattgaagtggcagcagtaggcatccctgccttgttcctgatcttacaaagaggttcagtggaaaagggactgaattgacaatcagtcaatcaacaaatacaaagtgataactatgatccaaaggatcttggtttttagtctttctaacttgcttatatactcacttcattactctaggctgttttaaccccaataaaagagggagctgcattagattataagagtctgtccaaattcagtgctccttctagattttatggttccaaaaatgttatttagtacctactaggcatttaaccaagggaaggtataagaaaagaaatattaaattctcagtaaatcaacaaaatataaccaagcacttatatacaaggtgctaggcaagaagtattcttgtttcttgcccaggaggaatttacaatatgtgagaaaggtaagacatgtatatatgggaaatacaatatcagtaagagagatgacagtgccattcaagaaggcagggcatgcttcattgccaagtgaaggacacaggaacaatctttagataaaagcagttcgcaaagtaggggatatagtgagacttattctcaacaaatgggtagaaaacacattgccaagatgaatgacatcatgatgtatcaggtcaggaatccagagaagagaacaggctggaatcgttggagatcgatattggaaaggctgtgtgtatggtgaacatttgcttccattgggctccgctttctcccttattttggaaactatcctgatttctttctaggaagcactccttcctcctcatcagcccatgaactgcaggtggaagcacaacactccttccctatccccgagccataagattggtccagggatgggtctgtgacccaatcatagccaaggaacacctggtatgtctgctggggctattaggaaagaggcaagttatctttctcactgggcttgaatctgcagcccattttgcctgcaaacctcttgccaccaggtgtgtagagtctgtgagtggagccaacatggagaaagcaaaaccaagagatgaaaccagatcctagtgactttaggcaagaccctgaatcaagccattcccagattgatccaacgttctgttgcaaagtgggccttgaactagatttgggtgggtggaaatgaatagagagggcaatccatgcagattgtgccacaagaactagggcatgttgatgagggaaggatgtggtatccacagagctgtgcagaaactgcttgagagagaaggtctgagtggacagtgtgcaaaataccttgcaagataacacctatttttatttctttgagtgagtttatctatttggacaaatccagtgggactgctaaggagtggcatgtaatggaaagacaaaggaagggagacagaaaaggctctaaaaataatagaataacagcaaatacttgctgaaaactacatgctaggcactgtagtaagcactttttccattgaattctttcagcagaccatgaggtattatcacatctccattttaaaatggggaaactgaggcacaaagaagatgtccaaggtggcctatttaataagtgccagagctaatattttaacttgaacccccaggctgtctgactagagcctgcattcttaacctacctctcctggctctgcagacatggtctctgccttggggcagccaagggccagcgtggtagtagggggaaggggaaggggccagctatggccaaatggggccacaggagaacacagaagtcaaatcattttcctcagggtgacctggatttgattatttgttcattttcactcaggttttcaaaaacaaaaaaaaatcctttcaaaaaaagctgttggacaaatgctgaaactctgacttgcctgcccctgcttagcagccgtcattggaatcagcggaaggctctggctggctgcttctgatcaggcctgccagcctcctgggctggctgaggacactcacagcgggagcaggttccttaagacaagcccccttcgctggccctggcttgctccctcctctctccctgtctgtttccacctctgtgtccccttcccttggactgcctcaggaaaaggaagaacaaagttttttttaaaaaaagaagtttaatgaaaccacacacttgtatttccaactattgacattggatttgtgcttctccagctctgccatttgggacaagtctttctcctcctctcttcaccc

SEQ ID NO: 472972 - DNA, 647 bp, Homo sapiens
ctcttttcctccaggcgtccttcatggattgctcttccctaagacgttgctttctttatgatggccttgctatttatataagtggttctcttctgttgcagctaggatgccacctgttgctgtcctcagctcacatggaggacataatccctgaaggaaggtatgaaacttccctctgcttggctgttggagaatggtgtggtcaggacagctctggcaaagctgtgatgcagacattaagtcctgggtgcccctacccctaccacatgccccatcctgggttctgtacatggctgggccacaccagttccagggcctccatgcacacactgtcctggccaggaggggaagagtattccagcgaggggagggctaagccgaggctgaggcagtgtgagcacattgacaactacacttttttaaatcaggaatttaaacagtaatcacaaaaagtacaatctctggcatactgaaaatttgacagttataaaattccttcttctctatacatggatgaatattacttattgttaaaatgaggcagtgcttagcttcaattctacttctattttttctttcttatatatgtacctgctgagaaaacatgttcacaaaatatgattgaaatagaaaaagctttgttatat

SEQ ID NO: 472973 - DNA, 720 bp, Homo sapiens
atagatttcaaacgtaggcttccatgccctcagtagagtcactattgcctaacagagaggactctggtgtccagcttctggggagttcaaagggtcagaggactgagtggccagggcagactttacagagaaggtggaacttgaccctgctccacgtctctgacaggaaggcctgtcttccttcccgtctgcccccaggcatgcaaggaccaagccagggtcaaggagtggaagagcagcttatcctccagaagcctagagctatgctaagacacagtgaaccatttaagagtgacaatcaagatgctggagggaaattaaggattccactgagcatggggccagtcttcaaaaaagtggttgttagtgaaaagaaaggattctgtgaacactctttctgggcacccttcatccccataggcactcaggccacacttttgcctccttggatccctccttcctttccctattcctatggataagaatcatttccattactaccaggtctctacatattccagatttataatataaccatgaaaaaatatataatgaaagtctcagaaccttataggatcagataaccacaaatagttctctataccaggggttcccaacccctgggctgcagaccagtaccagtccgtggcctgctgggaatcaggccacacagcaggagaaggacacagtcattggatttagggaccatcatgaaaccag

SEQ ID NO: 472974 - DNA, 721 bp, Homo sapiens
aattccttttttttttttttggacctggccggacctggaaatgccggttataaacaagaataaaaacttgaatttattggtggaaaagcaaacagtctccattcagagagcaggaccacactctgggttcttgtttaaggacgacttgctgtccttgatccatttcgggactgggaaagagtaccaaatggaatctgatcagaaagttgtcaacatgttgtcagtgtttcaaccattccagacctggattctcccttcttaccccttggatgcggccttctcctggggctcttttcttccccacgtcttctggggctgccttttgctcttcaagataatgtgcatccccctcaccccgactcagcagctttctccccatggtccaagctactcctctttccttctctcttggcgatatgcaccttcctgcatcaccagcctctgtaaccaactggcttccgaataaaatcctagttgtcacctttagggttataatgcttgttttgagtatcttcccttgccaaacatatagtctgatagaagtcaactttgtaactgccccctctgagtgtcttctctttgttttacagcaggtataagcccattttgcaattgctggttcccaatgggccctgtcctgattctatttttgattcaggtacttggtaaatttggattaccaaaactatagagttgcggtgttgatgttctgtattccact

SEQ ID NO: 472975 - DNA, 1052 bp, Homo sapiens
catttcctgggttttgataactatgtttggccaaattcacattcgacacagaggtcaaactcaagaccacgagcaccatcaccttcgtccacctaacaggaacgatttcttaaacacttcaaaagtgatactcttggagctcagtaaaagtattcgtgttttctgtatcatctttggagaatccgaagatgagagttactgggctgtactgaaagagacctggaccaaacactgtgacaaagcagagctctacgatactaaaaatgataatttgttcaatatagaaagtaatgacaggtgggtacagatgaggaccgcttacaaatacgtctttgaaaagtatggtgacaactacaactggttcttccttgcacttcccactacgtttgctgtcattgaaaatttaaagtaccttttgtttacaagggatgcatcccagcccttctatctgggccacactgttatatttggagacctcgaatacgtgactgtggaaggagggattgtcttaagcagagagttgatgaaaagacttaacagacttctcgataactctgagacctgtgcagatcaaagtgtgatttggaagttatctgaagataagcagctggcaatatgcctgaaatatgcaggagttcatgcagaaaatgcagaggattatgaaggaagagatgtatttaatacaaaaccaatcgcacagcttattgaagaggcattgtctaataaccctcagcaagtagtagaaggctgctgttcagatatggctattactttcaatggactgaccccccaaaagatggaagtaatgatgtatggcctgtaccggctcagggcatttggacactatttcaatgacacactcgttttcttgcctccagttggttcagaaaatgactgaggcctggagaataatagacctgtgctgtccaagagcacttgaaatgtggctagtccaaattctgatacagtagggaatgagtagaaaatcaagaggaagattttcaaataacctgtgaaattagagaggctatatatgaaagtacatagaaaaa

SEQ ID NO: 472976 - DNA, 633 bp, Homo sapiens
tgatttactaccccttcaaagaatttgaattttcagacacttccctggaggagacatgagggctttaggtggcaacctagggaggttacagggagctgctcttggcaactataactgtaagggaaaccagtatgaggagaggtggagccaagtcactacggaggaggtggcagcattccggggggaacagggctgtgcatttcccaagcgaagggaacacattgtgcttcatgccacccatgatgcctcagcagcagaggcagagaaccaaagccaatgcctggagataagtaggagaaggcagctcagctggagagcacgtgtacagcagcagcccttcccacaaggccatgaggggatatttggaagactgagcaatttacatttgaacgactgtaatttctcagcaaaaactgagttaacaactctcaatcccgccatttttttaaagctagattaaataattataaaattaaagaaaggaatgctttaaatttttgtactttgctgaaaattctttttcccggggtctataaaagattaatttgtttttatattttactactttttgtggttttttttgtttgtttttaaatcaataagtaatctaggactagcattatgtttgctaga

SEQ ID NO: 472977 - DNA, 594 bp, Homo sapiens
aattcacaaccaataatttggtgttggggaggggccactgttgctcggagcacagtacctgagggctcatgcttctcaatggtgagcgtcaagtggatatttgttaacacatggaatttcccggagagtttgtttcagaaggaagatggaatacactttgagtggagggtgaatctgaggataagttccagctgtttctattgttcattgtttgattttttgatactagccattctattagaagaaaacataggagatatgcttcaggacatagacttttttcattcaagattaatagaagacatgggcagaggggtatgtgtgcgggggtggaggaattatgcccttttccatgggaatgagagaatgtggagaatggtgccttgtgcagaacagagctcagggaagagagaggtaattgaaacacctggtgataccaaaccgtcatctcaagattttcttattgctaagcgcatgtttaacttctttttggtaatttggctgggaatctgcctctacggcagtagtttgtccacttaagtatatctatataaaatcagcagtgccttgttgttttaataacctgtttcactc

SEQ ID NO: 472978 - DNA, 1081 bp, Homo sapiens
aagaaggacatcgtacttgtccgaacgcccagtaggagggccttttgcccaaatgaatgggaaatcattggcccaattaacatcctgtgatcttagatctaaaaatgacccggagccgggtaaacaaggtgacgtcagcggactgggcagtgaacggctctctactgccacctcgaggagagtgtcctcaatggcgcggcggctccgggcccaggggaagcggacctgggacggctggaagggaactgggggagaactggccggcgctggaaaggcgcggggaagggaagaaacccacagaggggcaagaagctcctccgtgacctcagctagaggaaaacgagggctgcgtaatccgggccattgggcgttactgcgctgtcccgtctggcttctgattcctgggagccttctttttataaaaggagtcagacaccgtgaactcttgccagaataacttctagctaaaactgggcggggacacaatcctcaaggctgggcacccttaatgaaagcagttcccagatttccagtcctggagggagaagcagtggcatggccaggctaatcgcagagggctacaagatttggggttttgcttcgggcttcgctgggactggggcgggggagggagtgcaggggtggaatagccctaatttactttcccgtcaggctaatgcgagaaggaggctgcggagctttctgcaggacacaagcagcatgctgggagatgccccagaaatgcgctgggcccggggtcggggaaggtcaactgcgcattattgcttttcccctgcagatgatacacaaaaggaaaatgagttggtttttaacttgatgaaaacaaacacaaactcattttacttttggatcagttttgctgcgttacaaaccacctcaaagtgctgagaaccaggactggaattgctggaccaaatgcaaagtctatgtttaaatttttgatgagctgttagactggtttccaaagtgatggcaccattttatatttctatcagcagtatatgaagttttcaatattttcacatcctcaccaacactttttattatttgactggttaag

SEQ ID NO: 472979 - DNA, 556 bp, Homo sapiens
gcagctgtgatattgatgccaggtcacccctctctccccacctaccctgactgcagttccctgatgcagacaacacttctctggctgtcagcttttgatgacttcctcaatttgggcttctggtggttccttcactccttgaggagcgaggaggcaagattcctcttcagagagcaaaccaatgctgtggccaagcaaccatttgctaaagagcttactgtagatagaagggagccaggtgctagttaccaaaacagtgggaaaaataccctgaaggcatctcagagagttacaaggctgccccttacagcacaggcccagagctgtaggaggtttcaggggataggcctgggacaccttccgcaagctccttcccacggctgccacaggtctctgatcccaatagccttcctcagctgccccagctacggctcaagtgggcccaggtttcctacaactatatccctgcatacttgtcgaataatagacttgtgattttactcctatgttcatctccttgatgtctgctccatgtcacttcaataatacttcctgc

SEQ ID NO: 472980 - DNA, 611 bp, Homo sapiens
cagtgccacccgaagtgagcacacacctggccatgttacaacagagcccaggctcagccacaacttctctctgcaccagagtgggcaccaggagcagggagaggccagggaagcacatggatgcctgggtccaaagccatggctggacagctgcatctgtgcctgagagcaccgagctcctgccccgccaactttgtagggaggagggctccctccggttcctggttcccactggctccatggagtacacagtcttggctgcccctcccttgctgcagctggccatcccagtggtggctgctccagatggcccctgcctccatcacagttacaaagttctctggattttaggactcaactggaagctttatgccattgcattagttaaaacacattgctttcctcctcatttaaaaaatgcagaatgcaagtttcaacgacttcctaccatattatgttttcattttgtgaaataaaaggaagaaaagttttaataagagaaacaacttttgtttcatgttttacttcacaataagctgaaatgtgtatgatgtcttttttatttcctatctagataagtagtaggaaagtccgaaacaagtactttttgc

SEQ ID NO: 472981 - DNA, 2715 bp, Homo sapiens
tttttaagtgcaatttttttttttttttttttttttttttggagacaaagacaggaaaatgtgggaaaatttggaacttcctggagacttgttgaatggctttgcccaaaatgttgatagtgatatgcacaaaaaagtccagactgaggtggtctcagatggaaatgaggaacttgctgggaactggagcaaaggtgattcttgttatgttttaataaagagactggcagcattttgcccctgccttagagattggtggaactttgaacttgagagagatcatttagggtatcaggaggaagaaatttctaagcagcaaagcattcaagagttgacttgggtgctgttaaaggcattcagttgtaaaaggcaaacagagcacaaaagtttggaaaatttgcagtctgacaatgtgatagaaaagaaagtcccatttcctggggaggaactcaagccagctgcagcaatttgcataagtaatgaggagccaaatatgaatccccaagacaccagggaaaatgtctctagggcatgtcagaggtcttcacagctgctcctcccatcaaaggccaggagtcctaggagtaaaaagtggtttcatgggccaggcccagtggccttgtgctgtgtgcagcctagggacttagtgccctgtgtcccagctgctccagccttggctgaaaggggcaaacatagagcttgggccgtggcttcagagggtgcaagcctcaagccttggcagcttccacatgatgttaaccctgagaggcagtgcagaagggaaatatggggttggagcccttctggggcaccatccattggagctatgagaagaaggccactgtcctccagaccccagaatgatagatccacggacagcttgtaccatgcacctggaaaagccacagacactcaacaccaccccatcagggcagcctggagggaggctgtgccctgcaaagccacaggggcagagctgcccaagactatgggaacccacctcttgcatcagtgtgacatggatgcttttcctgtttttgatgacattgagagttctgcggaatcctggtcagttatttcgtaggatgtccctgactggaatttttctgattttttctcatgatgagactggggttacatctttttaggagatatttttcgttttcaaataaaaactcatcaattgctccagcttcttcaccattgctataatttgttcaaaaccttcttacattacttccataactgagtctttcatatggtatcttaactgtgtaagataaaacaattattgttctttatgaaaacactaatgttaaatagtgttcactatcaccttttatgtagtgttcactaattaatgatgaaagcactattaaacttatatttaatgcaatgtcaaagtctattatctgctttgtggtattttcaccctcttggatcaaacgaacttgccattaactacaatacttagacttaaaaaaagtaaatcattcttaactgtttcaaacactatgtttactaattttcccatatgatactaatgataacaatatttttgtgattgctcattattagccaagaaccacattaagcattttatcttgctcgttttatataaaatcactacagcctaatcttatttacagaaaaggagacaaaggcacaacaaattgagtgtcttatctaaagacattgtagcattacatttgacatttttgtgtttattttgttagtttggaacaatttacctttttgagtttttattcaataattatattatagtctcttaggagacaagaaacacatatttcaaacttagatagttaagatttgtttttcagtgcacttgaaaaaaatgttaaatggaaaactttctgagaagttacacaagcaaaccttctagaaaaagggaatgcttctgcagatattcaatagtgtaatgtttcaactacaatattctttagcctaataggagactgcttgtgctcgtcatccttcttaggggagagcttcctttcccctttacagaaggataatatatggtaagtgaaatgccttctgtctctgctgctactgcctctggtgctacaaatttgacactcccctattatttgcctaaactctcatgatcaattatatctgtgtattcattttaatatcatagtgcttgatgcctgccatcttacttaacaccttttgtttagttcctgttgaattcttccaacaaccttaagattgaggttaacttttcgcagacatagaaaatgtacaaattaattaatccaagtattctccaagtctaaatggatttagagcaatataaactttattctctagttctgtgtggaaatgacacttgattgaaattgattgagattattatttagagattatagttatggttatattttctttacttcccaggtccaaaattagcaatatctcttcactttcctgtttagctcagtatcccttcactttttccacaaagtataattttttttgctagatagccgcatgtccacagatgaaactctgcagttttctctgttaatcaactacttggcttacagtttaatttgttgctctgatgcaactgtcatcttcccttaattgcctaccaccaaaatctctgagggtagagtgcccctactcctgaaattcccaacatgctgttccaattaagtcagtcattttaagatagttatagag

SEQ ID NO: 472982 - DNA, 530 bp, Homo sapiens
ggggcacacacagggagtgtgcactggggaagggaagaggttcatggagcattggtggtgcctatgtgccaattggtgtgagtcagctggtgggttgagaaggctcttgggtagcgtcctgctgagctggggaagctggacgctcactcattacacacttctttccccagtgggaggaatcacatgccaaggagttctcttttggcatagaactgtgctggcttgggagaagggtgatggtgatatagtgaaactcttcttcttaccctctttaatgcacctattcttagattttttctcaagtggtatgctgaaatatctctgctctactcccagattcccacaaatgtactcttgtccattggtggttttcaaattcaatgcactggctactatgaataatgctgctaatgaacgttcacaaataagtcttgtatggacgtatggcttcatttctccaggagctatgatcccttctgagtgtgtatgaaggcgtgtatggaatgaggggtccaaatattattatgtgc

SEQ ID NO: 472983 - DNA, 846 bp, Homo sapiens
ctacaccgagagtccaagaagcatctgaagtcaggagagcaatatgccatcttgtgaactaaaagtgccccctgaccgacaccaaaaattaaagacaaatgttctgcatatcaactgcaatgcaaatcattctgctatcctctggagatactcatccttggaactcaaattcgcacacacggagagactcccgcacagagaagaaatgagcaccctaactgacagccagcgtggaccatccatcagcaatgtgactgagggagtaacaggagagaaatttagactaatcatttctccaattgtgaacacccccccatataacattgatgccaaaaccattaatggcaacatggcaggcatggaggaggcagcgacctttgggagctacatgaatggcaacctggatccagatgaaagggaggaggaagctgcctctacaactgaggaagaagccaagaaaaacagatggaggaaaaagaagagtaaaggggctgcagcagggcagcaggaaactgataaaggattaagagcctcagtggatgaaggagcaagacaactggaaagacaagcattggaaaagaaagaaagagatgatgatgatgagacggagatgaaagaagaaggaaaagaggaaaaagaagaaggaaaagaggaggaggaggaagaagaagaagaaaaggaagaagaagaagaggaggaggaggaagaagaggaagaagaggaagaagaacaaggaggaggaggaagaggaagaggaagaagaagaagaagaggaggaagaagaaacaaccaaaattccaacagaccctccctccctcagttccaatatgtggctgtatcctagtc

SEQ ID NO: 472984 - DNA, 611 bp, Homo sapiens
caaagaatctacaaatcattaatgaagagtaaactagtcaatacaaatggcaagataattgaacagccacttatcaaaatatatggcaggccagagggtgtcaattctaaaggcaactacaatagacctgagaagttattggagaactatgtctgtggcctaacgaatacaaacacacacatcatccttgcagctatgatcactgaaaacttaaattctatccgaggacacaaaaagataaacaaattgcttcatcacaatatggcaagtgctatgctagatgcacgacctgggtctatgggagcacagagaattcacattggccctgactctggtcgggggaggattcctagaggggacagcatttcccaagacttgaaggaaaaccaggcattattgaggggagggaagcaatcgggcctgaggaatggagaaaaatgaagttgccaggtaagctgtggctgttactagaacggcacaaaattaggcacactagacatttgtgtagaaaatgaatacgagcataaagaaaaagtacgtagaatatttggtgctatcaatgattttctaaaattaattgcagcttttatgtactttcagctgataactgc

SEQ ID NO: 472985 - DNA, 650 bp, Homo sapiens
aacccccaggccacggacccgtgaggaaccaggccacacagcaggagataactttgaagatgaagaattccattcttaaatatgtagtgcttgttaaccaatctagaaaaggaaaaggaaatttcaaaattcatgcctttgtggatgttgctatatgtagtaaatggtctgtaagctcgttgcctgatgaccacacaccccataaaagtgagttatgcactggtgcccgtgaggtagcagtggaacaaagggagctgctgctggcagtcaatgaccatgttgaaagcttcacatgtgagataaatgcactcaaagattcctcacaagtagctctttggagcttcagatgtgaaatggatcattcctcaatctgtaatagacccttctgtgaagctcttcaatcaaaccagagaattcaagagtttccaacacctaagagtggtatttggcaaatggtgggccaaaggaataaagaaggcatgcaaaactcttgacagaagacattcagaaattgatttgatatcagatacaaggagaaaatatgccagtaagaaaatgcatttttcaagattaaattcggcatttgttacttaatagcatttgtcatattccaatttttcatatgtagtaaattcatttcaaatcatttc

SEQ ID NO: 472986 - DNA, 638 bp, Homo sapiens
aagaaggggtcagggggcaagtaaagcctggagagggaggagatggacttagaaaacctggaggaaaacagtggaaagagagataaaataatccaatttaagctagctacaattgattataactattatcacttcttggagacgtttgatattatgcctattacccatcagaccccaaagcatccaagttattctgaactgacagagggtcctgtggagtcagcacttcattctcttggccctggctctgtccattctctacatcttcccctttcccatagcccagtcctcaggttctgtggattgaaagcggagtctgctgtattcaatactctagtgagacacaattgcttgttaacaccaaatcccactgtagtgcaatggtttgcagctttagtgttcccagacactttggattctagaatatttggtggctcactcagagagattcctttgcatctataaatataacctttaataacctgtcagtgttacatcactggttgcatagagttgtttgttgtcttttcaggattcttgaaaatatttccaaggcaaggtccttgagtgtttcagaaaatatctcaagtttctgggcatataaaaataaaatgtaaaatgtgataggtgcatgtgtt

SEQ ID NO: 472987 - DNA, 841 bp, Homo sapiens
ctgagagttacaccattggcttccctagttcttaggcttttggacttggaccaagccatgctactggctttcctggttctccatcttgcaatggcctactgtgggatttctcaacctccttatgagacgcatggatggatggatggatggatgaacggatggatggatggacggatgggtggacaaatgaataataaaagggaaatccctaaagtacatcaatttaaaagcaactatgtttcaggacttcacctgggaaagccacctagtggaaagccacctagtggaaagccaaacgaccctcattctctcgtgcccatcttcatactgctttccaagatagcagcaatgaaggattctgcagctcttaaaggaaaatgtgaatgcaatggtgtgtcacaactgcgattagagaagtccaagggaaaagagtacaacatgctgatcaaccttggcagtccccacatacagcatgattatattgtaatactgtttgatgcaatccagcagcgaatctgtacaggtctgcggcagtctgagttattgcctcttcctcagaagaagtttgaccgaggggcataaggcagagtgagagaccaaggcaagttttagggcaggagtgcaactttattctgtctttcaaactcaactatgtattccatttctttttgtcatatttcatccagcatttccatgagttagaggagaaagttgtttgtgttagtttggcttgctgtgttgctagaaacaaaaagctcattattattattgttatgtattaatttgaccaaagcactatttattaaaagactgctgcaattcttactattcttgtcatttt

SEQ ID NO: 472988 - DNA, 575 bp, Homo sapiens
tggatttctgcaactcagagcatgttccatgctggaacctgagactttggtatgtaggtacattgcgagttttgtaccttcagccccagccaatgtagaggccagggagaagctactgacggagctgcttcaagaaagatcccaagtctacgcaaatccattgaactcatccaacttcttttactgtagaaggactgatgtaacatgggagaagaatgatgttaccaggagcaagaatgagggctccggttggggaagctccaggcagctggtgcgcagggctctctggaaggcacatgacccagaaagtgctgtgcttcatcagctccgtgagtcatgtggggcagcggttcaagaagtggtggctgtgacgagagacttcatgcaagaaggcctttccaaagtgtcatccagcaaagaaaacatggctttccctgaagccccaccctgtggtttcctacatcatcagatctacgtggccctgattgctggctgcagtgaagctggggaagggagtgttctcactgggctgctctgaacaaacacagagctctgttagcaaagaaggagaaatc

SEQ ID NO: 472989 - DNA, 473 bp, Homo sapiens
gtcttttcttttcttctttgagaggagagaagaagggatgtgggacagggaaaagaagaaaccaataaaaggacagaatgctattaagcattttaccattgaaggcaactggtgttcagtgaatctggggagctctgactttctggaacgtgtgtctctcatagggtggagagggagctggggtgtctatccatcaactcaggaaaggaccagagatgcaggtgctggcgttgaaccatccaaggctctggctgcaagggagcagactggcagtgagagttacccacccatgcccctgagcacccaccattccctgcatcctggagacaaacatctgagcatttttcccaagggcttccctggcagccagagaccattgtgccatgctaaaggcaggccaggagctcatgagagtcgatcccatgaggaggaaccctcagttaatgtccctaatgggacagggtagatagatc

SEQ ID NO: 472990 - DNA, 590 bp, Homo sapiens
accccacgacaggccccagtgtgtgatgttccccgccctgtgtccatgtgttctcattgttcaactcacacctatgcatatctcttcaatatactcacttcctttcctttggttatatacccagtactgggattgctggatcacatggcagttctgttttagttttctaaagaacttccatactgttcttcacctgactacaaataccatatgtttcaatccccatctattatgtgtggctgaagtgctgccccacactctgctgcggggcttgggtaacatacaatatatgcatcctgtttccactctaaaattggaaaaattctgcattctgaaacctatcttgcccgtaagagtttccaaaaagggagtgtgggtctgtaatatctacctcatagggttggaaaaggatgaatacagtctcagtgcaggtactctctttaaatcctgcagtggagcaggccactgctctgctcaagtcttgcaatgacgtctcttcactccaagtcttgcaatgacgtctcttcactcaaagtacgaaggcagcgtcctcctcaggccctacaagaccctactaatcaggtctcctg

SEQ ID NO: 472991 - DNA, 484 bp, Homo sapiens
tgtaatgtcatgaggacttcaaaccaaaggaactcaataaaactccaggagccgcacagcaagtcaaacctcaaacacattccagcctcctacaggatgcccggtcctctgggcatgccggtggctgcagactcctggcaaagtcacaatgctcagccgctaaaagagatgtcatcaggcccctgcctgcctgagttctttggggaatctccatactgtgaaaaccatattttctcatgtaaaaacagggtccccatgaccaggtacgagaagtatcctggtggcatgggagatcagattggggcagctctgaaggatgctccttcggggcccagcagccacatgccttttccatttcccatggcctctgctctttggaaggtctctgtgtcagtcacctccaacttagtgtaacttttaaaaatgtgttgtgagtccttaggtcttgcattccatccttatctctcttcagggaattaaagta

SEQ ID NO: 472992 - DNA, 751 bp, Homo sapiens
actgcctctacagcaaatcaagctccaggccaacagcacgctgttgctatcaggagtgaaaaagaaatagcttctctgaatgcactggagagaagctctgagcatcatccaaagaagatgtggagctattgaaagagaatttgcatcatcggatgttgcctttgaaacctggaaactttggggaagatggatctaagggagccaaggctaaaggatgcaatgggaaggcccatgcaatgggtgtttcaaagcaccctctcagcaaatctgcaaaagaaggtggagaagcagcggacatgaacactactcctgcagaagcaagggcagagcaacttaccacagaaatgggggtgggtgggcaggttgcaatggatatgtcgcatcttgtgccaggtgacaatgctactaaatgtcaagaaggcaaaggccctcctctgtcatcatcagctctcactagtgtttcagtgctacatggttcagaacttgattatctatttccaagtgatgtacacctgagccacagttgcaaccaaactacaaaacattcctctggagcactgtctccttccagaccaaggtgctcagttttctgtctatagtgtcaattaaaacaatatttaaaggtaattgttcgtcttgtgaaggtcaacttacataaactagaaaatagtcataactccatttaatgggcccatgtaaacagcaatggatcctgaaacacagaaaacaaaaggatgaaaaagcgtgtgac

SEQ ID NO: 472993 - DNA, 688 bp, Homo sapiens
atctcaccactctaccacatcaggtctatgatcgccagtgaacacacgaagctccataaaagtaattttaagcgctttgctttagctgtggcagcagtcgcaagtcgtatttttgatcatctgggtgcacaatactttaccaggtcttgctcaccaggaccaaatgtgaccaagatgggaggtggggaaggagattctggagttgttttaaagggggtgagaaaacctcaacagaaagagacctgtgttgaatgcctacggctgctgagcagagagacagagaaagcatttacaaagaaaggtggctctgtttctgctacggatgcagactactctccatgctccctgagaatttggggtactatgagcctttgtaggaagatgcaaaacttttctggccccaaatcccaacagtatacctccttagatggtttttgatataagacttttgtgtcacaaacagtccataaagagggattcactttgaatatttggatggtggaggaagtgagggtgggtagaatatgtaaagaggctcaaatcacaaatcacacaatggtggaacttttgctatcgccacatacttggaaagatgactggagatacaaatatagaaggaaccatttgcaaactaacatagtacaaattgtacttttcttaattctttggattttattatttacttttt

SEQ ID NO: 472994 - DNA, 605 bp, Homo sapiens
gagcagcagggcactgaagaagtatgtgcaaagagaagtaacagatgctgtacaaccgagctggggctaatgcagctggtgactttaagttgaagccaatgctcatttaccattttgaaaaccctagggcccttcagaattatgctaaatccactctgcctgagctctgtaaatgggataacaaagcctggatgacagcacatctgtttactgcattctttactaaatattttaagcccactggtgaggataaagccagattatctctaagtagtgatgaagcttcattaccatccagttgggatgaaaatctcaacttcctactcaaaagtttcagacaccaatcaagtgggggaattggcatggatgggggaaaaatggaagatgaaaataaattataccaaaaaaatccaaaacaaacaattaaacaaagatttcaaaaatgtaaggaaaaagttcataattgtgctacaatttctgagtccatttagtaaagtagactgaagaaatagatgctagagagaagaagaatctgtgcctacagccaaacctggaaggtgcccgatttgaggcctttgtggcagggtgtccacttcagctatgag

SEQ ID NO: 472995 - DNA, 1144 bp, Homo sapiens
aaggacctgttcaggaccacgagccagtcacaccaggatatggtggtgaccagagaaatgaatgtgaaggatcacgaaaaaccaaatgatcaggagaagcagcaagcatattccaggaagagcctcttgacaaaagcagttgaaaggcatatgacagacagcagacattttgatcctggactgctttttatcatcaagagttctctccagttttccctgctctgccatgtgtccctgctaacatttctggaacagctgcacacagccatctacatgagatctgtgccttctcggcctgcagtaaccactccctggctactgcctatgttcactcaagtccctggagctctagagttgccagatagcaaagccagccaggcctgtgtccattccttcagtgcagcaagttccctcaggccccgggtgggtccagaagtgccatccaagagtcagggaccagagtcaaaaaccttagcagtctacctggtgttctattgtactgtggctgagctggcactcaaaccacaagatgcagtgcttcctactcttccttcccctttccaaaggcacaggagcctcacctcacagccaccaacaccataggccacaggaagtactgccagactaccactgatacacccttaaggcccaagcactcttaagtcagcttgtggtgaatgctgcctggcttggtactcacccttcagggcaatgggctcccctctggcctagggcaggtcaagaaacaccatccaagagtcaagtcctggaatcagggaccctaaagagcctgcttggtgctttaccccactgtggttgtgctggttttagcaaagaaacatttctgtttacttctgtaactcctgtgagggcatggaaattctaagtgccattattttctggagattcactatgctaaataaacttgttttcctttgttaatccaattacatctaaagttatttaactttaattttttttttcacaatactactacaaccatcaagcagaagagtcagggtcagttgaataccagattaggaaacataattttaaataaagatttcctcttttaaatgttttcactagttaacgagttacaggatataaattaccttgcttttggctcttcatgtgactaatc

SEQ ID NO: 472996 - DNA, 539 bp, Homo sapiens
tgggaattataggagctacaagatgagatttaggtggggacacagagccaaaccatatcatggtttaactgatcgtaaacgtggagcccttgtgaataagattagtgcccttgtaaaagaggccccagtcttcttcactttttcaccacctcgttcatcgactacccctgcttatgtgcttggctcccgtagagttgtaacagggaaagaagatgtggacagtgaaggccaggatgatgaggtttccgatggaaataaggaacttgctgggaaccagagtaaaggtcacatctgttatgcactagcaaaaaacttggctgcattaagtccaggtaatagggatctgcagatgtttgaacttaagagtgatgatttagggtgtctagtggaagaaatttctaagaagcaaagcattcaagaattagtatgactgcttctaatagcctatgatcagatgagagcaaagaaatgacttaaaagttggaatttatatttaaaagggaaatggagaataaaagtttggaaaatttgtggcctgg

SEQ ID NO: 472997 - DNA, 477 bp, Homo sapiens
aggagtgctgcttcttcgcccaggaaatgcgtagccccttgtactactgccttgctccgtcaatcattggccaggatctccccaagaaaacagtggccttggctatcactgtttgctcagtttttggctggaggaagcactccaagaatagcaggtccttggctcaacagttagacaaacctgataaacccaacagccaagtggtttcaagaggtgatgtggaactcatctgtgactatattaccgaagtccaatccatcctcggaaaccttgactttcagcacccagagacgtggaatacgcctctcattactgcagcagaggaaaatctaacagagataggaaccatctctattcatttcctcactcggtccacaaatattcctgctatatccaaggtgatcactagattttatggtggatctggatgtgaatcaaacacagatgccacccccgaggagctaatggtctaatggc

SEQ ID NO: 472998 - DNA, 570 bp, Homo sapiens
tcaaagatctagccaaatgtcaccattagcaatccccccaccccccaccaaaatcctcctatcaaaactagtatctttctcgcttgagcccagaaggttcgtgtttcagaatgatgtggttgctgagtggagaatggattggatagaggataagcacagaagagttcattccctacttgagcgctatcttcttgtctcttcctcctccatggcaaggaggaaatctagtgaaaatggaaaaatcacctccagggtggcatatgttataaaaatgtttttcaataacagcaggaagccacaaaagtttcagtgtcattttccaacaaagtatagtgacttctatggtgacttctctgatggaacaataaagttttgccagaacaagtgcaagcattacaagcgcttcccaatacaaaattgaagaattttgttgctagaagtaatggaaaacacaacactacagagacatcgtaaagtaagtatatgccatgctattgccaaagagcttgtgaaaccagctacaaaggtaatgataaatactatggagaagaatcagaactaccaacaaaa

SEQ ID NO: 472999 - DNA, 864 bp, Homo sapiens
agtgatgactgccagggaaaatggccagcttaggcttcgtgaggatctttcagattgcaaaagccccaagaattctttccctccgtctgtgctccccctttgcaatacgactttcagctcctgcccctgtgatttgctttggccatactatatggcagaagctacacagcatcagttctgggcctagatttcaagaggccttgaacacttctgctctcctacttggacctcgtggaggctccatgggaacaagcttgggttggtttgatgaagggtgggagacacaagggcctacgttgtgtttcaaatcagcccatgagggcactgatttcagtggctacagttcttctggatggagatgtgggtgtggcccggtccctatagcaggggtgcaggatgaggtggaaggtgacggggacctgccagcaagttcttcctgccagggtcactcagcaacacgctgaacacagggatgaaggagaaggaagtgcctcaggtgacatccagatcccacaagtaaaatatgaggagacaagatggtgtggtgggtgggagaaagtggtttggacccagatttggtttatggggaccccttttgttttggacattgggtttgaggtgacattggaacagtaaaactttgattgttctttctaaaataaaagacccagtaaagaagcaagattttgccaagcaatatggcaaaccagtacccagacccacattgagggttacctgtgaaagcattttgtcaatagtaaaggtgccttataagtggtaggtatcacatttatgtgaataaagtcactagttctctggggctttcagtgcctgaagcttaaagagtaaactttcttatatttc

SEQ ID NO: 473000 - DNA, 998 bp, Homo sapiens
gaacggggaccccgggatgagtctgccagcagcggataaaagctccaattaaaaataaaaaacaggagatggaggataaaaattggcctataccacctcctccagttgcagaaacatcagtgccacttcctttggtggcagaaatagagaccccaatacaaagaaatttatgctctgctgccatagctggagagcccttaggaccttgcgcttttcctatttctgtaaggcctgatccaaacaatccacagcaggttattcatgaacacactccactagagtttaagttgttaaaggaattaaaaacgagtgtggtaaatgatggcatacagaacccattcaccttaggattgctagaatctgtgtttggtgctatgcgtcttttaccctttgatgtgaaacacttggcacgaacttgcttgtccgctagtgcatatccgacatggaatttaaattggcaagaaatgtgtgcaggcctggctaaacagaaccgtgttgctggacacgcagacactacagaggatatgctgttaggtaatggcccttattcagacctggaacatcaaatggcactcccagacgctgtttatcagcagtgtgcacaggccgctaaacgcacctgggtcacaattcctgaagagggagttccagtacaatccattttacatatcatacgagggttgcaggaaccctataagcaatttcttgcaggattacaagaggcagtgaagcgtcagattcctcataccacggctgcagaaatgctaaccttaactctagcttttgagaatgcaaatgcggactgtaaatgtgcactggcacctgtgaggtgtacaaaaaacttaggaaattttctcagagctcgtcaggatgtgggaaatgagcttcatcgctctgcaatgttagtgtaaggaatggctaatttagcagttgacaaatctaaaaggagccaagggtcaaatcctaaaatgggaaaatgttatgattgtggaaaaact

SEQ ID NO: 473001 - DNA, 525 bp, Homo sapiens
ccccgagtcagcaagctttttctgtaaaggagcagaggagatactctggggcttgtggtccagatgggcaaattgccccgtgttgagaacgactgttctagtagaatcacttaccacgttaataaatcaagcagtatccaaagtatttacggtagcgatgggagggcaggatgttccagtggctgcatttttgtgtttggtaactttcatggacagatcaggcttaagtggatgtggagcatagtttcaccccaagaatgtgacagtcacagctgcaagctgacagtggaaaggagcaaatccttttggataggatatcctgtgagcataatatgtgacattcatcggttttcagaagtggctttaaagttttttcttcttctgaagctttgtgtggttgctgtcttcaagcatagaattttaatttttcacagttcataggagatgcaggagaaatcttcctttctccctgatttgcttcctttgactgaggcttgataaacttacaaattctaactttatgta

SEQ ID NO: 473002 - DNA, 653 bp, Homo sapiens
acagctcattgagaacgggccatgatgacgatggcagttttatcaaatagaaaagggggaaatcctttcccaacccaactgctggaaactcagcccttcctgctgctcaagccccaaacctcaaatgcattctttcctcctttctttcacactctgattctaatcagaacattctatttggctctgtcttcaaaatataaccagaatccaacaacttctcactaccttcagcaatactcccatactctaagtcaccatcatttttttactttgattatgttaccttgctcccttactgtctatcctcaacacagcagtcagagtaaatctattaaaacacatcagatcaagtcacccctctgctcaaaacctccggtggcttccagcacactcacttctatgcaaaatcttaacaggatgcttttaagtctcatcaatcctgccctcttctgccatgagggctacagagatgccacttgctcgcagctcaatgaatagatgtcattgacatggacaatctgtttattaggaactgttatagccagctaatcatttcattcataaaccaccaactagccctcatcctggaattcttttgactaattcaagtcaggtgtgatcctgtgacctccaggtgtggagattggttaagc

SEQ ID NO: 473003 - DNA, 560 bp, Homo sapiens
cagtggcttaatacaactcaaatgtattctcttacttattatctctctctggaggcaataagtccaaaatcagtctcactgaaagcaaggtgttggcagggctggctccttctgaacactcttggggagaatccatttcctccccttttccagcttctagtggccacctgtgttccttggcctgtgtccccctcttccatcttcaaagtccatggctccagtctctacctccaccatcacaccacctccactgactctgaccctccttcatccttcctggaagggccacttgactacatcgggcttaccaatataatctgggatcatcccctatctcaagatccttactttagccacatctacagaatcctttttgccatagaagtaaagcagattatcttccatgatataatgggcatcactctgtcagttgaaggccttttgagaaaaaagactgatgtgtctcagccctggtaagacaatgaggaacagttccatggcacgatgctatgagcatatatggaggtacaagcaacgttcaccatatttaggtagcggac

SEQ ID NO: 473004 - DNA, 861 bp, Homo sapiens
cagccagtattttctaaaatgtgttttttggaatgtaaggtgccatgatcaggtgagggctcctccgaactaaggttcagatatggcagatgtgatcaaagcaaccacacaacccacctgggaggctggggattcacatctcaaaatagtaattaatgatttggaacatggcagtgcctattttcgtccatctgcccaaccgtctatccatccatccatttgttatcagctatttgcaaaacctcctactggagccaaaagagcatcattttgtacctctttccccccaaccctgcgctatccacgtgggccacctttcaggtcattgggcccactggcttctttcttccacactgggcttttacatgttgttcccttcacctggaatgttcccctttcccatctccctgcctgggtgcttcctttgtatcttcagaccttaaatatcatcagcttccatactgcatgcagagaaaaaccctctcatatctcagattccctattctaactctatcagttagggtctctctgctctggtctcctatttatccccagcccgaagcttagctcctggttcatgatgaagattcaatgtatagttgtggttgaatgaataagtgaatggatgaataaatgcagtggtatatttgagtgttagctgtccatcaacttgaatacaagatttattattgagttaaagcccttatattttaagagaaactttaaaagacaaaaccagttttgctgaaataatcatcccttttgatttctttattctctgtgtcccagtaaaatgaagttttattagaatctcatcaacaatgtaaatgcaggccccaattaccctggtcaaattacaga

SEQ ID NO: 473005 - DNA, 514 bp, Homo sapiens
aggattgcaaataatggataagaagcccctggcccatatcagcagctattatcgaaggggtaatatattattatattatagaaggagtaaaattatagaaggaatccagggttgtggggtggtagagaacaaaggagttgtggtagatgaccaggaatccctgggaggaagagggagaaattctccttccttgtttgctcctacttcaggcttcctcacaccaccgacagaaggctcagtcttcctgcctctggccctcactgccaacaccttgccaatatctgaaccccaaatgggcctgaaattggcagagtctgctgagcccctaatgccttatagcacttatctaatcgtccaccataacatgcttatggaccacacaacgagagctccaaaacgtcctgctttattaaaggagtgaatgaatgaatgacaaaatgaacactaaattttcaaatgcttatgtttgatttctgccaacctcaactaatacccgtgtcatgaaaatgacact

SEQ ID NO: 473006 - DNA, 740 bp, Homo sapiens
gccagactaaggcatttttgctactctctctgcaatgaggaatgccaaatgttgagctcagtgccctgggtatctctgaccctctagagggtcaatgcttgatctcatatcatggagccatgatacctgctacatccccgatcaccttccaccatgtttccaataatgagggtgacactcccactggcagagacccttaccctccacgtgactgctgcccttccctgggctgggatgttgaacagatgaagaagcacatggagaagaagaagggcctgacaaactggtctctgctgacttgtgagatcctgggcatacacacaggggaatttagggcccagagatacagaaatggggacagggctcttttctccaaactcctcacagatctccatgtagttctggcactgggagttcccatgtgggtagccccagtgagccctatagaacgagccctgcagaatctcagtgaagttactagccacacagatggaggcgcagcccttgcccaggaggccagaggaaagaaactccacagacttattcaggagcacgggaacatccccagggcctcccgaaaataaccaagggaggtttggaggaaagactgcagtgctgtgagaacagatatgggctcagagctctacaaatttggatattaatactaaggcagacgtcattggtgcttaaactctttttgagagagctgtaggaatgtgacttatttagaatgaaggaca

SEQ ID NO: 473007 - DNA, 801 bp, Homo sapiens
cctgcccaggtggtcagatccagaagcagcagttttcctggaccctccaagatgcgcttcctggccctgctcgtctgcctcctggtgctgggctttcaaggtgagtacatttcccactgcagaccatgcaggggccttaaccctggacacagcgataatgacctcagtgagttttggaaattacattgtgacgtgcagcaagaatggactaagacaggaattgctactaagaagtgtggtgctgctgtcacaactcctaaaatgtggaagtggctatgggtagatgatggaagagtttggaagtgtgcgctggcaaagcctgtattgccacgaacagaccacaaaggtatcactgctacgggcattcatacacttttttgtgtagacaaacgttttcatttgggggtgtataatcctataagtggaattgctggattatatggcaattgcatgttttaccatttgagaaactgccagaccgtttcccaaagtggccgtaacattagcctgtgtaataagaagaaagaatctcttagtgaatgagtattgagaacagctgaaatatttgagggtgtaaaaaataaatctgagaaacagcttttaaatttcaacaaaattcacaggattttgattgtcacagtattcaattaatttggagagagttattatattgacaatattaagtttcctaatacaagaacatggtaaaacctttcgcttattgagtctccttgattctctctcagtaaccttttgtacatttgcacatactctttataactttttattttaccataatat

SEQ ID NO: 473008 - DNA, 510 bp, Homo sapiens
ttggagaactcaggggcaggtttgctgttgaggactctgggccatgaatcctcagctgtacctcaagcactacctgtttggatttcaccatcacaaacactactttggagcctggagatgctgcacatcctcctgtgagcagaacactcactgggaccctgcacagtgtgatggccccaaacataaagctctcaaggaagctccgcctctcagcgtggaaggagaggctgcggtgccaggggatgtgtccacagagagtcgagtcaggtgggctcaggcagttgcctggagagtctttgaggaagaggacatgaggcctcagtcacaggtacatgctcctcttctgtgtgaacaggggccaggtctctccagggcaccttccagagcctcttccttcctaactccttggggtgctcaagccctacagaccctccagtgttggctgccacatcctcactggaccagccgctaaggtttcctgctgtcgtcatggctgcagggatgctcagt

SEQ ID NO: 473009 - DNA, 4580 bp, Homo sapiens
tagtgccctccttgtagtgacaagtgaggtcccacttagttctggagcagaagggtggatggagaggttggtgtttctcctgtaccctcctgctttggtgctgcaccacccaagctgcagcttctcccaagaggcccctctctgtgggcccgttagccctggggatacagcagctccccactgttgccagcccctgggtgccttgacttccctgtgggcccccttaaccctgccctccccacaggaatcctcactggaccccaggttgagccctgtttcctgcccagcccctgactgctcctgcggggtacaaggcctggatacgctggccccaatggcagcccaacatcatcccctggagcccctcagccagctgccctgctccaccaggacgccagaagctgccctcagccggctgcccgctccaccaggatgcctaaagtcacacggagcctggctctgttcctcgtgaggcaagctggcctgccctggtcccctgaccaagcgctcttgtcgtctgttcacactgaaccacctctctccagaccttccctgactgtccacccatgcccatgggcagattggaattaagagtggcctgagaccagatgcaagatggcatgacttccaacctcgaagtctatacccgaccacattttaatcacctatgagaacagaacaaagaaattttcagacatcagaaagttgacttcacgtgtaccctttcttagatttttttaaaacctttgaggggaaaaaattgtgaccagagaatctttccaccaagtatgaggatagtatggagacacttttggatatggaggctcaaaaactgtctatacagacacatatatacatacatactctaaaaattacttcaacattttatagttgaataaaaaagattcaatattgagagttcaaaaatatggaaaagttaaaaaatggagaccaatagaaacagtttttaaaaaggaatgagtttaaataaatactgttagaatatttattaaaagtaataaaaatattacaattattcttggaaaataggttgcttatgttatgaaattcaataataacatttttggatataaaaatcccaggatatagtacaaaaggttgaaaggaaagatgcatgtacaaagccaaccaaaacatctagacataaaggattaaataattagttttgataaattcaggtgatagaactgtatagaatcatttttaaagtgtgatttaggggaatatttcaaatcatcattaatgctcagaatagatcccttagtaaaaatggcagtcaccaagaaacataatataaatctaagcataacataacctataccataacataaaatataacttcccattttcagaaaatgtaaaaatatatacattattattatattcacagaaacaagaccagaagagattccccaaagtattcacagttatcctcgtaagtctttataatctttctgcattttccaagtcttctataatgattctgctctactccttttagacaactaacaagcaaagcatgagtcccatggccatgcccacagatcatactagacacacaagtccccaggccaaggtttagcagcttggagcctgctttttcttctctttttggtacatcttttcttctcctttagaacattgaaataaaaagtccaacatatgcactttgtactcagtagcaactctactcttgccaagatagtggtcttgtgatggcctaagtggggaaagagagaatggggatgaagggtactagataggcgatgtactcaaactgggctttggaaagcattttgaaattgtcgatcatggtgttgtggaaggactgatgtacaagaaatccaagcaagggtgtagtctaaactatgagagcagcgtagacccttccaagtcttcgtgtctatccctaaagcagagataatatggtcctcacctgactggtggagatgtgtaaggccgttaaggatgtagcaggcatgtagtggaaccctctgcatacttcaggcttccagacctggaggctgtcaggcttactacctggcatgagggctgccagccccacctccctctacctgtctcttcctggacccaccactttcactcccacctccctgctctcctctccctcagttgctaagatgagctcgtttcactttcttccttccaaaggcagttgcaaactttatagtcccattgtttgaaattattgaagatgctaatgtttgatgtggaagtttaagcctgtcaggaaatttcactttcaaagtccttcagtcggttcaaaaattcctcacatgcgatgtcctcttgatggtgtttccaaaccccttggagcctatctggagtgaaatggtccacactgaagcccttctgggggatatgacagaaccctaaagattgtcagcactgtccgtttttaaccatggtctgacatgcgcatactgtcttaggagtaattgttagttctgaactcaccagtgagcattgcagagctaaataatccagaggtctcctgcaaaagtaaatataatagagagtgctacaccctgtgcttgtgacgaatgccaaggcttggcagaccaggcctctgctgggctctggactcagggctccggcctccaacagccagaaatcccaccaacaccaaggagactgtacccagaaaaggtcacccagaaatcccatcacttttggaccatggcagaatatttgcctctccagaggttgaaacaaagtatgagtcacttccaaaattattttataaaagttaaaatgtttcctttaaaaagaaaaatcctatcagaatgcagattggggtttgccagggtctgtgggggttgaggaatagggaaaaactgcttaatgcataaggggttttgctgtgcagcaatgggaatgttttagaaccaggtagagggggtggctgtgcagctttgtgactgtactccctgccactgaatggcaaaaattgttagttttatttcatgtgaatttcacctcaataaattactgtaaaaatcatttcaaatgatttttctcccctctggctggcaaggctcattatctttgggtgagggtggtggcacttatggtgtatagtacagcagacaaagcacaaaattggcaccagcctgactggtatgtgcactggatgacctggggcaagttgtttacttatgctgtgtggtcaaatgaggccagtgatctagctgtttattaaataatctgtacatttttctaatgaacaaagcaatactggtatattataaaacagcgatcctcaaccttttttggcaccagggacaggttttgtggaagacaatttttccacagaccggggaagggggatggtttcaggatgattcaggtgcattacattaattgtgcactttctattattattacattgtaatatatcatgaaataattatacaactcaccataatgtggattcagtgggagccctgagcttttttttttttttttttttttttttgcaactagatggtcccatctgggagtgatgggagacagtgacaggtcatcaggcattagattcttgtaaggagtacacacctagatccttcacatgcgcagttcacagtagggtttgtgctcctacgagaagctaatgctgcggctgatctgacaggaggtagagctcaggtgagaatgtgagtgatgggaagtagctgtaaatacagatgaagctttgctcgcttacccaatactcacttcctgccgtgaggcccggtgaggcctggttcctaacaggccacagacaggtaccagtgccagtccatggcccagggattggggacccctgttataaattttatataaaataagaaaataaaaatcatccaaaacttcactactcaaaggtgacattttgtattttgttttctagctgtctaacccttttcatacccatgtatatttttaagtatttttgatctccatgcttttcttagccagtcctttgttcttggactctgcctgtcccgggccatgtcagcaggaagcttgcagacacctccctccttcacgcttagggagcatttcctggggtgggagtgggaattggaaagatgtttgaatcacccaccattgggatttgctcttttaaatctttaagtttctgttccttcctttgtcttcagagtttttattaaaacaatgccagttttccatctcctctgtggcatctgtttattctctttgactttcagaaagctgaacatatgactcatttctgtgtgcgtgtgtgtgcgtctttgtgaagcaacgcagagtaaaagggaagtgaagtcgggaataattatttgaacctgattcttctgtgaatgtttcaatgagaaataaatcttgtttcccctcacaggaatttgcaagtttgctacaagccaaacagaaagattggtccagggctgtgaatttggtcagagccccttccagttggaagtagcaactctttgcagccccagtaacaggaagtccatgtgagtgtgcttgggccctacgggacctgactcagacccaggtacctttcacac

SEQ ID NO: 473010 - DNA, 1314 bp, Homo sapiens
gtcctcctgtctagatggagggggcgggactccatcacttcccaggcccctccaactttcctgttataactctgtggtctttgagagcttacttccagaacacccttcaacaaggaaacacccagaagaccaatgaaaccaccaagaatgcctcatccaggaagaacgatgtggctccaggaatgcccattgtgagagactgtggctgcagatacctcacagcctgcagtcaagtgctgcctctgggtcccgggagccttcaggcagagcagcgtttgccaagggtcacgacggctgtgttccgtgacgaatgcacatgttgtagatataaaccagtaggagacaactttggggaaaatttttaaaacaaaacatattccgatgtgtttgaattatgcattgtgaagatattcagactttccatgactgaggcagccatgattgctgtttgtttttaagggcaacacacgtttcaaagattttgttttgttctgtttgtttttcctacagagctaggatttgcaagacaaatatggcttatactttagaggaatgggattcgaagatggagaaataaaacgccaaaatcaaaaaaattttatgaatgtcatttctttctgatatcatgataattctcattacaataaaaagaacctgtgagatgattccatttctggtgagcggaaagtgccgagcgactctccttctcaaggaaggttgaggtacaagggcaagcttttgtacttggatttaaaagagaagttctagttttaaattcttggtctgctgttaaccagctgtaaatgttgggaagtcattttcttcatctgtaaaatgcgtaaaaggaatatttgtcttataggatttttgcactttgaaatccaactatgcaactcattatttctttcaactgtggccacattcaggatcccatggtgtactaaaatctctttgaatcagaaagcaaagaagaaggaagaaacattggcgttttccctgtctccagcatggctgtaggatgcagagtgattgaaaatggacatttattaagatgattaatgtgtgccctcggttctacgagattgtctgtataaattgtctttccctattcagtctttgtaatttgcgccttctctatttttcggtagatattttttgcatttggggaggtttactttttttttttttttttttataaagtttgcctttatagtaagactttcatacaataccatttgcattagacgaaggcctagtcatgagaaaatcacatccgttaactgaccagggagcatttactctaattattaactc

SEQ ID NO: 473011 - DNA, 651 bp, Homo sapiens
gaagaggagggggaggcagctctgagaagaacggggaagaacagtcaccaggacctgggactgcacacccctgagcaggtggtggcatgcgggcccctccagacaaggtgcctggcaggaacatgattcatcatcaccaccaccatcactatcatcaccactaccatcactatcataatcacatcaccatcactgttaccatcaccaacaccatcactgtcaccatcaccaacaccatcactctcaccatcaccatcaccatcaccaccatcatcgccatcactatcaccatcaccttcatcaccaccaccatcaccattaccatcatcatcaccaacaccatcatcaccaccatcgctatcatcacaaccactgtcatcaccaccaccatcactattaccaccaccatcaccaccatcaccatcactgtcaccatcaccatcaccaccatcaccatcatcactgccatcaccaccatcaccatcaccaccatcactattaccaccatcaccatcaccaccatcaccatcactgtcaccatcaccatcaccaccatcaccatcaccaccataatcaccatcaccaccaccatcacatcaccaccataatcaccatcaccaccatcatcaccgtcactttcactgtcaccat

SEQ ID NO: 473012 - DNA, 622 bp, Homo sapiens
aacaagaaggaatgaagagctgtgacgcttctgggaccccagacctgagaaatccccaagccaggactgtgacacactgcaacaccctctttggggctctgtggttcctggcatctccaagctttttgatgccatcatgttcctcttgtctagacactggtgcctatggtggaagctgctcgggtgtggttggcaaaatgaggggccataaagatgtctctgtcctcatcctcagaacctgtggatgtgtcaccttatatgaaaaaaagggtctttgcagctgtgactcgggttacagacctttagataaggaaattattttaaattatccagttgggctcaatgagtttttaaaagtagaagaaggaggcagaagagtgggtcagagatggggcttggcctgcctgtgtctctttgatgaacaaccaactgagatgccagcttctcaggacacgaaagccagtaacaaagtgctgcaggaagattgacgagttatttaaagattatttatatcttatgattgctgtatcatgaataatagaatatgctgacattaaatgacaaaataaaactgttagacatgcattgtccataggcactgagaccatgcacagtgtttctg

SEQ ID NO: 473013 - DNA, 1686 bp, Homo sapiens
actgataaaaataactgctgtgtcttctaagttctacaagagcagaagcacccggtatgtcccagctgcttagtgggcacgcactctggattcccgttagttctacagtcttgccaatacttattttcatgttaatttcagccaagttaataggtgttggccctggccgattactgaaatacttcattttcagtgcctgtgtggccgtaattcgaacacatggattaaataagaataagccttgtatgagatctatggcaacacctcctttattttcacgtgaggaaaggattcagaacagggctagacattgcacctttccctcaacagcaaccaatcatatctacattcctgtatcaccaaagaatttgccatgcttccagtcctactcaggagcacctgaattaaccaagacaagtaccttaaaaattgagttcccactcccctatacaaagcaatatgaccagaaatgcccgagcatgaaaattattacaattttgatctcttgagattttctggaatcttgctgaaaaggaaactgttctatgaaactgttattttaaagatccatttcaactcctctgaaaattattaactaagaagtaacagcatcaagttaattttgtgggcagtggccaatttccacttgctcttctccctctgttttccctgctacaaacagtaaaaagatgtcagtgcagttggctattccctaacagtaaaattcccctcccattctaaacagttgagcagactctcagtacagaataaactattggtcatgggtcagagcccacagttctttgctctttgtcttattaatttttaaaaatatatgtgatgatcatctcctgaatttcaatttcctgaagacaatatgacaaatttattttaactattctgatgcagaaagctaattaagtaaactggttcagcaactgatcatgtttcactaatttcaaccatctgcctcaacatttgttcctatgtgtaccagctttcatagcttctttcctctaatagcaattaatgaaactgttaataagctacatatatcatacactgttataacaatttaccaaagggtagcattatgagacaaattatatttaacaattgtagaaaaatgactctgattatcaaatgtacaacatcaattagattttttaaatttatgcttctcaattaattatctaattaatttggtgcacattctatgtataatttgtaattttaaactcctggtcagattttgccatctatttttacatgctgactgcttatatgaggcacatattaatgaaacataacttccctgcaaattactgagccttgcttttattttcattcattgtgctttttcataagcactttttcaattgttgtgcaatgcataaaaaggcaaattgtactattatccagtttttgcactatattcaaagaatgatatatgcacacacatatataataattttaattttaaatgaggttaatttataaatatcttttacaaatatcttttaaaaataaaacagtacaccaaaaaccaaaaaataaatggcttttacgaaactttgattaaacatatgttagcccttctcatggtattccttgtgtctcttaccctcccttctgtatattctaatcttccacctctctgagcgtggatgtctaaagttctcagcc

SEQ ID NO: 473014 - DNA, 1490 bp, Homo sapiens
tctgtgtggtttgcaacgcacattgctttcgagagctgtgttttgtccgaagctgattttgatgcattttgttttcccagatgacaatctgtttgacattaatagctatattcatggtgagggaaaaagtagaaagtctgtggaaagaggtggcgggatctcttctaccaaggaagcaggttgtacccttcccacacttgctgtggaaaagaaggaagacatagccatgaccatgagccccttgtttttcttgttctttgaaagctggatccctaaagcatgtgggccacttggttccctgaaacccgaacaatacaaatcactactcctcctacttagggatccagtaaaaagtaaaaggatggaggaggattattatgtcctctttatccatacttatgactgggaaaactcctactttatccctggtaatatttgttattatgacatgcttatctttattactgcatatagttagttcttcacttttaccttttaacacttggacagtaattaagatgtttagtccattaacaattagtatagtaattggtagcctaccctcttgctatttatttttctttttattattcttctgttcctcttttttggccctctttttgactagtaatttttttgagtatttcattttactttctttgtggatttcttaactctctcccctaattattatttttaactggttgctctatgtttaactgtattctttcttaatgttccttttgaatcaatactgtgtcatttcactcattactcttcacacctgacacttcaatcttcttacttcatgcttctctctttaccctgacacctccagttttagtataaagaccttgtaatagtatgattaaatttaccaatagtatagttatatttacatcaaccaataattatgaggagatacttaaggaaaaaccctactcacaagtgacagagcactcaatagaacctgatttagatatgatgcatattttaaagctattaggcaaggaatttaaaataactatgattaaaaactgtagtggaaaatgtggaaaatatgcatgaacagttgtagcatttcagtagaagggtagagagtgtaagaaaatgtcaaaaggaaatgctaaatatgaaaaacaaatgaagaatgcctttggtgtgctcatcaattgacctgacacagccaaagaaagaatcataaatttgaagatgtatcactagaaattaccttataatagtgtacttatacttgtttaaagccattacactaaagagggaagcgtccagaggtaataaagagggaggagcaaaaagacccaacagagcatccaagaggtatggggtaataacaagtaatataaaatatgtgtaaatggaatgctagaagaaaacagagggagaatgggacaaaagaaatagttgaagagatattggttaataatttccagatataatgaaagacatcaaaccaccaagcacagaagctc

SEQ ID NO: 473015 - DNA, 906 bp, Homo sapiens
gggcggtgcaagatgtgctttgttaaacagatgcttgaaggcagcatgctcgttaagagtcatcaccactccctaatcttaagtacccagggacacaaacactgcggaaggccccagggtcctctgcctaggaaaaccagagacctttgttcacttgtttatctgctgaccttccctccactattgtttttagcttctttgcgatgggttcgaacatcctcctttagcttggagaagtttgttgttaccgatcgtctgaagccttcttctctcaactcatcaaagtcattctccatccagctttgttccattgctggcaaggagctgcattcctttggaggagaagaggcagaccatcagctgcatctctgttggagtttgctggaggtccactccagaccctgtttgcctgggttatcacaagtggaggctacagaacagcaaatattgcagaatggcaaatgttgctgcctgatccttcctctggaagctttgtctcagaggggcacccagctgtatgaggtgtcagttggcccctactgggagatgtctcccagttaggctactcggggtatgcatcaaatatttgttttatgtagttgaggtaaagttatttatacttgtgttttaagcataattaacaaactttcatttgtcttagatgacagatatctctcttagatttctgattatattaattataggttttttaaaacacaattttcttttaaactaaatttaacttaaatttaactccccctaccctgccatttttgtttcttctgcattcaatcttatctctttttaaatcttttttttctagtttctattttggaggtttcactcacattcctgggctatttggcagtctgttcacattcaagatagaagctctggatgctgatt

SEQ ID NO: 473016 - DNA, 739 bp, Homo sapiens
aaattcagacaaatgaattaacctctcggagcttcagttctttcatctgagctgcctcctctcagctcctcaaactaaaaatgcttacatcggccaaaatctatttcttcatcccagttagttcagcaaagatagactatactattcaaggcttcagtctcaatgccaatacacaagggctctgcacagaccttgcagatacctcatctgtgcacgcagctttagaggagacaattgtcattgaaaaaacagttgttattcacagttctcaagagaatggggcacagaactccatgcaggtcctcaaggggaagcaccagggcagtcaggaggcagacggagtgggaggaaagcatgggcaagaggcattattgtggtttctgcaagaaagaatgggtgaggcagggattgagtggtgtcaaaaaattctgctaggaaaggggtcctctatgggtgctgtttctatccctcatcagggttgctggctacctgttgctggtagctgtgaactagatgactcttgaagtgacagctagaatctgtctttctcttgaagacaagataaggcttctattattttaacaattatatttttgtgtatattctctggaaatagttgtaatactgaggcctctgtcattctaaaaagagctgatctggttaataactattaacttagaggctttcagtagaatctcttttagtgaacagcaatcttgaattttaaaaaatatatctc

SEQ ID NO: 473017 - DNA, 771 bp, Homo sapiens
cattgggagtgaggcctccaacatgcgaattttggaggcacacattcaggccatgacaggctcaaggggctcatgtggttacgctggagctaccccagataatcctagatcagcagcggcactggattctcagaggagcgccaaacttcttgtgaactgttcatgtgcgggatctaggttgtgtactccttatgagtatctaatgcctgatgatctgaggtggaacagtttcattcccaaaccgttctctccctcccctgcatccatggaaaaattatcttccatgagaccagtgcctggtgccaaaaagtttggggatcgctgttacagaggctccttctgccttgtggctgaccctagtgttgctcatgcagccctgcatgccatggcatgccatatgtctgctgtttctacagatctcgtagcagagaagctagtaagagatgacttatgggccctgcttgctaaaaatgtccttgaactcaagaatgttttaaataaaggaaaggttaagacgctggccacagttggagacaggaaactcacctacttcactgaaccatagcatggaaaacatatttacattgggctacttcactgaattttaaactccccaataccagaaagggacttaggaggtagaggggtcccgaatgtgttgatctacagtacaaagaacaactgatagagactcagcagaagaaggctttaaagaaaatcatagattttctagtttatttgcatagaggtgtttatagtattctcagatgg

SEQ ID NO: 473018 - DNA, 515 bp, Homo sapiens
gcagtttgttccttctgatgttcggatgtgttcggagtttcttccttctggtgggggtgaagctgcagactttcgcgacccaggagcccagctggcttcacccagtggatcccccacgggggctgcaggtggagctgcctgccagtcccgcgccgtgtgcctgcactcctcagcccttggatggtcgatgggactgggcgccgtggagcaggaggcggcgctcatcggggaggctcgggccgcacaggagcccacggagtggcggggaggctcaggcatggtgggctgcaggtcccgagccctgcccggcgggaaggcagctaaggcccgggtccgccggggccacgcccacccggaactcgcgctggcccgcaagcaccgcgtacagccccggttcccgcccgcgcctctccctccacacctccccgcaagctgagggtgctggctccggctttggccagcccagaaaggggctcccacagtgcagtggcgggctgaagggctcctcaagtgcc

SEQ ID NO: 473019 - DNA, 859 bp, Homo sapiens
cgcgtaacttaccaagtgatcagcaagaagaagagcagaacttggggaggttcagggcagttgctatggggcaggaggagattcatcatctaggaaagactttccctactactcctgctctgtccctgctttaccttgcatgggcattatcacaacacatctcttaccctcttaaactctatctcgatgtctgcttcctaagggacctaagcagatacaactcacatgaagcttcaagttatttggagagaaagaacaacatccatggcaaaaacttcctactatctggcagcttccagattgtagcagacatcagctccatcagtgactcagttctgcactgtgtctttggaagttgttctgattgctggccttctgccagactccagctagatgctagggaagcaaagatgcaagacaaagccttatctgaaatgattacaggaaagagaaacagaaatagccatggggaatctgtctgggaacgataggggcgcaaagggtctcaaagggtactgtggtggtcaattcagagttggtgggggcaggggagcatatttttgcaaaagaagcagcttcagcatcactgaggaggtgtgaaaaagcctggaatgttctggaaactgcaaacatggggttgggttttaaaggctaagctttggtctggaggcacacaggtagagtttggcattctggctatgccacatacaacctgtgtagcccatgtgagttatttaacttctttgaaactatttcttcatttgtaaagtggggataataattttcatttcacagggtcattgtgagaattaattgagaatatttatcccacaaaatatcttttggacacctcctatac

SEQ ID NO: 473020 - DNA, 763 bp, Homo sapiens
gatgggcggggggaggctcaggcatggcgggctgcaggtcccgagccctgccccgcgggaaggcagctaaggcccgcccggcgccggcagggccggccggccactctgaatgctgggcccaccgagcccacgcctacccggaactcgctctggcccgcagcaccgcgcgcagccccggttcccgcccgcgcctctccctccacacctccccgcaagctgagggagccagctccggccttggccagcccagaaaggggctcccacagtgcagcggtgggctgaagagcccctcaagtgccaccaaagtgggagcccaagcagaggaggcgcggagagcgagccagggctgcgaggactgccagcacgctgtcacctctcacagtggcctgatctccactcactgcaagctccgcctcccgggttccagccaaggtcagttccaggacttgtacaggagatgtgaggattcagagctggaggtcaccccggggccttgcaagttctacgacagtagatcagttgtgaggagaggagaaaagcccaagatgcctgagaattccagcatccttgtcagaagtcaaggaagaagcttcttggaaaagctgcaagatggagactggtttgaggagaagacgaaggaggaccctgaaataggcccgggctccctgtgaaggtgattcgggggccagccccctgcttatgccgtcacattccttgctttgtaccagggtgcccattcttggcaattttcccgtgacttggg

SEQ ID NO: 473021 - DNA, 664 bp, Homo sapiens
ggatctccagtgcagagagagcctgtgacgccagtaagtgctcagtaaatgtccactgtgatatccaggatgatgctgagaaaggtgatctccacaagtgatctccacccactgtggccgccttcagagggagtctaccagagaccaatgccctctcttcagtactgcccccgctgctcctgtggagacagtgctcgggcagcgggcaccatggttggtggcaaggcgaccaccacggtggaggagctggtctcaggggtgcggcaggtggcagacttagaggagcagttccgctcctactcagagagcgagaagcaatggaaggcccgcatggaattcatgctgcgccacctgcccaactaccgcaacccacccaacagcggtggccgcctggaccagctgctgtcccttcttcatggtctgggccaaccacctcttcctgggctgcagttacaataaagaccttttagacaaggtgatgggaatggctgatgggatggaagtggaagacttgccacaatttactaccagaagataattaatgaaaaagcatcaaagtatgaaggcttggctgccacctgagatgatgttgcttctcaggcaagtaattctaaatccccccacccccttggcattaaatggattttcactgttgtcacatgct

SEQ ID NO: 473022 - DNA, 994 bp, Homo sapiens
ttttcaatcccatcagcgaggcagaggtccctggaagacagcaggggctgctgtggcagattcgcgattccttcagcccgccttctcctaactagctcttggaggatgtgatgcaactcaggaacaccatggtccttgccttcagagacctcatgtctagcatggggacagacgcggacccatgggctctgggcctgcgggatttgaagtcttcacgaatgaaaggcggagacctgaaggatgggcagtacctcctggcagagctggaggaaggtattctggggcgtggaaaggaagaggagccgcctcagcaggacaaggcaggacccgtgggaagaaagaagctggagcaaccagagatggagcagagctacccctggccctcgagggaccagggctgggggcctggctcttggcaggaagtcagggcagttgggagtccaggtcacacacactcactggggccctctgtgcagagcgaggccagtcctgagaatgccgcgcgggagcggagccgggtcaggacgctgcgccaggccttcttggccttgcaggctgctctgcctgccgtgccgcccgacaccaagctctccaagttggacgtgctggtgctcgccgccagctacatagcccacctcacccgcacactcggccacgagttgcctggccctgcctggccgcccttcctgcgtggactccgctacttgcaccctctcaaggaggggacttccccatggctcttctgtgacagctactgggaagtgggagagaaagagggccggctccgcctcatggagatcgtccttgggggctttctctaagtcctaccatggggtgccagaaatgtgatatagcttcggtgaaactcatctctggccctaaagaaataacttgaggactaatcatagaatctacacacactgaaaataactttccagatcggatgtagcctcaaacctggcacctgaagtccagatggaacaaattacctttc

SEQ ID NO: 473023 - DNA, 605 bp, Homo sapiens
cagagacctcctttcatctcgttaccattctcaacatgtggctgccacttcatggctcaagacggctgcttcaacttgagccatcccgtcttctttccagccagcaggcaggagaaaaggggaggagcagggcatgcccctcccatgaaagacgccatctgtccctgcaggcctcgaatcctctatggcagtcccggggctccaccactgtgtcttcaggaggccgtttccgctgcccatcgtgcaggcatgaggttgtcctggacagacacggtgtctacggcctgcagcgaaacctgctagtggagaacattatcgacatttacaagcaggagtcatccaggccgctgcactccaaggctgagcagcacctcatgtgcgaggagcatgaagaagagaagatcaatatttactgcctgagctgtgaggtgcccacctgctctctctgcaaggtcttcggtgcccacaaggactgtgaggtggccccactgcccaccatttacaaacgccagaaggctggagtgcagtggcacaaacacaacttactgcagccttgatctcccgagctcaagtgatcctcccatcttagcctcgcagaacactaa

SEQ ID NO: 473024 - DNA, 652 bp, Homo sapiens
gcccctggacgtccccagccctctctctatgccatcctgcctttccactcaccttcgggcatcgggaggatgaggagacaggtctctggagcattctcccaccttcacactgggccaccatccccgggagcccaggaaatccttatctgcagagctgcctgcactcccccattatcctcctatcctccttctccactcgcttatccagaagtccctttcccctgggtgcccttccttgatgatagatggaggagggagagtcgaggggaagggactgggcctgggaggggtgaggggaaggcaggggagagcaacgcagagctgcagggctattcaaaggagaaactggagatcaaagggccacaatgcagggtgcggacctcagaggcttcgtgctgcagtgactggcgagaggagcatgggcacattgggaaggtcctgcctgtctcccaaggctgccacctgggggtggcccagggcactgttgccagacgagtcttccattaagcactcatcccatcctggccctcattctctgctcctcacctccaccagccaatgccccctcattgtcccaggggatattactgcagaactacagacactttgcaattttacactgggaattgccaactacccttttaaagcctat

SEQ ID NO: 473025 - DNA, 535 bp, Homo sapiens
tcggagcagtgagatgcttaatttttctatgtgtgtgcacagaaagctgtggatttcgaaaagtgctgctgcaaatcatgaccttttccttatatttcctggcaaaatcacaaagaagagccatcaaagacaaaaactgtttaatttctttaaacaaagattatttgagaatctgactcaagaatctagagaagacattgatgaagcagtatgtgcaatattatttaaagaaaattccattgtgaaggacatcaaccagacccaaagacaaaaatccaccaaagatgctagaagcacagagaaatcagtctctaccttggtacttaatattggtgacctggtacttgaaatgctcccacagaggaaggtaagagttggagattgtcaactcattcctgaaggctctcgcctctctggaattctttttaaagctgtccagtgattttaaaattcttaattttggtagtaaattttctgctttttcttctctatttatttcagcaggacttttagcctgtgcagacttctatattct

SEQ ID NO: 473026 - DNA, 787 bp, Homo sapiens
tcactgacttagttcaggcccatgaatacctctttccctggacaactgcagcagtcttggtctaacccttgtgatcaagggttagactatgcacccaccttctcttcttggaagtgtgaacttgggagatggaccaggcctcagggtgcaggatgcctcgtggggccatctgaaaaaggcacatcctgccagggaggaccaggccacctgcccctctgccggtgtgatgtccataactgctgggacaccaagcattttccttccgagctggccactgagcaaacctgggagagaagactgaagagacaagatgaagcctgtggttttacacaagttgagtttgaggttcccataggacagccaggtggctgtcacatcaagaaggccattagatgtgcaggtttggttggggtgaaatgtatctttcctattcaaaccacccactcaaggttgatctcctatggaaacagcctcacagacaccccagaggcagcccaatcactcaagtcaaatgccaaaccacctgggaatcagaggaatgggttcagtgcctactggagcactgagaataacgctttatcgctggtattatacttccttccaacaggatttcttactctctcaagtgattttgataatcttcataatcctgttaaaaatagccataattcgttcaagtatatgagagttgatgacgtctgtgatgacaaaataattaagattgtgtctctcttcatggaatcaacctagatgtccatcaatggtggactgaataagaaaatgtcat

SEQ ID NO: 473027 - DNA, 897 bp, Homo sapiens
agatgcttgattggaggctggagggcacttggcatggcgacatcatggaacacaccgggaagaaagtcagtgcttttatggcccttagaacccaatgcaagatacttggcacttttatacagattcctgttaactgcaagctaaatgcttatgaaattcgggttggaccaatcagaagcttgggaaggcacgaggtccctgagtatgttagtgaaggttcccagagaaatggccaaagagcacatggtgcctacaataactctgaaagtttgctggtggtagggatgcttccagaagaagcagatcttctagcacattcacctggtgctgggaaagagaccttggaccttcccagcaacctactgtggaagcaagaggtgtggcctgggaaccagtcagcagcaaggtccatacagcagggtgagtctctgaagtgtgaccgaggtgctcatggctatcagaggggcagcacctatctgtgtcttggaaccttcactgatgggaacaaagtcattgcttccttcaagagctgcaaagccttgttggacatcaagaaagcatcctcaaagttcctggtactttaccaagcatggcccacagtgaccatgtgggttaaacatcatggacctgatttttgccatggaggaggatgaggcttggagaggttatgttgctagtcattgtttgagtacctggccaggccctgtgctgggaccctctggctctcccgcagggagtgagtatgctgacagctaccctaggttgaagatgcttgcccaagaggaggtataagagtggggaagggaagggacaatgagaaccttgtttaactggaggaggatgggacaaggccggggggagggaaggagactcaggagggaagagggaatcacaaag

SEQ ID NO: 473028 - DNA, 571 bp, Homo sapiens
gtatttctagtgctgtccatgtacatgaccttggaggtgcttctcccaggagaaaaacgagcggaggaggaggtggctgggagcaccatcttggtgcagcaacgtccgggaggcctgctgtgctcagccctgcaggtttgcagctcagctgagagttctggaccacagcgatatttaattactgtaggcaaatggatgttaattaagtcaaagagtggaggaaattgtccagggagactgtaccagattctggaaattctggaacaggccactattttgagggtcctctgtaaatttcctactcattattatttcagtgaatttgttccacaaatgtctgccgagcacctgctgtacattagacctgaggtacagagagagaacaaaatggaaatggcccctggcctgcaggtgtcccaggagatggaagggggattctagaaggactgatttgctccatctgataccctgcacaattttggagagttttgctaatggctctgcaacattgctttgacaaatgggtaagaacatggcagtatgtgacaaattacttgaatatcagccaagg

SEQ ID NO: 473029 - DNA, 1202 bp, Homo sapiens
tacaatcatggcaaaggggaagcaaacacgttccttctttacatggcggcagcaagcagaagtgcagagaaaaggggggaaagccccttataaaaccatcagatctcgtgagaatacactcactatcctgagaacaacatggagtcccaaggactgtgctgaccttgtggataggtgccatcagatcccagcatcagtcaaaggggaggtcaggccatccgtcatcctcagtccggacttcctaggctccctcttggaactgcatccagggtacatgtcatcaggaggtgtttcctgtgttctctggcccacagattctagtgtcttcatagtctctgaactccagttgtatgtatcttcaatgcagcaggaattccagtttggtgaaaaggatatttgctagatttttcaaacaagttttggaggctttccttccttttctaatcacttaaacagttatttaagatagttattttttgaagggatggcaaaaggcttattaaggaattgatctttgctgatcttctattgtttctttttcattttgttaatatctgcttttatatttgtcattttcttcttgtaacatttttaggctttagtaatttttctttttaaacttaaaatgaatgaactcatttgttaaaaaaaaaaaaaagctgtttttaataaatacatgaaggctataatctaaaccccaagtactaatttaactagagccttcatgtgttgaggtccacagcattttcatgctattcatttctagatactctgtaatttgcattatgaattcctccttaatttgtgagttattaataaatgtatttttaagtatctccatatctggagagcagaaagtgttgtctactccattatcttttattgttgtttttcaatgtagttgaattatgcttagcaaacatgatctgtattttatcgatgccatgaaatgtattggcaatttctttgtgttttaagccatgattaatttttcttgaaaagaatatatcttctatattttggtgtgatgagacattttctacatatatattatatatattttacttttgctggttattaatttttgtctcatatagttgatatgttaatttctaatatgaatgtgttgaaatctttctcaatggtttaaaatttggcatatttcaaggcagtattgctaagaacaaaattatgattcttct

SEQ ID NO: 473030 - DNA, 2808 bp, Homo sapiens
acctgtccccaacagatgcgactttgctcctcattcaccttccaccatgattgtgggcctccccagctatgtggaactagacttgttgaatggctttgaccaaaatgccgatagtgatgtggacaataaaatccaggctgaggtggtctcagatgaagatgaggaacttgttgggaactggagtaaagatactcaacaccagcccatgaaagcagccaggaagggtgctctaccctgcaaagccacagaggcagagctgcccaaggctgcaggagcccacctcttacatcagcatgacctgaatgtgagacatggagtcaaaggagatcattttggaactttaaagtttaatgactgcactatagatttcggactttcatggggcctgtatcctctttgttttggccaatttctcccatttggaatgggtgtatttacccaatgcctgtacccccttgtatctaggaagtaactaccttgcttttgatttgccttgtctcagcctccctactcccactgctgcctactcccactgcctccctactcccactgctgcctactcccactgcctccctactcccactacctccctactcccactgcctccctactcccactgcctccctactcccactgcctccctactcccactgcctccctactcccactacctccctactcccactgcctccctactcccactgctgcctactcccactgcctccctactcccactgctgcctactcccgctgctgcctactcccgctgctgcctactcccactgcctccctactcccactgcctccctactcccactgctgcctactcccactacctccctactcccactgcctccctactcccactgcctccctactcccactgcctccctactcccactgcctccctactcccactgctgctgcctactcccactgcctccctactcccactgcctccctactcccactgctgcctactcccactgcctccctactcccactgctgccttactcccactgcctccctacttccactgcctccctactcccactgctgccttactccccgtgcctccctactcccactgcctccctactcccactgctgcctactcccactgctgcctactcccactgctgcctactcccgctgctgcctactcccgctgcctccctactcccactgctgcctactcccactgcctccctactcccactgcctccctactcccactgcctccctactcccactgcctccctactcccactgctgcctactcccactgcctccctactcccactgcctccctactcccactgcctccctactcccactgcctccctactcccactgcctccctactcccactacctccctactcccactgcctccctactcccactacctccctacttccactgctgcctactcccactacctccctactcccactgctgcctactcccactgtctgcctactcccactgcctccctactcccactgcctccctactcccactacctccctactcccactgcctccctactcccactgcctccctactcccactgcctccctactcccactgcctccctactcccactgcctccctactcccactgcctccctactcccactgcctccctactcccactacctccctactcccactgcctccctactcccactgtctccctactcccactgctgccttactcccactgcctccctactcccactgcctccctactcccactgctgcctactcccactgcctccctactcccactgcctccctactcccactgctgcctactcccactgcctccctactcccactgcctccctactcccactgctgcctactcccactgcctccctactcccaatgcctccctactcccactgctgcctactcccactgcctccctactcccactgcctccctactcccactgctgcctactcccactgcctccctactcccactgctgcctactcccgctgctgcctacttccactgctgcctactcccactgctgcctactcccactgcctccctactcccactgcctccctactcccactgctgcctactcccactgcctccctactcccactgcctccctactcccactgctgcctactcccactgcctccctactcccactacctccctacttccactgctgcctactcccactgcctccctactcccactgcctccctactcccactgcctccctactcccactgctgcctactcccactgcctccctactcccactgctgccttactcccactgcctccctacttccactgcctgctaaccctgagcatttctcaagctgttctccatttcaactgtagacaaaaagagtctctgtaaaatatgtgaagagattgattctgagccaaatgtgaatgaccatggcccatgacacagccctcaggagatactgagagcacgtgcccaaggtggtcagggtgcatcttggttttatacatttttttgggagacgtgagacatcaatcaaatacttttaaggtgtacattggttcagtccagaaagctcttcccaagtgtggacaatccatttcaaagttgctctatacaactgtccagaatagacctgttctttgagggaaaggcttagagaggagccaaagcactgattctctgaaaaccatttgtctcctgtttctgaaagaccagatagaacctgtggctctttctaaacattggcttgccacatgcctgaaccttccagggagcaccaactcgactttttaagggagaac

SEQ ID NO: 473031 - DNA, 939 bp, Homo sapiens
gtaacactcaaccgtgagggtccgcggattcattcttgaagtcaaaccatagtgtggaaccggcctggtgagatggctgctgccatggccatatccaggacgatattccctctaagcgagctgctcctccaactgcagaaacacgtccccctgctgcacagaacactcttcactcagagagctgcgtggctccctccctgggccaatttccacacttatcccaaaggtgaagatgtagctcatcaaggcacctggtataaacagcctgatcttcatgattttaccctcaccgggtcttccgaacctccctcctgtttaaatgccccaaagtcactcacctgtgaggcagtgacatgtgccaggccgtatgccaaatgccagacagacaaagatgaaacagggaaagaggaaaaaaaatctcactacctctcaccagagcagtctctggaaatggagaacaggaaccaggtaaagctgtcgattttgcgggattctgaagtgatgggatgcagatgcaagaacacagaactacaggagaattttacaaaatctgctatctgtattgttgttgactgtgctatgaaaggaaattagatgctatgggcctctggaaagaaagaactatgttttaaatttttcatattccctagaggatttagcataaaactttgatattctgaatattagatatatattgttatcagattgaacggaatctgattggtatgaataagtgtgtttgcgtaagtgtgtgtgtgtgtgcgcgcattacagaaggcttgtaaggagcaattatgaaaacttacatgaaaagtctcaaaatatacagcttcgtgtacattttatggcaataaaggaccgtgacttctcatcattctctaccatgagccttccagtcaagtgagatcagctgtgtcattttacccaagtaaagcactt

SEQ ID NO: 473032 - DNA, 687 bp, Homo sapiens
tctctggcttcaaaaggaaaaggaacaggaacaggatactctctgttgggactcctgctctgagcgggaactatgctgatgcctgttcaagttgttccctgggtattttggcttcttgccctgcctgacagctgcaggagttctgtaagaaatctgagggagaatttcctttgcaaccatgactgagaacccaggatcaagagctttgcagacagaaaagacattacccttcgaatatcccaagccatctattagggtcagcaagcagccggcaaaaagcggggcagctggtggtccagccctgggtggagaaagtggattccatcgggaaacagccaggttcattggattggatgttgggagtcgaggagaaggaggactcaaggacgtcaagttgagcaaccgatggtgccatttatggagaggaaggccagggtcaagagaatctaaaaaatgtcattttgccattgtaaatttgagttgtgtttggatgcaggagtctgaaactcagaggagaggtgcaggttctgagctggtggacccaggatgtgctggctccatgaatggaagtacatacgtctcccctccctaaatgaagatgtgtagtacaaccactgactatggtgattagttgaatacattaatacattagaagaggagtgtctggagggcagggagcctcttttc

SEQ ID NO: 473033 - DNA, 1302 bp, Homo sapiens
gcagggctttgattccaaagcgggcactggggaaaccagaggagccttatagttctgccaaggcaccatgttgactcatgaggcagaccctcaggtgtacacaggtggctggagcctccctgcaaaggcccagccgcaggaagagcacagcacattcccatccctgctccgcgttcagggttctggcacggcctttccctgtggatatgggaaacgcagtgggacagcagtaggcccttgcgaggactcccggggagccagaagcatctgggacgtgggctctgctggctgccctcgggtgctacagcggcagcagctccccttcctgcgccccgccctgcaggcaccgcgcgctgccttcttccctttggtttccgcggtggggactcccggcgtccctgttgtgcgggtggagaagcgggagcgcagagacatgaggaaggctcaggaagcttcctttgcttgtcactgcttctctgtagccaagggtgcccttgacctcagggactcagagcgaatcctggagagtcacagctccctgctggcagttgaaagagactccaaacaccattctgctgcagccctggctcctaatgtgatatagatcccggtagtactgattagaggaaggactcatcttaattcctcccattaaaactttttctaatgtttctaatctcgatgctgaaataaatgagccttcgccatgttaaattggaggagaggaaatcatctcaacgtatttattcaattaacttttcattctctcatactccaaaactagcagaatgtttacatcctgacatctgaggacataagaccttctcatcttaatttctctcaatcatagcagatttttacattctcttcctaatacaaatacgttcatgagttacagctgctgattttataattaccaacgaattgcttttggatgcaaggagacattttcttaaagtcacagcatttagaacagtcaactgaccagaattttaacaaggtggtattataggtacacattggtttatataactaaaacaacaaacttagattttagatattttcccttaaaatgaatccagctttcaactgctttagaagaatttgttaatattttcattataaatatacaaacttgtatataaagaaagccctaactaaagccaaagactccagttgagaaaaactaagtaattggatatattttaatacataaaatgttacacttgttaaatgttactgaccatagctttctcatccctgcttatgatccttgttggcttttattttctaacattcttt

SEQ ID NO: 473034 - DNA, 522 bp, Homo sapiens
gagtgctcacggatgtgtgagcaggcacctgccaattaatctgtctatctggttctaatgaagaatgataagggtcctgagaggctggatattcatgagtcaatcattagttcctggaatttctctaacttctctaaaggactgatacaaagtaatgagtggaagcctgagaatgttccagaatctgacaaagacgaagcaggagttcatgatgagaacgacagtgtgaaatacactaagcttcctgccacgcaaattaaaggctttgctctaagaacagcaaaggccatttcctgcaagagcaacttccagcaggttctctgtgcccggattcagcatgcagagcaaactgcccacagggggcagaggcactggcgggggaaattttatatgattactggggtggagacagactctcagcagctcagcgccctgccaggcccactgagcaaccaccccttgtttcggagcaaggctttccacagcagtggtattcttctctttgtctgagttgtaaaatgt

SEQ ID NO: 473035 - DNA, 1277 bp, Homo sapiens
ggaagctgtcctctgagataatctccatggatgcactgactgtgaacatgcagaagtccacccagccgtattctggagtagcgccctatgtgacagctgtaggcactacagaaatgtggccaaggtttgcagggtctgggatagtcatagttgtaaacattgccatcaacatctccatcatcatcatcgtcatcatcatcatcatcatcatcatcatcattgctaacattcgctgggcatgcactcacactgcattccagacattgcactatggcctctcatggcagagtctggaggctgaagaaggtccagaggggaccgcgcagggcaaccggccaggcttcctgggaagtcagtgctggaaacaggagactgtgctcggcttggtgaagcagctccgagcctgtgatttgtctgtagacagctcggttcgggctgcgtggccctggcaggagagcatgcggcaggcgagcctccggccgcagagatgccgggctctgtgcgagacctccccaccgaagctgcgggaagccggcggtgcaccatctgcagtggagcaggtcagagtgggcctgctgaggctcctgtcactgctgcggttaatgctgccgattaccatggacacagggctccccccacactgccctctgcaacaggtgtgccgcccccacactgccctctgcagcaggtgtgccgcccccacactgccctctgcagcaggtgtgccgcccccacactgccctctgcagcaggtgtgccccccccacactgccctctgcagcaggtgtgccgcccccacactgccctctgcagcaggtgtgccccccccacactgccctctgcagcaggtgtgccgcccccacactgccctctgcagcagggctctgaatcccaagtctccttggccaccaagctgctctctgaggaccgcctgcttcctcactggccctctggtctccacgcaccctctccttatcgcccatacttacacagcagcccgtgttaatggcaagagagaaggcggagggtgtggcctgcacacctgtgatgcattgcctgttcccggccattggcgggctgccgggtgagatgaactgtttgattctgaaaaccatggccactgaagtctctgcttttaaagttctgctgtcagacttttatactttctctacgtcgagggctgttgttcaccctcttatcgtcatgcttcctcttggcttggagaaagccgtggagcaaatgctgttcccgtgttgggggcagggagcctggagaga

SEQ ID NO: 473036 - DNA, 607 bp, Homo sapiens
agacggttctttacttaaacctcatgaaccaacctctgttagcttctagcttttctgctggagcttccttacctctgttagccttcaaagaattgaacaggggtagagagggtgccaatgaacacagtgctccaaaggggggtggtcagggtgccacagtgcaggctgctggtgcccactgccagaggaccttctcgcccctgctggatgcactcgcgctgcctcctccatgctgcccccgtgcttgtcttacctctgcatgccaattcctctcagctgggcccactctgcctctgagagagctgctctccatggggctcttggatgctaccggagaggctcatgtctgtgttggggatcctgccagcttgggctccaggccaagcccagacctgctgtgcagtggtgctggggctatgggcaagggctttcttattctcccacaggaacacctggcccactaggtatgtttccgatcggtgactacagatgacagttttgcagcactacttccactactccaattctcccctccactcattgtttcagtgctgcgacacacaacgctgcgacgcacaagccactgtccctccagcctccggcagcc

SEQ ID NO: 473037 - DNA, 579 bp, Homo sapiens
tttttaaacagctgcatggcgttgcatcatatgcctgtttccttccctcccctttggttgtaagatggcagagcctggcacagagccaaaagcacccacgggtacaatgggactttgtctacatccggagagagtgcccacaagcctggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcgaccactgttgtatcaaaagccctttgttgtatctgttggtggcggaggcagccagcggttaactgaggttctactgagctctgtggaccacagagttgtcttctcaagtttgcttctagggacaaattagtgactttatgatgtcaatctgtcccaagtccatggccaaagagaaaaaaataatgctgaaaaagtcaaaattcttagaattcttagagaattataaaactgcat

SEQ ID NO: 473038 - DNA, 649 bp, Homo sapiens
gtgtgtaaatgagtgagaatggggcccagccattgcgcacagccagacaggctagctgctgcagagggcaggcagctccagatgccaacacaggtgatggctctgtgcaaggctgcagctggaccagatgtgctacatacagcttctgctgcaggcatccatatctggacaagggaaatgcagtctgtgctccatgaaaggctacaactcgtctgtccccattgcctacgatgtggaagaacaaagtacacggacaactggagggtgagcaaggtagagaggagcttcattgagcagttgaacagttcccaggagacatacaaaggacagctcctttccacaggcaggtcatccgtacaagtgtgcagctcacagccaagacgagagccagagtgggtagctccttcccacaggcagccaccggaactgtaagaaatatgtctctattctttataaattacctaggttcagacttcttttgtgatctaacatatggcctatccttgagaatcatccatgtgcttagtaaaagaatgtgttttctgtatcccttgaatgaaacgttctgtaatatatattcgatccatttggtctgtagtgcagattaagtacaatgtttctttgttgatttttcatctggaagatctgt

SEQ ID NO: 473039 - DNA, 563 bp, Homo sapiens
cctcctcatgttccgtttagtaagatggctccaccaaagccatatagtgctgctgagtgcccaggaagaagagaaaatagatttaatgaggagatggataataaagagagaacatatacattaaacaatgagttctcacagcacaatagagggactgtgattatgaaaacagttggaagtgtaggccacaaacaggaagcagtacatctgtcctcaaactctggaggacaaggaccagagaattttgctaaaattaggcagttatttggagggagtaagaagtttgaaaattcatacctggaagactacactttggagatgggaaagttcagagcattgaatacctacatcagaaagtctgaaagagcacaaagagacaatctaaggtcacacctcaagaaaatagagaaacaagaacaaactaaacccaaccccagcagaagaaaagaaatatcaaagatcagagctgaactaaataaaattgaaaaaaaaaaaactacaaaagatatatgaaacaaaacctggttctttgaaaatataaataaaattgatagatgattagc

SEQ ID NO: 473040 - DNA, 835 bp, Homo sapiens
agggaggctctggcggtgcagggtcggggaggggggctcaggcatggcgggctgcagcactgtcgggccggcactgctgggggggccggcactgctgggggacccggcgcactctccgcagctgctggcgccggtgctaagcccctcactgcccgaggccagcggcgcaggccggctgctccgagtccggggcccagactgggtttcaacatgttgtccaggatggtctcaatctcttgaccttgtgatcacccgcctttacctcccaaagtgctgggattacaggcatgagccactgtgcccgacccagttgtgtttttttaaatggtccttagaagaaatcaactttgcaaaaattcttagacttctaatttccagagtagaaaaaatatttttaaactccagaatggaaaataaatttctatgtttaagccactcagcctgtgctatcttcctacatcagcccaagcaaatgttagtgttgctaaatgcagtgcttgtagaggtgactgtagaaaaacagaaactcaagaggggcaaggaagcaaacatgatgaatgaggggtcctgcattgcattatctggatgtgatgatctgcttactcctccaaattcttcaagcccctacccattactcagttccaaagctgcttccgtattttcagaaaagatacttatatgattttgattatttttaaaatgtttgagactagttttgtggcctaacaaaatttgtaactactataaaaaagacaaaaaaataagaaatactgggaggaacatggagaaaaatggtatgcatatgttgttattgggaatgtaaattagtacagcc

SEQ ID NO: 473041 - DNA, 584 bp, Homo sapiens
catctgcctagatttcagaggatgtatggaaatgcctggatgtccaggcagaggggaggagccctcatggagaccatctgctagggcagtgtggaagggaaatgtggtgttggagcctcaacaaagagtccccactgggcactgcctagtggagctgtgtgaagaggggcaccactctccagaccccagaattgtagatcctctgacagcttgcaccatgtgttctggaaaagctgcagagtctcatttccagcctgtgaaagtagctggaagtgagtctttgttctgcaaagccacaggggtggaggtgcataaagtcaaggagcctgaagaagacgctatgaagattagccttccagagcacaaggcaggtcagagaattgtggagagtgggaaaaatggccccatagggctggagctattgagagtattgatcattgtaaataatggaggatgctaaatccttcagctaccattttcttgcagactgggagataaagttggtgtcttttcagttcttcagaagcatacccccaaattacttctccttagactatttttaaaaatattcatttcattttatc

SEQ ID NO: 473042 - DNA, 526 bp, Homo sapiens
caactccttgtgcttcccagagattgcaatgcagtggccgtgcactaagtctggtgtcagaaaggcattttctgagctcacatatggagtaacagaatcgattaaggaactactccctccaggaagctgccctgatccaatgaccatgggtgtatttctgttctgctccaaacaaggcaatgatgtgaccttgcccctgactctaaagctccattctagaaactttcagtatcctggtcctgactttattgggccactgatacaagaaaagcagcaacgcagattggcaggtcgagaaataatagacacacacaagatagtgaaagctgggtccaggggagtcacctccttctggtcctgcaatgccgccaatgcactggatacaccagcatttattattaagtttagtgagggcgggggtagaaacacagtctttccataacctatgattagtaagatattaatcagcagtaacagttgcagcaaacaatcaatagaaacaggacatgaagctggacaaccggtt

SEQ ID NO: 473043 - DNA, 856 bp, Homo sapiens
tttcttaggtcctattcatggccaggagctggaatctacttgatgctctatactactgcagctgttttgttctggcactcaagctgcaagacggtttttcccattctttattctcctttcctgaagcagagggagtttctccccatggccatcactgtcccaggcccatggaagatgggagaaagtttggaacttcctagagtcttgttaaatggctttgaccaatatgctgatagtgatttgcaaaaggtagttcaggttgaggtggtctcagatggagatgaggaactttttgggaatgaggcagaaattccccctggaggactgcctagtggagctctgagaagagggccactgtcctccagaccccagaatggtagatccactgatggcttgcaccatgcacctggaaaagtcacaggcactcaatgccagcctgtgaaggcagccaagagggggactgtacccagcaaacccacagagatggagctgcccacggctgtggaaccccacctcttgcatcagtgtgacctggatgttgtaactgagaaatacagaaaataacaaacaatgaaagaaaaccaatgaatctgacctattttattaaaatgtaaatatatatttgaaaatgacattacaaaatgcactttatttaattgcaagacaatccgtgagcacttacaggaaattttctcaagtgaaagaatgcaatatcacaattgattaaattgttgtaaatatacatatgatttttctggagcaactgtgataattgaaaccttttagcattacactaaattaatttggaaagaatgattttacagatatgaagataatttatttcaaagtgggaata

SEQ ID NO: 473044 - DNA, 921 bp, Homo sapiens
acctgggaggcggagcttgcagtgagccgagatggcgctgctgcactccagcctggatgtttcccagagattctggtatggatggaggggtcaagatggcccaatagaaacagctccggtctgcagttcccagcgggaccaatgcagaaggcgtgtgatttctgcatttccaactgaggtacccagttcatctccttgggactggtttggcagtgggtgcaacccatggagagtgagcagaagcagggtggggcatcggttacccgggaagtgcaaggagcgggacggggagcacctccctcccccagccaagggaagtggtgagagactgcgctacccgtcctgggtactatgctttttccacggatttttgcaatccacagttcaggagattccctcgtgggcctacaccaccagggccctgcgtttcaagcacaaaactgggcagctgtttgggcatgctcctccactggtgatacccaggcaaacagggtctggagtggaccaccaggaaactgcagcagacctgcagaagtatgacctggctgttagaagaaaaactaacaaacagaaacagcagcaacaacaatgtcaacataaaagtttatatttttatttaatcatttattctggcatgtcttagatgtgaaaactgtgacgacaataatattcaaattgaaaaattcttttgtgtgagtgcgggattgttataggaaaggcatacatatagactctaatataatttgacaaaaagcaaagtcattatttgacaacttaaggcaaaaggaaggtgaactagctaaagctggagaatttaatgccggtaaagaatggtttgataattttaaaaagaagtttagttttaaaattatcaagataacaggagaagcatattctgctgaccaagaggcagcagaagag

SEQ ID NO: 473045 - DNA, 2661 bp, Homo sapiens
cctttctgctttggctgtgatttcaggcccctcagctccaggtatgttggagtttgctggaggtccactccagaccctgtttgcctgggtatcaccagtggaggctgcagaacagcaaacattgctgcctgatccttcctctggaagctttgtcccagaggggtacccacctgcagggatgtttaagtctgcagaagctgtctgctgccttttgttcagatatgccctgcccccagaggtggaatctagagaggcagtaggccttgctgagctgcagggtactctgcccagttcaagtttccctaccactttgtttacaccctccagcatcccaggtcgatctcagactgctgtgctagcagcgagcaaggctccaggggcatgggacctgcggagccagccgtgggagggaatgtcctggtctgctggttgtgaagaccatgggaaaagtgtagtatttgggcagtagtgtaccgttcctccagttacagtctttcacagcttcccttggttaggaaagggaaattcactgacaccttgcacttcctaggaggaaaatttgtacacagacactcatggaaaggaggatgtcacgtgagaagacactatgtgatggtggaagcaaagaacattgagggttgctagtatagtaagtcagcagaagctaggaagaggcaaagaaggattttcccctacagatttcaaagagatagccctattaacacctagatttcatatttctagctttcagaactatgagaaaataaacttatgttgttttaagctacccagtttgtggtactttgttaatcagtgctagaaaaccaatacggaactctttaatgggcctaaaaatattgttgtccatgaaagaggtttgattatcaattgcttaaataagtcaacttaagtgattagttacattctgaatctaagagattttgatagttaaataatttgtaataaatacttattaattgccttctacacataagttactgaataacacagacactctctgtggctcattaaatttatcagccaacatgggattcttggacttggttaaaatgaggggttggggaacgaaaattcactcttgtattctttagtattaaggtagaaaattattattgaaaattgaattattttggagtacatgaacctatttatcttctgaagacactttgaattttggtcatagatgcttagagcacatctggcataaaagataagtgaaatgataaatcattagacaaactgcaaagggtcacaatggagcatgtgcccatggatgaatttgaggactgtaccctggggagtgtggagacatgtttggcctgctgctttaatttgtctgtacatgatttgataagaaaacaaaaggatatgggaagcttgcttgtctaagtgtgccaaggctgcaatcaagcccttcacccattctttcaagctgccacctttgtgacagctgcagatgcagaagagctggctgctgtgccaaggtaaaaagggcacagcagccagaaaaaaaatatgaactacaagaatgtaaaccacagatgctgggttggaagaatacacagagatgcaaaaaagagaaacaaaaaacaaacaaaagcacaaaatattcctagaaagcaaaaattaaaactcaccctcttacatatctagataagcaatgcttatgacttaaaatatactactggtggttaatacaaatattactgtgaattgtatgctaatgatatagaaacccaaatatgatggaaattgaatttagaggagaaaagtctgtcacttgtgaggcaaaatagtttcccaaggcacataataaatttgaagcagggctgaaattataacctgcattttgtaattcttagttaattatattttcactgaaacatgctgcctttctcccatcatcataacatttgtctatatcaacaatatgactcatattagtatcattaagaaaatgctgctgttaggtgtgttgtttaataaatttaaatttttacttgatatttctttttttttaacatcaaagcatacaaattttaatataaagaagataagtaaccaattaggacatctgaattattcatgaatcaccccccaactcagctataaagttttcttttttttttaaattatactttaagttctagggtacatgtgcacaacgtgcaggtatctaagtcaatacatcatctgctctttcttctccagaaatttgtcaatgtttctattctgctgatagcactacttcttattatggacttattattttgttattaatattttaatatattttgcatatattaactttctcttcagttctattttgtgaaggagaaagggaatcttcactcaattacatatgtaatgagtgctatatttagaattgacatcttgattcattgttactgtttttggactttcattctttttgtctttatatatatattttttattacactttaagttctagggtacatgtgcacaacctgcagttaaaaggggcactgaatgcctactgacaattcatatatgcaggatttcacctaaatagagtatttgttagccaaataataaaagtctctaagtttcagaactatttattgaaatattatattggcgggatcagtgtttctggaa

SEQ ID NO: 473046 - DNA, 500 bp, Homo sapiens
acatcaaagaccaaaggtagataaaaccacaaagatggggagaaaccagagcaaaaaagctgaaaattctaaaaatcagagtgcctcttcccctgcaaaggatcacaggtcctcaccaggaatggaacaaagctggatggagaatgactttgatgagttgacagaagtaggcttcagaaggttggaagccaaaaaccttgaaaaaagattagataaatggctaactagagtaaatagtatagagaagaccttaaatgacctgatggagctgaaaaccatggcacgagaacttcattacacatggacaagcttcaatagccaattcgatcaagtggaagaaagggtatcagtgattgaagatcaaattaatgaaataaagcaagaaaacaaggttagagaaaaaagagttaaaaagaaacgaacaaagccttccagaaatatgggactatgtgaaaagaaaatctacgtttgattggtgtacctgaaagtgatggggagaa

SEQ ID NO: 473047 - DNA, 569 bp, Homo sapiens
tatgataagatagtattcctcggtgtgagaacagactaatagcatggatcatcataaagttcttcattttccttgtcttcacattgagtggactgaaaaggaggaggaagaggaggggcatgtcaagcaagccaatccttgggttccagtggtgacagcagcagtccaagcatccctgtccttgggccccatggtagtatacactggcactggtgttagtgggttcaggtcagctgattattgggccaccaggaggattccttgggtgttggcagtcacagcagtgagccaagtgggtgggagggtccttggacccctgggcatcaagtatggcctgggtgatggcagtagcagtggcaggacaatatctggctatcctggtgttggtgcttggaccctgtgtgagcttcctctcagaatgaatactgtgggaagtctccaggcagctccctatgttagtctcaggggctgcttgagttgaatggctcagggtccgggctaggatttcaggagtccatggtaagaaggtggacctgccgggggtttctcattcacccttttcccacatt

SEQ ID NO: 473048 - DNA, 3688 bp, Homo sapiens
tttccgatctcaaactaacccgtaatggagctggcaatcggagaggctgcaggggaggaggaagacccagccagctccagggtgcaggattctgcccttccacccgagagcctcccccggtgtcccagtggcagtggctgccccgggctgcggtcgcagagtaagcaggggctccagtcctcggtccgcgcgccctgccccttgggctcagctgcgagccaccgccggcgtgcgcacccacaaggagagaaatggagatctcctggcgagtattttaaaacaggactctgcgctagatcagctcgcccgtcggcagctggacaaatcatttgccttgcggaacttggccctccaatttttttccgagcaaagactgtcaattctcactggaagaagcaaaatgtggcttctgttgccatcgaggtgattcaagaatgtatttctcagttatgaggaatcttttaggttacattattggcatacttctctggagcacaaataaactctaaaaagaaacctggtgcccaaagtaaccttagacagacttctaggttgccagtttagcacacataaaaaactcatgtgtgtgtacacatgtacaatggttacagccacaaagccaagttgttaccagtatgcatatattttatacataatatatctttaaacataaacctaatacatacatatatacatgtgtagctgcacttgtgcaactcaacagtttttagtgcaaacagaatcttagtaatggaggtaaataaagaatgaataagaggtaaaaatggatatagaagtaaaacacaagacatgggggtataaataaattaaaactaagttctgaaaagtgacttttagtaatagaaacctaaaaacatttcatagaaggcaagaacaaagtctgacaacagagtttagttttagtggacattgtggtagtaaatatgtaagttacttctctcttcagaatacaacagatctcactgggccttccagggtcattattcctagaaataatcccactaaatgcccatcttagcaacgcacatttccatgtgtgagttatttctctctcagccccatttaaaaatgtgaaatttggatttagaaggggacatgtatttaaggaagagaagtgccacacaaataatggagcaattttaccatgaaattaatgtcatgaaaatagatatttctataaatacctcttgtttttattattaagacaatgcagacataaaacacttcatactgtagtttctacattgcagccaaaccacttatcaatggccaataaattacttcactcctatgatagatacaaatgctcgattcaagttcaattaatagaatagtgtcaggatatcatgcagacagcttgcataaatactcgaggaataatagcataccttcagtagattctgtgatttttaagcatgaaaactttgtcttattccaaatttcaaaagatggaataaagaatgttttcatataaaatacatttggaacagttttccttcttaaaaaaaaaggcatctaacccacttgcaacatatactggcaattcatctttgtagttacaaaatcagatagatatatattctttttcatctcatgtgactgtatgtgaacatttcagtaattccaacaatatcaaacagctaaattcaaaatcatataatactttctaataagtgtatacgatatatatcttttgtagccaaaggcagaaagaccttcagttagttgatttcatgtttgggcactagtttatattttatcagataattaaaagtcattagttatttcacagtataaaatattgaatcaattaccaacaggcttttattttctgctcctaatttcgaaatgtatttggactcgaggtatgggaataatgtcactgcttatcaaacaattttctggaaatcttaatgcacaaaaatttccagatttatatattcaaaaataaattatatgttaaatgaaattaagaaaaaaaggcgaggggaaggagaaaatctagtttatattctgtgtgaatagctttcaatatcttccaggtgggggcaaccgtaagccacttttgagagaagggagaacaggctctttaagctccctgagtctagttacagaagacttcctggcagtaacaccgtgaataaaacaaccacaagcttccaggagatgagacttctaggctctgctccagacaacacccggccatgggcaacagggcccaccgccctgggcgcgccgcagcctcggccactccgagtcggctccgatcgcgcacgcgcgccgtgcacctgccccatcgcgcccagctgctgcctgagctccgggcacgcccgcgctgtgccggcggggagtgtccgtcactctcagcgctcaggatctctccctttccaggaccgctaggaagcaggaaatccttttcctctcacgtttacatcccattcattcttcctccgggcaattcaagtccattcacagccgccacagatgcacgtgtgcacgcgcgcagctgcacctttaaagaaactctcaagtcctggcggccagaaaaccagctttcaggcggggcggtggggctccccctccccttgcttcgtctctgcagatctttgtgctctagggagggatggccgcacattctgacgaggacgagggtggtgcataacgcggaggtcaattttgcacagtccaggcaaaagagaccccccccccccaccaacatcccttcctgttcagtttccctctctggcccagcgcgaagggcgaggggcgacagaagcccgagggacagaaaaccgaggctcctcagtggccgagttgggagagagtgtgagtccaggagagcccgggggcagcagggagagggtgcagaagctcgagcgcaccgagccagaggccccctcttctcccgccacgcggggctggaggtgcaggcgccggttccgcggcgtggcccggctatgtgtcgctcctccgcgcgccgcccgccgcagcccgtgccctcgggccgccgccgccgccgctgccccccgtcgagcccgcggccgcaccctcgggccgatacttgagccagcagatgacccaggtgacaacgaccgagaagagtgccaggatgctggccaccgacaggcagatgggccccacgggcgagggcgagggcgacccggtggccggtgcctcgccagggggcgccccgcctccgggggttcccccgccgccgtagtggttgacgaagatgaggccggtgaagagcagcaccaccatggagaggaaggagaagaccacgcacacgcagccagcgtttctctgcagaagacagcaagatgccccagggaatgtttgtgaaaaaggatgactggatgggaagcaagctgaagaaaaagaaggaaagaaagagagaaatcagtaaatcaccacacaagaggtggagaagaggacttataaatattgtttctatgacatttgaaaataaatgttttactccatgctaatagtgaatgtgatgtcttcagtttgaagggctttaagtgaagctcattaaaacccactattttccatttcctagtttttaattttgtaattattacttggggtaataacattctttcaattttttaagcatttcacttagtgatggggtggtgatcagagagggtgggttgaggggaca

SEQ ID NO: 473049 - DNA, 1912 bp, Homo sapiens
ctcctcatctgcagcctctacaggtagcacgtctgtttcagccctcttgcctcaaagcccatcaagcaggatgagacccttaatgaatgagggagaaagtggtttcaggacatacctgacccgcagctcaaaaaactggactggattcatccgtagaactgcttcagattatgaaaaaacgaaaccttttcaagtgggagataaagtaatgggaagtggctggagaaaggtaggaatgcagacagtaaaacagcacagagtgactctgattaagatcttggggaatctgagacatcaggttctgttttaccatgccctccacctagtgcctccttccctctctgcccatgatttagttctggcactttccagtaactgctgtcgtgaagtagacctggcccagttcactttccatctcttatccttgaaggtttatggaggtagggttgtcactcacagctccaatggtgatttctatcagaggcagagagaatggggatactacctcctcaatgacaaccattcaatctgattccttcgtctggatccaaatgactaatagagtagcttgcactcattggttcattgtatgtgacactacatgcaatatacaaaattatgaaaattaacacagtggtatgtgttttacaccaagaaatacaacagtaggacttcagtactcctggaaatatatctttttttgtgcttcttgctagtacattacttcagatgctaatgtaagaatgtgcttatttcaagagacagttttaaaacatagttacattttattactcctttaaaaatgcttctcaccaatcccatatcactgagaagtgtgttggtccaatgttttattgagtgcagcccttgtcctatttatgacccaggactgatgcaccagcctataaatgtgatttctctgaagcagtggaggacaagtatctagctgctgtgacaggaagacatgtaacacaataattttgctgctctaaaaatgcttctgttgccggcatcccagataggaagcaaggcttcccatggatcatgcatttgctggaaaagcacaccatgttttgaagaagctagttctaattggtgcgaaacattttgaattgctgaagttctaatggacttgaaaaaccccctggagaatcgaagaaagaacaaaatgatgtaatggtctttaaaagataaaaacggaatgaaaaaaatgctttaatttatttcagaaagatatgtcaacgcttagtttttgtggataaagttgccagataaacctttctcaatttgggggtgggaaatggagggtggagggggggagtagaattttgggcagaaagaggactagcaaacaattagtgccatctagtggttgtatagaataaagacagattgttttcgagaactgtactgtagtatcacagaaatgtacaagcaggctaaattacagttcttagattaggctggcttgagtttatatctccatatattcactaattaatgaacttcaagtgatgtggcaacagttgaaattagttttgatagttaagcctaaacagaaaagagttgcactctatatagaaaataagccctttgacatgttttaatttgtcatgtttcaacaaagtccaagttaaaactaccatgatatttcaaaaggaaaacctacatctatttcaaagtatgccagtgagagttttctgttacctggaaacaataaacacgttctaaagttaggctactgaactgaaggtctgctcaagaagagcaggacagaatccagtggtccagaaatttggatgggaaaaatttacatctttattttcactactctaaatctgaaatttagcatttccttcaatcaagaacgtcagctgcaaaccacggtagtgttagcaatacctgagatttc

SEQ ID NO: 473050 - DNA, 680 bp, Homo sapiens
gtccatctcctctgcttctaaagtactaccatcatcatgacaacatgaaatatcccacagctgctgtacagaggattgacaactgggagccagctgtgaggaggcttttgctgtgctccctgagaggtgatggctgcttggaccggatggtagtggaggtgatacgcagaggtcagattcaagacacattttggaagattatggggaaatcctctctgtcccatcaatgcccactccagcttcaaccatcatctcccacatgcaatcagatggtgccttgcctctggtccatcttgtgtgcctctgtcttctgccctgatgagtcttccctgggaacttgctctgcacgtgcacagatacagcctgcaggtgcaggaaatttactgtggccagggccacccttaaccagcggggagcaggagcctgtggatgaatgcttcccactcttattccctcgcaaacagttctgagatgcatcttttaagtctcctcagaaggtgtcagagggactgagcaccagtcacctctaatggcagccaaactaatatatcattctattttcttccctctttctctgttcacacctaccatcctttactcttgttcacattccaatatatacttcttcaagccagtctttcttttcttgccagaaggttacacttggccttcttaatgat

SEQ ID NO: 473051 - DNA, 823 bp, Homo sapiens
ctggatatccacttatacccttcctcctgggttttcatgtaaattccagggccaaacaacgtgacaagattgtctttcaaaaggtgtataattctccgctgcagaagacatggcatgctccagtccccaaagggtttatattggggttctcacactgggatgttccagactgcacaaagcatcttttctctctactgctgtttccagaaccattgcatttgttgagttgttttccccagtggcaggctgcttgcactgccttaggctgcttcagggccctttcctgctccaggccccactcaagatccaagctcttcatatttcccggtatatagataaagcagtaattccaggtgtggaatatgctgccccagaacccaaaaaggcctttcctttctgtgccttctttgttataacagggcacaatgcaatgagctgcttctactttggaatggatgtcctgaccactggatttctaaacattttacagatgtggcaggttctgattctttgcattctagcctatcatctgattgctattgatgaaccagattccgtagcaggttctcccactgtcagcccaggcctgcaggggacagccaccactcaccttcttagtgatgccggtgcctgctcaccagcacattccaagccaaataggtaaaataatactaatactaatagtcgtaataataataatgtgatcataatttagaaacacaaatcaaatcaaatctacatgaccaaaaacagtactttcaaaatgctgtgtttcttaaaacatttttcttcaattatttcaacaaatattttagcctctgcc

SEQ ID NO: 473052 - DNA, 1943 bp, Homo sapiens
aggtaaacaagcaaaggtgctggagaatgccgaaggtgccagaactaccccttcagttgtggcctttacagcagatggtgagcgacttgttggcatgccagtcaagcaacaggctgtcaccaacccaaacaatgcattctatgctaccaaatgtctcattgtccagctatcctgaagtacagaaagacattaaaaatattccctttaaaattgtctgtgcctccaatggtgatgcctgggttgaggctcatgggaaactgtattctccaagtcagatcggagcatttgtgtcgatgaagatgaaagagactgcagaaaattacttggggcacacagcaaaaaatgctgtgatcgcagtcccagcttatttcaatgacttgcagaggcaggccactaaagatgctggccagatatctggactgaatgtgcttcgggtgattaatgaacccacagctgctgctcttgcctatggtctagacaaatcaaaagacaaagtcattgctgtatatgatttaggtggtggaacttttgatatttctatcctggaatttcagaaaggagtattcgaggtgaaatccacaaatggggacactttcttaggtggggaagactttgaccaggccttgctacagcacattgtgaaggagttcaagagagagacgggggttgatttgaccaaagacaacgtggcatttcagagggtgtgggaagctgctgaaaaggctaaatgtgaactctcctcatctgtgcagactgacatcaatttgccctatcttacaatggattcttctggacccaagcatttgaatacaaagttgacccatgctcaatttgaagggattgtcactgatctaatcaggaggactatcgctccatgccaaaaagctatgcaagatgcagaagtcagcaagaagcccccaagtaaagctgtcaatcctgatgaggctgtggccattggagctgccattcagggagatgtgttggccggcgatgtcacagatgtgctgctccttgatgtcattcccctgtctctgggtattgaaactctgcgaggtgtctttaccaaacttattaataggaataccactattccaaccaagaagagccagcaggcatcattgaagctcttcaaaatggcatacaaaaagatggcaactgaacgagaaggctctggaagttctggcactggggaacaaaaggaagatcaaaaggaggaaaaacaaagaaacgacttctggctttatgagtgtgaagagcaacctgtctcccacaacacatgggatttcaagatgagatctgggtggggacacagccaaaccatattaccatggcacgttgtacataatactgtgatggcgttgatctcattccatcaacctacttgtcctgtccttccctcagagctcaatattgtacccaattgtcacacagtttcatcttgggatgaaaactctattggactcaccttcattcattcattcatttatatattaattctacaaacaactattgaatgtctgcaacatggattatactgtgtaggcattggggaccgaatggtcagcaaaaacagaaaaaatccctatgctaatgcagtgtagagtctagtgagaaagactggctttgatcaaatgatcactgttacctgtaaaattatgtcagttataagaattatgaagatttttgtgctatgagaatatgtagtaaagtattagcaggtcatggaacgtttccctgaaaaagtaaggctggttctaagatctgaaggacacataggacctaataagataaaagcaaagaaagaaaacctaacagtcaaagggaatgatatatacaaaggccgtaacacaggaaaaaaaaaaaaaaaggcaacttgctccttgaactgaaggccgctatggctggaacacagaaaactctgtgcagaaataatccccttactc

SEQ ID NO: 473053 - DNA, 647 bp, Homo sapiens
gttgtcgccggtcggcgtgatcctgaagtgtgtgtgttcgtttctcaggtaaaatatggctaaaagcttatggagtaagtggaaaagaaagatgcgtgctgaaaagagaaaaaagaatgccccagaggaggtcagcaggcttaaaagtattctcaaactagacgatgacgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctaaaggcaaagcgagagaaaagaaaggagaaaaacaaagcaaaagcagtgaaagtggcaaaggccttcttgcaggggaactatccatggatcctaaatgaagattgttcaaggaaacttacacagctggtacatgatggatcgggaatgcaaatccagatcttctgactctaaaatctatgtttgttctgttcctggaactgcctttgtaattgtccattcggaataaatgttctctcatctataccagcagtctccaaactttttaacaccagggacc

SEQ ID NO: 473054 - DNA, 599 bp, Homo sapiens
acggattgtctgtcaacccagagattttcattttcaacaaaagtatcaaatagtccctcgtactaacaactatagcataacatgacaaacaaaaatgcagaagcagcaaatgaaaaactggaggcttcaaaatctgccataacttcatgggtacagtcatttcttgaggcccatggatttttccaggccatctgtggaaatgacattcactctgcctccttccccacggtccgagggcgtgtgctggggacagataataccaggtctaataccttaaaaactcctacgaaatgttccacactcactctcttctctcattcctgcctggatgcagatggcttagtggaaaactgtgagtacctagaaaatagtggagttagatatcagaaccactacgtggaagaccactcaccacatgtccaattggatttcagtaatggatgctctttatatacagaaaccactttcattcttcttgtctataaacatctttgcataacttctttttaggccagtcctaattcacaaatgaaaacccattgctctgagttcactgtcaccatacagcctccttttaggttcctgaatattaaaaaagg

SEQ ID NO: 473055 - DNA, 4943 bp, Homo sapiens
ccacagtgttggacacatagtaggctttcaagattctgtgaactagtcaatatgcctttaataattttttctgctgaaattagccagggtaatttctgctgcgtatacttcagcatcttgatcaactcgcaaaggcaacacaacaccaagatcatgattagaaaagcagtgaaagagtttaagaacaacaaaactttcacaactctcgagtacctgcaggtcaaaattgaaaatgagacaatgactcaggttgctggcaatgagggtaagaccctgattgcagagaaagcaggcaagtctcccctctctctcttgctcctgttccaacaatatgaggtgttcactcccccttcatcttccgccgtgatcgtaggtttcctgaagccaccccagaagcagaagccactatgcttcctgtacagcctacagaatcatgacccaattaaaccttttttctttatccattacgcagtcttgggtctttctttatagcagtgcgagaacaagctaacacagtggatcatcaaaaactggtatcatattacaaaaagatgcagaacaaaaacccaacatgataagagtagcaatattggaattgtgtgattacacaatttctattttattctgtgtgctcttcagaattttccaatctttctacaatagatacacattgcttatggaaatgtctccctatcatactataaggcaaaatttaatgatatcaattccagtacatgtttagtatagaggtaaataactttcactttgtcatatagaaaacaaaatgatcttcagatctctgtcatttacatagttaggatggcacattggtggatgatctggtataatcttattagccaaatgttcctatgaaataagaaatgtaaataattagaaatgaagctagatgcatgagaagagtatcctgtataggggcagaaagtattaacggggtagaattggggtagaggagggtggtcagttgcattttgaagagccaatttctgtttaccatatgtttttcctgataagtaaataaacggtacagaaagttccttatacactccattttgccaggactttcctagtagcagtacatcaactttcgtcacattggcaagaaccacacccaggaaatttcagagttctttgaccttgagctcgtatatttcataagtgtctaaagctcttttgcaagtcaagcatctctagtcgctggaatcttgcacacacgcacacgatattttctaatcctctcctagaactttctttgaaataataacgtccaaataggtttctaaataggagaaatttgtgtgtgtgtgtgtctgtgtgtgtgtgggtgtcagataatgccatggcattgatgtctgaattacatagagcttaataaatatattaagtcaattaacttaacaaattccatgaatagaccattttttaaaaatatccccaagagaagacatttttactcacaatgaatatccagaagactgactgatagcaaaataattttcattataaacggaataaatatattttatagctaaaaacagtcaggagaatagaataagtacacctgattacaatattaaagataggctcagttgaaataaaaatgtactatatatagtagtgatataaaagaagcaaaacatgatttttataactttttcttttgaaaaatgcttgtgtaattactacaatgggcttaaatacacaaactaagctgacatcattgagttcattaatgactctcaaaaatactcaaactcattagtcatatttggaggatttttagaagccaatttactcttctgaaaactaatcaataaagggggagaattacttctgagccatctgtacattaagatagccaaataatcatgaagagaaagtccctctttacagataaattccaaggaataaatgcataaggaattatagaattaaaatatcactatttggcagcccagaataaaataaccgatctaggtgaaaacccttataatctgcaaaaacggttagatgaaacactgtgagaagcctctaatagatgaatcaaatttgcaatgcctgaatgcctgtttaatattaacatcacaaagagagaaagatactaactagacatggcaagctccccaggtgatacaaaatgaatttataactagctctgaagtatcgctgcctaaaaatgaaacctgagcttatctgagtctttagatcaaaccacaagtttatgggaaattaaagggcagaagaacatggcaaatgacaccacaagtctgtgaaaaacaaaatccagagtgtgggatttgattcaacataatacggatggaagtagtgggaattgaacaatgagaaccacatggacacaggaaggggaacatcacactctggggactgttgtggggttgggggaggggggagggatagcattaggagatatacctaatgccaaatgacgagttaatgggtgcagcacacctgcatggcacatgtatacatatgtaactaacctgcacattgtgcacatgtaccctaaaacttaaagtataataataataaaataaaaaataaaaaaatttaaaaaacctaaaaaaagaataaaataaaagtttacataaatagctatgtacaatgtaggcaataccaacaactgaatagatataacaatattttgatactaaaacagtttacctaaagactgtgatgcattcaatttttgctatttttttcataaataattgatgggataataataccttcttcaagaaagctttataaatattaaacgaggctttgtttgtaaagtgctttgcatagtgcttgatacctaaatacccaataaataaaaataaaaacaacaacaataataattgctgctactcttactgttactattagccaaagttctgtgctctgaagagatcatagtcacaatatgataacacctctaactttacctttagattaaatgaattatttgattatatatgccaaatcttatttccaaacaatgcaagtaaactaattgtgaacatactgaaagatatagctgtcagaatatttttgtagctttgtttacagaagcaaaatacaaatgaataaacagaaaacttgggtataatctatatttccaaaaacaacagaatgcttaaataagttttggtatatactgacaagaatgccatgcatttatggataataaagttagggaagaatatttgatgttgtatactacaactttactttgtaatataactttattttgtatgaatgcttggattcatggagatacacataaatgttaacaataattttcctttagtgacaagattatcctttttcatagaatttatttttagagcagttttaggttcacagcaatattgagcagaagattataaattataaagcagagatcatatcccttctgcttttcatctttgctgaacacattctagatattcaagaaatacttcttgattaaacctagcagatttttaattttttttaatttttttttgtttcaatatctttagaggtatacgtggtgtttggttacatggatgaattgaatagtggtatagtgaagtctgatatttcagtgcacctgttacccgagtggtgtacattgtacccagtagtctatcactctcattagttctaattatatttactttatatattagtaccttgttgtttggtgttggatgcatatatgtttacaattgctaatcttctttctgaatttacctctaatcatcatatagtgattttctttgtctcttcttacatttttgacttaaactctattttatctgacataagtataactactcttgttctcttttggtttccatttgcatggaatatcattttcccttccttcattttcagtctatgtgtgtctttacaggtgaattgagtttcttgtaggaagcatatacttaggtctttttttttataatcttttcagcccctctctatcttttaattggaaaatgtaagcaagttatatttaaggttatttttggtaggtaaggacttactcctcccatttcgttgttttctgggttttatttatatatatataatatataattttatttttatatatattattttatttttatatatattattattatataatattattttattataaaatttattatataataaataaatatttattataattaataaatgtataaattatatttattataattaataaatgtataaattatatttattattataaaattattgtaaaataaattatatttatttattacaaatatataaattataaatttatatatttatatataagtatatataaatatatttattactattttatataataatttattaataaattaattatattaattaatttaataaattaaattaatcaataatttaaataattagattaatttaattattaattattaataaatatatattaatatataatatataatattaaaataatgcattcttttaaatttatttaaaacaattaaattaatttaattatttaattaattaaatatttaattataattaaaaattaattatattatattaataaattaattatattaattatattaatttatttatatatttatttatatataaataaattatatttttataaaattattattaaaataaataattatatttattattaaataataaatatataaataaattataaataaataaattattattacataattttattatataaaaataatatataattttattatataaaaatgatatataattatatattattttatttttatatattattttataatatattaatatatattttatatatattttatatatatatataaaaccctttacctttcttcctctcttattgtttacctttgtgtatt

SEQ ID NO: 473056 - DNA, 634 bp, Homo sapiens
ctgggggtccccttgtccctttaatccaggcactgggggtccctttgtccccttaatccaggcatggctcttctgttgctgcaactagtgaatcaaattcaacaaaggctgcctgaagtcgtgctgtgtgctggtgccattctgatgactggagaggaaaaaatgaacagtatagacaggatttctgatctcacggagttcacattcggaataagaagacaggtgaaaaacttgtgggttaatgaaattgccagatgtgactgcttgccaaaatattgggatgctttcgttgtgagaaagtacaacaggttatgtggaaaagaaaataaagaagcagaggttactatttactacattctgtatggcaggcactgtactgaatgctttgaatatcttctctcattggaatcatttcaacaatatgaggtaggtgttataaaggcccgtgttattgatgaggacactgaggaagaagaagaagaagaagaagaagaagaagaagaagaagaagaagaagaagaagaagaagaatagcaaaaaccatacgtagcccacaaaacctaaatatttacaatttgatcctttatggaaaattttgctgatcctgctaggagatatagtagggacatctgta

SEQ ID NO: 473057 - DNA, 2078 bp, Homo sapiens
agtgggcagcttcatacactactcataacagtatgcaagattccactacaagattccagaacaaatctcagtcagctaaagtctggcagagaaagcagacaatctttgatctaaatgtcagtgatgtttgcaatggttttgaagaaaagattcccacaaaagagtttgggaacctcctggatctggaagatgaagaggagcgctgtttcctagaaacacaggctaaaacagctttgtcatgttttcattttcagccatatgggttggaagagaagactttgaactatcatcaggactatatgagggtcattatccaagaattaggaaccagaacaccaatggaagggggagtggacacttgtgcagctgtatcctgggttttagtggacactccagggccatatataagtcaggaagatgatgtgaaaaccagaagatccagaatcctacgacacctggtcgtgtctggctgcatccagcagggctttaagcacccagccaacttgcttggtcctgagtttattctttctaactgggagtgattatatagaacaaaagctctgagcatcgtattctctaagaggatttagggagagatctccggaggaagtcaatagtcctaggaagatatgtaacttcaaagctacctggcagctggaaagcccctaactcataataaaaagaggagggaggaggggacctttgcaaatgtcagaagaactaaagggagatgtgaaagcttcttgggaccactagtacatctgtctctccctagagttgcctgaaggtttttaaggctgttacattagatgttaacttttccccatggcattcagcagggcttctcttcggggtccgtttctagcaaccaccctttggaaatcactgggcactatgtatttacgtgagtctacttatacttccataccatatttttattgttattttaaaaaagaaatacaatttctcacttatattattttctccatgaagatggcgaacccactttgctcttaatgatacatgcacctttcatgactatatatgaaacatgattaaaacaaaattatatatataacatatgatttatatataaaatgtacgcatgatatgtatttaattttatatgcatttctgtattttacatgcatttaacatgtacatttgtatttaatttaacatgtttttaatttgctcctagaatttgttgccatctccgtacacttttaacttcagactgcaaatattatagtaaacaaaacaaaacaaaaacattgtctgaggaagaaaagctgctcgttatgctagatcttagtctttcaattatttaaaaatatttttagtactacttcacaggtaaagattttatgaaagaattatttttctgtcaaacatcctacgatgtaccctttttaaaaagaaaagcttttatttttccatgaaatgtcacccttgtttaaaaaacaagtgttttaatcattgtaaatttagccataacacagactttgttctttatttctaaaaagaagctacggctataaataaagggatttttgttgtaacagtaacatatcacaataatggtagttcacaataattattataaaaatggatagaaatcatttttttgagaatcaaatatctatttttttgtcatcttttataaacaccatctcatttaaggctcacaatgacatatagggcaagttatatttcccccatatacagaaaaacctccttaggctcaaagaggttaagtgacttgcctcagaagagttacagccagaaatcaaattgatgctttttttttttctgttatgccagggtagtgcttattagccaagcccctaaaacacagattacagatttacttttcaccctctgactacagattactgttgtcaactcgagcactttttcagattcccaactcttttgccaatcctttctactttggaataatagattgcattgtggaaatactttaaaattatgaaatacgttcgcatgcattttctctcatttctgtcaacatttgtagtcttattttacaaattagacactagcttatattataa

SEQ ID NO: 473058 - DNA, 1557 bp, Homo sapiens
actgacactctttaggaaactctccatggccatggtgctggtaattccaatgtccctgggtgcccccaaagcttcccaaactctagcattttggtcaaaaccattcaacaagtctgtaggaagttccaaactttcccacatcctcctttcttcttctgagccctccaaactgttccaacctctgcccgttacccagtttcaaggtcacttccacattttcgggtatctttataacagtgccccaaactcccggttgctgacctgcagccatccatgtgcgtggctgctttgggggagctgtggccgtggagctcagggctcccaacagctggcctttctccattgtgaaccggtaaatgctaaaacttttgctccattcccaggggaccccccattaaattcattttgtattcactacctgccaacaggacctgtaagcgagccaagaggagcagcagattaagcataattatgaattctgagtggaagggagtagtctgagattgtttttcatgaaagacctattttttttcctactgaaaattcacatagaggaagtactgaatgctccatggagtctttatatcgaaatgctctttgcaattaatgcttcttactccttgtgctttcatggaacagatagaaaacctctcaaacttgaaagctgttcttggaattggattttggtttgctcaggatttgtatctaattttctagagaagtattataatatttattaacaagaacgggtactaagtgtaaccctcaagtcatttcccaggcttagttgtcaatgagaagctaatccctaaggatttctaaaccagcacaactgagtaaggattcaaaggcctcttgcaggctgttcttgagtgcttaacgtgtagtcatcagtaacaagtcagtggtaccatttattcttttactctttccttcttcataaatgaaaaaaagagaatccaaaatattgagcataaaaatgtttgtagtgcctgcatactctatactcactcagtactatgaatgttacaatgtgctaacttttcctaatttgatataaaattatcaacacccttcctcatgtgttttcttcgtattgctgatatattttccttttttgaaatacttttatctgcatattagaaaagcattgaagtttgctactggaatagtctatccaaatagtctgtccaaataatctgtttacccatgataaattactatcatgttattaaaaagaacacctgtaaactgataacttgagagagtcaccaggacattctaagaagcacacattctgaaaggaggactgaaattgattgatgacatcaacgctgtaaataaattgaatttgctgtgaggattttcaataaatttccagagctattgaataatgaaagttagtgtctactgagcactggtaatacaggtaagcacttttgattttacttctgcttttatttcctcaatgacctaataagttagacaccatatgactagtacttctcagatgaggtaactaagggctagtattagtgttgatgccaaagtaatttc

SEQ ID NO: 473059 - DNA, 923 bp, Homo sapiens
cacagtctgagtgttggagacaggctggggtgataattctacatgctcctggggctgtggttctcttctagaggcagcccccttgtcggtggagcaggcctttcatttactccctttccagggtggttttcctgggtgacatgggcaccagtggaaatatgcataatgaaggtctcttttggctaccactctggccacagtattttgccccccaacacccctgcagaccttcctgtctatatgcacgaaagccaagagatttcacacagcttgactgaaacaaataccaagtcagacgagacctcagatctgagctgcataaatgcaacaccgtggaatgcagcagtaatctcttcaacaaaacggggatcagaaaaggaaaaggaaacctccacaatgcaaactggtccctgggagccaggactgattaatggacaattttatggctcatttgtgaaaaaggaaattctaacagagccctctgtttactttgctcctacaattcatatcaagaagacagaaagcagaaatgtgggagggtgagggcatttttagacctcactcaatagctcaactaaatagagcaaatagattatgggtttctgagcattaatgactctaaattacttgtggatttgttacaaataatgattgtcaggggatgacaaaatgctagcatattttccttctttgatagtataaactcaagttcaaatgcaacattggaagcttatgggtgggttccagttctttctttctctcccacagtgaccacttgttatcactctaatggcttattgatttatcaaggctggcatatttgtaaatgtgaatgtatgagcatttgtgcgcatgtgtatatgagtacatgtatgtaggtgtgtacttgagtgtgtaagcatgtttgtatatgttaagtcttc

SEQ ID NO: 473060 - DNA, 1580 bp, Homo sapiens
gttcccctgaagtccagccatctcccgctggattcttctccaaagttatgctgtcaagctgtccctctgaagtcaagacacttctctctgacatccagctacagaccccaacatccagatgcttctcctctctggcactgactcatggagctgtgagcagagggccgccatcctctggaccccagaatggtagatccacctacagtttgcactgtgcacctggaaaaactgcagacactgaacaccagcctgtgaaagcagccaggaaggggactataccctgtgaagccacaggggtggagctgcctaaggccatgggagctcacttcttgcatcagcttgacctggattctcagttatgtctttataagcagcatgaaaatggactaatacaccagccatatgaaactgtgagttcattaaacctctttttcattataaacgacccggtcttagaagaagacaggaaaatgtggaaaagtttggaacttcctagagatttgaagagctcagaagacaggaagatgtgggacagtttggaaattcctggagactttttgaatagctttgacaaaaatgctgataatgatatggacaataaagtccgggctgaggtggtctcagatggagatgaggaactggttgggaactgccgcaaaggtgacacttgttatgcaaagagactggcagcattttgctcccaccctagagatctgtggaactttgaacttaagaaagatgatttaggggcagtgcagaagggaaatgtgggattggagcccccacacagagtccccactggggcactgcctagtcgatctgtgagaagaggcccatcatcctttagaccccagaatggtagatccactgacagtttgcgctgtgtgcctggaaaagctgaagacactcaatgccaggccatgaaagcagcaaggaaaagggctgtaccccagagagccacaaggatggaactgcccaaggccgtgggagccaacctcttgcatcagcatgaaccagatgtgagacatggagtcaatggagatctttttggatctttaaggtttaatgactgccgtattcgatttcggacttgcatggagcctttaaaccctttttttccaccaatttctcccatttggaatgagtgtatttacccaatgcctgttcccccactgtatccaggaaatagtaatttgctgagaatacctggtgttacatggcctccattctatagtggaagaaaatttccattatgaagaggtgagagtgtgaagtaaagagccatgtctcaagagctcttaacacaaaattaattactatgcccccaccttataagtaatttctagtctaaagtctcctagcatctggagaaggctaggttaaacctttgttattaacaaaataactgaagcctcaggtgataaaatgattgatttagaacatacactgagtccaggtaaaagttaaagcctaaacctaatgctgttgagcggagctcagttaggggagaaaaatatattagcagctgaatgttagacagtgaagacaattcataaaaaggagatttggcatggctaagc

SEQ ID NO: 473061 - DNA, 3116 bp, Homo sapiens
cttccatggaaagcaagtttgacaagtttgatatttataccgggacccaagccaggcatgctgcagacacaagcccacaagcaaagcagagacatcgctggaggagaaaacggccatgcaacagttcgttgggagagaatgagggttatttcagcagctacctttgtgggtccccagaacatgactgatatctcagaggccacctggaaagatgacttgaagcccagattgtggctgcctttcccccatgcttctggccacaccttaaacactcaaaatttagagtccagtgatagtgaaatgatgatggaagacagtgaggaggaggggctggagggggagggctgtgagtgtgtcctgggaagcttatgcaagcagcatgggcagagatgccctggacagagatgctcttctcaaaatggaggagaaagttctcaaaagcttcacaggagatttgatatatgctccatacagctcccctatccctacagagaacctctgtagccaacttttaaaatgttatctctaatatataaggtttatggcaaaccagattccatccaaattgaaaatgttcgttagacattttacagccaataattccattatgataaatgtctcttctgtgctgtagagaaaggtttcttgcctttccagctagactaccttatattcccttgtgatacgtttcttatgtaacaagtttctgtgggcatgctcattgactgatcttctccagttcaactctatttctcacaaattacagacaactctacctgtttgaaatgaaaggaaagcacgaaggggaaagggagctgggcttattgacatggggtcacttaccccgttcccagatgactccaacctagattctgagctgcagtctgccttctggactcagcagacacaggcctgaagagagtggtcattcaaggcctacaaccctttcataaaaggggaggattcaatgatgataaggaaaaggaagggaatttagctcattataaacctatcacggtaacttgttaaagattttaactgcttcatatgttgtgtttttatactcttgacacatcctagtatcatcttattctacatatttctaccttctaagagagaaataagagagacaagtcatgcaagcaaattctcctttttatataataacttacctaggatgtccccttaaaactcctgttttccatgaaagcctgaagaatcctcttttaaacattcctggggagtattatatggcttccccttcctgttagatccatttctgcacccattagaataggtaaccagatgtgcctgtcacatatgaatgaggacaatttgtaaccaagagagaagaaggagaataaagcacagaaaacagttcccctattaatttgcacacatgcaggtcttgtccagatacctaaaaagcaatagtttcccttcctgaaatctccaaggctattgtggttgaccatgaggtcaggggaagggctaattgcaagagcagctgtcatcgacccagagagttagctgaagagtcaagtacaaaggcctactgatgctcaaaacattcctcaaagcactcactggagtctcaggactcagtgttaaggagattagtgatgggtgaaccacaaacatgtttaggcatgttttcccttcttatatttaacaatacggatagtcacttatatcctagatatatctaacctgattactatccaccagaaagttatgtctaaatttaatatttagcacaacaaaaaagccattttaaagtacttgagctgccaaattcaggacttagccttggttatagtaatataatcaagaatctccattatttcaatatggtcttagcaatgaatatccatagctatattatagttgtatttattctctaactgtacataaatagacaagactcttcgtcttaaattagctcaattctaaagatgaacaacataattacctcaaatgaaacagcactcacaaaggttacatcttgctgtaagtacacttgtacttaccctactcacaatggtatgtgtctgcaggataaatggatggtgacgcatatttgtatgtggcatttcaattgttttcatgtgtttgcaatgtgaatgaagcagtgtatctcttaaggttatctgaacagtatattttcacaaaaatcattacatttgtttaaagataattccaatgtgttcatcttaataaacttgaaatgattaatcatagatgttcataaccacatgcaattaacaaaaattaatctggttttcccttactgccaaataaaaattttgcttaaaaaaagtaaaaagtcatattcattgcatcatatttgaaaactggtaatcttgttccaaggttaaaactcccccctccacaaaatacttttaatgaatgcatttgttatgcggctatacaattgtttccttcctctgtagatgatagagtcataattatttctctgatgttaattaaaaataaaccctttcatttgtaaaagaatagtaactatttgaaaatcacacaaatcaattagtagtttcacatagaaaaaatatccagttatttaaataattttaactgccactaaaaagaaacaagcacctggattggaaaaagaaaggctatcattatttttgaaagcattttctcattgtctccttataaagttacaaggtcatatattatttgtagtagtatatggaattacatatttgatgaattcagaaacagaatagggatttaatatatttttaaaatttctatacaggaagcttattttaaaaaaccttagggacttttacatatgcaaatgttcactaacaaaaaaataatcaaccttctaacactttgcatggaaaagaattctagacaacactatactctcaagaacattctagtaccatgcaaataattaaaccataaaaatctcacatataattatacatttatgtagatgaagaagtatttgataaatataaaaggagaatgaattattataaaccaaaaggataaatttttgaatttttaaaaattacatttaaaatttcataaattttaaaaaatacaaataataaatgtttatgtctttcatacctaaa

SEQ ID NO: 473062 - DNA, 1158 bp, Homo sapiens
cgcgtgtggccttgtcagccgtgaggccgggagaccgtgtgctggccatgggggaggatgggagccccaccttcagcgatgtgctcattttcctggaccgcgagcctcacaggctgagagccttccaggtcatcgagactcaggaccccccacgccgcctggcactcacacccgctcacctgctctttacggctgacaatcacacggagccggcagcccgcttccgggccacatttgccagccacgtgcagcctggccagtacgtgctggtggctggggtgccaggcctgcagcctgcccgcgtggcagctgtctctacacacgtggccctcggggcctacgccccgctcacaaagcatgggacactggtggtggaggatgtggtggcatcctgcttcgcggccgtggctgaccaccacctggctcagttggccttctggcccctgagactctttcacagcttggcatggggcagctggaccccgggggaggaatgtccctgcaagcagaaaatgcaggacctcagcaagaaggttcagaaagtaccctgttcccctaacaaactccaggtgcatctgcatctggcttctgcacacacttctgaatggccaacttggaaaaactcagaggaaaggaaccaggagtggtggctcactcctgtaatcccagcactttgagaggccgagacaagaagatcacttgagcccaggagttgaagaccagcctggggaacatggcgaaactccatctccacaacaaaagtacaaaaaaaaaaattagtctggcatggtggcgcgcacctgtagtcccagctactggtggtggcagattgggtgggggttagggggtgatgtaggaggatcgcttgagcccaggaggtcaaggctgcagtgagccatgattgtgccactgtactccagcctgggcaacagaagaaaaccctatcttggtaacaataataataattttaaaaagaaaaataataaaatgaacttgaaatttttaaaatgcaaaaataactaacaaacacagaatctcatggaccagtcaaaggtgggctctcttgccatacctgagtccaggctgacttccacactgaggaaggccagccacactgagccggtgagatggctctagtcagaagtggactggaaaaac

SEQ ID NO: 473063 - DNA, 1162 bp, Homo sapiens
agaagcgacagcacgcaggaatgcaggggtggctgggagctgctgtcgccattcctgaggtgtgtagccgtggacattgcctggctgaggtcttctgcctctttctttctttctttcttttatttctcttgaatattgccatttgtattcaaagttgcaattctcctaaaccaattagagagagttctgatctggagactagctccagaaattcactaacttcctatttatctttcttttatctccattctatgaaattttccagcaataatactattctccagaaacgcattctagtgttcctccctcctgaggatgcagtgttcatgaaagcaaacactgggccctcaccaggcaacaaacctgctggtgccttcatcttggacttcccagccttcggaactatggagcccgcactctccagttcatcaccaccccagcatccctactcttgcatctaacagtttccgctattttgcaccacctgcctggcccttatgggcaactcaaggaagaaaggaaagaagagatagaggaaaaatggattcaacaaatgaaagtgttctttctgactactgctgtgtttacaaacattttaatcatcaaaacatgctttatttgatagaaagatcaaatctgcctttgtaaaacaagagactattttaatcattaagacaacacacatgtttgatttggaggcgtgttctcattcaaaaccttgcaaaatataatttcttcttgtctgggagatggtgtctttcttcggggagaaccttgagagaaatgtctatgaatgtgtctgtagattgaggataggccaacaaacatattttgaaatattttttctttcttttaaaaaaatagatacttttaaaagaaaatgcttatttaaattacatagctctttttttcactctcagtcatcatttgtggtttcagtcagtactacatttattccccagagctaggattgctgtgtttttagaaagggagcctgtttgaagggactctatactcttgcagtaattaaaatccttttaggagtctttgactttgacttactgctttgttttaaattattgaaattattcaacttccccattctaacccacggaaggctgttgttgttctcatttataatggcacaatataagtttaaaga

SEQ ID NO: 473064 - DNA, 753 bp, Homo sapiens
ttctaaatcctgccctgagaacccatacgtatgggttcccctatacaggtctgcaacttggaaagttgaccttatgcttggggaccgtccatcacaatgtactacattatttctatccaaaaaaatgcaggtgagcgtactcctgctggcaacctcctcaaagcacaaatcgggtgatgagccccaaaaagggcttattagtcccggttttgcatgtgaaaagtcagagagcgataaagccatttcattccccatcgacctggcactcagcgctgcaggggtcagaaccccacatgaagactgcatgccgcactcccgaccacgccaagaggcctctggtccccttcggccactcttcagagacaccaatccccggccccccacagcattttcaacaatccacttccgactacctttttatgactttacaacacagtttttcctcaaattttatggcatttcattaaagccgccagaaggacatttgatagattttctcaattacaggacttgtggagcattttatacttacatctgcaccgaagcccgatagagtcgatgctcgtcttgcctctctcccttttatcccgtgcatccttttaatgaccaatttgttattttttcccttttatttctccttacctcctattttctgcattttgtttctctttttgctgtttggtttagagaatgactcatttctcacacaaatttacattatttgtaaaagagaagggaagtggggtcgggggg

SEQ ID NO: 473065 - DNA, 699 bp, Homo sapiens
cgggccacttcttacctcgctagtcctgcaaggagggtctttgaaatatgggacatgttaactcctactcatccttcaggatccaagtcacatatcacttcttcagctctgttgtacatgtggaccatggcaatgtctgtgctctaccactatgtctactgctggagtccaggcttgtctgggtgaatcctaaggactgggatggggatgggtggccccttctgctgacaacccacacagttcctggaccatattatatgctcaataaatatctattgacccaacttaatgaaccccctcaggttagaatacagatgaagattgtgcatgaattgcatcagtgtgctgatgtagacttgctgaggaaggttatggaagtaaaatgtcactcgggtaaaagtcagaacataggctgtaggaaccgtctttttgggggaggctctgaaaataagccatctaatcacacagacacagacagcccaggattggatggaaacaggattttgctgatgcctattaagctgcagtgccaataactcttagatttgtttttttgagactatttctggattccatagacatgcttcattgtttcttattttttcttttgtcttctctgactgtatattttcaaacagcctttcttcaagctcactaattctttcttctgcttgattgattctgcttttaaaagactct

SEQ ID NO: 473066 - DNA, 667 bp, Homo sapiens
aaccacttatcaatcacatgactctgtgcagctcacttctgtgagtctcaggagcctccttcgaaaaatgaggattaaacaaggcatataacattatgcaaaacacttactccatcaggtcagttatgttcttctctaagctggttattctagttagcagttccttcaggcctctcttctgcaggtctactggagtttgctggaggtccactctagaccttgtttgccttggtatcattcagcggaggctgcagaacagcaaagattgctatctgttccttcctctggaagcttcgtcccagaggggaatgcgccagatgcctgctggagctctcctgctgcacccacagccgccctttcccccaggtgctctgtcccagggagatgggagtttcatccataagcccctgactggggctgctgcctttctttcacagatgccctgcccagagaggaggaatgtagagaggcagtctggctacaggggctttcccaagctgtggtgagtgttttctcatattacagatgagaaagctgtcacagaggtgttggaaatgggctgagtttatatggactgaacttacccagagtaggctgtagaattgccagggtgttcagctgtctcaatgacagaatcagattaaatgtgtggctgatcttattgatt

SEQ ID NO: 473067 - DNA, 1485 bp, Homo sapiens
agggggagggggagggggcaacaaattttcctatatgagttatttaaggatttagatggttttatgagccacttagtatttacaacccttcttaattgtaccctcttcctcacaggggaacatttgcctaaatctttggaaggattttttatctatgaagaagaaggttctggagttccaggttctagtaggaaaggaaatgatgccatcgtagtagaacaatggactgttattgagggatgtgaaatcaaaacagattatggccctctgctgcacactctggctgaattcggatggcttctgacaagcgtgttgcccacacctgtattgagacatgacaggaagaaccaagttgcacagggaattgaggacagtgattgtgcaggttttattgagggtagaggtgggatgcagtgggaagatgatcatcttccggagtttgaccgtccagcagccgatctcctctccaaccatctccagccaaactcttctcagcattcagatgctccttctcttatctctgccacgccattctgaattttaaattttaaaaatcaaatttaaaaggcaaaaagtcaatcaataaataaaaatatgtggaagctgtacatggtttctggccctgaaggatcttgtgagctggttaagcttacgtttcatatgtacaaaacaagggacttacattctggtcagggcagatcaagcttatgtattgtgtaatataatacagtaactaatcaagggctagatgaggtgtcttagtctataggttctgtaggaatattaaaaagaagagacattttaaactgtcaaagttggatgggatcatcaaatactaaagagattagagggcagcatcatcactatttagcagatttccatttaggaagatgctactaactctgtatagaagatagcagaaaaatgtaattttaacattaattgccattatgcaacaaggctcactacaactctcaatgtctactcttcttttgtatgccaaggagcattgtgcaatattggtgtttattttgttcctttgcattttgtaatttgagtcctgccaagtgcctgcaacacaggaaatataggatgaaggtcatttggtaacaaggattgttggtaaatcttgtttattctctgcctttttattcttgtgcaaatatactgtccctgtgacaagtcacatgctgttcttagctgcttcagtacacacaacgatagtaatcatggtcaatgatgtcatctttacaaataaagaaaagtgttatatacagttgaccttggtcaaaatagaggatagagcccgaagtttttagtctctgacactagaggaatggttatgagctgcccaggctttggagctaagcagatcttgttttaattatagcttcatcattgtttagctgtatgatttgggcaagtcatctaacctttttaagataaatttccttatctgaaaaattggacaataatatcaacttt

SEQ ID NO: 473068 - DNA, 760 bp, Homo sapiens
caactcctttccttcctgggcatggttggatactttcgcctttggatacctggttttgccatcctaacaaaaccattatataaactcacaaaaggaaacctagctgaccccatagatcctaaatcctttccccactcctctttccattccttgaagacagctttagagactgctcccacactagctctccctgactcatcccaacccttttcattacacatagccaaagtgcagggctgtgcagttggaattcttacacaaggaccgggacggtgtcctgtagccattttgtccaaacaacttgaccttactgttttaggctggccatcatgtttctgtgtggtggttgctgttgccctaatacttttagaggccctcaaaatcacaaactatgctcaactcactctctacagttctcataacttccaaaatctattttcttcctcacatctgacacatatactttctgctccgcagctccttcagctatactcactctttgttgagtctcccacaattaccattgttcctggcccagacttcaatctggcctcccacattattctggataccacagctgacccccataactgtatctctctgatctacctgacattgactccatttccccatatttccttctttcctattcctcaccctgatcacacttggtttatcgatggcacaagctgaactcattgccttcactcaagccctcactcttgcaaagggacaatgcatcaatatttacactgactct

SEQ ID NO: 473069 - DNA, 878 bp, Homo sapiens
ctggagccattacttcaagactatggaggacctgagggcccagatcttcgcaaatactgtggataatgcccacatcgttctgcagattgacaatgcacgccttgctgctgatgattttagagtcaactctgcagctggagacagagatccaggctttcaaggaggagctgctcttatgaagaagaaccatgaagaggaagtaaaaggcctacaagcccagattgccagctctgggttgactgtggtggtagatgcccccatatctcaggacttcgccaagatcatggcagacatctgggcccaatatgacgaggtggctcagaagaacagagaggagctggacaataacaggtctcagcagattgaggagagcaccacagtggtcaccacacagtccaccgaggttggagctgctaaggcgatgctcacagagctgacacgtacagtccagttcttggagatcaacctagactccatgagaaatctgaaggccagtttggagaacagcctgagggaggtagtggcccgctatgccctgcagatggagcagctcaatgagatcctgctacacctggagtcagagctggcacaaacctgggcagagggacagtgccaggcccaggagtaccaggccctgctgaacatcaaggtcaagctggaggctgcgatcgccacctaccgccgcctgctggaagatggcaaggacttcaatcttggtgataccctggactgcagcaactccatgcaaaccatccaaaagaccaccacccgccagatagacccgccagatagtggatggcaaagtggtgtctgagaccaatgacaccaaaattctgaggcattaagccagcagaagcagggtatcctttggggagccc

SEQ ID NO: 473070 - DNA, 963 bp, Homo sapiens
tcctcacccatgtatcagtttgagaggtcttcacagcagcacctcccatcacaggcccggaggcctaggaggaaaaagtgggtttgtaggctgggcccagtgtctcctgctgtgtgcagcctaaggacttggtgccctatgtcccagctgctccagctatggctgaaaggggccaacatagagctcagcccatggcttcagagtgcaatccccagcccttggcagcttccatgtggtgttgagcctgtgagtgcacagaagtcaagaattggggtttgggaacctccacctagatttcagaagatgtatggaaatccctggatgctcaggcagaagtttgctgcaggggtgggacccccatggagaatctctggtagggcagtgcagaagggagatgtggggtcagagcccccatacagagtccccactggggctgtaagagggctaccgtcctccagaccccagaatggtatatccaccaatagcttgcaccatttgcctggaaaagctgcagtcactcaacgccagcccatgaaagcagccaggagggaggctgtaccctgcaaagccacaggggtggagctgcccaagaccatgggaacccacctcttgcattggcatgacctgggtttgagacatggagtcaaaggagatcattttggagttttaagatttgactgccctgctggatttcagacttgcatgggtactgtagcctctttgttttggccaatctctcccatttggaatgggtgtatttacccaatgcctgtatccccattgtatttaggaagtaactaactcatttttgattttacagactgataggtggaagggacttgccttccctcagatgagactttgtagacttttgagttaatgctaaaatgagttaagactttgggggactgttaggaaggcatgattggttttgaaatgtgaggacatgagatttgggatgca

SEQ ID NO: 473071 - DNA, 971 bp, Homo sapiens
taggctcctgcgcagcttcactcctctttgctctctgtgtccccttgctgccttgatggatcccggaatcttttccccattcatcatgatactagtgtgggtctatcatacagactttttggcttttattgtactcagagatctgtggaactttgagcttgagagagatgatttggggtatctggtggaagaaacttctaagtggcaaactgttcaagaggaggcagaatataaaagtttggaaaatttgcagcctgatgatgaagtagaaaagaaaaaccaattttctggggagaaactcaagcctgctgcagaaatttgtgacatgtcagagactttcatggcagctcctcccatcacaggacttggtgccttgagctccagtgctccagctgtggctgaaaagggtcaagatacagctcgggccgtggcttcagagggtgcaagccccgagccttggcagcttccacatgatgttgagcctgtgggtgcacagaagtcaagaattgaggtttgggaacctccgcctagatttcaaaggatgtatggaaatgcctggatgtccaggaagaagtttgctgcaggggcagggccctcatggagaacctctgttacggcagtgcagaagggaaatgtggggttggagcccccacacagagtcaccactggggcattgcctagtggagctgtgagaagagggccactgttctccagaccccagaatggtagatccaccaacagcttgcaccatgtgcctggaaaagctgcagacactcaatgtcagctcatgaaagcagccaggagtggtgctctatcctgcaaagccacaggggtggagctgcccatggctgtgggagcccatctcttgtatcagtgtgacctggatgtgaaacagagtcaaaggagatcattttggaacttcaaggtttaaagactgtcctgttggatttcagacttgcatggagcattgt

SEQ ID NO: 473072 - DNA, 474 bp, Homo sapiens
gagggctgccagcacgctgcttgccatgtccgtggtgcccagtggaagggctgagctgaaaaatttggataaaaaacagagaacctctataggattaaaacaatggagccagacgctctcagtgttagcctttggatttgagaggcttgtgtttaagaagtctgggcctgaagaggtggaaatacagggggctaaaaagttagcctcccacagtttcatggatgctgacagaagacaggagaatcctggggactggaatatccacagtttttggaatctgagggaggtcctggaactaatctcccatggataccaggggacagctgtaccagcagtgcttttggaccacaatgcaagtagaaaggaaatttctataattcaaaatctatttaactgtgcagttgaagagcttccacttaactttaattgcaagtgaagaatctgaaatgtagcaacataccaaaaggaggatat

SEQ ID NO: 473073 - DNA, 560 bp, Homo sapiens
atcatctgagtcccacatggctggggaggcctgacaatcatggcaaaaggcaaaaggcacgtcttacatggcggcagacgagagagaacttgtgtaggggaactcccctttataaaaccatcagatctcgtgagaacagcatgggaaagacccacccccatgattcagttacctcacacaaggtccctcccacaacatgtgggaattatggaagctacaattcaagatgagatttgggtaaggacgcagccaaaccatgacagtgggaaagtgaattctggagaaggtgctgcatgtgttgctgcatccccagacgcccctgaaacccccgtgcccttgtacttggtagcatgtgcaggatgtatatcatcgtccccaccccagccatttttttccctccttttcattatgaaatatttcaagcatacagaaaattgaaagaattttacaggaaaaaaaaaacgtaatggaaaagagacaaatattcatgcagaaaaatggtaaataatgtatgtagatactccattctcaggaaggtggagcataactccctacttggt

SEQ ID NO: 473074 - DNA, 1691 bp, Homo sapiens
tgtcagagagtgggcaaaatacaacaggaaaggtccaaattcaccctctgagggcccggggcacgggggcagcctgctctcctcctggggccctgttccctgtggggactggaagagaggctttgagtctagggcctggggcagccaggactgacgggggtgcagtcctagaagggtcggcagtcacggtggcccaccatggcatctccgtatccttgctgcatgctgcacccactccagctgccagagcacggaggcagagacgtgggagccgatgaaggtcgcacgccagcctcccacctgtgagacaaagggccctgtcactggaagccacgtccagcctggccccgcaggagccagggctctgcgcctaacggaggactgatgggaaagggaaggctggcagcagtgaggttttttgaccttggcaatgttcccgtcagactgcagaagaattgactattcccgttcaggtagatgatgaccggccccataaacagccaccaagggtcaccctctccctccccagccctgaaggccaagaaatgggactgggctccttggatttatgaccttctggctcctgcagagagaggaggactggggcttgacaaggacacggggctaaggactgtccttggatctcagtaggacagctgaccttccctccacccaatgactgctccagtctgatcgttcctggccacctgataatctctttgtgcaaacaccaggaagccctggttagagaacttggctcaggagatgacatgtgaccaatccgaattttccctggggactgatacgtggacaccagggacctcgtgcaccaccccacgagatcttacccgcttcactggtaacacccagaatcctcagcacaactgctaccaccaggtagcagctccaggcggccccataggcggcatctcacatggccccatctcctccgccgtggttgactggaccagggaggagcacgtgattcacagggatgtggagcagctcacagttgcaaagaggttgctgagcaacgtgcactgcctggaggtgactgcagcggccctgggcttccctgggctcccccgctggcagacagaatctgacagcacgaggctgcctaaagccctacctgaaaaggatgctaggtttgtgagtccaaaggtcagccggggaaggtgcagggctactgtggttcccaagaagagcccagacaagcattctgctgaaggagcctcagacatgaaggtgcgagagcatttaacgcggagggcttggggcctgcaggagtgagctgcgtgcccaagtgtcatacggatgcctctgttgaaaggcccagtcctcgatgggcaccatggctgtgaccagtgtggactgaaacccagggttctctgcaaacagtgcagtcatcaagggatgccccagctaggacccgcgcaggatcttgggggcggaagggatccagtgaaatggagctggagcatcctccagtaaaccttggtgaattagggcaagttacgttcaatttgaagaaataagagaagtgtgacttctactccaggttagcctagaagccgttcctgtgaattgaagtgtcccccccaaaattcacatgctggagccctaacccccagtgtaacagtatttggagacatggcttttaggtaaaatgaagtaagggtggggcctga

SEQ ID NO: 473075 - DNA, 553 bp, Homo sapiens
cagagcagtattaggggtatgccatggctgaaaggggtcaatgtagagctcaggctatggctacagcggttagaagccccaatccttggcagcttccatgtggtgttgagtctgcagctacacagaagtcaagaattgaggccccacacagagtccctactggggcactgcctagtgaaggtgtgagaagagagccaccatcatccagaccctggaatgttagatccaccaacagcttgcaccatgaacctggaaaagccacagacactcaacaccagcccgtgacagcagccgggagggaggctgtaccctgcaaagccacagggacagagctacccaaggccatgggaacccacctcttgaatcagcgtgacctggatatgagacctggagtcaaaggagatcattttggagctttaaaatttgactgccctgttggatttcggcctgacttccagaaattcaaatgtgaggataaatcagttcctgaggacatagagaagtaaaaaaattctgagcagatgaaaatgtcccttgattcacagtttctgca

SEQ ID NO: 473076 - DNA, 787 bp, Homo sapiens
gaagagctccctgttcccctcatgacaccgacacaacaaaaaagagttattccactaattcccttgatggtcggtttaggactttctgcctccactgttgctctcggtactggaatagcaggcatttcaacgtctgtcatgaccttccgtagcctgtctaatgacttctctgctagcatcacagacatatcacaaactttatcagtcctccaggcccaagttgactctttagctgcagttgtcctccaaaaccgccgaggccttgacttactcactgctgaaaaaggaggactctgcatattcttaaatgaggagtgttgtttttacctaaatcaatctggcctggtgtatgacaacattaaaaaactcaaggatagagcccaaaaacttgccaaccaagcaagtaattacgctgaacccccttgggcactctctaattggatgtcctgggtcctcccaattgttagtcctttaatacccatttttctccttcttttatttggaccttgtatcttccgtttagtttctcaattcatccaaaaccgtatccaggccatcaccaatcattctatacgacaaatgtttcttctaacatccccacaatatcaccccttaccacaagacctcccttcagcttaatctctcccgctctaggttcccacaccgcccctaatcccgcttgaaacagccctgagaaacatcgtccattctctctccataccaccccccaaaaatttttgccgccccaacacttcaacactattttgttttatttttcttattaaga

SEQ ID NO: 473077 - DNA, 3178 bp, Homo sapiens
gcctcgtgcagctcccaggatcaatatgcagatcaacggcaaagcactgagggtccataattcacccttcccatttacaatcaatggatttttgacagcatattccacagggaaacaaggagaaagtagtatttccagcacatggtgctgggataactgggtatccacatacaaaagaatgaagttgatacctacttcatacaacatcctacatctttctccacgctggatgcttcttgcccttgaacgtcggccttcaagttcttcaattttgggacttggtcctcagcttgcagatggcctattgtgggaccttgcgatcgtgacttcaaaaacatcagaattctcagggattttttgtaaactatctttcttttattctatactttctgattacaattccagtaatttatctgacttaactgccatctgcctattgtatataatataaatatgttgcttttttgtaattatataataaaaattatataattacaaattatataaattatatatattattatatataattataatatatattattatatataattatatatatattattatatatattataatatatattatttataattatatatattataatatatatataatatataattataaataatatattatatatatattatatatattacatatattattatatataattatatatatattatatatattatttatatattatatataatatatataatatatatattatatatataattataatatatattatatataattatataattatatataattatattataaaattatataattatatataattatattatatgtatattatatataatataattatatgattgtataatttatacaattatataatatgtatattatataattgtataaattatacaattatataatatacatatgttatatttatattatataaatataatattatattttcacttcatggacgtgttcttgtcctccttttgtattaagtatatgctggctacataaaataatttgaaaaatagtctttattttactatcctctgataaagtttacataaataaatatatacaaatatatttggtgctgatatataaatatgttatataaatcccagcaggctttttaagcttcctcaaaatagaatctaggttagcctaaccaaccatacttgcaaacattcctcaccatgcctgaatataggggaataccaggctagatatcattttggatctatggcttttgaaaataccatgcttttctcttttgtatttgccaaatgagtagttgttgcttgaagtcacagccctggttgctgtcctttatcatttcacatataagatataactcctagcccctttgtcaacattgtaatagcatgacggcgtagttccacaaatccagaaactctcaagcagcagcctacagtttatcatacagtaatgttggtccacagttggttatacaagtgaatcattaagaacttcatcttatttaatgaggcctgatatagatgatactgtctgcataattattatagtagagcttattaaggaacagaacatgtaaggatatttttaatggcccctgaaagacaactggagaccatcattttaaagatcatatttagccaacaaaaatccttggtttggggaggtgctaaacatttttaaaccatttgaagcgccaaaagaaaggtcctattctggtcaagaggaaagacaaggcttaaagtatgaaaaataacagggactcaaagttggatacttccaaagcttcaagttgaatctacaatagaaaagtgtccttaagtaatactatcaccttcaatgaaccagttttgtcatttgtaaaataataattatttgaaggattgttctaaataaagccggtgataaaaataaagtatctagcatagtatctgtaccacagaagataaccaaaaactactagttgttgttaaaacgattggctttgttattctctagccattccacactagctattaaaacatccgtaaaaattgccatacctttcagattatataatattgaaaagatattgaaaaaatggtactactaatcacttagttgagaggagtttcacatctgtcatcgatggaatatgcttgaatgtcaattttacattaatatagtttttaattaaaattgtatggaaaaaatgcatcatttttcttctccctaagtaacatctataattagctattttatttcctaagaaagtaaattttaattataataaattctatggagtatatatttcaaaaaaagccaaaggtgtcaaattaagtactgtaagatgtttccaagttttccttttaaatattcgtttgctctaaatcatgacttttgttgcctaaaaaccagtatcagcagaacatgactagtgactgtttttatgtaaatgagcaagaattaccaaggtatgtctaagttccattattttaaagtatcagcacaatctctgactgtctattaaagggatctgttttgccaggatattcaatagagtcaatgtttatccctgtaatctataattattagtgaatttcctctcccatctccaggatgccatctggaattgctctttgttctctgccctgaggcaagatatctactgctgacctgttttctcctttctgaaactcctatttctccaagacaactctggttcataggaaatgaaccacacatgcacacagaggaaatatgtgtacgcacacatgtgcgcgcacacacacacacatattccacaagtgattttatcagaaataaaagcagcattttgaataaagtgtgatttatttaaagaggcacactcattcttattctaatctactgctttccttttcttaaatcagcaattcttctaaactctgagaaaagtatataatttttgtgcttcgtcaaggatcatagaaattcatacagaaacagacataattcttttgtgaactgtttgtgtgactcaaaatggaatattttcatcaaaccttcaggaattggaatacttgtggatactcctagctaatttgtgtttggtttctgttgtttagttatgaacttctaggcaatagacatggcttcaatgattgcggttgaaatgaattagtctgtataactagtt

SEQ ID NO: 473078 - DNA, 646 bp, Homo sapiens
ttaagaaaatgtggcacatatacaccatggaatactatgcagccataaaaaatgatgagttcatgtcctttgtggtccagcttataggtccacaaaaagagctttgcctttcctatttatatctaaatggtctccagagaagaaatggttatgtaaggagaaataacccaccatcagttctgaggaccaagccacattccacagaaaagaaaataaaaacctgcgacgtgactaagatccagttagattttgatgagaacatcttctattccatctttcacaatctctttactagatatggagatgtaaaatggagaatgaactgttaccaaaaccacaaagcaatccctatggctacaaatctcaatgggaacctgtcctggattctctctggaacaagagggttgactttacccggtgttctgctacactctgcagaaagtcctagaagtaccccttcctatgtcaggggtcacagtatcttccaccattgacagaaatttaggttgatttcatatacctttgccattgtaaatagtgacttcagccacattatataaagctttacgattgccttagttaagtggatagtgcacatgtgacttgaatataccatttcaccagcgccttgaagacaatggtgttt

SEQ ID NO: 473079 - DNA, 663 bp, Homo sapiens
ctccagttagagggatcctctagagcctgagtctctctctctctcagagcagtatgagaacgaagagtgatcatcccaaataccagggtgagaaggagagggtcaggacctcaggcctgcagaagaggctcagaggaagtgacaatcaaatgagcctaagtaaaggagggaaagttgatcaggcttctcgatgtggcaaggagatggattcaggaggtcttgatgacctcctggctcggagcgagagggaggaggctagaaaggggctcatgcttccgacaggggtgaacaatagggatgatatcattgctgaccaagataggaactctgacacatcagcaggcaaatggagccatgatcaaaacagacggcacctccaccctcaaggagcttccccaaatgagaaaccaaaaacgaagctcctgaattggccccaaactgagcactttttgaccacattttcgaagctaaaatctcaaaaacaacttgccttcattgtgcctggtaacaaaagacccaatgcccttctcaacggcttcctgtagaagatcactctcagaatcccaggagcctctgataagcaggcagatgcagcagggaaaagaatccctgaaatgaaaaggagatgacatttaaacgagtagtggttgtttcagcatcatt

SEQ ID NO: 473080 - DNA, 786 bp, Homo sapiens
ctctggagcacagtcagtgtgcagaatgaatgccatatggttctacaggaataatcagcagagaggcctcggagagttatcccggcagagaagcctcggggaggtgtcccggcgggggagcctcggggaggtgtcccggcgggggggcctcggggagcttctcatcaaggtgaatgacagccaagtcctaaaaaagaagagcactctttctttgcaggtggagaggacaaggagctccagtgacaggggctctcacttcacaattgtggggaagggaccacaggcacagggagagcatgattgtctgctacactgtctctgtcattctggggcccatgctaaagaagcactggctatctggatgacaattctcatggattatcctcatcaccattatcatcatcagagcacaagactcaagccaaactatacatgtgcatttaagccctctgaaatctcatggatcaacccaaataacatggaaaattaaactctgcccaaagaaggagaaacgtgacaagtattattgacgacaatttgtcggttgtgttctttgaagtggcaggctcacttagtttatttttgataaaatgtctttaaaatatccaagtctgaataaacattcttttctgacacttgttcattcttttctgtaaaaaaaaaaaaaaaaaaaaaaaaaaaaatgcattccaggagaagagctgctagtttagcttgcaactcagatgcacaagtacttttccttgagatgaccactgtgaccagtgtgagtgccttccatttcat

SEQ ID NO: 473081 - DNA, 567 bp, Homo sapiens
ggcttctgtatccagacaaacatggctcccaacgccagctccacccctagtgaatggcatcacctcagacttaatcgagaacctaaaattataaggatcattttaaggtacagatcttgccctcaaggagtccagactcatgggaaagacaacgtcacaacctatgctgcagtgaaatattgctgtagtggaagcatatccccagcatcaattcttctgatgaagaacaagatgagagcaattatttctatggagctaggaaggaaaatgattcaggagtttaggactcctgataatccttcccccaagacctgccatcaccgatcctgcctgtccgacatccgcgaacaaacagatagcagacttctggtaatctcttctctaggcacacagagactgttcttctcacctcttatcaccgggagccctatcacctcctgcatcagcccccctgccagcctctcctctcctctcagctaaacaggattttcttccttagttttcagactggggataatcttgtcacttctcctagagtagaaaggcctagaagtcaagggttagaaa

SEQ ID NO: 473082 - DNA, 735 bp, Homo sapiens
cggctggctggcgcttgagttatccacaggatgtgtggaaccgggaagagatgtaactcgatgcataatgctggcagacagcacgtcacagccacatctattgccagagaaatggaatacagcgataatttcacctgattttcactatcaagtagaacttctcccatcaaacctaagcagacatgcagtcagaggaagcaagccttatccatccctggaggctgacagcacttacatgttcactcatctactgcctcttgagggtgttgacttaggcatggccaggaagcattcagcaaaattaactgtggtcaatgtccagtgtgccatctgtatcccccaagagtgcactaacatggacagtgcccatttacctagaaatctccctcagctggagccccagtgccagaaaagtggagaattaaattatgcacacctcagccctgtactagataacctcaagttgcatggatttatcaaacgagtagttattgtgctatgttaggaatatgttttgaaaggaacactaagttttaaaagggagctgccacttctatgatttggttataagattctatttatttattcattgaaattattctattcctgtgtcagtctgtttgtgtttctgtaaagcaatacctgagactgggtaacttataaataaaagaggtttatttggttctgcaggctgtacaaaaagcatggcgcccacacttgcttctggtgaggctt

SEQ ID NO: 473083 - DNA, 591 bp, Homo sapiens
gagacaagcaggaagacctcggatggggcagaggcccatatgcagaacccctagagcaatcaacagacagacagagccctgcttcatggagcgtctgctctctcctggagctcacacgctgaaacagacaggatgcaacacctcagggttgttggagaaccagctcctaattgcataccctggcatgacccagccacctccattgagcccttcatggcacatgactgtaccttccggctgttttcaggctggtgagagagaccctttcatatttatcctcttggtagcacagtcttctctgcagctgaagatagaagccagggtagtgattctaagtgacacttcagatgtcactcttcagctacctgagatgaaaaattgggattcctgtttcatacaaaaggagcttgaaattgtacccagggtatgggaagatgccaagatggtggcagctactgaatgctgggatcttataaataaatagaggctcagagaagtttcaatgacgcagctggtacgtcagggccagtcagagagggacttaggtcggtgtgatctcacatccagtgcctctttgttcatctcagaccc

SEQ ID NO: 473084 - DNA, 784 bp, Homo sapiens
ctgcaaggtaagtctcagtcctgcaagaccacagtcccttcccatgccagtggcaaatctggtcctcccgtgcggtggactgactggctggaaacagtttacttgtgtttatgggtttattataaaacataccacaaagcagagagatgatgggagagctgcagagggcgagggatggtgggggcttctgtgcacctccacgtgttcagcagcctggaagctcatcaagtctcattgttcaagagcttttatagagcttcatctccagctcaccccagcccccagaggtcagtgggtggggacgaaagttccaactctcgaatcacttggtctttctggtgaccagtcccatccagaggctatcttggggccccaacctcagtcatctcataagtataaactcagggacaaagaccaaatatatttcctatcatactacagaaggggtcatggtcatgccaatgccatggtcatgacctacggcccagtgcatggcccagcacatgcttggggactctagcaacaatcggaagggatcgcttcaacaggcagccgcctgttcaaagtctctccactgtttatctcagaaagtacagcgtgccattatgaattgcattattttcttgatttcatttttggattgtttattgccagcatatactccaacctgctaagctcatttattagttctagtagtattgttgtgcattctttagaatatttttacatataagattgtgtcatgtgattttttacatataggattgtgtcatgtgaataaaga

SEQ ID NO: 473085 - DNA, 681 bp, Homo sapiens
ggaaactaagacaagactgaggaacctcaaggaaaaccaaaatggggaatagggcgttgccgctactggcctgcagaggatgtgggcataccctcagtgcaacaaaacaaaacaagttccctttcctttggaccgtgattaaagccactgtgggtgtgctttgcatgtacaaagcgtattttcaattgagatcttcaatcagcatctcatacaatttgagaagcagccttaagcctactgctaagcttgctcaggacttggcagggagtgaattcaatgccagctctacatacggcgtctacagctacgatttcagccagggctttggaatcttcagcagtcgctggggcttcccatgctatcccagtatcggccatgtgtccgtgcggcacgggcagatggttttccggtcaggtgttttgctgctggttctgcagtttgtagtcacagaccagaggaaagccacagttttgtttctttggaaagccctgagtgataccctggaaaagaggggtgttgtttgactttggacacatcaactaagtctttgtgcttcactttcttcacttataatatgggggttatagtcacctagcagagctgctgtgaggattaaatgatgcagcaatttccggtatatagtaagttctcaataagtggttgtttcttcccgtttccttt

SEQ ID NO: 473086 - DNA, 1365 bp, Homo sapiens
gcgcggtcacgccgagccagcgcctgggcctggaaccaggccacagccccccagcttcacccaccacctccctaccatggacccccgcaaagtgaatgagcttcgggcctttgtgaacatgtgtaagcaggatctgagtgttctgcacaccgaggaaatgtgcttcctgagggagtgggtggagagcctgcgggtaaagtaccacctgctactcagaaagctaaatcagaagaaaatgccaaggaagaaaaacctaatagcagacgaaccatcaagtgaggaaagtgatctagaaattgacaaagaaggtgtgattgaaccagacactgatgcccctcaagaaatgggaggtgaaaatgcagagataacggaggagatgatggatcaggcaaatgataagaaagtggctgctattgaagccctaaatgatggtgaactccagaaagccattgacttattcacagatgccatcaagctgaatcctcgcttggctgttttgtatgccaagagggccagtgtcttcgtcaaattacagaagccaaatgctgccatccgagactgtgacagagccattgaaataaatcctgattcagctcagcctcacaagtggcgagggaaagcacatagacttctaggccactgggaagaagcagcccatgatcttgcccttgcctgtaaattggattatgatgaagatgctagtgtaatgctgaaagaagttcaacttagggcacagaaaattgcagaacatcagagaaaaggaatgcctggaatggccggaatgcctggactcaatgaaattcttagtgatccagaggttcttgcaaccatacaggatccagaagttatggtggccttccaggatgtggctcagaacccagcaaatatgtcaaaataccagagcaacccaaaggttatgaatctcatcagtaaattgtcagccaagtttggaggtcaagtgtaatgcccttctgataaataaagcccttgctgaaggaaaagcaacctaggtcaccttatcgatgttgcaataatacaaaccaatgtacctgtgacatgtacatcaagagagctggggtgctttgaagataatccccacccctctcccccaaatgcagctgaagcattttacagtggtttgccattagggtattcattcagataatgttttcctactaggaattacaaactttattcactttttaaaccttcaaaatatttaaaacaaatttaaagggtctgttaattcttatatttttctttactaatcattttggatttttttctttgaattattgggcagggaagatacttatgtatggaagattattgctctaatttgagtgaaataaaagtcattagtgc

SEQ ID NO: 473087 - DNA, 873 bp, Homo sapiens
gcgggtcccggccccgctgagcacctccagcagtggcacagcctctggaggggtccgggacgaagccacccgcgcggtgctttctttttctctgtaatggttggatgtttgaaataggagaggtggatctaccattctggggtctggaggatggtggccctcttctcacagctccactaggcagtgcccctgtggggactctgtgtgggggctccagccccacattcctcttctgcactgccctagcagaggttctccatgagggctctgcccctgcagcaaacctctgcctggacatccaggggagaaaatttgaagaaagtgccgcaacatcttattacacaaaatgtacggtgcttcttacttgttattctatttcacaagttaaattaaatttcagtcctttactgttgtctaatatttcagatgtttcctacaacatacttaaaatttcaaaaacaattgtaacattatctgaaatgtttcaccagtacaatttatacagaacataacaaagaaaaatgaagcactgacaactgtaaatgacagaagtcaaatgtaataatagttgaatatcaaagaaaaaaatgatagcctaaaataagatatatttctgaggatagcaattaaaaatatttcctatatagcatagacaggaattccctgaactaaaggagatggaagacatgtatggttgttttaagtctgggtacactttattttcttcctctagtctgtgcgttgtaaaggcatacctgttgaaaaggaaacttttgttgggttacccctcctgtcttttaaagatgagggggaaaaagaagcctttgctgttatggatgcagttctcagaatctcactagagggtggtgttgg

SEQ ID NO: 473088 - DNA, 922 bp, Homo sapiens
ctccaagcttgtgggggcatcatgttcccctcctccagatggaagtgcccacagtggaagccacgtggaatacgtctggtccagcctcagcctcacatggagctggtacctgtgccagtgtctggagctgcctactctgccgcagcagccagtgtgtctggttgtgcgcagtggccagagcctgcactcactcacccacacgccccttgccactccgcgcctgacgtgcccttggtaaatgtgggatctgggtcggtagcacgagctgagagcagcctgccaggccaagtaggtggaatgaacacagcaggtgtgaaaaatactcaggtagaaggtgctgctggccacagaggtttttggctagtgaagcggcacctaaagtatcctgtgacatatccatacaatttatgtgcatttatcagttacagttggctataaatttgataaaaagacattgtacatttacttacaagaaataaggcaaagagaggagttgtgtaaaatgcaatcaactgattgtattactaagcagaattctgatttttatttctctttgaactactccccctgactgctttgacactatgaaacacaacatatgtcctggaaatatgtgacatatttaaatattgtattacataagaatacactttaggaacttatttataatttctttcattttttaatatctaggttattttgttcttctgatttattctgcttctcagtacattgccttgaatttagaaaagtctttgctttgttaatcatacttcaaaatgaaaaaaatttgttggaaactgtgtaatctcacaatgtgaacatgcttttttttactatttttatttcctatgtatagctattccagttcttttgtttttgagggagaattttttaaatttatttttaaattttgatttta

SEQ ID NO: 473089 - DNA, 652 bp, Homo sapiens
gaggcacaggaatgaagcatggcttcaggaaggaatcattaatttcaatatcatcctgcaaatggaccttttgcataaacacaagagcaaatggtctaaggtcccatgtgtgcaggccttctttgccttgtagtgtaatgcggacttttgtcaatgcagtattgattcagccttccagtggccataaaaggagatgctgcaaggggcaatcccagggcactaaggaagcaaacccaagaggaggacctggtcccattgcttcatctgcttatgacagggaagcaatggaaggtctgccccaccagttgctggcagcaatttggacactcctcagatgcatcccccaaactgggaaacatttaatttccccgaacattaagctgcttggcaatctcttgaagaggccatccatcgctaggggaaagggaaactagaagcctgacatgccagcaaaaggggttaaaggattgttttaaattatataagataaagtaaaaggtttaatcaagttgtggaaggttcataaatgttaattttgtaaaagcaattctgtgtgtgaacatattgagtaaatttaaaaggttgttatttggtttttctgtaatttgaacatttgaataaaagcacaaaaaaggtttcttaaggcactaat

SEQ ID NO: 473090 - DNA, 936 bp, Homo sapiens
gacctggaatatcaagatgaaatcagtctactactccacattggaagagaatgtgcatgagattaagttgaaaaggggtacacttatggttaatattaagtggcaacttgattggattgaaggatgcaaagtactgttcctgggtgtgtctgtgacggtgttgccaaaggagattaacatacgagtcagtggactggaagatgcagacccaccctcaatctggctgaggaaaatgaagcttaatgaggttaaactggcactcgaaaccaggttcatttgcaaaactgctgccactgaaatattcagtgcattgcatttcttctaccccaactctgagattttcatcaatcctaatgatcccatacctgaggcaaaatttatcagggaacattctatcttcaaagcttcaagacattctgtaatgccaaagtataaagtgtaggttatctgagatactttattttattaaaccaaatttgatagttatgcccttgataatcacaggcaaaattcaaaggttcagtttgttattatgaaacagtaacaattcttacgacttttaaacaaatgtggtgagccttaatcttttagctaaaagggtttttgctagaaagtttgcatcttctaaaactctttttcagagattcttttccaattgtagaactgtcaggccagaaatctatgaaaagttaaaacctctcctaaatatacataaaataataaataaaactaatcactcttcaagggaagtttatcttgtacacaagtagttctatgaatttttaatatcattcctataagcagtctagtatgtttaagaagactcctttagaacttaaatttgttctattatatttttttaaagtttaacatgaaagttaaaatagtaaaatgtaggtttataaaagccaatataattcttaatttatttaaagg

SEQ ID NO: 473091 - DNA, 511 bp, Homo sapiens
aggcagacatcacaaatagattatagccctcgtatgaaagaacgcttgctatgggaacccagccagtctctatcttcaaaccagaaaagggacattgcatgagtccctcttgtactttgaatttcattgacgcctcctctatcacatccctctggattcctttcctgcctccttcttccacatttaaggactcagatgggtcattgcgatggcagcggggacccatttgtagcagccattgcaaagatgccagctgtaagtggggaggcatgaccagggatgcatgctccatggagctggagggagctggggacaggtggagccccaccccttatgagttggtggggcaggagccccaccctccccggtgcagctactactgcccagccactactgtggacctggacatctctgcactcccgggggctcaggaaacctctgcctccacaggcttggaagtgcctgctctcgctatctgtcctctccccactccttaggcctgctctgattt

SEQ ID NO: 473092 - DNA, 783 bp, Homo sapiens
tgctttcttttttttagtggtatgtatactttcctaagtggcattctcactttcagcaggggtggagccatcttgaaaaccatgaaaaactctttcttcgagtacctgtgctggcccccagtgggaagaaccactgctgcgtcttcaacagcgtgtggggacattaacatgtttccaaaagaagaaaacactccttcctgtatcatttccacctcatctctcttaccccttatagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaaggcagaagactgtgaaatatcatttttaccatttaacagctctgatgatgtgcaagaaaggagggcacagggatctcccaaatctggaacctgcaaacgcattcttggtaggcattgtgacactcagtggttagaagaagcatgcaggggtgcccactagacatgggtgttctagaggcataactgactgttttacagaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttctt

SEQ ID NO: 473093 - DNA, 2175 bp, Homo sapiens
aaaaggaaaatccagggagtaatgtggcagaagcccagggagtgcccagatatactacctgcaccacatcgctgctgctgcggttggggaaaagatagtgctgaaaataagagtgagtgtgtcatcaacaaacagcagcttcctaaactatgtggaaatctgaaagcaaatgggttcatatcgatgtacaagccacagaggaactttatcctggaaaatgtacctgagcaagttacaccaaagacgtttgttaattccaatttgctaatttttgatgagattgtggaggcagaagtcatgaataccaaagtggagagaagagggacggtgtctggtttaaagagcatcgatggggatgagctaagtagcaaagatgagaaagtacgagtaatgccaagtactgatgagagtagaaagaaatcagttttctcatatttattggttttggtagtataaatttgttcaatatttttggagggcaatgtttattttaacattgtcatttttgcaaaaataaatttaaaccatgaaatgaccatctagcagaacttgttaaaacaaattaagatataacaataaaatgaatgcaaaatattcatcaacatgcatgagagatctatatgattatatgtgaaaaaaaatccctgccacagtatagagtaaaaggcatgttaccaaaaaagttataagaccaaatatgcaatcgagtcacctataaattataattaagcttacatctatttagtgcttatcatgtaccaggcactaaactacataccaagtgctacagatgcaagcatacacatatgcaagcacacatccacacatacatgtatacatatacatccaatttttatctttgtgaaataggaaagctggagtagagggtgggtggagaaggaaagtagggaggtagggaggttcaagaagaagtaagtttcagcaggattgtctgaatttttttagtatggacatacatttgctttgttatcaggaaaaaattgatcaagatatttccgttttgagagaaagcgagaaaaatatgtgatattttgttcgttcaccaaaaacattactcattattttcacaagactaactataattttgatatgagccactttaccaaaaatagtgccttgttcgtcttggtatttcatcttagatttttcacttgaaaagttattaatacatggtggctcgattgaatgacaagttacttttatcagatacttttgggaatgataaggttttgtaggttgattctagtttccattatgttaagaaattaatattataaaaatatgcagttttaaaaatatatgtttttcttcataaaatacttattttcaataatatacaaaagcacagtttcagtttttatgaaaactctttggatatttaatattttaaacatatacacaatatttattctgctgcctttagtggagtcaagttcaaatatttctgtacatgacttcagtgccatattatattgcataaatatatgtatattgtttatttatataaattatataaatattatattgcataaataaatatttatattatttaattatataaataatataatatttataaaatatttcatattataaatatttataatatcataaatataaatataatatttatattatttataataaaataaataatattaatatttatattaatttatattatttatttaaataaataatataaataatatttatatacatataaaatatttatttatatattatttatataaatataaataaatatttatataaataatataaataaatatttatataaataatataaatataatatttatataaataatataaataaatatttatataaataatataaatataatatttatataaataatataaatataatatttatataaataatataaatataatatttatataaataatataaatataatatttatataaataatataaatataatatttatataaataatataaatataatatttatataaataatataaatataatatttatataaataatataaatataatatttatataaataatataaatataatatttatataaataatataaatataatatttatataaataatataaattaatatttatattatttatttatatcatatc

SEQ ID NO: 473094 - DNA, 594 bp, Homo sapiens
gtcctgcttccacacagctggcagtcctaaaggctggtctcactcctaccaaccgatgcttctcattgctgctggagctcccactttacttcctccccaaagaatccatgggacttggaagagtgagtactctgtactggaaatagctcaaaaggaagtagcagttttttgctgtgagctgggcttctctcaacacaaagcaatggaagaaacatttcatgaagaggttaaagatttcagagtggtttgtttacatttggctttcagacaatgtggtgaggggtgtcaggaagggcagaaaacccttaataatgtggccacaccatatcctggtggatttaaatgtttcacctgtgaaaaggcagcagacaattatgagtgcaaccgatgggctccagacatctactgccctcgagatatccagccgtctgagtaatcgaaaataagttttattgccgtctgtagtcactgctcatttccaaatgggccagtattttctaacattaccactgtggaatgaacattgctaatggatctgattaaaccactgcttctcagacttggctgtctattgaaattacctggtaaactttc

SEQ ID NO: 473095 - DNA, 761 bp, Homo sapiens
cgggtggcaaggatggtggatttctttattatcttctttgtaaaagcaaccattgtcttaagcattatgcacctcagtgggataaaggatatctctaagtttgctatgcattatataatggaagaaatagatgaggacacatcaacggaagacttgctgaaaatgatggttatggctcttatatacagattattagtttgtttttatgagataattttcatttggggagcaggtggagctaccccagggaagctcctggtggggcttcgagttgtgacatgtgatacattagtgcttattgcactaagtcgtgttttagtgattcctttttcaaatgttagcattacaacgtccactatacgagctttgatcaagaattttttgattgcttcttttttccctgcttttatcacactgttgtttcttcaacataatcgaacagcctatgacattgtagcaggaaccattgtggtaaaaagaaatgggaagaaaaacctattaaattcaagtattaaaatttttagatcaaaaaggcaaatgattttataaacaatgaacaatatatactttcttaagatctaaggtactttcataagatctaagaatttgctgaaagcattttcagctttgaaatctccaaatgaaactttaaaattgattttggtttatcccaaaacaatggaaaatgtccagttgtgttttgtaaacatgtatgtaactcatcttttagttcacacttcctggggagccaccaaagaagg

SEQ ID NO: 473096 - DNA, 650 bp, Homo sapiens
aggaaaggagctgaggttggaaaaccatgcgttcatcttcaatatgactcgtctaggattcctgcttctcctcacctgcgaagactactcagcattgtccatagatgcttatgaccaggaactgacaaggaggctgggtcctgggatctgccttgttcttgctgtcttcctgtccaagcccactgccgtgatgctgggaagcaatgttggttctggtctgtgtcctgcagctgtttggggctctgtgctgagtagagcattaggaagatccgttgtgctgctgaggcccccttttcttccactcggtgcttttgcttatcctcctaccactgctgtgtctccttggatgacagacttggggacccaagtgggcatgggtgcctgcacttctatagcccatgttgctgatcctctgagttacaagcagaagctcaatgagagagggagaggacagcaacctcgggtgagggcgtggagacccagaccaggaagttgcaaatgcaacgagtgctttcagaggatcttatagccaagacatggccaagttacgtaaagaaggtgtctgctgtggagccctgtgaatgtccagctggggtgggtcaatgtgggttcaggtcagaggctcaagtgaatgtttactcaaagggtcg

SEQ ID NO: 473097 - DNA, 676 bp, Homo sapiens
cggcttcattcttgaagtcatgtcaacttgatcggattgaaggatgcaaagtattgttcctgggtgtatctgtgagggtgttgccaaaggggattcacatttgagtcagtggactgagaaaggcagacccagcctcaacctaggtgggcacaatctcatcagctggcagcatggccataaaaaaaagcaggcagaagaatgtggaaagactagactagttgagtcttctggcctccgtctttctcctgtggtggatacctcctgccctcagacatcagactgcaagtctttgagggcagctttgggactcttgggctttagaccacagactgcaggctgcactgttggctgccctacttttgaggctttgggactcggactggcctccttgctcctcagcttgcagacagcctattgtgggacctcaccttgtgattgtaatgtacggtagtgagcatttatcctagtctgttttatgttgctgtaatggaatataacagactaggtaatttataaagaaaatgaatttatttcttatagttctgaaggctgagaagtccaatgttggggggtctgcatcttatgagggccttcttgctgtgttataaccatggcagaagggcaagcaagcacacaggacaaacagacaggatgggggccaaacttatctatttat

SEQ ID NO: 473098 - DNA, 571 bp, Homo sapiens
attcattgctaataggaatgcaaagcagtacggccactttaaggatagattggcaatttcttacaaaactaaacatgctgttaccatacgatgtaatggaggaaagactgtcactaaatggagggagaagagggaggttacgtaggagagagcagcaagaagataaacagggaagggaaggaccaaagaagctgacatctcctggtaaactactgaaggatgaatctggctccttggacccatgggagggagaccagcttgatggctggtgtggccacacagctatagctagcaagaagcacgcagtccacgggaactattatgattctaaacaccttctggcagaactcaaactttttctaagtgatcgcctcttagtcaacggaaaggctgtcattgcacaaggagactgggtcacttatttctgggaggatgtggtgcaggtccatggaggggaagatcaacagctcaagctcagagagaaatatgtaccctgaaattcgagatgcctcgtgctaattcccatggagactggtgtcaggtaactgaggacaagaccgtaaacacagtc

SEQ ID NO: 473099 - DNA, 966 bp, Homo sapiens
acatcctgagataccatggttaaggtgaaggccagagtcaacagatttggccacattgggcaccagatcaccagggctgcttttaactctggtaaagtggatattgttgccatcagtgaccccttcactggcctcaactacatggtctacgtgttccagtgtggttctacccatggcaaattccatggcactgtcaaggctgagaatgggaagcttgtcattaacggaaatctcatcaccatctttcaggagcgagatcccaccaaaatcaaatgggacaatgttgacgctgagtacatttgggtgtccaccggtgtcttcaccaccacagagaaggctggggctcacttgcagcagggagccaaaagggtcataatctctactccctctgctgacgcccccatgttcatgatgggcgtgaaccataagaaatatgaaaacagcctcaagatcatcagcaattgcctcctgaaactgtggtgtgatggccacggggctctccagatcatcatccctgcatctactggtgctgccaaagctgtaggcaaggtcatccccgagatgaatgggaagattactagcatggccttccgtgtccccaccaccaatggcatcctggactacactgagcaccacgttgtctcctccagctttaacagtgacacccactcttccaccttcaatgatggggctggtattgccctcaatgaccattttgtcaagctcatttcctgttatgacaatgcatttggctacaacaacagggcagtggacctcatggcccacatggcctccaagaagtaagacccccagaccaccagcctcaggccctcagctgctaggaatcccctattgcactaggtctcctaccacactgagaatctcccctcctcacagtttccatccagaccccctgaagagggaggggtctagggagccccaccttgtcatgtaccaccaataaag

SEQ ID NO: 473100 - DNA, 846 bp, Homo sapiens
ggaaactgggaaccattaggtcatgttgagcaaaagagtgactgaagtggacttaaattttgattgggtcatcttggctattgtgatgagaatagacttgaggagcatctcagggcatgctcagtgctccatctgtctctactcattcacttcccccagtgtgaaatgctcacgttctgtgtggacgagagacttgagaaaagaaagagacacagagacaaagtatagagaaagaaaagtgggtcgaggggaccggcgctcagcatacggaggacccacaccagcaccagtctgtatagctgccatagataatgattcctctgatggatctgggcaaagtaaattgaaaaacttctggaaagaactcatcattctagataccattaagaacattcgtgattcatgggaggaggtcagtatatcaatattaataggaatttggaagaagttgattccagtcctcctggatgacgttgaagagttcaagacttcagtggtggaagtagctgcagatgtggaaatagcaagtctagtggaattattagaggatagcaagtttgaattgctgacaatgcatactcggtaagcaccaagttattttcagaaacatatgaacgttgcaaaacatttgcatttttttcttgggcctgtaaaacttggtattatgcctactcagtctgtaagcatactttacttatctgtatgctcatttgttcaacacatttattgagtgcctactatatcccagaaaatataaacataattcagttacttagataatctgttagaacttagtgacttaaataacttaccaggatggagaggagaattaagatggctgaatac

SEQ ID NO: 473101 - DNA, 521 bp, Homo sapiens
tcctcaccatcaaagatcaaaggtagataaatctacgaagatgaggaaaaaccagtgcaaaaatgctgaaaattccaaaatccagaatgcctcttctcctccaaaggatcacaactccttgccagcaagggaacaaagctggatggagaatgactttgacaagttgacagaagtaggcttcagaaggtgggtaataacaaacttctccgagctaaaggagcatgtcctaacccaatgcaaggaagctaagaactttgataaaagattacaggaattgctaactagaacaaccagtttagggaagaacataaatgacctgatggagttgaaaaacacagcacaagaacttaatgaagcatacacaagatattatccagaagaacttccccaacatagcaagacaggccaacactcaaattcggaaaatacagagaacaccacaaagatactcctcgagaagagcaaccccaagacacataatcatcagattcaccaagcttgaaacaaacaaaaaatgttaa

SEQ ID NO: 473102 - DNA, 678 bp, Homo sapiens
tggttcacactttacagctgatgggtcaattatctgattaatatgattgatcatttatcataatgggtggcctgcccctccacacctgtgggtattcccatcaggggggacgagagactgagaaaagaaataagacacagagacaaagtatagagaaagaacagtgggcccaggagactggcgttcagcatacggaggacctgcactggccccggtctctgagttccctcagttattattattttcactatctcagcaacgggaatgcagcaggagaacagggtgatagttgggagaaggtcagcaagaaaacatggcctcagggctttcatgagaaactcaatgcagtggaaagccagaagggtgttaagtggggagtgaggagtgatgccatcaggcctgttttgggaaagcacttctgctgttgtgtagaggtaactgcaggaagccaagcccttgtggagagactcagtaagagactcttgcaacattccaggtgtcaaagagttcactgcagaagcagcagcagacatgaaaaggagatgaattttagatctattttgctggtagaattgatagaatttggtaatagatggaatatacaagagtagaggggatggtaagagaaacgggaaaatcaaggatgactcctagagctttggggaagatgatggttgc

SEQ ID NO: 473103 - DNA, 839 bp, Homo sapiens
ccacggttctctaccgtgatccatggcttctaatagagctgtaacaccgcatggcccaaggttccattctttggaatccgccggtctgctatcggactgtatagaggtgggaaggccaaaccgaggaattatgtctgacagaagggaagaaatgaccatggtggccttcttagaccttgtgggaaaggcctctacctatccagtgaaagtgtctacccggaccaagaggtattttagtttcctgaattggggcatcaaatcacaagaaatagctaattctacccccatcttattgaactccctgaaagtgaatattctgattgtaattactgaagaatttgatatctacaaacctgatcctggcacctatgaagatgcatatctgattgcctcttttggaaaggttaatcagaaactcaaaagaatgcaaccattttttctcacctacctgtgacctggatgccccctccctgcttcgagttgtcctggcctttctggactgaaccaatgtagttgttacatacattgattggtgtctcgtgtctccctaaaatgtatacgaccaagctgtgttccgaccaccttgggcacatgttgtgaagacttccagaggccgtgtcgggggttcacgtcctcaaccttggcaaaataaactttctaaattaactgagacctgtttcagatgtttggggttcacacatctaataaatgcaatcgtccaataaaatgtcttctgatttacttcattcacaatttgctgatataataacctaagattataatttattttcccatagttttggtaataatattttcatctaggcttaaaggttgtgctt

SEQ ID NO: 473104 - DNA, 742 bp, Homo sapiens
gggaagaaacggagcagccagtgtcagggtcccgtgagaatatgactgacgtgttcaaggaataccaagaagaccaacggggatctgttcatgtaggagacagtaatgtaaaaggaatgatgggtcctggagtgaacccaacaactccagaagcagaagaaaacctcaagtcttgcctctcggctgatatccagtccaagggccatctcccatctggcatgtggaggcagcctaaggatggtaaagaatggggtgaagaatacgtcacaaaagaccacccagataaactcaaggaggctggccagggtagacacagctccttggaaaacgttttatgtgaaacctccttagctgatggctatccagttgtttcagcatcattaattgaaaataccttctgtttcccattgttgaagaaatggttaatatcaagtcctctttggtttgtttctaaagctaaaagacagactgtggccctggaactgcttgaatctgaaagaaaatatgtcattaacatctctctgatcttgaagataaaagccacattccaggggtcagatggaaagaggaattccaaagagagaaggtatccatgcactcattgcctttgcttttcagattgattaggatttaagtatattaacatttactatcggcatttttctccatgcaaagatgaaagtaagtatattaacatttactaactttcccatcacaaaccacaaaccttcagcacttttta

SEQ ID NO: 473105 - DNA, 3604 bp, Homo sapiens
ggcagcaggtggaataggagtcaactccttgagctttttgtctttaaagggagggtccagccccggaggtttcttggcaggaatttccagacccttcttccgcccgtcgtctgctggcttcgccctctccttgaggttggggtctctggactggtgcctcagcttctccatctgcttcatcctctccttgtgccccttgtggcgctcctcgatctccaggtccttctgggagaacatcctctggaagctgattatcatcatgtcgccatccccccggagcttttccctgggcctggcatttttcttgcctgggtctttggatggcgatactttatcatcccctttgctcatcttcacagagtcgtccttttctttttctgcactgtccttgaatttctccttcagtttggccttcctgagcctcgggtcctcatccctggacttgtctttgagtgcacggggagggctgtccttgtccctggcagtgggcttctgcttggtccctgtgatgccgcaggagccagtctgcatgcctgttccggttcttcctcttctccttctccgggaggcaggcgctctccctggcctcctcctacatgggtggctgcttgagagagatctccaggaaggcagtcatccctggctcctgccctcagtctgtgcagctgtcagaggagacctcactgattttatcactggagtcgtctctgtactcatggagagcttcttccaacttttcaagcaggcttttttccatgtcagcacttctcaaggacttcctctccttggaatattctttatctgacttctctttgtgtttgctgttagccttgtcttcagcagactgtttcttttcagccttctcagggagcttctgtttatttttcttatcttgtgtggagtccactgaagctctttccgtcctgttcttatacttttctggtactctttaaccttcttctccttgtgcttttcaaggactttctcttttttatctgtcacaccgtcagcagcccctgtgtcctttctcttgtctttgggctccttgtccttttgcctcttgggtgctgctcatcagaagaggacttcctgtgtctgtcagaggcataggcctcccgcccttcgtccttctcctagaggtcatccatcctctgtaagtcgctggcctctccgatcttgaacctactccccatgtagttgtctttgtcatcctctctctcttctgtgaatacgtctgcgacgtaccagcttttctccttgcctttcttgtcattttttttttcagagaagtcttctgagataatcccagggaaagttttctcctttttctctttcccttggtcaagagacactttccttttttttgtctttgccatgtgtgtatttgtgtttattccttggtatcttttttctctttaaaacatttatcaaattctctgtccttctgacatttttcgaggatagatttctcacttttgtccttgttactggacttctgtttgtatttttctggatttgttttctccttcctttccttatcaaggccgtccttcttctcttgcactgggtcttgcagttcccacggttccaggcccttcccaaaatcgcagtcagacttttccttgaagacactctggtagcctcactccttcagctcctcgcggtgtgcggtgtgcctcctctggcttggccctgcagtccctgtgctccttggagctctggagggtgtcctttttgtcctggctggcctctacggactctctctcctctttttgtcattttccaaaaggtagccggggacactttgtgcttttcagtctggtcttttctcagagtttttatccaaatagtccttgtccttttggaagaagggctctctgtagtctcgcttctcccgggccctgctgtcctgcttcctctcctggctgtcctccttcactgtttctaagatcagcttggccacagagttattcttcaagtccctgtagtctgtcactgaagagtcccagctgtctcccactttgaaatcaaaggatgaatcagacaagtcaaaaaaaccaccgatctggctgattgtcagaaaggctaaatttgatgtcttcattctccagaaactgatttttattaaaatattcatcaaaagcagaatcttccctataaaccttttcttttttgagtttttctttatcttctttaaaagtcttctccttctcttttgaaatgttgtcctcttttaaatcattctttttctctaattttgacggcccgtcttttcacttactctttctctcctctttgtacagtctcagtttttcttcctttgaagacttttccttcagagatttctccttttctgctgtattcgaacagtctttctcttcttggaaagatctgctgatatctttgttcatgcctttgattctcttcagtgatttttcatctttggagaccttaatgatctcatctttaaagagccattctttctcttctgatatcattttgctaagtttctcttcttttttaaagtggtctcgatcaagctataacacttttaacttattttcagtggaaatatcattctctaaaagtatagccttaatctgacttttgcttgtagtcctcatattcatacgtaaaacgttccaatttcagctcttggctgatagaacactgtcccttctccttgtttttgtgtttgtgttttgttttatgtttttttgacaactttcccctccttgttcagcttggggacggtgccctctgcgctggagaggaaggggcttctcttctctgacagggagccctgcagcctgcccagcttcctgtgctctggcttcttcctcactggtttcagcgattccacactggagcccccagaggagtaatcagactggcttgtcagtctcctccttgtggattctgataaagaactgacctctgaccaagccaggagagaaatggttttccaattgtctgtctgccagtgcttggtgtgctggtttgtattgttggggttctgcttctgggtagcagagcccccatgagatgaggtggaggaggcagacagggagatgaacagggaggggtccttcaacaccagcggggaacacttgaggcagctggagctccccatggagtccctgtcatcctccccactctctgaggactcactttccgactctgaggaaaagaacttgtcaatccattttccaaagcaaacctctctgccttttgtttatctgttttccttcacttctttttcatttttttttccttctgctgcttggcattagaagcctcccatttcttactaccaggcaatattgtatgtgccgagagtctcagcttctctcctgtgtccccatggtgacactcacgtcctcctcgtctgatgtgtctgacagaatatgatgggatgctttctttggtgcaatagtgttatttttagtgtaacttttaacctccattttgagtatagagataaaactattggattttgtttcttttctgtaatacttttttaacaggttcattcagagcacctttctcttctatttcagtgactcatagatatatggtaaaaaaaataaaaaataatgccttc

SEQ ID NO: 473106 - DNA, 670 bp, Homo sapiens
aagtaaataaatggagagatattccatgctcatagataggaagactcaaatcatttttttttctgtttcagttttgacagtctctgttgctaaattttctagtttacaaatctttcattgtgtaatttctaatctgctaataatctcttatagttgtcattttagggatgggagctttcttctatacattttagggattggtgcttccttctctattgatttgggtcaattctctatatattatttagacaatttagtttttaaagatgtctggaaatacaatttgagtaaacaatataatatggcaattccagagcctaataaaatcgcaggctacctgaagggaaatattgtatctcaatctccccaactactggaatcagatcttaggtgacttatgcatatcctttttacgttccttgtacatattctggaatctaaataacttagcaagtctgattaactcaagaatgccaatatgttattgagtcattggttaatatatgatcacttctatatttatatgtgtatcttcaaaatgcaacttttaatcatttaaattttgtgccaaaagaataattacaattaaaatttagacccagtgcccgatcttggttaattgattgacagaatcttttgtctttctaaaatttgaaattatctattctaa

SEQ ID NO: 473107 - DNA, 533 bp, Homo sapiens
tatatcctattggttccgttttgctggaaaactctaacacaaccagtagaaagaaaatccagtgaaaccatgatgaactctgcctctgtatctgtaagaagaggtgttctgtgggaacctgggttagttcagatcatctttggctttacagagcaaacatactttccaataaacgcaaaagaaactgaaaaaggcaaaagaaaaggagacagaaccgaaagtaaagctgtgcctctgcagatcaaacagctgagcgggctacttcccaaccaacttcctaccaaaaatgacacttgtaaggatcttggcactgtacatgatactctaggggctaaaaactccactgacataggtaaaatgtttggagcaaaatctattgatagctccttccaaatttttacccaaaatgttcagtattctttgaagcctgaagaaaaggagacactcaaacctatagttgaaaaacttatatccaagggtcatcttgtagccttcactagtactcatagcattccaatcctatgataaagaaa

SEQ ID NO: 473108 - DNA, 780 bp, Homo sapiens
acagtggctgcttcagatgggttgctgctgccatcaagatttgttgaatggctttgaccaaaatgctgataatgatatggacaatgaaatccatgctgaggttgtctcagatggagataaggaactttttgggaactggatcaaaggtgactcatgttatgttttagcaaggagcctggaagcattttgccccagccctagagatttgtggaactttgaacttgaacgagatttaggacatctggtcaaagaaatttctaagcagcaaagtattcaggaggtgacttgggtgcttttaaaggcattcagtttcaaaagggaaacagagcataaaagtttgaaaaatttgcagcctaacaaggcaatagaaaagaaaatcccattttctgaggagaaattcaagccagctgcagaaatttgcataaataatgttggggaaaccagctccactccacccagtgggtaccctgagtctggcagagtcaaaggagttagaaagagacagaataaacatttaaaaggtggatccaggggactggagcattgaagacttgctcacagcccagagctcttgggctccacccaatttattggtttgcaaaatctttgttctttgggcagatgggagggggaggaagggatgaggaaaaggattaatcagtgaaggagaactcctgagtcatttgataagatgtataacagtggcgattcctgtgaatttccttgagcaaaagtgtgagtctaaactacttaagatctttaacttatcaggactgaaac

SEQ ID NO: 473109 - DNA, 573 bp, Homo sapiens
ggcttgctctcccattgttgcatgtcatgccattaactatggcaaagcaaaccttcaggcttgcccaacagccaattacgcttcccgtctgggtacccacaagacatcttaagctgtgccatgagccagaatccaaggaagaggtaaaaacctcagaacgtccctgcacccccagtttgtcagatggctcagatgaacatctctgtcgagcagatggaaacggtaaaactccccatggaactccactgacctgggggcaaatgaagagactagctcacattgcaaaagacaacctgaggtctcagaacaagctgctgaccaccagtaatctaatggtagctatgatggcagtaacctccctggcggtgagtctcccgatagctgaggcagatcaaaattacccttattgggcctacactccattcccaccactgatgaggcctgttacatggttagaccccctggtggaggtttatgttaatgatagtgtctggatgcctggaccaagagataactgaggtcctactcatccagaggaggaaggaatgttaacgaatgtttccattggttatc

SEQ ID NO: 473110 - DNA, 590 bp, Homo sapiens
agaaaggaagaagacactcatatgcaatatatggctatgggattgggtgacggcgaggcctggaagcctagaaagaaaacagggtttcctggatcaggcccagggtccccatgctatgtgcagcctagggacttggttccctgtgcctcagccactccagccatggctgaaagggtccaacatagagcttggcctgtggcttctgagagtgcaagctccaagccttggcagcttcgatgccgtgttgagcctgcaagtacacagaataccagaattggggtatgggaacctccaccgagatttcacaagatacatggaaatgcctggatggccaggcagaagtttgctgcagaggcagggcattcatggagaacctctgctagggcattgcagaagggaaatgtggggtcagatcccccctacagagtccctactggggtaccacctagtggagctgatccctgacttcccgcaacagaagataaggttggaaagatgttttaagacctcgcagtgaagtgtcagtataccagacaataggcaagattttgtccatgaagaaaggggtgggtcattgaaaaatgagggag

SEQ ID NO: 473111 - DNA, 591 bp, Homo sapiens
gccgcgcacagctcagcgagccatgggtgggggattacatgtttcagctagtttactgccgccacctcgctctggagggctgcttccgggctggctcagccctgccgccacttccggtcacatggggcagctgccggacaccaggagacgatggaaggtctatagtgttacagctctgacccaggaagtcccagggtcttgccttccagaagggtcgcggctcttccctccctcagtccaacgaacaggagcacgtcacctcccgcagctcggggagctggccaggaacgtgttacagcccgtttcgctcctgtccgcagctgggagactgactcgctatcacgagaacagcatagaaaagacctacccccatgattcaatcaactcctatcaggttcctcccacaacacatgggaattgtgggagacgcaactagaaggtatcattcatgagacagaaaatagtttctgttgtgaggaaaatgatttctggttgtgaggacacaactagaagatattattcatgaaacagaaaatggtccctcaccggacactaaatctgctagtgttttgatcttggacttcctagcct

SEQ ID NO: 473112 - DNA, 2081 bp, Homo sapiens
cggccttaacgggcctggaaggtgagcagagtccctacaacgagtggaacggttagcggcacttgctctatgttctatcgaccttgctgtcggaagagagaaatggcagaatgacatcccccatttggcccgctggaaatgcccaccatcttttgggaagatttactggctgtttatagaatgcctgcctatataatatgaaaaagctgctctcaacttctcccccaaaaccttttaaaagaaaacatttgccacatccagcccttctagagtaaagaggttgccaacgtatgaagtagagttagaaaatcacacaccttgcaaattctcattagtttaaaaagaagtcatagaaaatgtcttctggagttgactttttgaaatggagttattagaccacttctggaagcaacacgtccacgtttgttcaatgggctagaggacatggagcagaagacctgagaaggaaaagaagtgccagtagaacgtatgtctgaaactctcccctttctgcctgaagttagaagactacatgttgaaagtttgctttgagcttggttcttcttgaacatgcagcttcaaatcaatgtctgtctgctcataagttcaaccaaaccaggactgccactggctgctaaagggaagaaaaggctccatgaagaattccagcgtacctcctgccctggcagccattctgctgtttctatggaaacattcaccagatagcagcatgctatactgtgcaagtgaagaagaaggcatcttcctttcatcaccacatctagagtgtgaccacttcacagaatgaaagaatgtggtgaacacagttctttattctgacagataaatcgttcaagagaaaggggccagatgccagtgacattttcttggacttcccagcctttagaaccatgatccaaataaactttggctggagacctgaaaaacttgttccacagactcccttttctggcatggtagattgcaccaatgagaagcatttgcacaagggttggaagacagaggaaaagaatgcagatgaaaatgagcaaagggaaaaggtgctgcggcaaagtctgcaggaaaccagttactccaagtggcacagctcagagagaaggtactctctgcttggggatggagaggaaactgagcaccaggctttgcctcagatcccaacactgggtctatcccacagccccaggcttcaggctggtatccacagagcctccaagcctgccccaccaccagaactgatctcaatccccctggctttggacccacccctatcccaggccaacccctgcagacttagattccaagctctttcccatgaccaggttggctccagtggactatcccaacacctggggcggggaggaagtgactaaagtcattgcctaacatagatgacagagaatggatataaacagtggatgacggttatagaatatacaaatatccctcaggtgagaaaatattccacatgtttcacaattatagtatattgaattttcatccaaattcagcagtttggtaaaagaatgaaaaaattaaaaggcagctattgcactttcactttttataatttcataaggtttgtgtttagtaatgaacttggcctcttcaccagctgaggtctttcattatctattatgtcctatatatatttctgaaactaattatccataagtacttatctgattatttctaaaaggaaaaggaaaatttccctctgcaaccctcctccacaggcgttacagttttatgtatatatttgtccagcgttgtctaccaaatgcttagcacaacactgattcctaaataatttatgaataggcaaatctggtccaaatcctgttcaaagcagagagacttcatattaataaagatgaaagattttacctaagaggacacttctgtaaactgaagtaatgagagagaaattgtggaatcccaggaagcagtgtacagtggtcaggaagacagggtaagtgtagaatatactccaaacctgcacatgttgaatgctcagcaatgataaaccagtatcctgtatgaggatgcacatttttagaata

SEQ ID NO: 473113 - DNA, 615 bp, Homo sapiens
gtctaggtcttcatggctgtgaagatgggagtaatgcttcttccaacctgggatggaagtatccctgtcaaagacagaatgatgaactattataaatatttggcatgttctgtaaatatgtggcactcaatcaaaagccatttaaaccttgaaaggacaagaaacataatgaaactgaatgagactatttcagttttacctgttttcttagaatgctttattgtgttgttttctttttcagaaaaagcaaaaggcttccagggcagtgtttctcaaagtatagtttctatggaatacctgcatcagtgcttctgggtgattggctacacttcaactcctgaatgggaagctttggggataaggcttggaagaagcaatccagccccaaaagatggagagtccattaccagctgtcaccctacttgccacaattctgatgcacacacccaatattcccataggaaggacaaccattaagtctgcccttgagcagactctcaccttctttagcatcttatcctctcatcatagcactgttacctaagactgagggcttctaaacagatttttgttggtttaaagtcttttttgtctgaaattgaatagcagtccctg

SEQ ID NO: 473114 - DNA, 569 bp, Homo sapiens
tgttctttctgagctgcagccagagattgctggttggttcataggaacaagcaaggaatctcaggtaagaccttttaaagccaaaccgagccatgggtctattctcaaatacctgtgagttcgttgatgctctcctcttaaggttccaagataaatttggagctcctggacctgttagaaagcgacattctttactgaccacaggtggttcctccaccagggagacaaatttaattgctgtggggcaaagctggcctccctggcctgggaaggaggagactccttgggcacattgcagaaaatgccagccagctgctcctggcaccttgggccatggattccagtcccagcaggcagcagggagcagcgatgagccactcacctcaccagtcttgtcccaaaagggaaaggaaaaggccatggaaaagctgcagttggttcccgatccctgggagcaacagtgggtggaggtacagtttcctccactctcagaaatctcaggatgaaaaggctcaaaagggagaggaaaaaataactctcactcactacttcttgagtctccacattgc

SEQ ID NO: 473115 - DNA, 543 bp, Homo sapiens
gaagcgataatcacacctggctttattgtgtggatacattatgtcacagccaacactttgtaattgtcaacgagtcattccctgcaatttggagtctctgcatgaacttatgtatctcatattcctggagtatgtatcagtaatcttgtatgcctatgacctagttgcgagtcttcagggacagcaaggctctggcttcttcggctatgctagtgggataagacactgtctcccaccaaaatgtctgaacagtggattccacaagcagaggaaaaggtctcaaatatcagaagattttaaaataagtctccaaatacctttattgccagcagatctaattagtttgatcagtcaatcaaacactgcaatgaggggaaattctaatttattgaccacctctcctgtggcagtcactgaaatagaaattatctgctttttaatcaattaacttggctgatgacaactgttgctttgtgctaatatattttatattttcccttatcagaaactgcatctttaatttgaaatattataaaaaagcaa

SEQ ID NO: 473116 - DNA, 1676 bp, Homo sapiens
gcggcagccacagctgccttttccctgaaatccaaatataattctaacccttacagggatgtcatgggaattctgcttcttggcaattttcacggattgtaaaattagcttaccaacttgcataaaaacttctgtggtggaggtagctctcagtgagttggatggggagccagatgagggatggagtgggaaggtagtcttcccctggagtttggctgcccagcagctagactctcctccaactgcccctggccaaattcccctcgacatctgcatcattctgccatcgatggcctgccagtgtctgctggaggtggcaagtgagaggctgaagctggatggggaggttggggtggacccagaggagcagggctggagggagctggctcctctgctggggatgcctctgggtcacgtatctttgaaaccctgggcttgccagtcctacactggatcaaacaggagggctggatcaatcctacactgtcagcaaaggtctgaattgccttacaagtaaactatcgcaaggacaaaaaaccaaacaccgcatgttctcactcatagatgggaattgaacaatgagaacacatggacgcaggaaggggaacatcacactctggggactgttgtggggtggggggaggggggagggatagcattaggagatatatacctaatgctaaatgacgagttaatgggtgtagcacaccagcatggcacatgtatacatatgtaactaacctgcacattgtgcacatgtaccctaaaacttaaagtataataataataaaaaagaatctaaattagaatataatgtggcacaaaatatcctaaatagtacatttaattcacttccatgaatcaatttcatttttggaaaagctctcatcaaaaggaaataatttaaaaaatgttttgtttatactaaaaatatttcaaactgactcagagagtatgaaattttaaaaataaaaatgacactatcacatataaagtccattctcctacaacgcatcataaaacctaatgccttttctgggtttaatacacgatgaaagggtaccaaatcagaggttcacaaagatcacttcgtgctcctaggacaaatgattattcataaaaatcagtttcatttccatatttgctttaactatgtaaagcaaaactaaaaacttttatctggacatacaggagctttcatatgagaatttcaggactagcataatgatacaatgtaattcttctatccaatataataatgatagatattctgactcaaatatggaatatcctgtatttggcttttaatgtttatcccaaaattttacaaatggtatagaagagcaacataggcttttccagaaaataaaagattatcatattttaactctactcaaccgttctcaggatatattctacagacaccaatagacattttcttatgtttatcagtttctttatatactcttgcatctcaaagcttcctgttagttaggaattgcatttggctcctagaattaggttggtacaaaagtaattgcagtttttgccattccttttaaattattgccattacttactaaattatgccattatattttaaattttaaaagtaaatttgcaattacttttccagtgccataaaaatgtatataatcatgacacagaagattggc

SEQ ID NO: 473117 - DNA, 449 bp, Homo sapiens
ttctagggcgcttagagccacagaatggaccgccgagtttcaggatcccctctggtggccgtttgttcatttggtaggcaacagccttggtcaacaatgcaatacctttccatacagagaaggcacgtcctcacatccaaagttccccagactttccactttgcaaggacttgcttgaagggcaactttgccaatacccaccttgttgagagcgtgagagaaaacggacagatgtacctctcagatggaagggccagaggccatggagggaaatggaaaacagaaccagagattgtcagatgggttaatcatagaatgtactccattgccaagaaaaggagttctcactattccttccaatcagtgtcccagggtggaggatccccaaaatatcctcaatttatagttagttggaccacagaagctgcctgtagacatgactgaaaggg

SEQ ID NO: 473118 - DNA, 931 bp, Homo sapiens
gacggtattgtactttgatgaccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctattcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatacgtatatgcttttgtttcattcttatagtaagagcctttggaagaggagggagaagttgggggagaaaaaaa

SEQ ID NO: 473119 - DNA, 610 bp, Homo sapiens
aactgcaaggggttgagagctgtgggctaagtgaggcacccctgttcagcaatgagatgcccagttcccatggccctgagcagcccaggaagaagcagagatcttccaggaatggtgataatgggtatgagggaaggaccctgggaggaggggcactgagtgtcagagcttgcgtgctgtgcgaggagacccgctgctctcttcagagccagcagacaggaaaggttaagtctgctgaagcttggcccacagctgccccttcccccaggtgctctgtcccagggagatgggagtttatctataagcccctgactgaggctgctgcctttctttcagagatgtcctccccagagaggaggaatccggaggggcagtctggttatagcggctttgtcacactgcagtgggttccacctgtttcagaaagtgagtgtcaagcactgcaggatttatttgatggccatggaattgagaagcaggaacatgactcacaaattggcttctctgctagtgaggggtaaagtggttaaaatatagggtttctccaatgaaaggactgggcattaaaaacaaagggaggaatattcatgtcttttctggaaataggttg

SEQ ID NO: 473120 - DNA, 621 bp, Homo sapiens
ctgctaatcctcaggaacaggaacgaacctgaatcacttataatgggcaacaagcaagcctaccctttgcttcagagggagacttctttattgtacctgggagaacctgctgtgctgggggtccaaaggtgttcctggattgctggccacaacactccacagacaaagcccttcaccagtcagtcatccagagattctgggcaggccatctggcttggtctttgggcaggcttgctgctggcatcctcaagtggacctattgacttggtataccagggtaggcagtcacttcatgagggcaggcccgaagcctctaatcacaggagccagactaaatcctacttcctggagaccaatctggctctaaagcaggccttgaacccatgtcttcagggtaccgagtccacagagcctcgcctggaactgggaaaatccagaacttgtgtctgtgggggctggcctagtgacagaggccacagaggctggcctagcatcagggctttgtgctcagatggacctaaaggcttggggagggtttgggatttgacaggaccgtatcctgcgactgtgagtgtcagtctggagctggggtctgcaagtgctggcctgaagttgtagctg

SEQ ID NO: 473121 - DNA, 690 bp, Homo sapiens
aaaggggcaagatttttctttaaatgtcacagaaaaaaacagaaatagctctaggagtccttacacaggtccgagggatgaacttgccaactgtggcatacctgagtaaggaaattgatgcagtggcaaagggttggcctcattgtttatgggtagtggcagcggtagcagtcttagtatctgaagcagttaaaataatacatggaagagatcttactgtgtggacatctcatgatgtgaacggcatactcactgctaaaggagacttgtggctgtcagacgatcgtttacttaaacatcaggctctattacttgaagggcctgtgctgcaactgcgcgcctttgcaactcttaacccagccacatttcttccagacaatgaagaaaagatagaacataactgtcaacaagtaattgctcaaacctaccccgctcgaggggaccttttagaggttcccttgactgattccgaccttaacttgtatactgatggaaaagataatagggataaaagtacaaattggacatcttttggcaaaggaagctccttaaaactcagccttggttacatcaagaataagaattcctgtgtcatccctaagaagtagatttttatataactcaaaaccagctcaagaaatataatatttaaacaaacttctcagtgcttggttaataagcattgttatg

SEQ ID NO: 473122 - DNA, 1239 bp, Homo sapiens
tcatcagttaaggcaggaaccagtcatctggatgtgaataccgccatcttgtggcctgttagaatatggcctcgaaaattgaaaccaaagtgcatttacacctgcaagcaccctggaagtggaatccttctgcaggaatctggttcagacaggcgctctacccagggtacacagggctgctgctgtgtggtgcagggccagtgtcaatatcagcagtggtgccacgtggcagtgaggagcaggagcgagctgacccatccagctttctacagatactggatcttctgttgatagcacaggagaaatttaagacggctgcagaaatttgggtaaataatgaggagccaaatgttaattcccaatacaatggggaaaatgtctccagggcatgtcagagggacttagcatcctgcttccaagccactccagccatggctaaaaagggccaaggtacagcttgggccgtggcttcagagggtggaagccccagaccttggcagcttacacgtggcattgagcctgtgggtacacagaagtcaagaactgaggtttgggaacctccacccagatttcagaagatgtatggaaacacctggataaccaggcaaaagtttgctgcaggggtagagccctcatggagaacttctgctatggcagtgcggaagggaaatggaaacaggaggatacagccaccagatggattcaggcagaaacagaaatactggagtggaatcactaccagctctcagttggtcagctgtcagaggccagagaatagatatcaagaattcaacacagatcaaacacaccagaaaggggctctgcacaggtggagatcagatctttacattcttctctacccagactgaccctttacaccttatctttatgcctgaaatgcattcagcttatcagctctgcaagaatatagagagattggtaaaatcttcacctctggttttgtggtttttctatatggttttaacttttaatattaaaattgttgatataactagaattatttttaatgtacaatgtataggtataacttgatttaggtataacttgatttttcccttcacttagccaatttcccaggaccatttcctgagtaattcgagcttcatttcatttaataaagagaaagtaagggtggagcatgttaacattagggtaatacatgttataaagcctttccttagtgccactgtcatggaagcatattctcatttgcttatt

SEQ ID NO: 473123 - DNA, 1090 bp, Homo sapiens
agaaaactggaaactgcgtcaagggtgactgaaattctgcttctgaattcttggaaaggaactctcctcatatgaccgcagggagatgggcaagacccggtgtgagaaccaaatgcagcgcttgttcagagcctctctcacatggggactgagaggtcctgatgacaacaaggccttcctaggccctctagactcagccactcctgtctccctcactattgtcagatgtctccagactctaaccaccagtatttcaggcccaagggatctcagacttgtcattctctttagtactgcagcattccccagaggagagaaccagaaatcccgtagaaaatgcagaagtagaagaaaggctacactgtgtttcctccagacacttcatttactttctgatacccaggaatttctggaaggagaagagaatcctggaaaaagcaagaagcaggaagataagaggcaaagaagaagagagccccacccactggggcaagctggggccccagatgaaagagcaccagcctgacgaatccataagaacaggaacaacatgaaagtactgagggcccaaatcaccaattttgttctctgggaataataaagacaacctgaagtaccaaaagtctaggcaagttataacagttaaagaattacaattctattaaaacacaccaaagactaactgtgtgtttaacttgaatgtaacttttcttcactgattctaaaagtatcctaggatcttagagtatctcaaggtcataattgtagataatactgtaatggatttggctactgttattacgtaatcacaactacctttgttaagtacttactattatattttccagaaaccatcttaaagggtgtagatgttttaccttatttaataatcacaccaactttttgagttagatgttaatgagattattcccatttttcagaacaataactaaggcttaaagaggtcaagcaactttgttggcaaaaccaggatttgttccagtgtctgatgactctgaaacaattgctcttaactagtctatcacctcttacgtagggcattggctccaaatgcaagaatcttaaagtt

SEQ ID NO: 473124 - DNA, 1067 bp, Homo sapiens
tggagactcgctcattgctagcacagcagtctgagatcgaactgcaaggtggcagcaaggctgggggaggggtccccgccattgctgaggtttgagtaggtaaacaaagtagcctggaagctcgaactgggtggagcccaccacagctcaaggaggcctgcctgcctctgtagactccacctctgggggcagggcatagccaaacaaaaggcagcagaaacctctgaagacttaaatgtccctgtctgacagctttgaagagagtagtggttctcccagcacaaagtttgagatctgagaacggacagactgcctcctcaagtgggtccctggcccctgagtagcctaactgggaggcatccccagtaggggcagactgacaccccacacagccgagtacccctctgagacggagcttccagaggaaaaatcaggcagcaacatttgctgttcagcaatattcactgtactgcagcctctgctgctgatacccaggagaaaaaggtctggagtggacctccagcaagctccaacagaactgcagctgagggtcctgactattagaaggaaaactaatgaacagaaaggacatccataccaaaaccccatctgtacgacaccatcatcaaggaccaaagctaaaggaggaatttcaaacccatcgtaaagaagctaaaaaccttgaaaaaagattagatgaatggctaactagaataaccaatgtagagaagtccttaaaagacctgatggagctgaaaaccatggcacgagaactacatgacaaatgcacaagcttcagtagccgatttgatcaactggaagaaagggtatcagtgactgaagatcaaatgaatgaaatgaagcaagaagagaagtttagagaaaaaagagaaaaaagaaagaaacaaaacttccaagaaatttgggactatgtgaaaagaccaaatctacgtctgattggtgtacctgaaagtgacggggagaatggaaccaagttagaaaacactctgcaggatattatccaggagaactttcccaacctagcaaggcaggccaacatttaaatt

SEQ ID NO: 473125 - DNA, 984 bp, Homo sapiens
cttctggaactgctgagtggggaactagttctaaggaacaaggttagtgccccagcagttggagcagtttgccccccactgcactgtgggagcccctttctgggctggccaaggctgggaggtgtggagggagaggcacgagcgggaacctgggctgtgtgcggcgcttgcgggccagctggagttcccggtgggcggggacttggtgggccccgcactcggagcagccagccagccctgctggccccgggcaatggggcacttagcacctgggtcagtggctgcggagggtgtactgggtcccccagcagtgctggcccaccagcgctgcgctcgatttttcgccgggccttagctgccttcctgcggggcagggcttaggacctgcggcccgccatgcctgagccttccacccactccatgggctcctgtgcggcccgagcctccctgacgagcaccaccccctgctccacagtgcccagtcccatcgaccacccaagggctgaggaatgtgagcgcatggcgcaggactggcaggcagctccacctgcagccccagtgtgggatccactgggtgaagccagctgggctcctgagtctgggggggaatgtggagtctttatatctagctcagggattgtaaatacaccaatcagcaccctgtgtttagctcaaggtttggattgtaactacaccaatcagcaccctgtgtttagctcaaggtttgtgagtgcaccaatcaacactccgtatctagctgctctgctcaaggtttgtaaacacaccaatcagcaccctgtgtttagctcaaggtttgtgagtgcaccaatcgacactctgtatctagctgctatggtggggccttggagaacctgtgtgtggaaactctgtatctaactaatctgatggggacgtggagaacctttgtatctagctcaaggattgtaaacgcaccaatcagcaccctgacaaaacaggccactc

SEQ ID NO: 473126 - DNA, 684 bp, Homo sapiens
caccttgtgaccttaacatctgcaaagatcttgagaatctaagtttactcattgcttccttcaggaacctttccttacctctgtaatcagtcaaatcctccctactcctgggctactcaaactatgaagcatcctgacaccagcattaagttactgctgctcctcccagcaacccagagctgctggaggccacctgcattccttggcccatgctcccttcctccattgtcaaagccagcaaaggtagcatctgccaatatgacttctgcttccataatcacatgttcttctatgactctgaccttcctgcctttgtcttataaagaaccttatgattattttgggcccacccagataatccaggataacctccccatctcaaaatccttaatttattcacgtccacaaagtcccttttaccagaaggagtcctttctgggcggtggtgcttttgcctctctggtgacctgggacgaatgtcaaatgccacagcaaagcttggaaatattgcccaggtgttacgactctctacatatatgttccaaaaaagtcttcagatgacaaattaagattgacttagaaaactcagtagtggtcctaaacatcttaaataacagaattataattaaaaatacatcatttcctatattctactttcaccaaatgatatgtacaatcatttcc

SEQ ID NO: 473127 - DNA, 3667 bp, Homo sapiens
tggactggctgattttgggtcatgtggtcaaacctcctccagtcaactttttcatctgcagtgaagggcagagttattggccatagaggccgcctcttccagagtctgagggtgtggcagtggtacattacatcccttgcagctcccatgtccttctggctccagcaccatcagtttaccatggagattctcgacctccaggggctaccatgccacttctcatacacccctggaaacctcctttcacagcaagacactggggcctttggtatagagatttgctacagcgatccaagcagctacataaggaccctgtggtcagaaaatggagtcacagctggggggtggaatccctgtttaatctttgaggactggagcctgacagtggtctcagactgtctgatcggaatgcaaatttcctacctcaattttgcccctggtgagatgcttgccaaaagacacgcccacaagtgtgccacgtcagtttaccattgccatgacaacactaggaacaacacccaggaattaccgcctctttccatggcaatgacctgatgatccaaaagttactactcctttcctagaaatttctctgcaaaccaccccttaatctagatgaaattaaaaattaatggataatttttcaaaggtagaattatgattctcatactaatataaaatcaacatgtcaaagattttacttaaatgattaactaatgaggaaaggagtaagatacaactggttcaaaaggaagaatttaaagagccacagatatataggtaagaaatgctgaaatgaattaacaagtacagttgatgcaaaactggactccccagagggcaacaatcaattacaccccactggatacaatctatttgcatttctgtggatacagggaatttgcagttatttctagctttctgcaacttgcatagttgtaaaatcgcttaaagaccaagaaaggcagttataacccagtcatcttttttggccatttgaatgtcctttacaatttttcctgcaaccatgaatctatttcctgtctccatgaatctatttcctgtctccatgaatttgcctattctggatttaaattccatatcagtggactcatagaatatctggccttttgtgtctggcttcgcttagcataatattttataggttcattcatgttgtagcatgtgtcagtacttcattcctctttatggccaaataatatttccctcagtgaatagcgacagtttgacttcctccttacaaatttggaggccttttgtctgagtgctctggctgggacttccagtactatgttgactaggagtgactttagctcttacatttagatctttcctcccttttgagttaatattttaaaattgaggtataatttatgtaacacactattaaccagtttaaaatgtacaattctgtggtatttagtgcatttataatgttgtgaaccactacctctctctagtttcaaaactttttcaccaccccagaagaacaacctgtatccatgaaataatctctattagccccctccacaaatcccctgttaaccactagtctgctttctgtcttgatgaatttgcctattctggctattttatataaaaggaatattctagtatgttaccttttgtgcctggtttctttcagttagcgtagtgttttagagattcatccaagttacttcattgctttttctatggctgaatattccattgtatgtatatagtgccatttgctgatatattcatccattgacggacatttgggttgtttccacctttttgatattataaataatgctgctataaatatccgtgtacaagtttttatgtgggtatatgttctcattcctcttgtatgtatgtgtgtatatatattatatatatatacaaactttgtacatatttatacacacatatatacattacacacacacacacacacacacacacacacacacgggagtggaattgatgggtcatgtggtaattctatatttaacttttaaaggaactgccaaactgttttctatagtggctgctttattttacatacccaccagtaatgcatgagagttctaattcctccacatcctcatcaatacttatcttctgttttttaaaaaaaagttattatagccatcctcataggtattaagtggtatgtcattgcagttttgatttacatttcctaatgaccaattaatttttgcatatggtgtgagggaaggatccaacttcattgttttgcctgtgtctactcagtgctgtttgttgaaaagactcttctttccccacatagcaatcttggtacccccgtagaaaatcagttgatcatagatgtatgggtttcttcctgggctgttaatcttactccattaatcgacatgtctattcctgtgctagtattacactgtcttgattgctttatagtaaccaggaacctctgtagtaagttttgaaatcaggaagtgtagtcctcctactttgttatttttcagtactgttttggctagtctgggtcccttgaaactccatatgaattttacaatcgttattgattcctacgaagaaatcagttgggattctgatagggtttttgttgaacctgcagatcagtttggggagtttcactatcttatcagtgttaagtctactgacccataagcagggaatttttccatttatttagaccttctttaatgtctgaaacagttcatttataaggcccatccatgtggtcaactttctgggacttacattttgaacctatgaaacattcagggaaagaagttttgtggaaggtggggaagggtataatgaattctggcttgatgcctcattcttgaattctccagaggtgatgaggatctccccttctgagctgcaccctttacagaagtccttatctgtcccttgaacgcccagtttcagtttttccctcttgaactcttagcattctgttgttatgaaatctcctggatatctaattggatgtatattactagagtgcttctgtattctgacatcaagtttcattttaattatatgggagaaaaactaattcttttaattaaaccaacatggatattaactattatcattgacttctagcagataaatcttacatgcaaaaaacagggcaaatacctcctgcactccttgggttgcctgtggagcagcctctgggaactcagtctcaaggagatgaagggcccatgggcattcctagttccatggaggatggggactagtgtggagcaaacttgtcaggatcatttattcattcacttttagttgtatgtttgctaaatccttacaaataaggtgtaaaccaaaaataaaatcctaagcaccccctcgctacctacctgaaactgaatggatcccctctggaccaaggggaccccagagaaacctgaaaaactgaattcctggtgtattagtcagggttccctagagggacagaatatgagattatatatatattatatatatattattaagtattaacttacatgatcacaagttcccaaaataggctgtctgcaaacttgagatgcaaggagagccagtccaagtcttaaaactgaagaacttggagtccgatgtttgaggacaggaagtatccagcatgggagaaagatgt

SEQ ID NO: 473128 - DNA, 640 bp, Homo sapiens
ggtgaccctcatggggacagtacacccgggagattcatgttctccaggtacccggagctcacggactgaccctcttctcctgcctcctctggcctacgtgctccgggactagagaaggacctgactccttgcttcctactggaacacgcaaatcaagctcactgtggctgagggatggctgcccagccggctgagggtcatgttcagcagtttctgcttatctgtcccctacccccaaagtcagaggtggagggaagtagcagaatcaagtcaatttccttcatgattggaaaatattttaaatcaagagcagtctcaaccacacagccatacccttctggagactggaaagattgccccagcaggagtgcccctgggaaagtcctaaatcaagcacccagaaatactcaggcaagtacacttaatgatgttgatggaaatagggtagtgatgattaacagaagcaaaagagagataggagaaagaaaatatgaagaatcaaggaaggagaaatcaaagaactatagagagctgaaaaggtggcttggtaatttatttttcagtatgggtcagtgtgcctgataaactcaagagattctccccaagctcagaggaaaagggaaaataaattgagagagct

SEQ ID NO: 473129 - DNA, 670 bp, Homo sapiens
tcctctcttctgcaaactgcagcagtaataggtgaatgtcacaaatagaggccagtggagggtgggaggctcccggggaggcattgcccaatgcagggcaaaggttacaatgtcaggctaaggctttctaatgaagctcctggttgtcatgtggtggcagaggggagagctgaaatcaggattcgtgcatataaaagttgtgtggtttgtggttttgcttttattttgaatttcttcctggggagaagcaccaaagcatcttcagtgcttagacctggaaaggtcaacgtccatcctggagatccagtcacaaccacaggaccacagaagggcagagctgggagggcctgtggaggtcactccatccacccaccccactcccagaaccgtacaggctgggcagtccaggccaattcaagcattcccttctggttctatcaagaaagtctaggaggggagtggagagctgcagaggggaaggagggaggggatcagaaggaggaggaggaggagcaggaggaggaagtagaggtgaaagaggaggagagtggtagactgacagaaatttttgctcttcctggcaccctgctcctacccctggacctaactgagccttcccaggtgctatgcactgaatgtctgtatcctgcatgatgggattagtgccctt

SEQ ID NO: 473130 - DNA, 579 bp, Homo sapiens
cagggagtttggcaagttcagcctatatgccgtcctcagctgaagcactgagccctggtccagtcacttgtggccacagaagtaaggttggttttatgcattaccagtcacacagatatgctacagatatgcttttttgtgtatgccacagtcacacaatagttgtattgtgtctggagttggttcctgcctgtgggttcacggtctcactgacttcaagaatggagccccagaccttcgtggtgagtgttacagctcttaaagatggtacggacccaaagagttccatcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacagaagctttaaaaattgtaactttttttctggagatctaggccacagaaaaagatggaaaatgcttagtgaattgtaaaatcttatgggtcatttctaactagattttttttttttttttactctaagcttctgtcattttcccgttggg

SEQ ID NO: 473131 - DNA, 588 bp, Homo sapiens
aggagccagacgaaaggaagctcagagatgtttgttattactgaccttctgaagcctacttccgacaactcgtcaaactcattctccatccagttttgttctcttgttggcaaggagtcagacccctcagctgcagatctgttggagtttgctggaggtccactccagaccctgtttgcctgggtatcaccagcggaggctgcagaacagcaaatattgctgcctgatccttcctctggaagcagctgtcagacagggacatttaagtctgcagaagttgtctgctgccttttgttatactatgccctgcccccagaggtggaatctatagaggcagtaggccttgctgaggtgtggtgggctccacccagtttgtgcttcctggcctctttgtttacaatgttgatctcagactgctgcgctagcagtgagcaagctccgtgggtgtggaacccgctgaaccaggcatgcgagggtatctcctggtttgacggttgttaagactgtgggaaaagtgcagtacttggtcaggagtgtaccgtttctccaggaaagagtaaaagcaacaacaaaaaaccctagaaagtt

SEQ ID NO: 473132 - DNA, 1122 bp, Homo sapiens
ccagcctgaatcagcttaggttggaaccggacaattggtgtagttagcaggattctgaagtgagtgagtcctcagcacctgatgatccctggttggccatgtggccccaacatgggttgcggtacttggtggcagctgtgctgtccagatgggccctggtggaaacatgggcagaggtagacaggtcccccatgagcatggagaaggccctgaagcacctggaagcatacaacaccgagaaggagggtgcctttgccagcagagttggatgggcatttttgactatgctatggaaagtgcatgcccagtccctgcgggatacagcacaggtgagcaggcagttggcacaagggaaaggtgaccatatcctgactgaatggctgatggcagccatgtggacagggtggaatgatgccagagaattatcaaaaactgtgagtaaatggcaatcatatgcagagctggtggaggacaccagagatcagaggccacatgtggaattggcaatccactggtaccccaccaatgtacagcaggtgttggtgctggtaggtactgatgcagattatagcctcgtctatgggaaacgggataagtttttaggcaaggctgcatacacagatggttatagaggccagtcagtgaaaatgacagtggactatcaagaactaaataaagtaacagcccctttacatgcagcagtcctgtctatcacggatttgatggaccacctgacgatggaattgggacagtaccattatgcagtggatttggctaatgcatccctttcagatgatatcgctccagagagccaggaacagtttggcttcacatgggaagggcgacaatggactttcacagtgttgccacagggctacgtgcatagtcccaccatatgtcatggtctcgttgctacggatttagccacctggaaatttccaaaggggatccgcctattccattacattgatgatattatgttaacctctgattctcctgcagatttagaagctgtggtgcccctcttgcaacaacatttggcagcatgaggttgggctgtcaatgaatccaaggtgcaagggcctgggttgtctgccaaattcttgggagttatctggtcgg

SEQ ID NO: 473133 - DNA, 1381 bp, Homo sapiens
attgcagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaagaacagtgtctgacacagagtaagcatgctataaatgttacgcatgattgtcctgaatgtcggtattgaaggacatgtcagctcttatagagcagaaattgatttcatgtgaagttgtgaccactgtcacaccagggtgggagaaggtagcagaaagccc

SEQ ID NO: 473134 - DNA, 1033 bp, Homo sapiens
tgacgttttggagcgagtgaagcacacctgaagcctagtcccctttgtaaacaaagccaccaggaagtttgaactgggcggagcccaccacagctcagcaaggctgctgtggccagactgcctctctagattcctcctctctgggcaggctatctctgaaaaaaaggcagcagcgccagtcagggacttagagatataacccccatctccctgagacagagcacctggggaaaggggaggctgtgggtgcagcttcaacagacttaaatgttcctacctgatggccctgaagagatcagtggatctcccagcacagtgttcgagctctaataagggtcagactgtctcctcaagtgggtccctgacccccgtgtatcctgacggggagacacctcccagtaggggctgacaaacacctcctacaggagagctctggctggcatctggcggctgccctctgggacaaagcttccagaggaaggaataggcagcaatctttgctgttcttcagcctatgctggtgatacccaggcaaatagggtctggagtggacctccaacgaactccagcagacctgcagcagagggacctaactgttagaaggaaaactaaaacagaaaggactagcatcaacatcaacaaaaaggacatccactcagagaccccatctgaaggtcaccaacatcaaagaccaaaggtaggtaaatccacgaagatggggagaaaccagcagaaaaaggctgaaaattccaaaaaccagaatgcctcttctcctccaaaggatcacaactcctcgccagcaaggaaacaaaactggatggagaatgagtttgatgaattgacagaagtaggcttcagaaggtgggtaataacaaactcctccgagctaaaggagcaccttctaacccaattcaaggaaggtaagagccttcaaaaaaggttagatgaattgctaactagaataaccagtttagagaagaacataaatgacctgatgaagcttgaaaaacacagcacaagaactttgtgaagg

SEQ ID NO: 473135 - DNA, 673 bp, Homo sapiens
aaaaccagaaaggagctattcatactgactccaggtatgcctttggagtcatccacacctttgaaaatttgggcagagcgaggtctcattaacactgtagtccctatcttctcccccagaaagcaagaaaagctagaagaaataggagccaaagaaagccatgagggaaaatgggtactaccagacaagagagaaatgctgtctaagcccctcatcacaggcaccactcctacagtttccagtacaccaacatcaacctggggaccatatcctcatcaaaagttggagagaaggaaaactcgaaccagcttgggaagggccctacctagtgtttctaaccaccaaggccacagttcgaacagcagaaagaggatggactcatcacacccgggtcaaaagagcaccaccccatccagaatcatagacagctatcccagcgccaactccaaccaagagcagagcttctctgctgaagttggtccaatgctctatgaaatactaaagagcaaggatggactgccccaactagtacttgcagtttcttgaaaccttatattcattttactaaaggagttaccccttccaattgtcagctgaaccaatgtaatctagtacagattaccattgctgctccccagagttcttcccctccattaagctgtttctgtggtat

SEQ ID NO: 473136 - DNA, 855 bp, Homo sapiens
gccggaagagagtcacccacgagtcatcacttcttcttggatctcaatatgactgatgtctatataaaaaggcagaatttggaggtagatgtgcacacatggagagtgcaatgtgaatatcaagatgccatatacctgccaaagagagaggcctggaacagtgcctttcctcacagccctcgaaagaaaccaagtcttcatctcgcagcctcagctgcagtcactaccgctgctcctgagagcccttgcaggggctttgagacttcagagaagacctgccacctggagtctccagcagaaggaggagagggagtgtttgccaaaatacagcagcagagtccagtgtgcagatcacttcagagtcagcgtcttcacagtgtcctcagggacagagacctggccaagttgtgctccttccccaggggcgagggttttctccacacacccctcctccaagatcctatttcagtaattctcatctttctgaagttgctgcctctgtgattcttgaatgtttgctttcttttttgataccaatttcacatgactcaacctagtatttgcacatctgaatttaacagtaaatcataaatataatggtcactctaacaaagggagaatattgctcccttttcagtgatagacagatgcttggcctatcactgagatagagtaagagtaagagatttattgagggacaacgcttgtgagggataaatgagcagggctgtcagagcctggtgtagtagtaacccttgtggagaagggcaggaaagagggaaggaaggaagactgggtaggcaaagtcttagactggtttagctctcagaaaactttagcaaagctgtcgggtgg

SEQ ID NO: 473137 - DNA, 607 bp, Homo sapiens
gagttaatgggtgcagcacaccatcatgtcacatgcatccatcttctatgggtttcttttaaggttatttgctggggccctgcaaatcagactgacagaagacggcgtaacaggagaaaaacagatttttcagcttattatcctgtgcagggtacaaggaggaatcttagtgatgagacctactgaggaaatcaggagccactattgccgaaaaggcctttgcaaaagagcgctgaatctggctggtaacttgttcggagctttgaggatgggcagatttccagtctctctactaagagagcagctctcttctgtgatttattgcaaagatacaagtacatttccagtttcaatattattgcctggatgtagtaatgactattggctctttcaagcatgtaaacataaaaacaccagagaaggcagaaggtgtatttgtttgagaaatattattgtttggtccaactgttttgttatttttctccaaaaatatgacaacatgaacaagtaatgtgaaagtgccaagaaattgatgtttcatggcaaagccaacagtctctggaatgcttaaatcatgttacatagagctatcatttccttctccctg

SEQ ID NO: 473138 - DNA, 1331 bp, Homo sapiens
cagggccaccgaggcaggtggaatattctagaagagcaaattagcaaaataaattgaagagagaggcaatcaacacaagaggagaaatctccaatgtctctatcgtctcatccccggggaatcacgccttcccagtgcctacttggtctcacccttggtgcatcatgcctctccagtgcctggactgactaatctctagggattcctgcctccccagtgccttcacagcctcatctctagggaatcctgcctccccagtgcctgcgcggtctcatacctagagcaatgaagaaggcacggaatgaaaggtgatgtggatgcggctgcagatcctcttcctgcctgcaggagccctggtccatgggcaggtcctctcagtctcaccttcctcgtgtggcaacagggataaccattcgtacttcatgcactggttttaagcatcagatttcctcatgtctatagagtgccacattaaaaatcacttaaatgccagtgggctgtcctttttgtgtgtaatttttttttcaagctattttcttaagacattttgccagaaatggaattactgagtcaaaggaggtagacattagccacaaatgtcaaacttacttatgggcaattttaaaatggcctttttagtttcaagtactagtatttgaaaaaagatattcatctataatggatccattatatgtagggcaagcagtcctatttcttttaaacaactttctaaaaaattaaaacaaaaataaacaatcaacatcagaaaatgaaattatttaactttgattttcactagctgaatagtgcgtatatttagagggacaatatgtcacctgaaactttggaatcattacaaggagaacccgaaagtacagccaggaccatcacatatcacgtggctgttaagggcagagccgggactcgaacccagaaggccagcaaacagtgtgtgaagcaccgacgtcaaaggccattaatgcaaatgcaaattgacatttttcatcaaggtctaacagtacaccaacagatcattaaaaagctcgatattcatttcttcagtgatgaggttcatctggaagttaaggatttaatttgtggttttgaattttacctttttcctgttagagcacaaaagaaaaactattgcatcacgaaagttctctatcatgtgaatcgtttccatacacatacaacagtgaaatattgccaagcagcaataatgaaacagtcacccttttcctcacgatagccatatacattctcagctctccaattcgttgccaccattagctctgttttatttattgtgcctgaagcctgatttccaa

SEQ ID NO: 473139 - DNA, 613 bp, Homo sapiens
agcacgttgtcacctctcaagagcaccacagcaaaggcatagtggctccacagcatttcatgttctcatgcttttcatttgtttccagaacatttgggtttgcttgtgggagccattttaggatgactgctttaaaacccttgtcatataatttctacatcttactcgtcagcctattggcctttgttgatttaccttttctcgttcaagttgtgattttcctggcttttgtgattccaaggggctgcctgctgggtaactcggagttgttcaataccttaggcttttaccaactacctggacaaagtgaagggtatatttatagtgagactcgatcgtatgttgttaataccacaagatgggctgaattcacaaatagagcatttctgatggataaatttggacttaatgttgatgaacagaaaccagaacatgtggcgttcattgttcctagcttacgttttgtgcccatggctatcatctatgcctgggacattttaacctacatagagtagtgtggtttgcaatactttctcgaccttgatgttttcaaatttcatgttaatttttattggaacccattagcatgtatttcccacccccaattcaccct

SEQ ID NO: 473140 - DNA, 1157 bp, Homo sapiens
atcctttttggacacatacatttccctcaggaactcaccatgaggcagtttctggggatctaccagaaagcaaataaactaaagccagataaactttctggctttccaagaccttttatcactattcctgtctggttcacatctcactctgtggcctgtgcctattttaagttgaatccagaaactcaccctcttcaccttgtggcagctaggacacaggcctgtgagctacactcagttgatcacgggacccaaggaagacacagtcacaagagaatggtaacaggaagggctatgggagagtccactctgcagcgcatggaaagcagaaacagccagcttttagggacagtaggggccatcctagagcagggacttattccctgggttgttggtgttggtggcagtttgcatgttcaggagtggtggaagaattccaggggaacattccaggctgttaacttaaaaactgttcctgatgcttgggaagtctttgcactctgtccatgtgagtcttttccttcatatgtgagccctcgcctggcgagccagagaaaacagggtccagatggccgagaagactctcatgatgacaactcccacagaagagggggcctcaggactgatgtcctcatgaatgagctcaggttcctgtcctgtatccctcagagtggagaggggacaactgttgccaataatagtcttgggagtcccaagggtttgttaaactcaaaaggccccactggtcatgtaacagtccaagggtctagatcagaaggtggatctctacacacggagattcaagcagatgcaggctctttcctgtatcatcctgggggctacttcaccctctggggcagtgctgcccaagagaactttctgcagttatggaaagtctatatccatgctgtccaatacaatagccactcatcacagatgacacttgagtgattgaagaatggctagtgtgattgaggaaccaaatttgtcctttgatttaaatttaattcacttaaatttacacagccacatgtggccagtagttactgttttggacaacatggatctaaggcctttaaatcaccagcatgatcaaggctcgattgccatgtctaggttctaataagatatggatgtctcactgtctttcccagact

SEQ ID NO: 473141 - DNA, 1058 bp, Homo sapiens
tggagagggttggtcaacaagtagaaacaaacggcacaccaggagattatatcccgcgcatggcttggagggtcccatgcccatggagcctcgctcagtgctagcaaagcagtctgagatcaaacttcaaggcggcagccaagctgggggaggggcgcccgccattgctgaggcttgagtaggtaaacaaagcagcccgctgggaagcttgaactaggtggagcccaccgcagctcaaggaggcctgcctgcctctgtaggctccatctctgagggcagggcatagctgaacaaaaggcagcagaaacctctgcagacttaaatgtccctgtctgacagctttgaagagagtagtggttctcccagcacggagtttgagatctgagaacggacagactgcctcctcaagtgggtccctgacccccaagtagcctttctgggaggcaccccccagtaggggcagactgacaccacacagggctgggtttccctctgagatgaaacttccagaggaacaatcagacagcaacattcgctgttcagcaatattccctgttctgcagcctctgctgctgatacccaggcaaacagcgtctggagtggacctccagcaaactccaacagacctgcagctgagggtcctgactgttaaaaggaaaactaacaaacagaaaggacatccacaccaaaaccccatctcaacgaaacaaagctggacggagaatgactttgatgagttgagagaagaaggtttcagacaattaaacttctccaagctgaaggaagttcgaacccatcgcaaacaagttaaaaaccttgaaaaaagattagacgaatggctaactagaacaaccaatgcagagaagtccttaaaggacctgatggagctgaaaaccatggcacaagaactatgcgatgaatgcaaaagcttcgtagccgattcgatcaactggaaaaaagggtatcactgattgaagatcaaatgaatgaaatgaagtgagaagagaagtttagagaaaaaggaataaaaagaaatgaacaaagcctccaagaaatat

SEQ ID NO: 473142 - DNA, 922 bp, Homo sapiens
actgaatttggctttggtgtttgtcatacactatgacacactttcaagtgattgacacctatcagaggacccaagaggactggactgaaggaccagcagcaggaaagggcaaagctcctgacattgaaccacacacggtggtggtagaaaagccgggcgaggaacgtggtgcacctcagaggctcaccaaacggagagagggtgtctggcccatggtggtgggtagatcccaatccctgtcctggccccaagatgcaacctttaaccacgcaggatgtttagcacttagaccaccttctgaggcacaaccaaaggacctgcaaactctaagcgagcacttcagctttccaggtatctgctgggacactctctctctgatgtgggcatgcaggggtccactgaggcgattccagcctgtggaggtgcaccttggaccctactcatgtggtgagtccagagccacctggactgactctttggactggagcaaacaacctggggttggaagcacattctttcgatagacaaactgagagcttaggctacttaactgacttttaaaaggggtctctattaagcaatatattttgtttggttttctcaaagggaccaaatgtacacaggaaactcaaagatttagtgcccacttactccttttctgagccagtatcactagtgaaattataactaggaggagccacgagggtttaacattctagtgctaagcaaccccaaaattgttattttcacccctaaatttcttaagttggcttgcctgtgggcttatatttttattattttctgtaaattcctcatcctacctttttttctttttttctggattagacttctagtcaaatgctaccagccttcaaaataaacatttcaggaattttgtgtatgagggggtacaggatagaag

SEQ ID NO: 473143 - DNA, 1585 bp, Homo sapiens
gcctgaactactcctccgttcagcaatgtgaggcagcaccacagattcagaatgagctgcttgtaatctactgcaaacccttcctttgtaggcctcgtgcagcagaggcccacaccttgagcaggagccttagtatgcattggttcgccttgatcctcctggaaccgtgtaatgcggtccagctgtggtcgctatcctatgggacaggggtcatccgtgtggagaagggcacagaagagggtggtcagggagctggacaggtcattgacatgaaggttgaggggaaagacgggaaatgcaatccagaagccagcagagacctggagaaggcggtgtgcccagatggcagggacttgactggcatgaccaaatggcatagacatgctgctgcttcccctgttgtgcggaagacactaggagaaggcgaggcttcggacacctctagtcctggaacatgtgaagatgaagtggaaagggaaggatgtttctccagccatgggaagacctgggtgggggcccattctgccattaacctgctctgtgacctctggacttcagcttccacagctgtaaaatagttttatatttagtttcttggggtcctcatttctgaaggctttcatgttacataaaatatattaaataaatttgtatgtttttctcttgttattaatgtcttctgttataagggcttcagccacgaaccttgcgatggcacctgaacccgaggtgtgaagataacgatgaggttgacttccagaattgtatctttaatctgatccttctccaagactccagaactccgtgtacagttgctttcatctcagcctccacgtatcctgactcacactcttccacttaccctcaatcctgttctgaggtcacttagtagattattcagactcatgactctggcaccttctcttcctcagcttgccctatatccaatcctgttggttattctcctctgtaatacatttccaatctttttcctcttcaccatggctatttctctgacctagtcaggccatcaccatccttgctttcattgatggaacagcctttaactgttctacccatctttaatctctacccctttgtcctgtcaagaacctatatttctaaaacactaatctgatcacattgcccctcttctgacatttcttcatggctccccagtacaaatagaataaaatttaaatatcctaggcattcaaggtcctccattatttaaagataccctatcattctaactttgtcttcaaaacaccaagtaccccactcatgctgggccagtcaccatgccctgaatcctcctgcactcccttcactcggaatctctgcctctctctccgtttataacaccccatccttcctgtcacttcagacagaaccctcatgctgcctgcaccaggaagtcctcctagggctctcacaagctgagttggcctcttgctcctgtgggttccctggtgccttgctgtacctctggtgctttatattcttcatgcatctgcaccacctgatcccatccctaaagaactgtctgctccaaagacaggcgctccttacctgtggcatcttc

SEQ ID NO: 473144 - DNA, 655 bp, Homo sapiens
tttaatccttttttttttcctatgccctgccccccagaggtggagtctacagaggcaggcaggcctccttgagctgaggtgggctccacccagtttgagcttcccagctgctttgtttacctactcaagcctcagcaatggaggatgcccctcccccagccttgctgctgccttgcagttggatctcagactgctgtgctagcagggagcaaagctccgtgggcgtgggaccttccaagccaggcatgggatataatgtcctgggatacctcttcttctctgatgccttcaccccagaagcagtgcgcatcatgatgagctacttctggtccttctctttcaggtcccttctctatggccattgctgtgaactaccaactcctagacctgtgatgctgagaaaaactcttaaagagtctgatagtgaagaactggaaataacacaggagacgccaaatttggtgccatttggggatgtgagtaggggacatgacacaccactgagggccacaggggaagtatcagaatggtcaggaggcagaggacaggagtgaggggagagtctaggccttttgggggttgctgagggaaaggcaagccaggaaaccagtttaggattggctagtttgaataatttcaggggtctttgggttat

SEQ ID NO: 473145 - DNA, 522 bp, Homo sapiens
tttgtcaaagatcagatagttgtcattggtccccaatctttttggcaccagggactggttttgtggaagcaaatttttccacagaccagcatggggaggaaaattactgagccatccatgtttatgaatcttgcaccacctccagaaagaacagatcccgtgaccagactggtccgttttattgatgacatgctgattggacttggtgagcaagaagtagcaactactctagacttactgataagacatttttgtgtcagagagtgggaaataaatatgacaaaaattcaagggccttctacctcagtgaaatttctaggggtccatggtatgggtggtgacatcctgtatacagtgaaggatgggttgttgcatctggcttctcctacaacaaaaaagagatacaacacctggagaaataaccacagctgggcctctttggattttggaggtaatctgttcctcctttgggtgtgttattctggcccatttactggatgactcaaaaagctgccagttttg

SEQ ID NO: 473146 - DNA, 606 bp, Homo sapiens
agagaagatatttgaggtgacgtttccttgctttttcctgattcatgtgtccctacattgatttctatgcatctgatggaaaagtcacctctttcagtcgcgtcagatgtgggcacacagctgttcagctggcctggaatcctatctgccaggggcagcccgtagggatgtttcttgggcctgagatgtgggggcacagctgctttgctggcctggtgatgtgtctgctgggggctgcccacagggccatttcacaggtctgggatgcaggtgcaaagctgctcaggggcatggccactggaggagtgtggaatcataagcttgaattggggctacagcaaattcaagaagagctggaaaagatgaaaaaagaatatagaaatctgaatacatggatagataaagctaactatttagaaagcattctaatgccaaaattggaacataaggattctgaggaaactaatatagatgaggcatctgaaaacacgaaaagtaatcatcctgaagaggagcttgaaaatattgtaggagtaggatgagaaaaaagttaaaatattaactatgacctgtgaaaaggcatttttattagacattgtgaactat

SEQ ID NO: 473147 - DNA, 569 bp, Homo sapiens
tcctcatcaatcttaagacagaaaagtccttcctggttcccctctccccatgccaacgtgatgccttccttctctggtacccgtggaacactgaagtaccccgacaatcacaaacctggaattcctgttgaatttagggacaaagcagttctagggacaatacataggagagttcttgctggagtagggggtctatattggggaaacaggggacagaaatggaaaagcaactttggttatggcctttgttgcaaccttaccttttctggtggaaggccacatttggctgccacagctgtgatgcaagattctgttactagggctccttgtgggaagccaaatccacgaaaggccgtattggatggtaaatttgtcatgcatgcacggccctggaacctgaacagccagcaatttgtcaccttcagcgccattggtgcctggaatgtcttcagctgttatcacatcaaccacttcgggtagttcaagggccttggacacatcaattgatctaaacaagagatatttaagaagtagaaatcactctgggcagggtggtggaggtctgtaat

SEQ ID NO: 473148 - DNA, 590 bp, Homo sapiens
gagctgcttgatgtacagactattccacaccccctgttatgaaggaatatgctgactttgaggagtacaacaggaaaatgttattactctttatcttctggaaatcctaagcttgttgtagtcagtttccatttgctatgccaagaatggctatccaaaactactctctctgtgccaaagattggctaccctcattcctatgggacatttccagttagagctgcagaatcagtttctccattctgtctgctagtcaaagataattcttctattttcaaaatatctttaaagcacaacaacagggcattagctcaggctcttagtagagaaaaagagaattctcgaagaattacaactgaaaagatgctattgcaaaaagaagtagagaaactgaattttgagaacacatttcttcgcctaaagctaaataacttggatggagatccaaatatgtcctccactgacattgttgggcggggatgtgctctttaacactgggctgtcccaagccttttctgatggtactgctgatttggaagagagttgtcttattatagcctgaaaatctttattggttctggttctaaaac

SEQ ID NO: 473149 - DNA, 613 bp, Homo sapiens
aagagcttcagagacctgcagagatgtcggtactaccagctgcagagaggaacaaccctctccagggcttcctctctggtgagagcttgatacttgatgggacaacctgcctacagagaggagccacccactgcaggtctcctctgagctgtcgtacacttaataaagctcctcttcatcttcttcaccctttactagtctgcgtacctcattcttcctggatgcaggacaagaacttgggcaaaggcaccactagccacagaggtttccagccagaaaatcgacaccccaaagatgccataacacaagtcctcatgcccttgtgtggtcttctcaccttgagtctggggcattctctgaaaacaccaggcaccagggctaaaggaattgcctctaggattcgtttgttgcagcttcaacttgaactctcttcctcagccataggttcactgccagtgcctcgctctcatgtcacaatgacccaaagttggaaattgatagcctgaacctcactgagccaacacaaacagtttcctaagaagactcgtgtatttattaactgaagaaaaatgaataccttttttttaaccatgtgtctcggaagcccatgaac

SEQ ID NO: 473150 - DNA, 1188 bp, Homo sapiens
cctgccacgcatggattatacacaaagtctgttcaagtctgttgagggagtgaagggtcggggggcagcaatcccctgtttggcctgccagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaaggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcagagaaagctacaacctcactgattacagaggggaacacggaaaggaggcaagcctatttacccccacagaatcctggaaaaattcagcaattggaagtacaaagtgtagatctctaaaccaacttggttccaagacactggcagcagatacagacttacctctggagaagctgaaagctctagctaaaatacatacagataatgacatctggagg

SEQ ID NO: 473151 - DNA, 1655 bp, Homo sapiens
acatgaaatgctgctgcaggcccctgatctgcagtctgcccacccactcaaagaccaggtggagcccatagcctgggcctcacaggccagagtctgcaggccagtgtccagctcagagccctcagtgccatcttcatacaggagccatcagctggcagtcctccctgtctcccccagggcttctggcagccctcagaccacagtgtctgtgcaaggtctggaaggctcagagcccagcctggacccaaacccagaagaaagactgctccttacagttaagaaggccttgcccctgcttctgccctcaggagcttatagtgtaattggaaagatttgccccaaaccatcaggggctaatacaaaggagaatgtggaagatggggagctgggtttcctgtttcctgcaactgtgacccgccctgctcttcagaatttacctgccttgtgtcgtatttgcacagggctgtcctttgtgactttgaaggtgacaatcagttaatccaataacagaatcctgctaaagtgctaacgggaaagggtgaaaaaaaggcacccatatccctcccttctgactcagctcccctcccccttccttgagactctgcccccgctgctatgtcttcatccatcagtaataaagcgggaacaatagggggtttctttctaattaaagggagcagttagtgtttccacttcaaagccctgagagagaagacttttgtttcttgggcctgggagctctgggagccccgattggattgggaagtggagctccagacccagccaagcattaagctcgtgaacctgagagccccccatttgcaggcagagaagctcaaatttaaaacaacaacgtaatttggtaacttcggctctgataaaacagttgggggaattccttctctcctagcgtctgaagccaatgttattacaggtggtggctttgactggtttttggtgctggagtgaggagtcagtcaatttagcacattggaacgcttgtttccatagctgcttccatgaattttgatagcctgagtctgttgctgagagactgttaaaagactaaccaatttctgtcctgaggggtgtgggccagacattagaacgtggtgtctcaacctagttgccattcctggcagttaatccagtgcctagtgtgtgaacggctctggattatatgtgtgtgtgtatatatatatatatatatatatatatatatatatattttttttttttttttttttttttttttttttgtgggttgtgggactgaatcaagtaaaggcatagcccagaggactttgaagagtccctgggcagtattccattagcggcccccagccaaaaagatgatactctctttgatcatttttagcaaatttccaatattaaaaatttttttcctgttttttttttttgcaaactcaggctgcctaaatgtacatttgttaacacaactccatccttgtattttaaacatagctatggaagaaaaaaaaatttactttcagatataaatagagccaaaaatgtgcagaaaatgtagagcacagtgaggactttcaatgtaatccttttgtggagaaaagtttccaaaagccatcccctcctcgaggtttcaaatagaagaaaagtagatgttttgtaaactc

SEQ ID NO: 473152 - DNA, 1524 bp, Homo sapiens
cccaacagctcattgagaacgggccaggatgacaatggcggctttgtggaatagaaaggggggaaagggctctgacaaggttcctgggccccctctgagatctctagaggacagtgcccttctgactggaggaatacttgccattcattccattctggcgagggcagaagcctcaggctggagcgtgtcctatcccctcgcctcaggcctccagacgcccctgaagtgcccttccatttgcccttctccatcccccactgagggccgcacagctcttgggtacacccagatgcagctggcagtgtgtcatgcgagggagatccctaaactagaagacctgggaactagatctagctctggtatttactggcagtgtggacttaaggaagtcacattgactttagagatctctgctccctctgctgcaaagggttgatatctgctcgagggtgatcactgtcttgacttcaccatagattagttccacctggttttgtactttgtgtaaagtaaaactgcagttcttttatatttgttgctgtgtagtatttcattacatgaatataacaccattatttatccatattgttgatgagtctttgggtagctttcaagttttgtattgtgaataatgctgctatgaacactccttttttaggagacagagtatcactgtgtcgcccaggctagagtgtatgaaactcttgtacatgtattttaacgaacacatttcttttggatgaattcctaggatggaactgttgggtcaaagggtatgcacaggcgcatctttaaagatattgccaagtagttttccaaagaggatgcgccaatttactttccagccaatgtttggtattgtctgtctttttcattttagtcattctggtgggtgtgtagtggcatcttattgatgttttcatttgtatttcttattatttaaaaagttgagcacatttttatatgatttttgccatatagagatgctcttttatgaagtgctttttcaagtcttttgcccatattgagtagtttgtctttttcttattaatttgtagaagttcttcatatattctggatctgagtcctttgccatatatatttgcaaatatctcatcccacgctgtggattgcctgttcaatctcttaatcatgtctttcaaagagcagaagttcttccttttaatgtaattcaacttatttatgtttccaggaagtatgttttggctggttatatctagtcatactggttaaatccagttttccatgctgtcttgtattttgggggaaacaaaaagatgatttccaaggaaaacctcccagttcaggtccagtggttctcctggaaacattttccatttgtaagcttgagcacccctggttcctatgcctggaaacctcccaaccctttggactttcccaggaatcaagattaattaaacagacagctcttccctcttccattttaaatctgattagcttactccagagaatctaaaaggccaacaaatatataaagagttg

SEQ ID NO: 473153 - DNA, 488 bp, Homo sapiens
tctctgcttcagacaccagcccacttaaagacctggcatccccttcatgaggcatcagtcatggcccactggctcccaaaatgtagaattcaggttccaggtggccatcagcatggctgaggatttgctcaagaagaaactgaacccagtccccaacttccgtgggcaacaggaaaacgccacagaaagaccaggtcgtagagctaccattccaggcatgagtttccctgggacaaacttgccatggaaaaggcccaagagaggaaacaaagttgcctccccacaaggtctgtcggtactgatctcatatgcgggtaaagaaggacccagcggaggaagaatgggcttagctgagcacattcacacgtatgagaggaaactttgccacagtgtaggaagaaccaagtgggtgtgggaagccaagttggtcattgtcgcagcaatccggatgcataagaagtaaagaggagagaaaaaattagtcatct

SEQ ID NO: 473154 - DNA, 828 bp, Homo sapiens
tccttcactagatttaccagttgtcatcagtttgccacatttcattaatctcctcctacctctttacatctgcttcctcctgcttcacatccaggacttggatacacagcacccctgacctgcatggatgccttaggaaatgtctgagcttaacaagaatctttagaatatgctctttccctgccaccgccaggtcgtgcggacgcaaaggctttggtgtgttcaagattgggcttcacccataacccactgccatggccgaggaacgcattgctgttggaggtgtaatggacgttaatactgctttacaagaggtgctgaagaccgccctcatccacaatggcctagcatgtggaatttgcaaagctgccaaagccttagacaagcgccaagcccatctttgtgtgctggcatccaactgtgatgagcctatggatgtcaagttggtggaggccctttgtgctgaacaccaaatcgacctaattaaggttgatgacaacaagaaactaggggaatggggtggctatgcagaggccaccactagggtccagctacttctgaccacactggaggacatttctctaaaggtcttaaaggagaatgagaacttgctaagagaggggccagctggagtttctcctaaggagaaacagattggaagtgtagaaggctttcaaccagaattcagctgtgaacatttgaccacttttcaaagacctctaacatatctggattaggttcaaaagaagctgttacttagagttcagtttggagcttggattgaacaatgaccaccaataaaaatgtacaggtgtttgcctgtgtgtt

SEQ ID NO: 473155 - DNA, 590 bp, Homo sapiens
gcagcacatacctgagattcatttcctctagaatatgcattggtatatctcctaatgctatccctcacccctccccccatcccacaacaggccccggtgtgtgatgttccccttcctgtgtccatgtgttctcattgttcaattcccacctatgactcagagcagtttgatcgtctgaagacttcttctctcaacttgtcaaagtcattctccatccagctttgttccaatgctggaccctcagctgcaggtctgttggagtttgctggaggtccactccagaccctgtttgcctgggtaaaagcagcagaggctgcagaacagcagatattggtgaacagcaaatgttgctgcctaattgttcctctggatgttttgtctcagaggagtacccggccatgtgaggtgtccatctgcccctactggggggtgcctcccagtttggctactcaggggtcagggacccacttgaggaggcagtctgtgcgttctcagatctcaagctgtgtgctgggagaatcactcctctcttcaaagctgtcagacagggacatttaagtctgcagaggtttctgctgccttttatttgg

SEQ ID NO: 473156 - DNA, 763 bp, Homo sapiens
gtggagagtctttatgtctagctcagggattgtaaacacaccaatcagcaccctgtgtctagctcaggctgtaacactcaccgcgaagatctgcagcttgactcctgaagccagccagagcacgagcccaccagaaggaagaaactcggaacacatccgaacatcagaaggaacaaactccagacgctccaccttaagagctgtaacactcaccgcgagggtccacggcttcattcttgaagtcatcagagaaagagatgtgaaaacaaaagcagggaccacagtgaatcagaaattagatgatgctactggctttgaaaatggagaaagaggtatgagaaaggcacacaggcagcttctaatggattcttctctggagcctccaggaggaatgaagctctgccaataccttgattttggaccaatgaggcacatttctgacttctcaccttcagaactccaagatgataaacatgttttatttaaagccactaaatctgtgagttgtaaaagggctgagaacgtgggcagcagttcagagcatcaggagttttgtgtagaaactgacacactcagaactggaatctagttatgataatggaacatatttgtcattagtaaaaaaaaaaaaaagtaatggactaacttggatggataggtgggaaagttgtgatacccagcagataaactggttataataaacacattcattctgttccttcaacataatataagcattttgacaattaattttttaaagact

SEQ ID NO: 473157 - DNA, 611 bp, Homo sapiens
ctcctcctttggctattgccatgactctgctcctcccgctagtggctcaggcccagggagatctgaattctatttctgagactggctggagttattggagatcctgtagggaaaccccacccactgagaaaggatgggtcagggttagacctgaagaggcactctcaccacagactgccacagctggtgtattttgggctcttaccaacaagatacaatattccgtctgtgaagagaaagaaataaaggacatccaaatcaataaagaggaagtcaaactgttgctgttcaccaatgatatgattgtatacttagaaaaccctaaagactcatccagaaagctcttagatctaataaatgagttcagtgaagtttcaggatacatgatcaatgtacacaaatcagtagcactgctatacaccaatgatgaccaagctgagaatcaaatcaagaactcaaccccttttacaatagctgcaaaaaataaaataaaatacttagaaatatacctaccgaggaggtgaaagatctctgcaaagaaaagtacaaaacactgctgaaagaaaccatagatgaaacaaacaaatggaaacacattccatgctcaagga

SEQ ID NO: 473158 - DNA, 1135 bp, Homo sapiens
cgcctggctgacactgtctctttttctctctctcctcctcctccttctcctcctcctcctgcctcctgattttctcagtatgtctgttaggtcggcttgtgtggaaggggacccaagtgggttgctgctgctggctcaggtggccagcttttattcccttatttggccccgctacatcctgctgattggtccattttacagagtgctgattggttcatttttacagagtgccgactggtgtgtttacaaacctttagctagacacagagtgctgattggtgcgtttttacagagtgctgattggtgcatttacaatcctctagctagacataaaagttctgcaagtccccactcaacccaggaagtccaactggcttcacctctcaatctcccatctaaacaggacaccccaactgttgtcgggaattgggcgatgaccgctttagctacttcctgctggatacttgatggcctcgatcctagaggaaacaaatttgacaaggagtttaaaaatacaggcccaaaggcaagtaatagcaagatggctgtcacaggacctagaaaggggtgaagccatgtcgcccaactccggaggttggtataagagtttgaaaggcgtcgtctgttttcagaagccttttcctgtaaatgccaggcagcatctcatactatccctgactggttagtgtaaaaagaacactcttcccctaagaaggtgcatcatcctcctttctcagcagtgaagaggtctaggccttgacggttctggagaggcactgatgccaaagagtctatttgggattgtagagtaagcatagatttcgttacttcttgcaaactgtctgagaaatcctttgagaatgtgtggtattagcataatacatgttacactgttaacttttagcaaactttacttttgttgaaaaccttgtaagtttggcattttaatttttctttgctattaataaaacctcgttcagtccatattaacttagaatttgtgtctacaatgataacaaggtggtattggagtgttagagggttatggagaagaccttcaattatcaattataggtttcaaatttaccctggcttttaaagaaatagggtgcactgttttttctttactacttct

SEQ ID NO: 473159 - DNA, 625 bp, Homo sapiens
gaaaggggtccgatggtactcactgcttggtgattgtccctttgttgtcaccaaaatgtgtccggaatttattgcttctagtgggttcttggtctcgctgacttcaagaatgaagccacagaccctcacagtggttcgtccggagttgtttgttcctcctgatgggttcatggtcgcgctgacttcaggagtgaagctgcagaactttgcagtgagtgttacagctcataaaggtgaagaaactaataaccagaaagatgaagcttcctctaaatgttacacaatttgtgagaaagtagttttcaaccctcaccctccttccaaactccacactaaagcaggtcctggtatctattgttcctctctttgtatccatgcgtactcgatgtttagctcccacttagaagtgataacatacagtatttggtttgctgctctggtgttaatttgcttagggataatgacctccagctctatccacgtttctgcaaaagacatgatctcattctttcttatggctgcatagcattaaatggtgtatttgtaccatatttactttatccagtcaactgttgataggcatcttggttgatttcatgccttcactgttgtgaatagtactgtg

SEQ ID NO: 473160 - DNA, 1776 bp, Homo sapiens
gattgccgctgactgatcagggtggtggttgctgaagtttgctgagagtgatggtttccagcttcatccatgtccctagcgggggagggatagcattaggagatatacctcatgtaaatgacgagttaatggatgcagcacaccaacatggcacatatatgctcaaggcctccctcttcaaagccctagtggggcgagaggaaagaggaaccatgacaattccgtatgtggcaaatcactcgacctccagtgaactcatttataatgggttgaaaatatccaaagatgggaagactgccgggaagatagcaggagatgctaaagagaaaacggcacccaagaagaaacaacacaagcataacagttatggcagcccacctcattttcaccttctctttgatttaccaccaccaccaccttgctgttccctggagcttcctgctttccctaccactgtctttcagctgaagccaatgtggagaaaaaaatcagtaacaaggttctgggttaggtaataaattataaaaattaaatgtttaatccaacgaagcaaattttagataaatgatggaaatagttactgttattagtaaggaaatatttatttatttatttattagggaaaatgaaacagctgcatatttaatcaattaatatgttaatatgtatgttacagaattatttttcaatccacatttagagaaagtataatgcctttaacaagaacacttgtattttgcaataagtataaaaataaaaatgcaaaaaggatgcttatgtaatttctaatgctaaaatagcactgaactatatcattggtggtatttaaaaccctaagaaatcattcaatgataatattaacaaatagggcatatctttcagtcagcttgacactactctagacacaagcataactgatattcctttggtaaaatgcagggcagagtctatgaaggaacatctgatgtctatagtaaaattaaggtcaaggacttggcagaatatgttacagattataacagatgttcccaaattagatcatatttttattaaaatctatagagatgttcagtcagtagaacctagaatcacagaattgtagaacaaatggtaatatttagaggctagtcatccccatcattttaaaggtgaagaaactgacactcaaataaggttaagggcttagcccaaggtcccagatttggttagcagtatttgaatcagaactgaagtcatttctgctatcacaggttgtctctcattggcaacaaatgaagaaatattttctttacatttcaaaaatttagaatatattatattatgtggtagtattagactaaggaataataacaaaatgaaccactgcattatttggatcttttctgattcctgctcctgaaaattgcccagttgttatattttctattaaagtccaaatggcaaggaatgttaccattcaccagacattgaacagatatcaaactaatattaaatctgcaatgcacataaaaaaattcagtagtaccaaatatcagcaaatattagcaccatgctagcatgtgggtggtaccttttaaaattcagttaataagtaaacactttcacagttgagactttcacaagatttaacattatccagagtttggatgcaatgctaaacttccatgaatcacaatagatttggcaacaaatgggcatatattaccctagcaaactcaaaaacaccacagtgaatttcacatgtgttcttttatggatacatcaagttgacaatac

SEQ ID NO: 473161 - DNA, 842 bp, Homo sapiens
cctggaggtatgaggtgtaataggcagcctttttcccgtgaactaccctgcagtgtgacttgtgccctgctgtggccagtgctgggttgtggggatgggtgctgggatgaccacattctttcccatagccctgctcagtgtctggcccacggcaggtgcccagtaagcactggcaagttaatgactgctggcctgtcacccagccctgcctgcttgccccctgctcaggagtccctggaggaagatggagaactaagtccagagaagggtacagtgggctggggccatagttcggaccagggagtcagtcctacctccatgtggcggcagcctgaagcctgcttcgcgagggagcacccaaccccgtttagagaaggccttgcaaatgatggaaaggcggggaagggtggtgtgacccagactgtcagtgaggaagcagtcctcagggtcaagatggggagcaaggagaatccagggcaggttaggagtgcgggcctgaaccctgtgaccagcatctacccaggaactcctcaagggcagcctctgctctctcccttgatgggaaaagacaggactgcagacatgcctgcaaaccatgggagtatctgtccatttcccttccatcaggtcatgaaggagtgagggcaggtgctgggagaggtgcgaggacttgagggaggagttggtaggagaagggtccagggaagaggagattgaggaaatggcccgtggagctgccctgagcccaggtgggcgcattcaggggcagagatggtaccagaggaaaggtgcctggtgttgagctggcggtaagtgttggcgccccaggtggggatccaccc

SEQ ID NO: 473162 - DNA, 492 bp, Homo sapiens
tggataaggatgaaggggtggccagcccctccacacctgtgggtgcttctcgtcaggtggaatgagagactgagaaaagaaagagacacagagacaaagtatagagaaagaaaagtgggcccaggggaccggtgctcagcatatggaggacccacactggcactggtctctgagttccctcagtatttattgatcattatctctatcaccatctcagagaaggggatgtggcaggacaatagggtaataatggggagaagggacgagcaggagacagatgccttcctcttatctcaactgcaaagaggcgttcctcttttactaatcctcctcagcacagaccctttacgggtgtcgggctgggggatgatcaggtctttcccttcccacgaggccatatctcaggctatcacatggggagaaatcttggatacacatcctgcacagccgtaaatccattaaaccttgagtcaacacagcacatgtttctgc

SEQ ID NO: 473163 - DNA, 552 bp, Homo sapiens
cctaactcttcaatgcccagacactgaagaatgtctgctagcatcaacgccattcaggaaaaccatgacctcatcaaatgaattaaataaggtgccagggactaacgctggagaaacagatataagcgacctttcagacagagaattcaaaatagctgtgttgaggaaactcaaagaaattccaaataacacagaggaggaattcagaattccagcatataaatttaacaaagagattgaaatcattagaaagaatcaagcagaaattctggagctgaaaaatgcaatcggcataatgaagaatgcatcaaagtcctttaatagcagaatggaccaaacacaagaaataattactgagcttgaagacaggccatttgaaaatacatgcctcaaaggggcaaatctaatagttattgcccataaagtggaggtagagaaagagataggagtagaaagtttattcaaagggataataacagaaaactttccaaacctagagaaagatacctatattcaagtatgagaaggctagagaacaccaagcacatttaa

SEQ ID NO: 473164 - DNA, 749 bp, Homo sapiens
ggtagcaaggcgggtgcgggaggcagggagggcagctggctgctcgcttcctcccccaactccctccccagcgtggccagctgcaggccataaacaagccagcacctggagggcgtatcgagacattttggcaccaaaataactaggagggtaagggctgtgctgacctctgctctccagggattggtcttccagcccttccctccagctctctcacccacgtagttccaaaggatgcgtgagccagcacacgggtccacacctcgctttgtctgggatcccatccaagcttcccaagtggagcctcctcatctaaatcccaatctccaggacccgaacagctggaatccttctgaacaaccccagatgctgggaaccttcatgtgtatggaacccataccctggccagccctctgtcgccatgttccatcccagaagcctgatccacagatggaccagagcctatgcatctccatcctctccttggccgccatgagcctgttcagtatctgtgccatcagcagcaggcccgggctgggctctgccatcgctgaccacggggtgttgatcctcccagccaaagctgagccagttggattctccttcccaataactgcccactgggaccaagagacgcagagctgggaacgtatggtgctgagctgcatgaagagccgccctggagagtgggtccctgacccctgaagcttctctgattcctgcttaccccaggtgtggcagctcaggtt

SEQ ID NO: 473165 - DNA, 1062 bp, Homo sapiens
gcaacaggacatctgaaaagccccgtgatgatggctctgggagaaactgggctaggaactcagagcaaataccatccgtatcataactccctaattcctgggcgtgacataggcttattccgggaagcaggaagagagctttggagtgctctcaatctgttttcaatggatactgtatctgaggaaaaggaggaggcaaagccgactccaggctgccagacgagcggctgggtgatgatggaaccattcagcacgatctcaaatatagggaaagaccagatatgtcctctgttctttccctttacactctgtgccctgcggggcttatctttatggactatttcaactgggcccctaatgctgtggcttctggctgggtttggccaagcagcagcaccagcaggggatcaaagagtaggaggagggagagatgaggccacttatccgtggctgcctctgtgccaggctgcaggcaaacagcggccacaggctctcctgctgcactctgggcgccaggaactgtccagcctgaatggctccccagtgtggctgatgccaaggcgcatcgctgtcccttgctgattttcttcaactttgcccacaccttgaaaatgactcataaaattgtcctcaagtaccctttttgaatgagctacttgtttcctacagcttttctgactattgtaagaaggatgacaaatgtgtttgttttctaccgctgctgtaataaactatcacaaactcagtggcttaaagcaacacgaatttattctcttacagttctggaggtcagaagcctccagtgggtcagcagggctgcgttctttctggaggcgctcggggagaatccatttctttgctgtttccatctcctctgggctgcccacattccctggctcatggccttacaaaattctaatctctgcttccgcagccatgtcaccatctcctactctgactcctgctttcctcctatgagggtccttgaaaaatagcaagtttgattttcacatccatatgtctgcaggagttggaggagatatggcatgggctgttggttat

SEQ ID NO: 473166 - DNA, 629 bp, Homo sapiens
ctcccaccatatgatatgctcctcctgcttcgcattctgccatgagtaaaaactccctgagacctcatcagaaaccaagcagatgctggcaccatgcttcctataatatagcctgcataaccatgagacaattagacctcttttctttatacattatccagcctcaggcaaaccctggggctcatcattcacaaatgtttattgaaccaggctctgttcagacccagagaacacagcagggaaccaaccagaccaagtccctgactgccgagaacagccatgactgccacgggaagcaattgctggcagttgtgtgctccgtatggcaaagtcactggataacagctgctgaccaaactgtgattggtggggcagctgggaggattcaccgtcaattggcagcaggtgggctccacagcccacatcataacctggctctggtggagggtggtgacatcaaggagtgctgcaaaggccaccatcattggccatggccaaaggaaccagcactggaaaaagggagaatatcctcctgggaagatggggctccactcgccccacagcagtccaccccaggcttccagaggaagcaagaaaatgatgttctttcattataatccttcactctg

SEQ ID NO: 473167 - DNA, 706 bp, Homo sapiens
gggctctgtagggaggcaggaggcagattacacgtgtccaggagcttcacgactgtgtccagaagcttcacgactatgtgtggaatcacgaatgaatgagtgtgccggcccgcatgcttacactgatttgcttcaaaacgaacaaaagcaagttgctaaagaactcacagacctggctcccagtccccgaagtgaaactaggtttggacctcttagccacctagtaactgcagaagccttgccacagggagccattggtccaggggcagtgcccagagagaggcaatgttccaatggaacctattaccacaagtatcaaaaacaaatcaaagccactgcctggagagcttgcataattatttcagatgtgaaagaaggcatacgtatttccctaactcatgaggccataatcacaaaaaatgtggccaatggcaggcagaagtctaatatggcccaggatccctgcccacagtgttcatgccctgagtctccctgtaccctttgggtgctggcaggaccaccacttcttctcatcaatagaatatggcagaattgatgaaatagggactgttacttccttgattagattacattatttcagactctaccttattctgtggcttctcctcctctttccaacctttgaatactgcattcctaaggtttgggtcatggtcctttctctttttaaaaatgatatttttct

SEQ ID NO: 473168 - DNA, 832 bp, Homo sapiens
tggcaccatctggcaccaaactccatggtctcattaaatgagcagtatgcaagcatttatcacttccctcttagtactgtgttttttgtatcaagccctcctcagcagagtgcttggctgcctacagcagtgagagtagtggttgcagggagcctgtccttggggcatgtgcaagtgcactacggccctgttgctggaggaagcatggctgctgacagtggctgcagctgcagactggggagcctctccaggctcccagccaatcccagtgaactgactgccttgcttctctctccttccatgcctgtggtgttttctgtcacttctctgctaaattccagtgttctctctcagatgctctattcaaagtgtgactgtctacttgttattttgatttttcatggaggaggcaagtgtcagatgctgccagttggctatcttgaaggtcctcctcaaactctatgttgatgatgtcacatttctttatactttgtatccattaacatattttatatagttattttgaatactttgttttaactcctatacctgcatttaaaatgatttatgcaccatcattgcagtatcatagtattctgtatttatctatatattcaattttatcagcaaactttatactttcatatgcttttgtgctgccattcaatctttcattttaatttgaaggacctcctttatcatttcttgtaaggctggtctagttgtgatggcctcccttggctttgtttatctggaaaagttttatctttccttcatttttgaagaaccattaagccagatatagtatttttagttggcaaatttttacttt

SEQ ID NO: 473169 - DNA, 840 bp, Homo sapiens
ctgctctgctgaagctgcaacactctcggattattccagaaatggatgtcctttcaagccccgctgtcagtttctttccgatgcataaggcgatttatggatgctttattctaagccatgtgccttcagtgacccagaactgacaagacttgagttcctggccccctgcaggtttctccacagtccattccctagcagccccctccccagggacagcctgaggacaccaacaccaagcaatagctctgtcccctgcagaacctcccatccttctccctccacagccccctcctactccccagctcccccaccctccagccccttcaaaacccatcaaagccccaggactttgagcactgctatccttcggagtgtcaggcaaccacaatactctcattccaagggaggccttcggaagggtggagtttcctgcttggttcaccaggcagtctttggttgtgggaatgaacctggtggtagaaaaatgaggaaacaggaaggttccagggaggcaagtggaaaggaagaagggggcccgcccggctgcattcgagagaatttaccgagtgtggagaggaggagtagcaggattttgggccctgcctcgcttgtgtgcgtgtgtgtgcgttgtaaactctctgaagccaggaatcatatcgaggttcgctcactattgtatcccccacattcagctcagtgcatgacacataatgactaagtattatttaataggtgaatcagcaaagaaatcagctcattattggggggtaactatccattggtttcttatgtttgtgcacatgttatgaatagagatactgactacttttgtttctgact

SEQ ID NO: 473170 - DNA, 660 bp, Homo sapiens
cgaattaatcggtgcagcacaccaacatggcacatgtgttttctttccaccccccccctcacaattcctttcccaaggtacagctgactgcaccattaaggatggaggataatcaaatggcattggttgatgaggaaaaagttttctctgcagaaaaattctggctaataaatgcagaaggaataatagaatttgaaaaatattattttgtaagctctaatgaaatatctggtgcagaagctattactgtgggagtacatggaaaaggtctcctcaagaaagttgtaaagggacctttagactgggatggtcctactggtcttcctggcatcttctggcaatgcaaaaggatccacgtggaggaggaagacagcattgaaacatgggttggggacgtggaggaggaagacagcattgaaacatggggattcttggaaattgggcaaacagttttcctggtcacatcttgcttcaatttactgcttctaccgctgtcttgatctcccttgtgtctagtatcttgtgcagatgcagacatggaacacagctcctagtacttgatcctgagattccctttgccaggagtagagtcgggggctggaaaatgttacagaagaacacagcatggctgcaacacatctccattttcaaaattccttt

SEQ ID NO: 473171 - DNA, 798 bp, Homo sapiens
cgccgtcttcacttctggaggctctcttgggggaaaacgtgataaacctgaaaagatccaggtcaaggaggttgctcttcaaactctccccagagcaagggtgccagggctcctgaagagaagactgggtattgcccaggctgtgaaaataggcagactcatgacctggggctttcctgttcacacctcagctcttcctgctggtgctcagcctttactggagaagtttaatgcaagtaaagcagactggtggaatgcagaggacgtgggttttgaagtcacgatgagtcaacaagaagtttacagcactgagaaagacgagtcaacaacagaaggaaaaaaatccagagaaaatggcacttgctgcattggaatgaaagataatctgcagaagaagtcaggtcgactttcacagtgcaaaaagccagcattatgtaatgaaaatatctcagtaaatttcatcaatagggacatgcgggctcattttccaggcctggttgctacttccactcatgcagctctgaaacccacctggctcactcttctaggtgaagatggatatgttcacactttgaagacatttttctaaggctacaagatctttgtaaagttacaattagggaaaagagttgtgtatatacctttcaaatgtcaatctaaaggcaggatgttgtttttgtttttgctgcttttcaaaacatttattacaatgtctcatgagagaagggggcaaagtgtgataacccaagaggggttacgtcctgtaatctgtagatatcagcttttttttgcctagac

SEQ ID NO: 473172 - DNA, 1245 bp, Homo sapiens
tacactgttaccccagaggcgggggtgacagaggataactgaagacaggaaatcctggaaaaggtgagaagatatgagaggatgggatccagaaccaatgtggaaggcctgggtttggcaagaggaaagacacttcctcaattgtaagggggctgggagcactggggagaaagaaggaggaggaggagatggcaggtggacgagagaacaatatggcggtttggaaagatgtggaagttcccagctgatgacctgcctttatgttctggctctgctggaccaagaaaaggtgggcctctccacagggctgtctcatgatgtggcagctgatgtcccctggggcaaaggaggagagttcaaaagtaggagggatggggtatcatgctacttaaatgctgtaagaggcaaaagggagtgccagcaggaatacagaagcagtagctcaagcaagcctacgatgatccaggtcagtttgcaggaccccgaagaatccattccgtaagttaataaagtagttttaccctctcataaatgtattgccttgtgaaatcattttagcacagcagacaaaaagggaattattttgttaaaattttcataattattttccaaggctatagtagcatagtttagagaagtactctaatagtacataatgcctgaaaaatcacctgaaagaatataatgtctccccttgctcatctcacagtttcaaatgccctgctaagactgatgtgctacaagcgatttacaatgatttttgcattttttaatcactgacttactacattttaaaacatcgatcctttatgtttcttttataatggtcttagtttagattttgtattttgaagatttcaatgcaaatgtcatccaaatagtattctttcttaccaaagtgggctacaaagcgttttgggctttgtttataaaaagttttattctcaatatgatttaaaaaggtagagatgagaaaatggcatttaaggctgatagaacagtttgagcaaagaggtatgatatggacaactcatctcttctgtgaaaaaggggctgtatctactgtctggctgattgtgaatattaaatgattaaatgagataaaacaaaatcaagatatattagtaagaatatataattttcaaggttaagagcaatactactatttaatattaatattagttcaataaatattaattcaaatcattttaatgaccggtggaatattttttaaaagatttaaat

SEQ ID NO: 473173 - DNA, 602 bp, Homo sapiens
ttgcagtgagccaagatggcagcagtacagtccagcttcggctcggcatcagagggagaccgtggaaagagagggagagggagacctctctttccttctctctctctcgcgcatgcatgcacacacacacacacacacacagacatacacatatacatgcacagtttgaatcagtatccaagtaaagtccatacatggaatatagttgatctctctcttaaatctaacactaccatttccccaactgtgtctgtcagtctctctttccttctctctctctcacacacacactcacacagtttgaatcagtatccaagtgaagtccatacatggaatatgattgatttcactcctaaatctctttttagtctttggtttccctctcctcctcttttttacttgcacataagacttcagcctgtttgtcctgtagtttcctacattctcaattttggtgattgcatccttgtggtggtgtttagctgtttctatttccctgaattttctataaattggtagttatgttctagaggcttgacagcatttatgatcaatttttttttttttttttgcctgtgatgagagtagtgggctgtgctatg

SEQ ID NO: 473174 - DNA, 604 bp, Homo sapiens
tgctctattatgtcccgggtatttctcatacttttttaaataatccatgctctctatagacattttagaaaacataaaagatcttaaagaagtcattgcctgtgagcagcagtatgactcttcctatgacgctcgctgtgacgtctggtccttggggatcacagctattgaactgggggatggagaccctcccctctttgacatgcatcctgtgaaaacactctttaagattccaagggctgctacagcgaatgaccacaaactcggtggattaaagcaacagacatttattctctcacagttctggaggtcagaagccccacatcagcgggtcagcagggccacactccctttgaagactctaagtaagaatccgtctttgcctctgccagcttctggtggctccagcttttccttggcttgtggcagtatgattccaatctctggcttcgttttcacatggccgcctttcccacgtctttgggtcttcttttctggtctcatataaggacatagacttagggcttatcctaattcaggataatttcatctggggatccttgccttaattacatctgcaaaaattcttattccaaatgaggtc

SEQ ID NO: 473175 - DNA, 1196 bp, Homo sapiens
cgccgagagtaagcgagggctgctagcacgggctgctagcatgtttatacactattgtgtcctaaataccatggcccctcaggtatttggccaaacaggctttcggattttggaagacatggagcatgagggcccccctatcagcagaaaagcctctggctacggtttttcagaaatatacccatacaaccagtttggtgttctcaaaataccctattctctgatggacctgctctccaaaatggtggttggacagccccactttgtgcgctgcattaaacccaatgatgaccgagaggccctgcagttctctcgagagagggtgctggcccagctccgctccacagggattctggagacagtcagcatccgccgccagggctattcccaccgcatcctttttgaagaatttgtgaaaaggtcagaccggccatgggtattcagacttgagggtgggaccattgccggggaaccatcctcttctaccgagtatttccctgtcttctgttcatatcactttcctatggtatataagcactggaagccattttacatatacctcattgacctgacctgggtcccgtgaccattcctagcttcagggagaggcttagaaagtggagaacaggactggggcacattgtcacccagtaaaaaactggtgttcatttagccagggagaagtgagtgtggaaatgggggaggcggggcctctcatttaaagtttatgaggaggcagcagtagcagtatcagaaacatttattaagcacctgttgtatgctaagtgctatctataaaaactctcccttcctgatggacctcttggcttggttcctttcagcttagcctttacattgaagtacacaggagctcaaagtgatttatcaccatggtgcctgctagaatccaaaattattccgtgaaggaaacatattatgcttttcttacttgattactatagatatgtcacttacatgtttcttcactatattttgaaaactgcctgtttacatatagtactgttacccatgtctttctgaactaagctagatatgaatattattatcataataaattaagatgttttggttgatggactgaaaatcaaagttaagttctaatattaatgatcagaatacattctgcctatttagaaactaacagttgctaaaaaaaaaaacacccacagatgtcc

SEQ ID NO: 473176 - DNA, 784 bp, Homo sapiens
ctgacttcagcgaagcgaagcaactttggaactgggtaatgggcagaggtaggaacagtttggagggatcagaagacaggaaggtgagggaaagtttggaacttcctagagacttgttgaagggttgtgaccaaaatgctgatagtgatatggacagtgaagtccaggctgaggtggcttcagatagagatgagaaacttactgggagctgcagtaaaggtcactcttgctatgcttatcaaagagactggtggcattgtgtctctagagatctgtggaactttgaacttgagagagatgatttaggatatctggtagaagaaatttctaagcagcaaagcattcaagaggggtcctggctgcttccaaaagtctacactcatttacataaacaaagaaatgacctgaaactagaacgtttatttaaaagggaagcagagcataaaagtttggaaaatttgcagcccaatcatgtggttgtaaagaaaaacacattttctgtggaagaattcaaggctgcagaaatttgtatgagtaaagaggacctgaatgttaatagccaaaacaatggaaaaaaactcctccggggcatttcagagaccttcatggcagcccctcccatcaaaggcctgcaggcttagagggaaaaatggtttcctgggctgggcccagggtcccactgctctgtgcagcctcaggacatggtgccctgcatcccagccgatctagcttcagctgtggctaaaaggggccaaggatatttgtccagcagatgttacttgag

SEQ ID NO: 473177 - DNA, 648 bp, Homo sapiens
tgacatcaaaccccagaagctcctatccctttgcttcctgggaattctacagacctgctgcctcatgctctgtgtgacggtggaatgggactccacaaatcatacttctttgccatatgactctccactggactcccaacaggggatgctagaggaaaactacaaggcacgagggagaagagggacttgcttcttccggtttgcttcttgttcctaccacggtcaccacagcaacagatcttcattctggcagcaatgcttgatttcagctgtagcagtagttccagtttgcagggtccccatactcccagaactagcctcagcaatcccttcagagaccagcatcagccggacaaataacgcgcaaatgactgtttcttcaaggacaaataatcaaaatggtcatttgctaaataaaatcagccccgctggccttacaataatgatcaaggaaaaccgccaaaaagcacagttacccaagaactttcatacaagatctaaatctgattttgcaacatttgaaacaatagttctggcatctcagtatattaatcttggatcttcctccagaatcacaccagtgtctgagtctccttaaccctcttctagttaaattgggtttaggtcttgatatctcatgaagaagga

SEQ ID NO: 473178 - DNA, 854 bp, Homo sapiens
gcagctgacccatgtagtatagcacaaatgcgaaagaaacctttgtggctccactgcagtacattgagctccacagagacagtgccggggcaagtgagagccggacgggcactgggtgactgtgtgcctcgctgaggaaaaataactcaacatgggcaaaggagaccctaagaagccgagaggcaaaatgtcatcatatgcattttttgtgcaaacttgtcgggaggagtgtaagaagaagcacccagatgcctcagtcaacttctcagagttttctaagaagtgctcagagaggtggaaggccatgtctgctaaagataaaggaaaatttgaagatatggcaaaggtggacaaagaccgttatgaaagagaaatgaaaacctatatccctcctaaaggggagacaaaaaagaaggaccacctaccaggtaagggactcacggaccagtcctctccagggcctctacctgaagcgacagcttttgggggagttcagagaataacagtaaacaagaagaggggcaaaatgaagatgcagcacagacatgaggctaataatggcttctacctcgtaattcagtcttcctcatctaaggctgcaccagacaacttatgtctccagtgcccacaagattcccatcaatcatctggccgtctttagttaaggcagtagtgcaagaactatcatttttggaacaccccctacctggtgtgattggcatgtactacctttactcctcaccacaaccctgcaaaacgatggttaccgttcctattttacagaaatcaaaacttaggtttgtgggggggtaagtaacttacttgcctgagatcccatggctcgatgtcagagc

SEQ ID NO: 473179 - DNA, 688 bp, Homo sapiens
ctgtcttcccctggagagagtgagagaaagcacacaagatagaaaccacagtctttttcaaacctcatctctaaagtatatctcctaatgctatccctcacccctccccccaccccacaacaggccccggtgtgtgatgttccccttcctgtgtcctggtgttctcattgttcaattcccacctatgagtttgtcaaagatcagtcaggaccttcagctgcaggtctgttggagtttgttggaggtccactccagaccctgtttgcctgggtatcaccagcggagggtgtagatcagcgaatattgctgaacagcaaatattgctgtctgatcgtttttctggaggtttcgtctcagagggactgctgtgctagcaatgagcgaggctccgtgggcatgggaccctctgagccaggcgcaggatataatctcctggtgtgctgtttgctaagaccgttggaaaagcacagtattagggtgggagtgacccgattttccaggtgccatctgtcacagctttgcttggctgtgaaagggaattccctgaccccttgtgcttcctggatgaggcaatgccttgccctgctttggctcacgctcagtgcgctgcacccaccgtccgacaagcccctgtgagatgaacccggtacctcagttggaaatgcagaaatcacccgtcttctgcatc

SEQ ID NO: 473180 - DNA, 599 bp, Homo sapiens
cgcagtgggatgcttttggattcgggacacctgggcccagacccagccgccccaccccggcgccccgggcttgtgcacagcaggagcctccgccccgcggggaagccggccccgcacctcccgcactgggcgctcagacccctggtgcttccacggcgtctgagggtttctcagccaccgaagggtgtctccgccgcacccaacgggtcccccggtggagagatttgccttcacatcagattaaagggggttccgtttggtgaaggcgcccaggctcatcccccacgtttccgcactgggtctgagatggaaagaaagcgggggaccagagcccttcttccaaagaacggaaagcgccccaccgcgacgccccggccccgcccaggggccctgcgagggcggcccggagaccccgcggccgctggcggggcgcggctttcccaggctcccggcgccacctggtggcccgtggcgcgcactgtagtccccgctcgggaggcccccttggctcggatcccactccacgtgggcggcggtaagaccggagttcctgaacaaaggtgaatgtcgttccaggaacctgccgcgtggggacagaa

SEQ ID NO: 473181 - DNA, 499 bp, Homo sapiens
tgattgctagactgtatgttatatctatttttatatttcatgttatgcatgtggattcctgctccttgcccctcccatgactttgtaattcagtccagagttcataatctgtcatacaatctcccttccctcaacatgaagtttctttttattgtagaatataccactctgttcttttattggtatataattaaatctctacttatagataatgctaaattgaggaagctcctaggagtggatgccaaaatgcaagggagactcctagagatgggtggattgatggaagaaaccatgaaggactcaaagggtagaaatctgatgatacttgcatttttacatcatcctagaaacagagtggaaaatgaactggaggaggataaaaccagagacagcagttaagatgctaggaaacatgggagaaatgatgaggtcccaaataaagagatgaggaaattgaatcaagttacctgctgagactaatactcaggtctcttaa

SEQ ID NO: 473182 - DNA, 720 bp, Homo sapiens
ttgccatctgctgctccttcgtctttttgggtgtgggtctttcagtccaagctcttgtccacatgctccctgagtccccactgggccagcctgcccagctcgctgccatggaggccgtgctgggagaactcccggcttctccttgttccaaggaggatgaaaaatcaggagctgtcaacaaccgcctggtaaccctgggtcggcaccattttctagttgcttgcaatcaaggattcagcgaggaaaccctcagcaatgactggagtgtagggtatgaggtagggatcatgacagatgaagctggagatgccagcaggagctggatcatgggaggacttagatgttttgctgagaagcttggacttggccctgaaggagacagaagtcaccagaagctctccaaggacctcaatccacccaataataataatgataacaacaacaacaacagtaatactagttatatttgttaaacatttgggtgctctgccctcatgaatgaacacctagttctgcctggtttctagtttttggcaatggaggtgaggagtgaaatttgtccttgggatggactccctgccctgctgcagccccaactgatagtctaatagagaagatggcacagtgactgtcccagtgaggtggagcagtcactccaaactcatcaactctactttctaaatagctccagactctacctacgtcataccctctctagta

SEQ ID NO: 473183 - DNA, 1152 bp, Homo sapiens
ccaggagccaggctgctgcctctctccgctctttggatgctccagccccagttgagccaccccagtttatgtcatacatcaaaaatatgagctgaccctgctgaaacctgtccaaaatacagacagatgagtaaaattaccaatcattgttgttttaagctaccaagttttgggttgaattgttatgcagcaacaggtaactacaacagatatatgtacctgaagtcaggtgctatcataatagagtcctacaatgtagacattggctttgggaccacacagcctaacagccacaaagaaaatgttagtgaaaaccttaagggccttgagaagattgtcaatgagggcattcaggaaaatcttggaaatattatagaaatcttaaagtcaaggggatccttgccatgtagtggcagaaagtttagcaacactgtagcctgcagtaacatggaaaataggaaggatcccttcttagagcagattccaatggggcatcggggtgatgttcagagaagtactcagaatcctcctccttcctgctggatcagggagcaggctgatttctgtgtgaggtctgaggagcggcgcctgtaggagccctcaccctccttcccctcactcatttattattgatcagtcattggccgaggcctccaccatgaaaggcacaggggacaggtgaggaagcaaagggtcagctagttttaggcactttctcagtgtccgcactgagagatagagtatataggtgctgagccatgcacacacacagccgtaatctgaattaagaagccagagcctttttaaaacttgcatcccctgtcctcctgaaaattgttaataaaaaaaggtgatgtagcaaaaataactaaggtattaaatcaacaaaaaactcctcttttcttttgacccaaggggctttagtcacatctataaagttctacttctttttaaaatataaagccagtgtagcaaaatacccagatttgatagtggtcaaatatttgtttattatgttgttctctgttcttatgtataagtatcttcatcctttttcttttgctaatacattttactttaattaaaccctaaggaatcagatctaacatttcatattcaaataattcaaagatcatagtatagataataaaa

SEQ ID NO: 473184 - DNA, 881 bp, Homo sapiens
caggacacttttgatgtacagtctctgaaattcagacaatggtgatggtggaggatgaggagaaagggggaaaaaaggggacaccttactagtcttattacatactggtataaaaatatcaatttgattactatttcctaaaaagggactctatagtgaagaacaattgtgacttgaaacacaactgtagctctgctaatggtttccagagctggtcataggctcttggagttagtgcgtcactaaactggtatgtgtttaggagtctatatagttcaagaccttactctaaagatttcttgtcaacagggtatggcttgtcaaaatgctattttattcgttccatcatttccatcctatctgacgaaagacattagtatttcagttttctgtgcaaatatggaaacatcatcatcaataccccttacacatatgcatcactttgtggttaacaaaacactttctatgtcacctggagctacaaatagcctggaagaaggcggggcacatttacagcatttgactcctggcagcccagtgcagggaggtgatctactcactggtaagtttggatgtttgatctctccaaatctcacgctgacatttgattcccagtgttggcagtggggcccggtgggaggtgtttgggtcttgagggtggatcccttgtgaatggcgtggtaccttcgtcgtggtaatgagtgagtgtgcactctgtttatttccctgagaactgattgttgaaaagacagtctggcaccacttcctctctcactcttttccttcctctcttgccatgggatgcctgctcccctctaccttctgtcgtgagtagaagcttcttgaggccgtcatcagaagcagatgccaagcttctttta

SEQ ID NO: 473185 - DNA, 597 bp, Homo sapiens
gatgtaagtgtctgtgtgaatcacctcaaggtgcttggcatatcgtaggcaataagaaaaacgtgctacctatttttatgttttttatgattggagacataaaattccaatcacggagggaacatgtctttgcttgcaacagactcaaatgtctgccaaactgctccgtgatgttttctgggagggacttcacagatctgacaagtggatctgactgccacactgatagacctggaatccctccagtgctctccaatgcagtgggatacaactgtagttcctttgacagtgaaaatggtttacaattgattgcagcaatggttgtgcaactctgtgactatagtaaccatggaattatatgctgtaatcccactgctacttgcggctgtgggaaaagcagtaccatgcaccgagccgtcctggggtgccaggcactgtatgggagtcgcctgagttacctaagcattccagccacaccaccctgtggggtgcaagccacgctttctatgtgagtaatgcaggtggggtcacaggactgttaactgggagaaatgaatgtcaaattcctatttgattccattgttttaaatcactgaa

SEQ ID NO: 473186 - DNA, 712 bp, Homo sapiens
gattcagtggcatttggtgagtcgagggcctgatcagctttgactcccagggggtccaaaggaaaagggactgcagatgtctccaccggcctcggtcattcagggaacccatggcttctcgcatcacacatggacccctgtggacattggcgcccatgtcggtgggaaggaaaaccttcaacagcccaggccatttgggctggaagcaactttctggcttagatccaccctcctctcctctcagtgggataatgaacagaagtttgccatcaacttgatgcgtgtcggattctccaaagatgagctatgtgcagcaaactcccttctttcaagtcctgtttatggttggttaaataagcagtggtgtgatctgtcacctccgctctccagccgggctgatgagggcttcccaggggaaggccagagacgcatcttgcctggaggtccctgcaaacagaaccacatcctatctgttggggatagtttaggtggaagaggattataatagcaacacattttaaagtgttgaaaatgtaggaaacaggtgaaaaacaaaataagaaaatgttttaactatccaaatttctatcattcaattattatggctttttcttttcatgtctttattctatgcaagtgacaagcttatgtacatttttctcttttatataattttgatcttatgatagggggatggtttatatgacatgtt

SEQ ID NO: 473187 - DNA, 876 bp, Homo sapiens
cgcaatggttcttttttgttttttggtttgttttaaactttcatttcgagttggctgaccatggctgccctggcaaataactcagttgaatccaggcaggtcagcccctaccaccaagccatgggactgcatgggatccaacagtgtgatgctgggagctcacattccccatggttggtgaggcagaaaattcacaagaacaaagctcttgccctagaaagatcttcttttcaatttagggtcaattccactttggggacttccagaagagtcacctttaaattaagaaaagagaaaaagaagctgttgcatataagccagggaaaaccacacacgaatgtgaacagcacccgcgttccacccagcagcacggattttttgtgggaaacttatacagagccccgtaagcctccaaggaggctccatgtggtctggctcagctgggaaaccatcgctgaacccttgttctatcggtctgcggacacgattcagtgtcttgagctctgtgggatcagctgtccctctgagctgagccagccctcccgtgagtggtgttcagcctccggggcccgggaccgggaacaagggcagaccagcctgcagtctgcatccagcggccaggtcaaggtgatcgagtttctctctccagtcacaaattccatcacccctggctccaggccagatctgcctcaggtactgaggatactgaaaccagacctgtcctaaacaccctactctatccagaaagagacactgagggaaattttattatgtatttgttatttattatttaagcagtcaaataaaatatcggaacataaacgctctaataaaagaaggaacaaaaggttttgaggatacagaagggggaagtga

SEQ ID NO: 473188 - DNA, 799 bp, Homo sapiens
attatgactgaacgaggagtttgagtcattccttgcctcctcccggaagcttttcttgacatcccagactgagtttcaggccctgctcattgcctgcccctcaacttaagtttttgttgcagagaaccacagtgaccactgataactctctttctcccctactagatgtggcctctttggtggcagggcctgggtctaagagtcatgtcccctgcccatggcaggtggcacacaaccttctctgcacttgtacccattatgtgtgggtcgtgctcactctgttgtctattgacagccccagtgatgcctgccatgtggggctccctgctgagcctggcccacggggataggggccagacctataccatctatctgctctgccatgtgttctgcgctctgagaggtgctccctattgctccctgtcccagactcactgcatcctgggttctggttcacttagtgaatgcctgggacgttcttcgggcaggtcattctcactggacatggcagccttgctcatctgtccccttcatttatgccacagcccctctcagccccttgtggtgagcagctcccagactgcttctacccatctgcttctgactgggggtgttggactttcattgagttttcttttaaaattgcctttatcagccgtctgcagtccatcatcacaaaggtttcttctggtcttgtagaagatatgcatcacattttatcctgaaatcagatttaactcaagatgaccactattgccatccttaaatatgtgtcatgaataactgccattttaagtgc

SEQ ID NO: 473189 - DNA, 748 bp, Homo sapiens
gttcccctttccataaggcacaccctgatctcccctaactagacatgatctcgccctacattgctcatgtgcccatctgggttgggggtcaggggctcaggtgcccaggacagtgctgcagctctagcatgtgatttgagcccaatcttggggcccacatcttcaagctgttcaggccattccccttcagcaccacatttacgatcagcttttccagtgcaaaatgaaaacaacgggcccctctttcaaaaattgcatagcattaaaccaagtgcaggatcctctgagcatggggccgtctgtgacttcctgggccacatatctgtgaggctggccctgcccccagggcattccgaggctttagagggaccaagatgtagtgggaaaatcaaggagctgtatgctgagctagacaaacctcagtcaattctcagttttgtgtgttactggttgtttgaccttgggcaggtgaagaaggtacctctatttcctcctttgtgaagtggagctaaaaatatcagtcctatggtgatattgtaaagatgaaatgaaatcaagtttgtagcgtgcttagcagagtgtatgatatctagtaagagctttaaatcttagtgtttcatagcagtgttgctggtgccctgccatggccacctgtccctccttagtacctaccaactgccttccaaatgctgccacctgcattgctaggctgatggcttttctcttgctgctgacagagaaataatta

SEQ ID NO: 473190 - DNA, 561 bp, Homo sapiens
ccccgctgcctgcaactgactcaactttcttcttcttatagctgaaataattggaccggggggtttctgagctgggagttcattgtcaagtcagctgtcgctgattctttatcaatgtgagagaactcagccatgcaaagacctttccctgctacttacctgcaaatcaggcagcatcagcatattagcagtcaatcagcattcattattcgtctgctctgtaccaggtactggcccatgtgcttgggaatagaaaggttactaagaggatctctgcccgaatgcatcaagttttcaggcaacagacagagcagggctttttacaatccccgggagccctggcaggctagtgtggggatgagtcagaaggcaccctccaaggaaatcacagcaaggggcgaagagtcaggcagatgccagagccaggacagtcctgtgtcctggccaagatggttggaccttagcttgcaggtcatggatggatatggatgggcttttagcagaaatgtgacatgctcaaacctgactgttagaaatttcctatgaaagacaagatgggct

SEQ ID NO: 473191 - DNA, 850 bp, Homo sapiens
gagggtccgcggcttcattcttgaagtcagctgtgactctcgggaaccttgttagaagagaatcgaggagcgtcagccacatccaaggccccttgctctaggagggtgcatctggaatcccatatatcctagggtccgttattatcatagcccaccctggcacatgcaggatgggctctctgatctttgagctgcttcaggctaaagccttccctgatctccacacactatctccaccctctcagccaaaggtgctcctcctccgtaacctccagagcgctgtgcaccggcatgccctgcttagtagagaaggctctggggaaaaatctgcttctaggttcattcaggttgttggcaggttctgttctgtgaggttggaggaccgacatcctggttccttgctggctgtgagccaggggtcattcttagctactaggggccaacccagccgaattccttggtctgtcccctccatcttcgaagccagaaatggaatgttgaattcttcttgtgctttgaatctctctgacccttccttctgccaccagctagagaaagttctctgctttaaagggctcaggggattaggttagatccatccagacaactatccctttttaggatgaactgtgttgctctcctgagagctgcaagtttttattctcctcttcagttctccttcatggaaactagggggcagctgacagtcataccacagagagtcaacccctccaaagaaaactgtccctaagaggaattccaggccagctgttgggagaacaatgtcttctccatcttgctttgggtattgatggccgcctcacagagatctttgagcccttccttaagt

SEQ ID NO: 473192 - DNA, 554 bp, Homo sapiens
tgtcaattacccagttacttaacttcctctgtataatccagacgtgggtaattgatctatcatgacttcccaagggacatccagcagacgcactgctccagcgacaaagcccatggaggttggtgttgatgggaagggcactcatgatgcttctcctgcattacggcagaggcaagtgtcctgccaggacacccaagatagtggggaaagtgagattcagggttcttcagctgcagtgcaagtaggacacatgcaggtgaaactcatctactgcaggacagctttcctgagccttaggggagcagctcctcatgaattgaaaagaaaggtgaatgaaaagaacattggtctgggactcagtcccagccaggggcatggattcagttctgacttgtttgttagcactatgtcttatcaagcaagtaacttaacctttttgggcctctgtttcctcctctgtaaatgagaggattatactagaaagtctccaaaaacttctgcagctttcacactttactattgtatatgataagccaggaataaagctcattctt

SEQ ID NO: 473193 - DNA, 1461 bp, Homo sapiens
tttgtcttcagtttatgtgtgtctttacagatgaagctgtacaagcatggtgccaacattgctcagcttctggggaggccttggggagcctttactcatggtggaaggtgaaatgggagcttgctcatcatatggcaaaagccaaaagcaggagcatggtcagggggtggtgtgccatacacttttaaatgaccagatctcacaagaacttagagaaccgctgaagggtgaaaagccaagtgcaaggagatcctggaggatgagaggccatttggacatcccagctccagccaaattgccggctgaatgcagtcgcatgagtgatctcagccacccaacgtggagcagaagctcctcccagtggagctccatcaaccgcagaaccatgacaagtaataaatcacatagctactgtgctttgagatggcttacaacacagcaatcgatagctgagctatgtgttaataagttactgtcttcattacatagggtgcttacctgagattttctcttatgaaagcattactgtgtgtacatatttacctttgataaagattcagctccaaatttatattcaactgaaatgtcagagggatgcctgacaccttgcaatgtgcttggcctctgagccatttaaaaacatatgtcaccccggtgcagctttgtcctcactgacatgtctaccaagaagcctgggctggctggtgttccaggcattgacttcaaaaaatgttgaatgaataacttgtaaatatcttatgtgtgtgtacctctgaaatgattaaaaaactctaaatgaaaccaatttaaattcagatatacttcaacatactaatgttaatgaaaaatgttttatataactacaaaaaatgagcaagctaagtactgatatggaaagggttcctagatatattattatgtcaaaaaagcaaatttcagaatgatgtttttggtatgctaccttcagagtaaaaggaggaaaatctatatgtgtatctgcatagacccataatattttaaaatctaagcacagggttgggaaactggcactaggggaataaacacaagaaggagactttccactatacactttttatactttctgatttttaaaccatcggaatatactaccatttgaaatacaatttaataagcaaaatttgaatctatttatgttttgcctttacacttcttttgcaactaatgaaaatgaatattttttcgtttgtgtgttgaccagtttacttcttccctgagtatgtttgcccatattgacatcttagaggctttgctttttttaaaaaaaaatcagcaaatgttaaatcttctccaccctttacagtggagatatttgccctctgtcacctgattttgctttcctttatgttattgcattttagagtgtgaagtttttatgcatttgtatctactcttacatgctttgacattgctcccttccat

SEQ ID NO: 473194 - DNA, 603 bp, Homo sapiens
ggggatacaaatgcccctgagagagcagcggtatactgggatagatgaggatggtcacgtggtggagaggcgtgtttttaggtaccagcccttcacctctgccgaccttcttgactggaaaaacaataccccatcctataccgaaaagccacaagctctaattgacttgctccaaactgttatccagacccacaaccccacctgggctgattgccaccagttgcttatgttcctctttaacagagatgaaaggcagagcgtgctccaagcggcaactaagtggctagaggaacatgcaccagctgattatcaaaacccgcaagagtatggaaggacccagttaccaggaaccgaccggcagtgggacccacatgaaagagaggatatacaaaggctacacggagacagggaagctctcttggaaggattaaggaggggagctcagaaggctacaaacattagcaaggtctctgaggtcattcagggaaaagaagaaagtccagcacaattctacgagagactgtgtgaggcctatggtatgtatactccctttgatcccgatagccctgaaatcagcacatgattaacatggctttagtctgt

SEQ ID NO: 473195 - DNA, 1098 bp, Homo sapiens
gtgacggttgaaaaaccagcaaactagattccactattgctactggaatgaacccactgccagggcaaggaggcattgctggggagacattgctaaaacaggaaacaaacaagaaggaacaggtcctccctcctcaagactcacagtcctctgtaacacataaaccatcaacactcactggaaaccacacggacagctcctcaggaggtgtggggtgccccactgcttgcccatggtgcttgctggccaccataagtggctcctggcatcatgccttactaaagtggatgctcagtgcatctactcaacaacggtgtgaagaagggaatggagagacaatgagtgggttggacttggctcacccttcctgctctaacatttggacactctgtgacaaatgcagaaggaattcactgaagccagctcagagtcctgtactgccaggcgtgactgcagaacacagcccaggcaagggatggagcagtaatgcaccgtggggtgggtgggggtccatgctcagccccaagatggaattctgtcccttcaataaagatctggagcagaaaaggagcatgcagcacccagcaaccacagagggtgaccacagagctgagcaacagctgaagctgtccagctgcttttctgtggcaagtctacccacatccgcaacagacaagggattcattcatcaagaccctggcttcatgagaagatcatatgtcagtgtgtgtttctgacaagtgttgttagctgaaagtgtggaccgaaggtgccccccagctcaccactacctaggccaccaagaaaagggaaaaaagaggctgaattcacacagccttgtgaagttcctggcaggaccaagtgttagaaacttagaaactacaaactgtaatataaagcaattattaaaatgaataatagtcgtataaactgggcatggatgaacgaatttattgcattttggaaacttttgcatcaggaggactcatattgtagaaaagagtaatcataaaaatggctgtcattttaaaaaacatgcctactgttgcaagtaccacatgtaattctatttaattttatcctcacaacaaccctttg

SEQ ID NO: 473196 - DNA, 685 bp, Homo sapiens
ctgtgatattagaggtgtccaagacacacggagccacggaatctcacaggtgtctgagaattcctcctcctgggactctcagaggatccagaactgcagccggtcctcgctttgctgtccctgtccctgtccatgtccatgtatctggtcacggtgctgaggaacctgctcagcatcctggctgtcagctctgactcccaactccacacccccatgtacttcttcctctccaacctgtgctgggctgacatcggtttcacctcgcccatggttcccaagatgatcatggacatgcagtcgcatagcagagtcatctctcatgcgggctgcctgacacggatgtctttcttggtcctttttgcatgtatagaagacatgctcctgactgtgatggcctatgactgctttgtagccatctgtcgccctctgcactacccagtcatcatgaatcctcacctctgtgtcttcttctataaaattgtcccctccattctaaggatgtcatcgtcagatgggaagtataaagccttcgccacctgtggctctcacctagcagttgtttgctgatttgatggaacaggcattggcatgtacctgacttcagctgtgtcaccaccccccaggaatggtgtggcggcgtcagtgatgtacgctgtggtcacccccatgctgaaccttttcatct

SEQ ID NO: 473197 - DNA, 710 bp, Homo sapiens
ccccctaggatattaccaataacatcacagggtgtccacccatggatccagaactgcagccggtcctcgctttgctgtccctgtccctgtccatgtccatgtatctggtcacggtgctgaggaacctgctcagcatcctggctgtcagctctgactcccaactccacacccccatgtacttcttcctctccaacctgtgctgggctgacatcggtttcacctcgcccatggttcccaagatgatcatggacatgcagtcgcatagcagagtcatctctcatgcgggctgcctgacacggatgtctttcttggtcctttttgcatgtatagaagacatgctcctgactgtgatggcctatgactgctttgtagccatctgtcgccctctgcactacccagtcatcatgaatcctcacctctgtgtcttcttcgttttggtgtcctttttccttagcctgttggattcccagctgcacagttagattgtgttacaattcactttcttcaataatgtggaaattgctaattttgtctatgagccatctcaacttctcaaccttgactgttctgacaccgtcatcaatagcgtatttatatatttcgatagtactgtttggttttcttcccatttcagggatcctttgtcttagtataaaattgtcccctccattctaaggatgtcatcgtcagatgggaagtataaagccttc

SEQ ID NO: 473198 - DNA, 543 bp, Homo sapiens
aatatttccttggcagtgtggacaaaattcctgataaaggtaaatgcaaatgcataaaattggaattgggggttgcccacttgttccaagagggtggggaagaagaactgggtggggaatgggtggctgcgtggagagctgggggaggggagagcccattccttccccagcatcagcagcatcaacaacgggtgtaacttaccaactggtttctgctcaagtcagcacttactgggcacctccccatgccaggcacagtgccctggtgggcaggtacaccccaccatgtggccctcccagagctctccactgggggttgaccttggagcctgccctggtatctgtgctccagccccttcgctatgagatgagcaccaccttttccatttctcagattgaagccagcggggaggtggggagagtggggccctggtcaccccggaggacctgccagctggacgcctgagttgtgcttggcagcctgcaatactggagagctgcccctggagggcgcaagggaatcccgttgctgcactcggacgc

SEQ ID NO: 473199 - DNA, 880 bp, Homo sapiens
aggtgaagtgtccagtacaacagcttctatgtgaccagctgggctttcagtccagacatttctacctctccagcttcccatcctcaagaatgtggctgggccagacccagactctgaggacattcagggacactgtgcctcgccagccctctgaagtgctcagaacgtatgtcccgaccccactgaatgccaggaaccatgcactgggaagtgggtggacaggagagacaagacatgctccttccccaagaggaggctgcaggcagcaagggaaacccttaggtaagctcggaacagccgtccaccactgggaccatgagctgcatcctgccttggggggccgctttggtgggagtgtgctgggcagagaagaagggaaggacatccaggcagagggggcacctgggcaaaggctcgaaggtgcagagtttgtccactcacttactgaaagacatcttgatagcttacaagttttggaaattcggaataaagctgctaaaaacatccatgtgcagttctttgtgtggatgtacattttcaacccatttggataaacagaatggacttgcagttgctggattacatggtgtgtagtgctatctcattgttttaacttgcagttccctaatagcatatgatgttgagcatcttttcatatgcttctttgccatttgtatgtcttcattgaattttgtagttttccttatatagatcttatacatattttgttaggtttatacctaaatatttcaatttagggggtgttaatgtaaatggcattgtgatttttttctgatatattcttattaaaagtttttctgggtacataatatatatatcatatatgtatctcatattttatatatgtatatatatatat

SEQ ID NO: 473200 - DNA, 711 bp, Homo sapiens
ggggcacagtgtggagaaacactcacctctttgaaaagtaacaatggaacaatttttttctctcctgggaggcaaagatgaaggcttatgtgccccagcgtggagccctcttcagctaatactcactgtctcacctccttccccaagtggcttaaaccagtcaaaggccacttttggcttcaatagaaaaaacctggaactggtgatcagcagcttccggataggatctcggaaattgggtgagtgggctcaagcatgcatactaagaggcaaaatggtggaatttaactggtatatggcctatggaaacactcaactggtaaggaaagaacgcctcaaggctgctgcagcaaagttccacagactgggtggcttgaagcagcagacatttattctgccacagtgcaggcagctggagcctgcagtcaaggtgttggcagggtttgttccttttggaggctcggagcgggatctgtcccatgcctctctccaagattctggtggctgccagcgattcccagcgttccttggcttgtgcctgctgcactgcaacctctggctctatcttcaaatggcaatggtccgtgtgtgtgtgtatgtgtgtctgtctgtctgtattctctccttatgaggacaccggtcagtggattagggctgccctactctagtatgacctcatcttaactgtttacatctgcaaagacacttttt

SEQ ID NO: 473201 - DNA, 3079 bp, Homo sapiens
ggtgaacgctgtcggttctgttttcagaacgtgcctgtcattcaggatctggccacttcttaccatggtcttggctgcccggggccatgcaactccatgaccttctggctctttgcttctgcccttggtcctcggccgagacgaacaagaagacagtccatgcaaaatattgcagcaggtttgtccatgctccctggaaggatgggagcttggtccacgtcaacattaccaaagagaagtgcaagtggtacagtgagagaatccacacagccctggcccggatccgaaggaggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagggccttgcaggaactcagcccgtcagtgttgctactccaagctcaggtcttgccatgggccactctggcagcaatccaatctaccaggaaatatgggcacaaacatcacctttgctgaagacaggcaccaccactgggtgtattgtggtggtcattgatgcagtagtggatatccaaggccagaaagtcctggattctggtgcaccaatcgaaagtcctgttggtcctgagactttgagcagaatcatgaacatcattggagagcctattgatgaaagcggtcccatcaaaatgaaacagtttgctcccatttatgttgaggctcctgagttcatggaaattagcgttgagcaagaaattctggtggctagtatcaaagttgtagctctgactggactgactgtggctgaatacttcagagaccaagaagttcaagatgtactcctgtttattgataatatctttcacttcacccatgctggctcaagggtgtctgccttattgggcagaatcccttctgctgtgggctatcagcctaccctggccactgacatggtgggtatgatgtggggaaagaattgccactaccaagaggagatctatcacctctgtacaggctatgtacctgctgatgactcgactgcctctgctacttcctttgctcatttggatgccaccactgtgctgccccatgctgtcactgagctgggcatctatctacatgtggatcctctggactccatctctcacatcatggatcccaacattgttggcaatgagcataatgatgctgctgaggtcatcacaggtcatatggggaagtcagtactcctgaaggagaccattaaaggatttcagcagattttgataggtgaacatgaccatctctcagaacgggccttcagtgatggaacccattgaagaaggtttggcagaagctgatacgctggctgaagagcacttattgtgaggggtctttttggcaaactaagcactcatctgctgtactgtccctctccttcccctaatccaaacagcttcaggtttcggtgtaagccacatgagaaccttgattgaaaacatgttctatctgaagagtatttaaggtttccaatacaatgtacacccctcagaaaaaaaagaatggtgtactgaagaccccaaccataagactctacctattttatctattacaactctattataaagtagataaaaatagatttatctatttttcttttcatctccatcaaattttgcttcatgtgttttgaagctctgttgtttgatgtatacacatttagggtcattgtcttcttggtggatagagaattttatcatcctaatgtccctttttgtccttagtaaattttctttgtgttaaagtctactttatataatattaatatacttatttttgctttttaaaattaaatatttgcgtaatacgttttttccatccttttacctttaacctatctacgttgttatgcctgaagtgagtttcctgtagacagcataaatcgggtcatgtttttgttcactcttcaatctctgtcatgtaattggtatatgtaggtgatttatatgtaaagtaattattcatatttaaggattaagtgtctcattttatttatttattatttttgtgtgtctcctctgtttctcatttttctcttttgtcttgccttcctatgggttatttgagcatattttggtgtttcattttgatttatttacactgtttttgagtgtattgctttgtatacttttcttaatagttctatgtatttccttatacatatatgtaacttatcacagcctattgtgatgtaacttatcacagcctattggtggtttgctacttcaagttaagtgtagcaaccttacttctatttaggtccctttacactcaccatttaaaatatataattgtctgaagtatttcctttgcatgcattatatgccatcttagatggtgctaaacttttgcttcaatcataaaatgtaactaaagaaatccatggtgttaaggattatctattatgcttacttttatatttactcattccattgttcttttttctgaaagtccaggcttttttcttttctcgttctctttctatatggaaagctttcatgaatgcttctttaaggaagatgtatttagcaactcactcagctagagtaagatgcatcctacgctgggcatgaacttttacagcttttggcacagtgttaggtcgtcatattctaggcatccaacaccatcctatgaacccccttcaaggcacagaattttgtctggttttgtaggttatgtctcagatctatcaaaatgtctggcacgtggtacttatgtgcttactaagtatctattgaaatgaaagggagtaaagctgatgaaggagccttagattggaagctccacaaacaccctgagtgccctgaaaactgcttttgctgataaagaaacacaggcaatctaccttctgaccgatgggagacctgatcag

SEQ ID NO: 473202 - DNA, 698 bp, Homo sapiens
atctggaatcttgtaggtcaaggtgatctaccgggtcagtggtccccaaggcagggctcatctccacaccagcgccgattttgagagctcctgttaggaggaagaggcccgagggggtggtgtgaatgggcacacgctccccgccagcccaacagctctccttcctgcgcagtggcctcctgaacatcctctacctgcacatgcctgactgcccggtgtccctgctccagtggctgttccagagcggcgagcgctgggagcctctgcttcccccgaaggtgtgtgtctctgggtgctgcctgtgccctcacgtggctttcctgagggacctggtgtacccagtggacttacggtctaacctctcagtgaatcggtccaagcccctcaacaagtgcttcctatgcaacaaagctaatttcttcaccagcggtcacaggtccctcatcccatacgcagcgggagggccgttcagggcccacggcaatcctgcagtgcctgcccccaatcccccacccaaggcccagaaggagcagtggaaagcagagactgcaaactcagttgcctacggggactgagtgagcaaagtctgagagctcctgcctgatgtaaaggggctgtccacatcaggtttggtgcagaacattttcatctccccaaaaagaaacctcttaaaatgtgctatatccataaaatggaat

SEQ ID NO: 473203 - DNA, 3233 bp, Homo sapiens
tgaagtgctttggctggcaccacccttcatagtatttgtagcaggttcctagccatgagggtccacagaacaaagctggaggcctggtatcagcccacagagttagaaaatgaacgcagtcaactgaacccaccttataccacaatcaaacttccaagggcatcaaagaagataaaagcgaaaaacaatctatccaaaggacagcaacttcgaagattgaaggaacataatccaacacagatgagaaagaaccagtgcaagaactctaatgactccaaaagccagagtgccttcttgactccgaacaaccatgcaaatttcccagcaatggtttttaaccaggatgaaatggttggaatgacagaaatagagttcagaatatggacaggaacaaagagcatctacgttcaggagaaagttgaaacccaatccaaggaagctaaggaatacaataaaatgatacaggtgatgaaaaatgaaatggtcattttaagaaagaaccaaactgacataatcgagctgaaaagctcacttcaaaaatttcataatacaggcggggcacagcaacacaaagatgggcagcagttagaaaaggacaggccccctaatggattctcaatgtttggttataaagtcggattacttgctggcacctaacattagactacttgatgcaaaacctccgttccagcctgatgctccattccatcaagctaattatcccaagctagaagcacagaggggtcacttatgtgtgggccttccctgttaaagcaatttttttttatgggccaaggaggaaagtcttcaatttggactcgtacagaggatttcctttgtcctgtgaaacagtcagatgttcaggaatgatcctttatttacacaggaagtttctaacaatagatcctgattctgctattaggtttcctctttctcatttattctaagagaatttgaaattcaaaaagaaaagagaagaactgtgaaaaagcatgatgtcttgaatgtgctattgaagtgaagattaacctttataacagggcatctgctatgccacagctctatgtgtaaagtctgtttactaaagagggcattaatcaagacataggcatccatttataatctctttgcactgttgctaactccagagtgagctactgtcattcttcaaacagcttatttagggaaaaaaatcaaatgtatttcagcctcgtatatatggttggcagtctgtcatagcttcttaaagtgattttctgattatatagaagattgacatgagaaattcaaaatcaacatatcttaaactcatgccggtgagtttgaatgatgatattaatccataagaatcaatttcttctgatttgctgtgcttgggttttacaacataaggaaaatgcatttggtgaaaacacttcttgctttgagtgaagagttattcaaaccttaatcaagcaagagcctagactaggcactttctcacatatgaccttatttatttaattctcacaagtatggtgtgagttacagataattctgtattacagatgaggagagtcaagctaagcgaagttaaatatcttcctgaaggccacatgctcttaagagaattgaaacacaagtattctaacttgaaagtcactgacttttctgctagaacactgtcccttctgaacacaaattgtcaggagggtaagattatatctcttgttgagctcatcattgctgttctcaatggtcaattttaaaatgcagcgccccccaggaaggtttctggaagcatactcttgttctctgttaattggcaaaccaagagttcttcttcaattcatggatggctttggtagctttcacacttgtgaacataaacagttcactcaggtgttgctctgatttgcccactgtgttttctctcattttaagtcaaccggaagacaaataaatactcatgacaagttgttaacagagtggaaactgctaattagagggtttaacggaagtggtgtattacgtagtatttgtcctcattgaatcttaatcagtctttaagtaaaagcaattacttaataaatgttgaaattaactagttcttgaaagcatacaaaggttttcgttaggaaaacctttgtaaacatcattaaaacaaatgtcataggacatttggaagacaaaacgtctttctggttcatagatttcaaatactgtaagacccataaaacagtgcagcttatcacctagccagtgtaaagtattgtgaaatacccagtggtgctgtctttgatggttaaaaagggtttttatttatcttttggggtaaattaactatttggaaaatatcaataatgagggacagtcttttgcactttgatattttctattgccttatgttaccactgtactatcaagcagaaaaatattatatccctatctgagtgatatatctacattaaagttcaatttcacctctgaagtgaatatgaattgtatttaatgaaactctaagagcagttgtacagagtgaaaaggccaaataatttggaatcaaatttgtcaagtaacattttacaaaagtgacatattttcttttttcattcttcatcatgctcacaattcaaaactgagtccaaatgtcacatcacctgttttgattcgtctcttctctgcctgacagaattaggctttttcctctgggctgaaacagccccttttcctttcctctgaaataaaacttgcagcatgatattgtaaattttgggtttcctgaagggaaatgattttctattactcatctttgaaccccctatgcccatcagagttcttggcccacagcaagagctcaacatgtttgttgaatgaataatgtaaattcccccaaagcacatgaactcatttcatgctaaaaaatttcatgttcaaatgtgtattagctagtttctgtaacaaataaactccaaaatttcagaggcttgaccaaatggaattttattttttattcatataacagcagtgtggttgttcttggtcagcaggagggtagctttcaaggactcatactcctttcttttatctctgcctttctctagggcctcagtcagagtcttaaatttgtgttgatttacatctttgtaatatatagaaatccctggatatattcttatataatgcaatgcatactgccttaggcaagccacttacctctcattagttcatatacttaatatttgagagtctac

SEQ ID NO: 473204 - DNA, 499 bp, Homo sapiens
cgagcatctgtgttcatcacattattgggcaggaatggggcttcctgagagccaaactgtagtgattgtttttgctcttctgagtctatccattcagcagagctatcaggctctgggctggtactggggagtgttgagcaaagattcctgtgatctgatttgtcctcaggccttttggccgtggataacagcatctgctcctgtggagctgtggtcctatagagaggaagcaaacttgcctgagggtctcctggttaagtattcaggtttcgcaggcagtgggcagggccatagagctgccaagagattatatcctttgtcttcagcaaccagggcaggtagaaaaagaccactaggtgaagtagagttgttcaaggccttgggagcccaccccttgtatcggtgtgccctggatatggagcacagagtcaggagattattttggagctttaagatttggtcactgccttgctgggttttttacttgtgaggggtctgt

SEQ ID NO: 473205 - DNA, 1787 bp, Homo sapiens
agcagcctgcctcctctttcctttcaacatgacagatgccacagtgtcctttgccaaggacttcctggcaggtggagtggccgcagccatctccaagatggctgtagtgcccatccagcgggtcaagctgctgctgcaggtgcagcatgccagcaaacaagtcaccgcagataagcaatacaaaggcattatagactgcgtggtctgcatatccaaggagcagggagtcctgtccttctggcgcggtaacttggccaatgtcatcagatacttccccacccaggctttcaacttcgccttcaaagataaatacaagcagatcttcctgggtgatgtggacaagaggacccagttttggcgctactttgaagggaatctgacatcaggcagtgctgctggggccacatccttgtgttttgtgtaccctcttgattttgctcttacccgtctagcagccaatgtgggtaaagctggagctgaaagggaattccgaagcctcggtgactgcctggttaagatttacaaatctgatgggattaagggcctctaccaaggctttaacatgtctgtgcagggtattatcatctaccgagccgcctacttcagtatctatgacactgcaaagggaatgcttccggatcccaagaacactcacatcctcatcagctagatgatcacacagaccgtcactgctgttgctgggttgacttcctatccatttgacaccattcgccaccacatgatgatgcagtcagggtgcaaaggaactgacatcatgtacacaggcatgcttaactgctggaggaagattgctcgtgatgtaggaggcaaagcttcctttaagggtgcatggtccagtgttttcagaggcacgggtggtgcttttgtgcttgtcttgcataatgaaatcaagaagtacacataagttgttttctaggatttttctcctggtgaacaggcatgttgtattatataacatgtcctgagcattcttgacagactcctggctgtcaatttatctgtggcaactatttgctgttgaaaatgagaagcaataatgttcatctgaccagttttctcttaaagccatttccatgatgatgaggataggagtcaattatattttttatttcagttactcctgataaacaacaaatttggagaaataaaaatatctataatgaagaaaaaagaaggccttcacttgagcaggaacaaagctgtgtgcccaaagtgattttaaaagaacatgaactggggctgggtatggtatttcacacctgtaatcccagcattttgggaggccgaggcagaaggattacttgagcccaggagtttgagaacagcctgggcaacatagggagactcctgcctctacaaaaaaaaatttttttaattcaaaagaacatggactgcagaattatatataacaacaaattttaaaagaaaacaaaaaacaagttaattttttaacaatgagagaatgaataagtacatggattgttcgtataatggaatactacacaacactgaaaataagctgagctatgatcatgtaacatgattatgtaaataagctatgatcatgtaacatggacaaaatctgcaaaaataatttgagtgaaaaagcccgttagcattgcagcctagatctttctatagtaatcagtattcagaggttataatgctagaaactttctacagatgttccttgtgttcgtcagtgcaagctgcctgaaatttgagttttaatgcctaatagaatttagccttacagaatcagaaat

SEQ ID NO: 473206 - DNA, 514 bp, Homo sapiens
ctccccagccatgaggaactgaatgcaaagatggtctggtcatcaacatacaccttttacacctctgcggcacaaaatgtcaacaagaactgtccagtctaccagcaagaaagacagagactgtggagggctatgggacaggctccccagggagaaggacctgcacggagctggaaaataggctacattggactggtgccagtatctcagagagactgtaattgtatcttgacaagaataaacactaacttaggactggactttgcctacctgatgggagaagaaaatgctcacaatgttacccaaacatcagacttcagtctagatcctgctgttcactgcacagaaaaacgatcactgagacaaggagtattgccagggaagaaggatttatttgcatgctgcagccaaggagaacaggagatcaggctcaaatttgtctcctcaactgactgaaatttggggtttatatagcagggaggaaatgtaaccacatgtgaaaaaataggaattc

SEQ ID NO: 473207 - DNA, 552 bp, Homo sapiens
actgccagcatgctgtcacctctcaataatagcaggcagtcaggtccccgtgttgcaggtctgctggagtttgctggaggtctattccagaccctgtttgcctggatcaccagtggaggctgcaaaacagtaaagtttgctgcctattccttcctctggaagcttcgtcccagaggggcacccgccagatgccagcaggagatgagttttatctataagcccccgactggggctgctccctttctttcagagatgccctgccaagagaggaggaatttagagaggcagtctggctacagcagctttgccgtgctgcagagggctctgcccagtccaaatttcctggcagctttgtttatactttttgtgcttgaaatccagcaccctggtggtgtagtgacccgagggaatctcctggtctgcaagctgggaagaccatgggaaaagcgacagttcacatgaagaatataagataatttatggccatattttaaaaccaccaaagcctttttaaaaccagtcaataactcatactttcttaaaaaataaggt

SEQ ID NO: 473208 - DNA, 600 bp, Homo sapiens
ctcccctagaggtttgagcagcagggcactgaagaaatgagtcacacccccatcacatgccctcaactactcaactctgccattgtgggaaagcagccatggacagtactgagtggactaggatggctgtgaccaccgttactctttatgaccactggctgacagtgaaggacttagaagtcctgaaagatgggaaggacccagtcctggcagcattcatcaaatgccaactgaagagcccttcagccctgaataaccagcaacaatacccagatttaggtggctcagaacagagaaaggaactgtttgtttgggagaaactaagggaagagaacaagtatctgtctggtaatccagagaattctcccagatattgtccaagactgtcaaggcagtacttctataaatctgcaagaatcacattgttactgggcttgaggtgccccctaaggcagatacagtttagatcacaacacctaagtcctttcgaatatctgcaaagccttctcaataaggacgggcacaaacaagcccagagagtgaagactacagtaactatctaactattcaatgccttgacactgaataacacctaccagc

SEQ ID NO: 473209 - DNA, 1568 bp, Homo sapiens
tggcaccacttatgtcccacattttaatccatccataaaatcaagccaaaatgcctattatcaaagacaggaggaaggaaccctgggagaggctggcaggcaatgaggcattaagatcagactggccacatttcacaggcaagactgccctgctctgtccaggtcaaacggtcaacaaaggccaatgccgtcttgaagaatgtggcaagcctcagaagctgctcaggaccaggaaagagtcctggtgctcagcaacactgtgcagagttcctagcttcctctcccttcagcccaaggtctgcaccctccctccatctactctcaatgcccttcttctgaagatctgctcagagtgggctagtcttctcgagggcctggtctctcagtggaggaagctcttcttggctgcatcaagtcagccatcttggctcagccgcaggatgctcttgggagttgagtctggttattcatgacctttgtttggctggatggtatacacaagtttggggccagtgcatacttgcttggcaaagtggaataccggtagagagctgtcactagatggcctaattctttaattttcctccctgtatgctcagactctgctctgaattaaggttaaatgaatatttaataaaattttctttaaaactctagaaaattattacctagtctagtaaatcctcatgacctagtctagcccagatcacagtacatgatttctagacttctcaatgtcttaatctcttaaactttcatttcaatatgtccctattaaaaaagaagacatcaaaaatgaaatattatttggatatggccttggcaagcaaaaataagactatcacctttcttactgtaaatattttatttcagtggattcgatcatagactatactagctttttttgcatttaactcatatttattttgccatgacatattttcttaaattactcttacctttgtctctgtattaagctttattttctcccaacttatacctaggcagtcagttttgaacttccaggataggatattttaaattaaaatgtaaaatacatagctgttcaaaaatcatacagagttacactttataaaggagtatacaacctcagcatgcactgaaatgacaaactataaaataccagacacaacagatttctattttagtatgcttactttgtcacaagctttgcatgtgagggtctttgcatacatagatgacctaatgatgtattgttttctagctgttgtagttatgcccgttgggtaagtactggtcaggcaaatcaataagcacagattacattaactactgtacaaggaatatggatcttgtaactaggtgtgcaaatatcactgaagcttctgaccttaactactcttttctttctcacttaatcacttaatcccattatatccacccaagactgcacagatgctttaactcaggaatatattggaggttaaaaaaaaaaaaatcttcatcaaattttcagaaatatttattcacagtgctgttctacaaataagatgtaaaaatagttcccacaaatataactaagtatt

SEQ ID NO: 473210 - DNA, 681 bp, Homo sapiens
actaaagcaaggctaaaacagctttgacctgaactcttctctgatggagaaagaccatgagtatccaggaatgatggatctggaaggagaaactgtgaggttcagtgagttagaaagattagaactttctttcctggtggagccagagggagagcagctccatgctgaggaaagctatagagggtgtagggccgaggaagaaacattaatgacagtcattacattcccccagactttcacatggaagtttgagtcatgggaagtaaatgtcattcctgaagatgtgaatttcacctaccgacatacattgagtgcctcatacccaatccacattgctaagcaccgtagaagcacagaggaatgcaagataaggtccctgtgctcagggagtgtgaaagatatgcacacacacatcaaaccaaaatacaaagcagtcggtacagaggaacacggaaggtgaagagaggctagtaaagtaatatatttttctgacatgttatgtgctttctgtggtgtcaaatcaaaattttgatttaataaataatttataaaattaggtcttactgtaaagagtgtttttcacttgtgaattatctccctcatttctgtcacctttatatcaagtaaaataagttcataagttccatggcaaatgaagaatgattatgtcattttgatgtt

SEQ ID NO: 473211 - DNA, 873 bp, Homo sapiens
aggcattgcccaactttctgtataactcaggtgttggctgtagattatgacttggcactactgggctgcccactacaactctaaggtgatctcagtgtttatgttccttccccaacatggagacagcagggtaacagctcttggtagtggttgtggccaagggttgcttgctggtctcctgggaactccaccccagagggatgcagtattccccttatcaccaccaccaacaacaaccaaacacagtgggacatggagtaaaaagcaaaagagacaagaaccttcaaactcccttcagagacctgccactcctggacaggcagagaagccaagggcccagagtctttccagggctctacagccccacaggtcaccttcctcccctgcccattcacaagctcattgttctctgatgcacaactcaccagacacttgcctgccctgcacactcttcctcttgaaagctaatgatctaaaatacgtcctccctcatgagtaccttgatgaacattctattaatatttaaatggcattcccaccctacgcatccagaacccccaatccatttttacagcattatttttcttccaaaatactcatcatcatgtgacatactatgtatttttacttctgtgtttaatgtctgtcagtcccttattgcaggaattactttttcttgtgttgtcttcagtatgtactaaaatgtctagtttatagtatgagcttaataaatatttgttgaataaacaaatattgagtatttatattcagaaacatactatgtctcttaattttgtcaccttaattttggtctttcaactaagtttttaaagttgttatgtaggtttccatgcttctatgtgaaaaggatgc

SEQ ID NO: 473212 - DNA, 613 bp, Homo sapiens
agcagcccactggggagccgtaggctcatgctatgttgcccaggatggactcaaactcctggtcttagcctctggtactctggtacttggattacaggtgtaagccaccatgccagcagaactttcacttttactgcgagcacagcggcagaagaagagagacccaaggaggctactgcagttgtcccagcaagaggtgatgataatggtttggtcgtgggaggtggcagtggacgtggtgaaaagtggacaaggtctgcttgtgtcttaagagatcaacctcctctccttgactgcaggtttctccaggggacatggtctctacttcagtctgtgagatctgggtctgaatgcttaggtccagaagctggaaaatactttccttctatgagagcacttttggagggcaccgtgggagtgtgagagagggaagtgatggagtttgaagacagattgggtttgaataccggttctgtcatcttagccacaatcccctcttctgcaaaatgagaataatagtagtgttaaatcaagtttagcctgaagctgcctccttatacatttttagtttggcctaaagatttttctgtacatcatgaattataacctaagc

SEQ ID NO: 473213 - DNA, 440 bp, Homo sapiens
cttaagaaccgccctcgggtgataatgctcactcacccaccactcacctcctgctgtgagacctggttcctaacaggccacagaccagtaccagtccatggcccagggattgggaagccctgctgggaaagaagaagaagaagaagaaagaagaagaaagaagaagaagaaagaagaagaaagaagaagaaagaagaagaagaaagaagaagaaagaagaagaagaagaagaagaaaagaagaagaagaagaagaagaagaagaagaagaagaagaagaagaagaagaagaaaagaagaagaagaagaagaacaagaagaacaagaagaagaagaagaagaagaagaaaaaaccttgacttcattttcatatggttctgctggcatctttgaaagccagcagctgcagctctacagcaccacaggggagtgacctcaagg

SEQ ID NO: 473214 - DNA, 682 bp, Homo sapiens
cctgtgtctcgcctctctgctgagagctagactctgtccatgtacctcattcttcctggatgtgggacaagaactcgggacctgctacatggtggagccaaaagagatgtaacaaaaatggctgaaacacgcccctttctctccatgttgtgggtgacaagaaggaaagaagacctgtggtcctttgggaagcccagacctaggagctcctcgagccacggctgtgacaagctctttggtgctctgcgattcctggcatctcctaccttctgtgccagctgtggaagcagcttgcggtatgcttggtccagagcagcctctgagggagctggtgcccgtgtgggagcctggagcttcccaacctgctgcagccactgtgcctggctgtgtgcagtggccggaccccaggcttcccttttcacacacccttgccgctccacacctggctcacccttggcaggcatgagatccaggcaggtagcacaagccaagtgcaacctgccaggccaagtgggaggaacaaggccagcaggcccaagcaaaacttgggcaaaggcaccaccagccacagagatttatggttggaaaagcaataccccgagaatcctgtgacagttatatacataattttttctttaaaataaactatttcacatcaacatatgtagaaatatatttgggg

SEQ ID NO: 473215 - DNA, 968 bp, Homo sapiens
ttctaagagaccttgctgttcatctcagctctctcctcgtcttcccaaccaattgttctgcaggcagccaagtctggaaaacttcaatgtttaatattaatgtctacatagaggaaaacgagcctatgaatgtggccaagaacagtagtcaaagatgcagaaggaaaccaggagcatactgtgccacagaaatccagaggagagagagctacgagaaggagagagagattgacaatgcaagagacctctggttaccactattctactctctacttctatgggaaaagttgatcattttagctctgattctaagacaaagttacagaatagacctggcttcaactctgaagtattccttggagagggcccatggaatattgcacttaacattaagagtcaaatatgcttcagtcaaatggggagttatgattcctacctttgagattcgttatggatttataggtaataacattggtcccttctgcaagaactactggctccttctgaaggcaggtaccttctttccacatcgccaatgacatgcagctaagttcacccataagaaagcggcattgattggctgtggagtaactgactgcttgaccgaaaccacacagatgcatcaacctgcagctgcaatgatttacgtgaaggaaccctgggctacaggaaatacacttggaaatacttttatcttctttcttaacatttcttcagaggtggatttttcatgcggttaatcagcttaatcttcattgcacctcacttgatgagctcttctcaaggctttgaatttaatgttgagtttatcattttggtattatttttgttaaaaggagctcccaaatttgaacaagtttcagatctcacaaaaactgggtctaccccttcattaatcatagactaatcagtatttagtttaatagttccaagtattaaatttaaaagaccttctcttacacttattt

SEQ ID NO: 473216 - DNA, 1056 bp, Homo sapiens
aaagtcatcacacgcagactatatcctttgatttagcaaaaaccaaaccatataagtgtggcacttcctctctctctctctctctctctgtctctacctctttctctctctctctctctctctgtctctctctctccagccaccatatgctgatagtgacatgaacaataaagtcaaggctgaggtggtctcagatggagatgaggaacttattgggaactggagtaaaggtcactcttgctatgctttagcaaatagactggtggcattttgcccttgccctggagatctgtggaactttgaacttgagagagatgatttagggtatccggcagaagaaatttctaagcagcaaagcattcaagaggtgacctcactttttatgaaagcagatcttcatagcaattcctctcatcaccagcccagacgcttaggaaagaaaaatggttttatgggctgggcccagagccacactgctatgtgcagccttgggacacggtgccctgtgtctcagccgctccagctccagccatggctgacagaggccaatgtacagctcatgccattgcttcagatattgcaagcctcaagccggggtggcttccatgtggcgttgggcctgtgggtacacagaagagttgaagtgtgggaaactcttcctgggtttcagaggatgtatgaaaatgtctggatgttcaggcagaagaagtttgctgcagggacaggtcctgcatggagaacctctagtagggcaatgcagaggggaaatgtggggttggagctcccacacagagtccccaccgggacactgcctagtggagctgcgagaagagggccaccgttgtccagatcccagaacggtggatccactaacaacttgcactgtaagcctggaaaagccaaaggcactcaaagcctgcccatgaaagcagccacaggagagcagccatgggggctgtaccctgcagatctgagctgcccaaggcctggggagcccacctcttccatcagcatgccctggatataagagattaataaaaggaggttattttggaa

SEQ ID NO: 473217 - DNA, 1450 bp, Homo sapiens
ctctccagttaaagagcaatttaataaggcttagtgtcacacggtcctgggctctagcttttttatagaaaatatgagagataaaagaagaaggcaaacacagtcaaatggaaataatcagctcaattcagaacgtgggaaattctacagaagaaaaaaaaccaggtgtcttcaacaagtagttggcatgggagaaagaagaggagaagaaaaatgtaaagctgtggtcccttgcagtgctctgaaggtgtgggctcctcttccactcaaatgctggatgcagatcttggcttggcactcctgggctgcacaccatagccgtggagctagctcaggctttatggtccctcccaaacgtgagggtagcagaggcagagaccttggcagtggtaatggcagagggccagagggtctttcacttgtctctcagggctgcaccccagcacaacacaaagcagttatcaatcagaacaatcagtctgaggtggggcggctgtgttgtgggcccaagctagacagccctgcctaatgatgagcaagaggatgggggtgctcacgaagaagacagactgggttccattttagatcttaattgttaagaaaaatatttaaaaactccagaaagacaatcagaagaacgaaatcctgagttgagtattagatgctattaagcaattattcaggaaagttggtaattttgttgtttgtgataataatattgtgcttgtgtctttttagagttcacatctataaaagttacatatggaaatatacacaggtaaagtaatatgtcatattgaatttgcttaaaatacttctctgtccaaaaaaaaaaaaaaaggaaatggcagggggtgatggatgaaagaagaaggaagaaggaagaatggagaatggcaacatgttaataattgatgaagatgggtgataagggctaaatttgagtctgaaaatattcataagatttagttaaaatagccattgcaacttaattattagctatgtgatattggacatgttttaaattttctgagctctgattttctcattaatgaaacagggataaaaatgtttttccttccatgatcgctttgaagattaattagtgtaataggcctgaataatgccaggctcctagtaagtacttaataatacaaaaatcccttgtagatgtcatggaatatccttaacactttgtttaaaccagtccttctaagtaagcagattccagctcagtgaaaaaaaaaaaacactgcagacagtgttccttttgaatccagatttaagcatggattcacgctttgtatccagaaacttggtgatatgattttgtatcccgtggatgttttttgaggacatggattctgtctcattctcacctgaattcctatataacagggtgctggctgtgtagtgaggctgtgtttgtcagctggctgactgaattagc

SEQ ID NO: 473218 - DNA, 794 bp, Homo sapiens
ctgtaggttccctggtctcatagtcaagatgagggtggacttagacccactattagactcaaaatactgcattttgcattgggggccagtttatctgctggtccagtgttctggggctgctcagatgtcacttggggctgctttagatcccgaatatttagggaaacatggctcaagccttcagtctcatggactatatgagcccagagctctccccacaattcctgtgaattctaaccttgggtcctcagggtcccatgtggacccctttgccaatgggatgcaaatttctgctggttcacagatttcctctaaaaattttactgaaagcttatcttctgccacttctgtgctttttgttggcttatttgtttcgttttttgtttttatttttttagtaaaaaataggcactataggcaggtcagctttccatattttccttttcccaattatgatgaatatagttttatttatttaattagctaagtatttttatgttggactttgcagcagcctcaagtattatttcagacttggcaggcagcatttcctgcacagatgcatttttcaaacgtaagatgtccataccattttgtcttgtttactcacttatcctaaacatattccagtgtttctccagagtcttcaataaatgtaattattaacacccataatctaccattctagctgcatttacaacaatcaaaacttttattttccctttaacatctataaatgcatttgcacaaaaagctgctcttagcctgtggttttaggtgagctgcctgggttg

SEQ ID NO: 473219 - DNA, 680 bp, Homo sapiens
gagttaactgcaacaggagagcagttcatgctaggaccaaagtatttgaaattggaaaacctcatcctcaagctgaaaagcctgaaacggtggcccaaagtgagaacgtatatccctggtttcccgctggaatgttaccttttcctaaaccacccagggccctgccccaccccatcctctgcctataaagaccccagattcagccagcagagaggagaagcagctggacattggggactacggctggatgttgtcgacttcagagggacagctcaaaggcaaccactttcttcggcaataaaatcccccacgtttaccatccttcaatttgttagtgtgacctcatttttcctggatgctggacaagagcttgggaaccatgagtgtggacacaaaaggctgtcacactggctcttttcctgctctggcaaagggcagccacctcacgcaaaaagggaaagggcccgctgaactgttgacacttaagcaacgctgggtctttagtcctgtagaatttgctacattctggatttggctggatttgttgtattgcatgaacatgtcctgttctttgtatttcctgcaaactggtggttagatctagaggcgtgatcagactcatgcttgattgatttattttgggcaagtatacccaagggtgttattgtgtacttcctgtt

SEQ ID NO: 473220 - DNA, 788 bp, Homo sapiens
gagtccatgtagcttcacgacgaactgcaggtcctgcagcagggagggctgggcaaccagagcttctcaagctgactcatgctcagctccattactctaggattcaaagacactgcccagtacctgttgatgttctgtgttgcaactgagagcacaatacagaaaagacccctgtctgtgccgcaagactgcatgttgtggtatgaagggcttcaatcattcaccattcattcaacagatgttttcgttagtgttgctagatgctggagacattatgtcgagcaaaacagatgtggccctggtgttccagtttggagaagacacagccaagaaaagaggccagtgcaattcaatgtgatgtgtgctgcaatagggcagatacagcgtattaggggagcacaaagagaggcatctgatccagctctggggagtcaggaaagacttctccaggaaagcggggatccatctgagacctgcaaaatgagcaggcattcaccagaagaaacgagaagcgtgtttaaggtagaacaaagagggaagcagtcaatgtttctgaagcatcatggaccaggtgtgtggtggagtcatgggagaaggatagagtgggcattatttaagcagatgctggctcatatcggctttgaaaaccttaggaaggagtgtagactttatctcaaaggtaataactttgtgatatcacccagatgttgtgggggagtggtctagagggaagcaaggctggggataaagaggctagttaggaggctgtgacaatggaggcaaaatgt

SEQ ID NO: 473221 - DNA, 504 bp, Homo sapiens
ttcaagcatatactttctgcctgtgtgcatgaaccatctctttagatgcctggtcgactctctatggtgtgtgactagtgctcgcctgcctccttgcctgggcttatgctgtaccacctgcctgaaatgctcctttcctctcctgtcccaaccaaatttcatctatctttcaagatccagcacctgcacagtgtttgggacatgcccgatagttgtcccctactggaagactgatggactaaatattgcaagaaggcacgaagacactaaaccagtggttctcaagcttgagtggcctaagacttccctgggggacttggtaaaagggtttcctgggatcagcccccagagatgctgcttcagcagtggttttccatctttgccaacattggaatcacctggggagcattacaaaaatctccaggctcggaccacacctcctgtcaattaaatcagaagctgtggacgtgggatccaggaacagtatttttgaaactgtgcagg

SEQ ID NO: 473222 - DNA, 689 bp, Homo sapiens
gaatttcccttatatcctatcctgagttctctctggtttctagcaatctccctgtccctgaaatattagttaaagggtatgagggctgagaggctctgtttctgctggtctcctagcctggcttcctcactgcctgtgactggccattctggtgacttcaagccttggagattaaagcccgtgttagtctttcagcacctgatgaaagcgcttaaccagatcatgaagtacattgggaaatcagcctccacagctggaggaagctctgaaagttgtccatgtgggtccgtggccgtgctgctggcagatgctttgatatacccaaaaaactgtgagtgcccaaaatgtgaaagggggatattctgcccccaaacatatacccttactgggaaacctgaaggtccagatcccagatcacaggagaaggatttgaccttacctggagctgagatgaatttagagagtcaagtgaaatacaggggtagaagcagcagcgagaagagccctgtgggcactttcattctccagggatgccatttctgactttgtctcacagggatcctttgggagggctgccagaggaactgggaaatgaccagagagaaggaaacttccagctgaactttgtaacaatttcaaccgagtgcaaagtttcctggacagaagttggggtcgggggtggttgaatc

SEQ ID NO: 473223 - DNA, 822 bp, Homo sapiens
tctgcatcagccaagccacagctctgctgtcatttttggtccacaatggccctgggctcactggcctctggtccacagggattgtgtttaacatccttgatcaccagtgaagcacagccaccaaccagtcagaatggttgtcatctgtgcacgaacaatgctggtgcatgccctgtgaacctcagccctgtgcctggaggatttccatccctgcttcagcaggcttctctagctctctgggtgtcattccatgttgcatctgtccttcttcctggaatatcagggagtaaggagaacacagacctgcattttagtccactcaaacacttcgaaaacactcgctcctcaagggaagtgacttttggggatttccacagcaagtgcttaataaggctttttttaaaaaaaacaaaaaccaaacaggccttgtttaatgcattaatattttaacagagcaagtctgggcctttcaagcaaatctagtcgctattcaacagtcaccttagcctttatgctaggtataaagagacagattttggattttgtatggaagatgggctttttgtgacagtaaaatgttttattttatttttacaaattataatacaataaaatcgactttttcttttggtgtataaaattttaacccatgtgtaaatttacgtaaccaccttcaggatacagatctatcactctaaaaaactcctgcatgctagttctttgtcttaaaaaatatatatactgatgtacatgtaaaatggaagctacaaggatatttgtaaaataaagtgtacattttatccatatgaaatcaagatagaa

SEQ ID NO: 473224 - DNA, 900 bp, Homo sapiens
ttttccttctgcttcctctacctctgtatttcactcagctctctaaattgactcagctccaggagaaattcaagatgcctgcagaaatttgcaagaagtttgctgaaggggtgaagaagtttgctgaaggggtgaggccctcatggagaacctctgctagggcagtgcagaagggaaatgtgggctcagagctcccacacagagtccctacctgggcaccacctagtggaactgtgagaaaagggccaccatcctccagactccagaatggtagatccactgacagcttgcaccatatacctggaaaacccacagacaatcaacaccagcccatgaaagcagctgggagagatgctgtaccctgcaaagccacaggagcagagctgcccaagaccatggaaacccacctcttgcatcagcatgacctggatgagagacatggattcaaaggagatcattttgaaactttaagatttgactgccctgctggatttcagacttgcatggggcctgtagccccttagtgttggccaatttcttccatttggaataggtgtatttacccaatgcctgtaccctactgtatctaggaagtaactagcttgttttgattttacaggctcataggtggaagaccttgccttgtctcagatgaggctttagactatggacttttgagttaatgctgaaatgagttaagactttgggggactatagggaaggcatgattggttttgaaatgtgaggacatgagatttgggaggggctggggtggaatgatatggtttggctgtgctgccacccaaatcttaccttgaattcccatgtgttgtgagagggaccccatgggaggattggtcccacgtgccttattcgcttcttttggtgagatcatgtttt

SEQ ID NO: 473225 - DNA, 479 bp, Homo sapiens
tcccggctgcttcagctccagccatggctaaaagggaccaatgtacaactcaggctgttgcttcagaaggtgcaagcccttggtggctcccacaaggtgttgggcctgtaggtgcacagaagtcaagaactgaaatttgggaaccttcacctagatttcagaggatatatggaaacatctggatgtccagagagaagtttgctgcaggggtggaaccctcatggagaacctctgttagggcagtgtggaagggaaatgtgggttcagagccccaacacagagctcccactggggcactgcctcgtagagcttgtgcatgtttgagcccatttgcccaactcctgaaattctatcggaaagctactgatcaccagcttcgggtattttctgtctattgggaggctgtcttttcgtggcgccagctgcaaccaattattttggagagacagtttaacaacaacctgaccataacctgatgg

SEQ ID NO: 473226 - DNA, 504 bp, Homo sapiens
acctaaaatggcatttattggcagaatattggtgcagaacagggatggccatgaccagcagactggctggattgcaggtggccccagcagggagactctcacagttggtgatgagagaagttcacactgtagattgaatgagagctcagaaaccttcacacctggagagtttggccaggccctgaaagacatcaagaagtctgcaaaggggacagaatccaggagagaatctgttaagaataaggagacctggagagtgcggaaagctcagaggcctaaagtggaggagtggggacaagaaaagaccatcagaggcaagcaggttgctggcagtgacagtggtgacattaacgtagagctggctgtggacacagcaggttctgggccctgattagggtgcccctcccaagctaaaagactaaggcatgaattaactgagaataaggtagtccccagtgtctaccgttgtcattatgtccatgtgtacccaatatttagttcctc

SEQ ID NO: 473227 - DNA, 550 bp, Homo sapiens
gcgtgaaattcatggacgtcacgagccggtccatcatccgcaatgtaaaaggccccgttgggttcttcaatgtaaaaggacgttgggttcgcccgcatggccgatgggaatggtgtaaagaatatccagctggtggctacagttccccctctggttttgctgccatgcatcctgggcgaactactggtaaagggccctctactcacactcagattgaccagcaacctccacggcttctcattgtgcacattgctctaccgtcctgggctgacatctgcaccaacctctgtgaggctctgcagaacttcttctctctagcctgcagcttgatgggccccagccgcatgtccctgttcagtttatacatggtacaagatcagcatgagtgcatcctcccttttgtgaatcatagtgaagagaaagacttccagaggttctatgcatctccttccttgaggtagccttgctgctaatatacgttatcaaatggatataagtcttatttaagatttccaaaagaggaaatttcataaatccattgctgaattat

SEQ ID NO: 473228 - DNA, 974 bp, Homo sapiens
ctgggtgttcattcatagccatccagggcgtctcagttggcttggaggacctggggcttataattgggcgccagggttgggggtggctgcttctgcggggcaccgcagccttggagaggtggctggtagttggagggcagcgagtaggcattctggtgggctttgcggaaggagggcgggggtcatggactgcagggcgtttctgaagtcggcgtggacggcttgctctgccagggagaggggccccccacaacgaggccatctccttggcccataatcctacttgtacttcatgcgccggttctggaaccaaatcttgatgtggtgctggctgtggtacagcaggttggccatctgtaggcgcgaggcccacgcaggcggcatggaagtggaactcgctgtccagccccacccactgcgcgctcctaggactccctgggactcgtgtcttcctcaccgccgctgccgccccctgttggatgcaaagggcagggtggtgggaactacatccctcccgcaccacttcgccccaccccaccccgattctggacaggttctgtaattgcttggcctgcctaagtgacactgtgccagtttatggcctcaggccttacgggaccagcggcttccacttcctgctctgggaatctggactctcggaacccaaatgccatactgcgaggaagcttcagcagccccagagacacatgtgggaaggagttagggtccctggtaaccagaacaaggaccgagttgtgggctttctgactctcagccagtgtttctttcactctattttgctggagctcagtggttccctggcaggtccagaaatccagaaactaggcctagagttgggaactgtagtaacctactcagttctctattctgctgtggctgagctgatacgcaagccacaagacaaagtccttcctcctcttccatatcattttcctatgtaggaggcatctttc

SEQ ID NO: 473229 - DNA, 515 bp, Homo sapiens
cacaggtaagcagctgacaaattctgccatgctttcaactggtcgtcagaaattttcagttgctcttgttttggtccaatatgttggtatttgcagggatgaagaaccaggaggccagctggttacagataagttccatattgactgggattccgtactcattgacatggataatgtcattgtagcaagatttgatggcagaggaagtggattccagggtctgaaaattttgcaggagattcatcgaagattaggttcagtagaagtaaaggaccaaataacagctgtgaaatttttgctgaaactgccttacattgactccaaaagattaagcatttttggaaaggtctacccagatgaaggtcataacgtatctgagaagagcaagtatcatctctacagcacaatcctcaaattcttcagtgattgtttgaaggaagaaatatctgtgctaccacaggaaccagaagaagatgaataatggactgtatttatacagaactgaagggaatatt

SEQ ID NO: 473230 - DNA, 628 bp, Homo sapiens
agctcctacagcgggctatatcatttgaggttgaggtaccactataccgccatggttccagataataggaactcttgctgtacttcttatcatttctaccatctgaccattttgttcacatcagctgaacatagtgtggccgtggcatgcatactgagagtggccactgttctatacaaattggcttatctgttaaccattttaaagtgtgaaaaagttccaaggtggaagaaccacaccccacacttgtcccactgttaccctgatgcttctgagctccccttcttactcaccacgggaattgctataagagtactcgggtgtcctccagctagttccaccctctccaactgttgctccagcaacccttcgacctggattcgagcccccacatatgggcgccgcttgccaagatcagctcagttggggagaccctaacccagccttgtgatttttaaaaaaacacaactgtgcagtttgaatatttaaaggtggtaactctggaaattagattctcctcattcccctgggtttgctggtgttaatttttgttaattttttagggctctacttgtctatttggtgacttttccaaactatttttacaaagattgtattccttatgctg

SEQ ID NO: 473231 - DNA, 813 bp, Homo sapiens
tgcaaccatacattttctctggcagggatgaaattggagctgaagaattacagaggcgatttgcatgtttctatatccttctgtcttgtgctcagaaagcctgtggttccaattaccagcttacagaaccatgtcagcggggaaagtttcccaaagggatacctttcattgccatcaaggagaggccaaagaagccatgggaaggggaaattatacctggaagctcaccgagagctctctaaccaggttaaatcaacagcacagaccgctgacatggcaggaagttcttgccagaatcagccagttgtaaatgacaaatggatccgggtctccaggcgtttggacgtgatgaagaagaaggcatatcatggaaacgtcctagacttggaactaggtgtgatagctagatatgactatgtcatcttcttggaaagagtttagtgcatttttttataagtagaatcacagaatctgggacagaaatgtactgacatgcagttcacaaactggcactggtttaaaataagcactgttgtatgtttctgaaattcataaatttcaaatatcttttattctgatattaagtcttttcacttttttggcattaaaactgcatttttaattgaatcctataagtggttttatgcttatatgtatcaagctacattagatagctctgcagtttacattatttaaagttttgctggtttgtgaaactccagaatctgcatattaccaaattaggtcaatatcttttactgattatgacggttaattttatgtgtcaagttggctgagctatggtcccagttg

SEQ ID NO: 473232 - DNA, 2403 bp, Homo sapiens
tggctccacatctcctttttgaagattttttaaatcaccattaagttgtggtggtttggatcgtgttcccacccaaatctcatgtcgaatggtaatccccaaagttggaggtggcgcctggtgggagatgatcagatgacaggggaaatttcacatgagtggtttcacaccatcccctttggtgctatttccactggtacctccctgtcttggaagggaagaagcaccttattactgctccccacatggcctagactttcttcacaagagggaaggcctcatcacccatgggcagtgctgaacgtccaggctttgcacttggcttctgatgacactacccagggaggagaggaaggaatgcctcattactgcagagtgagcaggaaagggagtccatgctccttacctggtctctacagacaccttggtgatggttgggtgagaaggggcttggggccttgtaattgcccggtagagttaaaagtcccagctcttttggggtcttctttgttatcccctgtcactctcctggtgtgggggttcaggcactttgatggagcctggaaagaatggaagtatcggttttccatgtagactttgctggattgagagaaatcccttcccttccttcccccctccctccctcccttcctcccttccttccttcttctctctctccctttcctttcccttcctttcctttcccttcccttccccttccccttccccttcccttccccttccccttcccctccccttcccttccccttccccttcccttccccttcccttccccttccccttcccttccccttcccttcccttccccttccccttcccttccccttccctttcccttccccttcttcccttcccttccccttccccttccccttccccttccccttcccttccctttccttcctttccttcagacaaggtctcaccctgtcacccagactttaactagttctgtttggataaacggaattctactaccccaaaacaagttgcaaacaacttttctcaattaatcacttgactgccctgtaaactgattcattatttttccacttttctgatctcagttagcaaccactctgccaacattgcaatgtcttttcttcctgaattcttctcattggatgtagtatatgttttgtccaatgactttcctgtatgttaaaaagtcacatggctaatcttctgtatatttatatttagttaaatatttaattaatttaatataataatttaatatttaatttatttaattattgttagtgttgaaatgacaatttgttacatacttgatacatttgtggtagagttttaggcactgaaaatacaaaattgagcaagatagacaagttccttgctcatatagacttcagcctagtagggaagactgatgaccaaatgattctataaattataatgaggaatccaataaagcttgctttgaagggagaaggaagagagtgtgagattcagcacatgttctaggctcttggtatattatataactccctttgtcctcctatttatcctgaaatatcatcttatgcctacttttccttcttgtaaccttttttttttcctttcaacccatggaaaaattttatagggtcagaatttagaattagaagggcactcagaaaccaggtgtcttcattttagagtagaaaaatacaaaaacaaaaccaagagtgaggtgacttgctcaagatcccacagctaacaaagagtagaactgtcttctagggtcttccactcatcagactccacctgtgcgttcttgtcctctgttgtctgagcactagtgtagcataatgtggacttaaaatttatttgatgcgtaccattcttcctcctcatcattagtttttcatcatgtgtacatccttcagttgaactagaagcttcctcagcacaagaacatactttttttccttctttttaatgtaccaatctacaggagagtttcttactcccctctggggttttgccagttttcaggaagatttagatttgctcctaggcaaatttcctcatctgtaaagcagagataataaaaaacttaaaatagtacttttttgtttttatttctgtaaacgagaccatacatgtaaagtttgttgtttaatgcctgatgttctgtaagtgatcgatgattatcaatgaaatctgttgctgtcatttaatcaatcctttgctcattcaaggtttatcttatgtaatgggaaccagttctttatgtcattttgtgattaaattccaacttattcttctttccagtcttctcagttgcaattaattatgtgtttcttattagttacacaagatttttcttgaacttatattaattcaaataattcatttttatctgtgttggatttccag

SEQ ID NO: 473233 - DNA, 838 bp, Homo sapiens
cagcaggaaaaacttcttgatattcactccactgaaaaatgtgggtgttccatcgaaaacaggggtccctggacatctgctagccggccctcgcttcctgtgagggctgcagggaggctccttctggctctcagcatccccagaaagggaaatctagagacacgcacacaggaaggatgccacgtaaacatgaagacagccatctacaagccacgaagagaggcctggaaccgatcggccctcacagcctcagaagaaacccctgccagtactttgactgtgttctttgcctccagaaccaggctgttgaaagaggattacccctgggtttggcagttcaaacgttgttgtgagcagtggaaagagttgagaatgatggtaaaaaccacagacaaaacattgagagtcaccgaggggtgggagtatggccttgcatgccttggggcagaacacctgtttttaacgtcttggctgaccactaactgggtcagggattttcagcactgtctgcatgtgagaaccacctgggaagctttagaaatcctcggtgcccgtgcagcgcccccaaaccaattaggtcagaatctatgtggtcgggaccctcgaagcagcatttgtaatccaaattcctcttatcatcctggctttggcactttccttcctggggttgaggccagaggcggaggcaagtccagggaatacgaagccgtggctgaggtcactgacgctaagcctggagaacctcataaggaaatcaatgggagcaacacccaggccgaggaaagaagacttaacaggagctggggagaaacatctgaaaacaaaacctgactcattt

SEQ ID NO: 473234 - DNA, 3794 bp, Homo sapiens
cagataggagttggtcaggtgatgaaagcagtttgagagaacgtctgtgctctttctacgtcaatgttaactttggggctgtggttaagatgtatatattttgtgtatgacctgcagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctatataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaatctatgctgtcatcctgggtacatattgatttgtctgaaaagtgctttctcagattccccttttaatattgtgatgtaaaggagggaaattttggtaaaggaagttgaaaggtgtgagctggcaggctaagtggaatttgtggtcagagtgctttcagagaaaggggagggctattgttttattttacatatcatttcctcattacaaatattaaagacattttgtaattcattctttttacacctggactttttatatactgataggtatatatgacttacgagtattttgtaaaatagcacctcctaccctaaaactgatggcaagtaaccctttgcttggctctgctcattgcaagacgagctttggttttgttcctgtgatagaccattagttaccccaaaatttattcttcctttcttccatggtaatgtaatatttagcttggtacatgggtgccaataattcctagtgcatttccaaggctcccttaacagctggaggtgggcgactggctagtttcttgccaatagtatgtgagcagaaggaatacctgaaatgtcaaggggatattatcactttcccctttaactcttcatatcggctgtattcagaggtgatagccatctaaggaccaagagatgaggatgacactaaaaggaattagcttgccttaggtaaatagcaagggaagggtccccagagagccctcggcccaccagtcagtgcctcaccccacataatgtaaaaagcagcctggggaaaaaatcaagctgcaggcactgataagggaactagcacagggtgttgtgcctggagacatgcctacggctgcacagataggagagcctctggcccattcagataaaagcttgcacaaacctctggctcactcagatgagggaacaagtcctggcataaaaacacctttgtcctttgtatagtcagcaggctcccaggaaaaagtttttttctccttttgtgggcgtgggcacagtgggctccagttagttccagtgggcactttccttgccagtttttggactgtgagtctggcctctgtgaatcataacttcagcccctgattggtcccaggcaaaggtcctaggccaggctttctgattggtcctgggccagggtgcctggccaagctgagtcatgccttctccaagacagccggtagactaagcacattcattcccctttccagcccgtaaaacccccacaactggcctcatagtgggcaccccattagagctcccccttctgctggcagagagctttcttttttcgcttattaaagtttcactccaacttcacccttgttgtctgcactccttaatcttcttggaattaggacaaagaactctggatattatctcagacaacgggagactgttacatcttggtgcattggtaagattacaacacattttggtgcattggctgggaagaagggaattcatcagaaggatgattaagagttgacctttaactttcacctttacttgcatttctgaggcttcttgtctattccagtctagtttgctttcacagagggcctagccatcatgtgggattggaaggtcccagggcaactgaaggtttctggctggggctaccccctcagtgttatctgaaggcccttggactaactccagtcccctacagcccatca

SEQ ID NO: 473235 - DNA, 3702 bp, Homo sapiens
cgcccgccggctcctgcgcgggccactgtcggggccgctgctcgggcggcgcggggtctgcgctggggccatggctccgccgcgccgcttcgtcctggagcttcccgactgcaccctggctcacttcgccctaggcgccgacgcccccggcgacgcagacgcccccgacccccgcctggcggcgctgctggggcccccggagcgcagctactcgctgtgcgtgcccgtgaccccggacgccggctgcggggcccgggtccgggcggcgcggctgcaccagcgcctgctgcaccagctgcgccgcggccccttccagcggtgccagctgctcaggctgctctgctactgcccgggcggccaggccggcggcgcacagcaaggcttcctgctgcgcgaccccctggatgaccctgacacccggcaagcgctgctcgagctgctgggcgcctgtcaggaggcaccacgcccgcacttgggcgagttcgaggccgacccgcgcggccagctgtggcagcgcctctgggaggtgcaagacggcaggcggctgcaggtgggctgcgcacaggtcgtgcccgtcccggagcccccgctgcacccggtggtgccagacttgcccagttccgtggtcttcccggaccgggaagccgcccgggccgttttggaggagtgtacctcctttattcctgaagcccgggcagtgcttgacctggtcgaccagtgcccaaaacagatccagaaaggaaagttccaggttgttgccatcgaaggactggatgccacgggtaaaaccacggtgacccagtcagtggcagattcacttaaggctgtcctcttaaagtcaccaccctcttgcattggccagtggaggaagatctttgatgatgaaccaactatcattagaagagctttttactctttgggcaattatattgtggcctccgaaatagctaaagaatctgccaaatctcctgtgattgtagacaggtactggcacagcacggccacctatgccatagccactgaggtgagtgggggtctccagcacctgcccccagcccatcaccctgtgtaccagtggccagaggacctgctcaaacctgaccttatcctgctgctcactgtgagtcctgaggagaggttgcagaggctgcagggccggggcatggagaagaccagggaagaagcagaacttgaggccaacagtgtgtttcgtcaaaaggtagaaatgtcctaccagcggatggagaatcctggctgccatgtggttgatgccagcccctccagagaaaaggtcctgcagacggtattaagcctaatccagaatagttttagtgaaccgtagttactctggccaggtgccacgtctaactagattagatgttgtttgaaacatctacatccaccatttgttatgcagtgttcccaaatttctgttctacaagcatgttgtgtggcagaaaactggagaccaggcatcttaattttacttcagccatcgtaccctcttctgactgatggacccgtcatcacaaaggtccctctcatcatgttccagtgagaggccagcgattgctttcttcctggcatagtaaacattttcttggaacatatgtttcacttaatcactaccaaatatctggaagacctgtcttactcagacagcaccaggtgtacagaagcagcagacaagatcttccagatcagcagggagaccccggagcctctgcttctcctacactggcatgctgatgagatcgtgacatgcccacattggcttcttccacatctggttgcactcgtcatgatgggctcgctgcatctccctcagtcccaaattctagagccaagtgttcctgcagaggctgtctatgtgtcctggctgcccaaggacactcctgcagagccatttttgggtaaggaacacttacaaagaaggcattgatcttgtgtctgaggctcagagcccttttgataggcttctgagtcatatataaagacattcaagccaagatgctccaactgcaaatataccaaccttctctgaattatattttgcttatttatatttcttttctttttttctaaagtatggctctgaatagaatgcacattttccattgaactggatgcatttcatttagccaatccagtaatttatttatattaatctatacataatatgtttcctcagcataggagctatgattcattaattaaaagtggagtcaaaacgctaaatgcaatgtttgttgtgtattttcattacacaaacttaatttgtcttgttaaataagtacagtggatcttggagtgggatttcttggtaaattatcttgcacttgaatgtctcatgattacatatgaaatcgctttgacatatctttagacagaaaaaagtagctgagtgagggggaaattatagagctgtgtgactttagggagtaggttgaaccaggtgattacctaaaattccttccagttcaaaggcagataaatctgtaaattattttatcctatctaccatttcttaagaagacattactccaaaataattaaatttaaggctttatcaggtctgcatatagaatcttaaattctaataaagtttcatgttaatgtcataggatttttaaaagagctataggtaatttctatataatatgtgtatattaaaatgtaattgatttcagttgaaagtattttaaagctgataaatagcattagggttctttgcaatgtggtatctagctgtattattggttttatttactttaaacattttgaaaagcttatactggcagcctagaaaaacaaacaattaatgtatctttatgtccctggcacatgaataaactttgctgtggtttactaatctatgctgtcatcctgggtacatattgatttgtctgaaaagtgctttctcagattccccttttaatattgtgatgtaaaggagggaaattttggtaaaggaagttgaaaggtgtgagctggcaggctaagtggaatttgtggtcagagtgctttcagagaaaggggagggctattgttttattttacatatcatttcctcattacaaatattaaagacattttgtaattcattctttttacacctggactttttatatactgataggtatatatgacttacgagtattttgtaaaatagcacctcctaccctaaaactgatggcaagtaaccctttgcttggctctgctcattgcaagacgagctttggttttgttcctgtgatagaccattagttaccccaaaatttattcttcctttcttccatggtaatgtaatatttagcttggtacatgggtgccaataattcctagtgcatttccaaggctcccttaacagctggaggtgggcgactggctagtttcttgccaatagtatgtgagcagaaggaatacctgaaatgtcaaggggatattatcactttcccctttaactcttcatatcggctgtattcagaggtgatagccatctaaggaccaagagatgaggatgacactaaaaggaattagcttgccttaggtaaatagcaagggaagggtccccagagagccctcggcccaccagtcagtgcctcaccccacataatgtaaaaagcagcctggggaaaaaatcaagctgcaggcactgataagggaactagcacagggtgttgtgcctggagacatgcctac

SEQ ID NO: 473236 - DNA, 488 bp, Homo sapiens
aggccaaagatactagcagtggaacgcgaggcttagggagtgagtactctgtaatctatggaaaagagatgtgatctgcgtccctcccatcctctgtccccactgggaggcttggggcaagcccttttaaatgcaaacacaagacagcagggaccaaacaacttgctggggcctgaacatgacgctggcagcctcactggctttgtccagaacttacactcaactggagaaggcagaaaggcaaataaaccctcagaaatcaatctaaaagtggaattttgtgctactttgaaaaacaggcaatggagctgtgactgtctagggaggaatgggaagacttcacagaagaggggtaaactgcctctgaaggagatcagggtgaaggcagaagcaggaaggcaggctggacaatgtagggagtttcaaatcactgggtggttcccacctgggccaagggtgcagccctgctggagaggtagatgagagac

SEQ ID NO: 473237 - DNA, 562 bp, Homo sapiens
acttaacaaacagctgccattagacttgctgaggtaaaagaaccagttcagtcacatggcccagtgtaggatcatgatcacgtggtcagaacatcagcgagaagctgaacaccatcaacttaaacttgatcatctgacggctccctctccatgggcagcgggtctccctaggctgccacctgtgggccagtgtggatttggaaaaggggagatatgggatgcagaaagggagtgggataataggagacagggattgcagggatttgctgagggtggtcctttagcaaaacccagagatgtgaaagtgaccttcaaagatgtgggagtcatctgtgctgaaggcccctgtgtggagccagctgcagcagatgcaaactccctgtccctggccctttccttgggccttcccttcccacttggcccatatcctgcctccctgcttcctcctcactgtgctttcacacaggactgtggggagggctatgcgtcagggctgcgtatacactgcagatgttcatcccaaacagaaccctaggaacagtcatgaacagatgctgtctat

SEQ ID NO: 473238 - DNA, 708 bp, Homo sapiens
gagtgacaccatcatgactggatgtttgaaaccgactcccataaaaagtaggctttgtaatcgagtctcagaaagtctgaggctgcctaggtctgccggatgctcccattcggtgaccttgatactaaacaggaaaggaaagggcagctccatttgcccgaaggcttttaacagagctgacaccattggtggaactgaatttgtcattttacctggtctagaaatgaaccctaaacaaaaatcttcaagtatcagtaagctgaggaggaagctactggggctgttgaagtgcttggtgtcgaaacatctacgttggagggtgacgccgccaggccatatcttcttctgtctctattggctctaccgaaccagatcaactcaaggtgcagcctcagttgggcactgtctccttgtggccatgttcctggggaaaggcatcttcttcagctgggacagttgtcactattcacatttggtagcaacactgagtgtctactgctgagtattgctatgccaaatttaaaattgagcattttcaccttggatgatgtaaattatatgcttttgaaaagtgccatctgaattgcatttctgtttaaatctatttatcccctcatatttgttacacttacaatcattcatgaaagtgttcaggattcttgcaaggttgtgtgtttgtcaaaatgatgaaactctgcctcgtatctg

SEQ ID NO: 473239 - DNA, 870 bp, Homo sapiens
tgatactgccttcgttcccaagcagcctttccagtaaccatgagcctgggccctactctcaagactctgaagcctctcagaatggtggttttggaaaatggaaggtacctggatctacgaatgactgtgtcaaaggtgacctgcttgccaatccacactgggcttagtatgagtaagaaagaaatgttggttgtggacatggatgaaactggaagccatcgttctcagcaaactaacacaggaacagaaaaccaaacactgcatgttcgtactcataagtgggagttgaacaatgaaaacacatggacacagggaggggaacaccacacactggagcctgttgtgggcttgatgtaccagtggtggggcctctaccttatgagtggggactgggtgaaggaagggagtccccaaccttatattccccatcacgtggagctgcaggaaagtagaaatgctggtttgctgcacctccaaggggttccttgattgggaactggggggaactggggggaacagggagattcattttcttggttacacccacccagagtggagcttccatcttgctgacctgatgagcgtggagggagcacatatgtgtttttgcacatagaattattttgtgtgtgtgcattttgatcagttctgaaaacatttttgcttatttgaagtatttgattcacttatattaaaataaactttgctgaattaatttaccagctctaggagctttttgtgtgagtctttagggttttctatgtatacaaccatgtcatcagcaaacagcaacagtttgatttcctctttaccaatttggatgccctttatttctttctcttgtctgattgctctggctagcgatatgga

SEQ ID NO: 473240 - DNA, 612 bp, Homo sapiens
tggagaggatcctttagatattgatgggttccaatcccctccatactgcgtgcgtgacttttgtttccctggatccacacctcattaaatacgtcatagctccttggaaggatatcaagatgcatcagacgccatgtcaaaggctcccagaatttgagacttacatctcaaaggctgtcacatcccctgtcctgcagatttcttatagagaacaatacctgccttataagactggttctgttacagacttcagctcatactttctcaattataacactaagaatcgtcctttggataataacgcttatatcaaacctagagactacatatctgataaagtccagatgcatctggaaaccatttggaattcacgggcaaatgaagtcctgaggttctgtgatgccaagcagagcagccacagatgctcttatctgcttgtggaaaagcagaattcacattccttctaagcccagagctacaaccctcccagtcaatcactgcctgacacaatgttcacgtagtgtgaaggacttatttcaactttattttgctcttaagttctgtgataatggtatacccctgccttttggtataactgtacaaaagaaaaac

SEQ ID NO: 473241 - DNA, 585 bp, Homo sapiens
ccggagctcctgcgtagaagaccggtattggttacacatggagtccagggctggaggtgaggatgaccctgtacaggaggtgagcagacaggacagtgctttttatgcctgtctaaggtctagagagcttgggctttaccatgagggcgaggggaagcaactgaaagtttgtaagcagagaatcagtaatttggaaaattgttctaaggataaatgggagcagaaggagcagtggagtagaatacctttaactgagtctcctcagaagattaaaattctgaccgaagcctggctgacatggaaaggttcacaagctttcccactactctgccacctgggattcccacattatgaagattcacattccaccatctcctaccctcaggaatgtttccttccctttctaacttcttctttaataatcgcttgtcctgtggccagttttctcggaactcactcagcaaatggtcaaggaatatgataaattgataggaagatctaatgagaagagtatcactttctcacatcataggtttacattttggtagaagcttttttgaagacagagatgtttagcaaatggtg

SEQ ID NO: 473242 - DNA, 739 bp, Homo sapiens
tgcaacttcctgacaagatagcatcatgtctttgcaccttgcagctctgagatggtctccttgtgctcctggccctccacccgcagcagcaggagtccactggtcgtcctatggcttcactcacagtaaaagcaaaaggcctgacatggcccggaagtctccattctatgcgcccatccgaaacacgtgctccgccccttcccgcctctcctcgcctctcctctttcactttgttatcgtcctgctctacttcagcctgagccgcgccttctatgcagccatatgtgctcatctagaacttgaattcagacccaattccaaagctcatgcttcttctatctttctgcactcaaatacatggaagattacagtgggcagatggacagagaagatgctacctgctttcatcatggaacatccaggagggagttggcgtgttgagaggacgtctactcctggccctggaatgagggtgctcacctatttgtcataacaaattcttgggctataacactctccttactgtgcccatgaggaagtgggcttagggctcttgaaggaaaatgtacatctgtgataatgtcttatttttatctctcacatttctgtcttttgtagaaagacatgctcaaggttgtctcaaagaaaattatgaagtgatttatgtttgtccctggggtccccagctgttcctttttgtgtgtctttcttcaaattacacatggctcgccatttcccc

SEQ ID NO: 473243 - DNA, 1619 bp, Homo sapiens
ctgctacctccaccgctacagtgaacagtgagactgtacctccaccgccgcagtgaacggtgacgctgtacctccaccgccgcagtgaacggtgacgctgtacctccaccgccgcagtgaacggtgacgctgtacctccaccgccgcagtgaacggtgacgctgtacctccacccccgcagtgaacggtgacgctgtacctccacccccgcagtgaacggtgacgctgtacctccaccgccgcagtgaacggtgacgctgtacctccaccgccgcagtgaacggtgacgctgtacctccaccgccgcagtgaacggtgacgctgtacctccaccgccgcagtgaacggtgacgctgtacctccaccgccgcagtgaacggtgacgctgtacctccaccgccgcagtgaacggtgacgctgtacctccacccccgcagtgaacggtgacgctgtacctccaccgccgcagtgaacggtgacgctgtacctccacccccgcagtgaacggtgacgctgtacctccacccccgcagtgaacggtgacgctgtacctccacccccgcagtgaacggtgacgctgtacctccacccccgcagtgaacggtgacgctgtacctccacccccgcagtgaacggtgacgctgtacctccacccccgcagtgaacggtgacgctgtacctccacccccgcagtgaacggtgacgctgtacctccacccccgcagtgaacggtgacgctgtacctccacccccgcagtgaacggtgacgctgtacctccaccgctgcagtgaacggtgacgctgtacttccactgctacagtgaatagggacactgtgcgccatctcagggcagaggaaaggggagaaccagtgaccttcttcctctctgagtgtctgtctctcattgccacccatgcagaagggactcccttaaacacaaggagaagttcctgatgctggatgacaaggcaatgacagatacccatctttaccttattgagctctttgcagtatgtgctagcttcgtaaaaacattttcttccttcttcccaaaatgtttcattcccttctctgttttaacgattccctctctgtttgggccatcttttgggtcctttgtcactgctcttctttacttattggcattcctcggggtccagtattttcttctggacttgtctcttgatagaaaagatagtatagagctatgcatgtacactgtagtcactgagtgccaggtgttgctccgactgctgcacacattcaaacatggccttgcagaatggagtaacacagtgttactgacatacagcgtgctcagagcacacagcaccaatgccctcactttgcacatgcaggcggacgctccaggaagtgaagccatgaacgcaggttcacacagagaacagcaggggtaggactggacttcattttaatttgtttttcacgacatctttgaccatggacaatgtgctggaaggggaagtgggaggaaattttactatcctggtgttgactctttttgaagaaacgacactcaggaaaagtttgaggcctgaaagcctgcaatgaaacatcaaatattacagaatatgaatacaaggatatggattgggga

SEQ ID NO: 473244 - DNA, 517 bp, Homo sapiens
ttaagtgaatagttttgtttgtgactgaatatcattttcggcttcaatgcctagtgctgacatgagtttctccggatggcttttctataaaaagctaccataccacacccagtgtcctcagtacaattcatcaagccctaactggttccttcaagctgcttgtagcactttcaaggagataatgcaacggtcaccacttcacaaaagaggaccaggcattctaggagttctgaattccagatcctgggcagagaagtgcaagaggaagcccacattctggggccagctggtcagtgcaggcagcaccttggcctttgaccaggacaggggcagtgttatgtccccgcagccttgcggaaggccttgggtctcctctgtgctccaacatcatctcggcctggaccctaccttcagagactcagcttcctcaactacaaaagggggttattaagaggaccaagtgaatttccatgtgtcttagtccattcaggctgttctaacaaaatatctattgacc

SEQ ID NO: 473245 - DNA, 2055 bp, Homo sapiens
tctggctgcctgactggcagcgtctgcatgcatattgcctgggagctcgttagaactagggcagggggtccttgctcccagagctcccaagacggcggtgggcgcttccaagatggtggcaagccttatgttctctgatccggggttcttggcctcacggatgccaaggaatggaatcttggtccatgcgatgagtgttacagctctattagaagccgtgggtcatggaagagaaccatggaacccagaacaatggcaagcctttagcgcgatcgggagcggcaatgggcgcctcgctggatcaggagaacagcggacaccctgctggatccggagggatggaagtcagcggggttctgcggtggtggcaaatagcagtggtggacgcatcccttcacaccgatcggcaagtggcctgggcacacacaagtcagctcaggattatttcggctcttgtgaaaaaggcaggaatgagctcaccattaactttgtttcattgtatcagcagcagttccgatgcagagcgttagaactggaagctctgtgacttcatccagccattgcctgggctagctgtgctgcctttctttcgaaaatcttttagtaacacaagaaaatcagatgattgtatttatttttcaggtgatttaattaattccatttaaagcttaaaagaagaggtcttggagaatttttggcagcgctactctcatccacatttcaaagggaaaaaaaagattatttcctattctagagtttaggcttggggggggccttttattttaacagccaaaacattgtcttactgaagaatgaaagaattttgctaccaccagtcacaagatgtggggacagttagttaatcaaaaaagctgattgcagtatggaaaacataaaaaagattacatacatgccataaacatttgtggtaacttaaactatatatcaatttcatggatgctaagacacacttaaaaaaaaatatatatatatatatatataaacatctctgaaattgacattgttttgtaatcacagacaaattcaagatgtggttgtcattgccagccttcgacctgttagttagctcttcctggtggcacaactggtcaactgcaactcctcaatgttttagcctccaaccattaaaggactctttgaggaaggaatatgagtcctgactgttgttggaaaacattcccttgacaccttccagcaagatcaagaacatgacagcattaaaacatgctgaatgggtttccaaggggctacagagaattcttagaaacaattgtggagtgctctttgaagaaatgctgcattgctatcaccctcgatggctcaggggaggatatcaagttgaaaggcctctgtgactccagaaggaaaatgatgtatggtagggttggggagaatttttcctccctctatgaattttccctcccctgctgaaatgagctgatgatagattaacaggaggaaaggtatccaaatttattcacatgtgtaggaatgggaatcataaaaactaggagactcaaagaaaggccaaacagctgaagcctaaatagcaccctcttcatagaggagtgggagatagggtaatggaggcgattttgactggtaataaatgatcttcagctcccagacagtggcctgagacaaaattcttctgagctctgggggaggtggtgacaaattatgggaaggtgaggggcaacacttcactgttaacaaaggttgtcttgttatggagagagtttcacaggtaatatctgggagctgccctcagaagaatagaggaaaagtctatctgggcctggcgatgacttttagtcttttctcttctctgctgtttcctggttatttgatgagattcctaggaacaggttttaagacaattgcatttcttctgaaagaagtttcctcagtcagataaggacattccagagagagcccctccttatgctagggaagaggggtgtggcaagaaacaagagaagtttagaaagtgtgtaacatatatgtatgtatgtatatatatgttacatactg

SEQ ID NO: 473246 - DNA, 5798 bp, Homo sapiens
gtagcccacacagccctctgggtgtctctcgggctaccgtgtttccacccttctctcagactctcacccctccagtagggaatacagtcaatacagagctttccatctgtaccccttccccacctccccacagccccccagcatgggggctccatagggcagagctccgaggtcttcctggcacacagtacatgctcaggggtgtcagctggaggcacactgagtgactgagggcactggactctgcccactagcttcactgggttcagtgagaatggaagcgtgttgtcgggtggaatatctgatgtggggaagagaaagctggggacccgggaaagccagcggtgtgatgcggtcggagtctgaaggcctgacagccaggggaaccgatggtgtaaatcccgttctgagggcaggagaagccttttattctattcagaccttcaagggactagacgaggccaattcacgttggaaagggcaatctattttaacagagtccgctgattcagatgctaacctcatctggaaacatccacagatatactcagaaacagtgtttcatctgggcaccccgtggcccactcccattgacccccacaagggccttggatattccagtgggttcctggccacaagggagttttccatcataggagaccatcaagcaagacaggaagatgcctccctcagggagggtgatgtgaatggcattgaatgggagcttgcaccagagcaatttgataactcacaccagaaggaaagctatggaaaaaccaatcccagatgtggagaaaatactggaaatgaagcccctagtccaacagtcttccaaaaactgaattctgccaacaactatgtgagcctggacacaatcctcccccagttgagccttcagatgagatcccagtcatagttgacacctgattgcagccttgtaagagaccctaaaacaaaagacccagctaagtggcattcgaactcctgacccacagaaactgtgagataataaatatgtactgttttaagtttgttgcagcaactggcttcacagcaatagataactaatacataaatgcctacgaatatgtgcccaaagacatgtataaaaatttccatagcaacattcttcataatgccaaaatagaaaacaattcaaaagtctgtgggcaataagatggataaataaatctgtggcataatggaacactataaagcaacaaggaaataaccaaccccagctacatgcagcaacatgggtgagtctcacagacaaataattgaatttaaaaagcttgacacaaaagagtacgtactgtgtgattcaatttacataaagttctaaaacagacaaaactaatctgtcaccctgttttaaattagaatggtggttacttttgcaggaaggtagtgacagggaaaggaaatagggaagctattgagatcctagtaagagtcctgtttcttaatctgggagctggttaccgggctattttgcccacttttgtgtaagtgtaggttaaaaaaacactactccaaattcttttctagaaggttgatcttttcagtgcaggatgtgaatagatgtgtggttaggggagtgctttatctttgtagacacagtgttatacatcaggagggctttgcaaaacactgatttcaattgcctcatttaacagaggagaaaactaagggtcagagaggtaaagtgagttgaggaagtcaagcttcccataattgtcagagctaaaactgcaaagcaggtctcttactttaatgtaactggtttggatgtgagggccatctggctgtggcctgtccttcatggttctctaggcttgagtccctttcttcactatcccatgaaatagctgttgatgttgcaaactcaattaaagaaggttactttcccagatagctcagtgcccaactcagtattgtgctttcaactagtcaataaccaacaagaaagagcttcctggtacccttgtttttttcgagcttccaccctgttctatttcacttgaaccctctttgctgttggcttccagtcctgcttcttgcaccatggccagtgacctttccctgatctatgcaccgtctacttctcacccagtacaactgaaacttgatacccttccctggcattgaacttggcaacccttcttggctttgactgggattcatccctcagtgtgtacttgctgccagcagctctgggttacaaccttgaatgagagaactgcaggcatcttgctgggtcggctgtggccctagaaaaagaggagagaaagaggggagagaaatattttttcagtcaaggatctataaatatccaatcttttctactgagacctccaaataagctcttacatttcattctacaataacatcaattggtgtagacagagatgagaggagaaaaaaatggtgaagacaataatttcaatatttgatctccttgacagtcacacaccttcttgtcaagaggtattgccactttggggagctgacttccagggggaaccctcttgttctgctgtccaggccacctgggctgccattcagacccctctcactgctctttcccaagattgctgagtggggtgagcatgccacccttgtgctggctttcagggacagggtttgcctgcactctcccccttctctgtgttcctaagctgaggcatcccaacggggccacatttctctctgcagggacccagcagtctctgccagtggccaatcacactttcttgtcatgaacttctccagagctgctctctgaagtaccgctgggcaaaaaaaaaaaaaaaaaaaaaaagcttttccccagatatcctccatttgtttttcttttgaggggaaggggcttcaatggcaggatttctctcccacccatccattccagtcgtgttctaggctggcaagggcagatccatcccttacccccggcaaaacgtgtctaactggatgactgtggctgctcagcagagctgcagctattctggcagctgcaggaaagctgggggagggaagctgccagaactcaggcctggagatgtacccccaagcgatggtcatgtgcatggaccagttttgaatacttcccacttaagccttggaaggagctaggaaggcgtggctaggtgggcagaggacaaaacacagcttctcttgtcttgggctacctgttgggtgttttcatatggttgggctatgagggaaacagggctttggtgcccatcatgctagctgtgggcacagtgggaagggttgcaaatgtatgattagttaatgtaaacttggattttgcagaaagcagccaaatctgtggaagggtggcagctgctgcattgaacacatgccccaggaaagccctaaacttgtggaatctgcatattttcctcacccctgcctagaagggcagcgcagagcagtcattacaggactttcctggaggcatcaggaagccagggatggtgatttgtttagatttgtctgagtagttgtgggttgccaaatcacacagacagctgcagtcagttgctttcttcttgctgttcaatccacgccatgcattttatcaaccacatttctgctccaccctggatgtcttgggaaatcatcataacttaatggaaaggcagagccttgaatctgctccctttctgcaacatcgctgcgtttattcaactgtatcattagctggaagataataaccaaccacagcatcatctttttccaactttggcatttgtttattgaatctttgtaaaagcacaatagactctatgtgccattctctccactcttccttccagaagtaatggtgatgacagtgaggaagagaaatccaattatgtagaaactgcgaatttggtgtgatggaaattctgtgggcagcctggttttatctgtgcagaattcctttagataaaagcaaaccactttttcccctgaatcaggttggttttggggtgagtttccagtttggcttaaattgaatcatagaatcttatcatgaagtgaaaacttggaaataatcttttactatctttcattgtatagatgaagaaactgaagtaaaaagagagctttacattcttaaagatccagatcaatggcagcaatctccaggtgtaccagtggaagcagaggctctcaccagaagcagatgttggtgccatgtttcttgtatagtctgtagaactgtgagccaaataagccttttctctttataaattccccagcctgaggtattcctttagagcaacacaaatggaccaaggcagtctgagaaagggggccaaattcattcttttgtatgtggatgtccttagtaccgtttgttgttgaaaagactgttctatccccattttattgtcttggtacccttgttgaaaattaattgaccatcaagtaaggtttatttctcaactttcaattctattccattgatttctatgtccttgtgccagtactgtattcttgattgctatagctttacagtaagtttgaaatttgaagtgtgagtcctccaaatttattcttctttttcaagattgttttggctattatgtctcttgtacttccatatgaattttacagtcagcttgtcagttcccctcaatcccccaaaaaagccagctgaaattttgctagggattgcattgtgcctataggttaattagggagtattgccattttaaactattaagtctttcaatctataaacatgagctgtctttccatttgtttacatctttactttctttcaacaatgttttgtagttttcagtgtataagtcttgtcctttttattcctaagtatttcaattttttgatgctaatgtaaatgaaattgttttcttaattttatttttggattgttcattgttactgtatagaactacaactgatatttatatattgaccttatgtcctacaactttgctgaactcctttattagtctcatttttgtgtgaattctttagtttttttctaaataagagatcatgtcatctgtggatggagagagttttacttcttcctttccaatctggatgctttatatttcttattcttacctaatttctctggctactccagtataatattgaatagtaatggtaagagtggaaaaccttgtcttgttcttagtctcaaagggaaagtaatcaatcttttatcattaaatgtgatgttaatttgttttttcatagatgccctttattctactacttgtttgctgagtgttttattgttaaataatattgaactaacactacatcaattaggctttggtacaataacagtgaattataggtaaaaggatggtaagctcagactctatttactaggtagtatttagagaaatccaaagataatagggggacagaatcaaagacaaaggaaatttatcctttgacgcctgcagttatagcaaacagtaaacacagccttgctcctagcataaacgaaaacctcacactaaaggcctgtttagtgctcagttccttttacccagtatgtcatgtctggctttcaacaaaaaaaattataaagcatgctaaaagacaaaaacacagcctgaaaagaaaaagttaagcatcagaaccaaacctaggctatattcttccctaagaaatcccattcacacagttatgtcaattacgcaaggactcttcatgacttcagcccagtcctggattctaagttccagatccgttaatatgcaactgcctcatggatgccccaaaggcaacttatttaacacatttgagactgaacttgc

SEQ ID NO: 473247 - DNA, 534 bp, Homo sapiens
gagctggagccagacctttcatcaccagcccactcaaccattggtggttactagaggttcgtttcaggccagtaatgagtaatgagattgaattcataatgaaaagtctctcccaaccaagaaaagcccaggactggatggcttcaccgccaaactctaccaaactaacaccaattctcctcaaactatttcaaaaaattgaagaggagggaattctccctagctcattttatgaggccagcattaccctgataccaaaaccagacaaagatgtaacaacaacaacaacaaaactacagaccaatatccctggtgaatatgatgcaaaaaccatcaacacaataccagcaaatcaaatccaacagcatatcaaaaagataacataccatgatcatgtgggacttatcccagagatacaaagatgggttaacatatgcaaatcaataaatgtgatatatcacatcaataggatgaaggccacaaaccatatgatcatctcaatagatgccccaaaaaatggataaaatttaacat

SEQ ID NO: 473248 - DNA, 686 bp, Homo sapiens
gctgagacctggagaggatgacttaaacagtctgaattttttcaggatgtaggagaaagggaggggcttgggaaatggatgggctgagcccaccctctgctcagtcacagggcagtgctttgaaaggtgttctttggccctgggtccctggacctggccctcaaaccccagagcaagggataggctcctgcagacttgccattggtggtcaaagagcactggaggtgcccattgagaatctgtccacagggcatcctgagagggggctgtctggggagtgtgtgaaccctgcatactacaccagaataagtttacaccatagggtgagaaaacgaggcactgaacatctttatgattccacgagaggaaaagaagagggaagaaaaggaatacaggaaggcactagcagggtttgcgcagttatcaggaattcagtgtacgtgagtcttaggtgcacgctgggcaaagctgcacacgattttgatgggtgggggctgctgagaggtgcagagataggggcgacgtctggacattagctgtgttgtgggttgaattgtgtctacacaaaagagaagctcaggttctaacctgcttggtgcctgtgcatgtgatcttatttggagataggggctttggaaatgtaaccaatttaaaatgagcttgtactagattaggagaggccccaa

SEQ ID NO: 473249 - DNA, 766 bp, Homo sapiens
tgactcttgtatgtcagagaaaaacaaagacccttggctcaaccctccttttcccacatttcctaagaaaaagtgggctatacctgttggttctatttccactcaacccactcacactatagcctcttgccccaggcttctgcccacaccactgatacttccaccagactctgcttcccgccttttgctccacatggattctctctgtgccgtctcctccattcctgccaattcaatgcccaagaaatacgccataagagcatgcttccactttaatgtttcagttggttcattttattggtctcagtcttctcgtctacttatgcccatcaggaagagtccaatcacaagtgcgcagatttctcttgttctcttctacaatgaacttctgcttcattcactgttactgaattttcctttgccggcattgcactattttattgtgctcactaagtcactggcggtgacattcaagttctgcagatttccagcaatgccacagtactgggcgttggctgaagctaatctagatagtaatccaaagagttcaatgaaaagttgagaatcagaacattagagtgccaaatctgacattaccttggacatgaaatctattaagcttggtaagctgacttgcatgttttccctcctgcacatattaaagggaattttagcatttatttcctacttctccagccaaaagaaaagaaggttgttttgtgcctaggcatctgcttagagtattgctctatatctcatttctcat

SEQ ID NO: 473250 - DNA, 1458 bp, Homo sapiens
tctacagctcccagcgtgagtgatgcagaagacaggtgatttctgcatttccaactgaggtaccgggttcatctcactggggagtgccggacagtgggtgcagaagagtgggtgcagcgcaccgtgagtgagccaaagcagggcgaggcattgcctcactcgggaagcacaaggggtcagggaattccctttcctagtcaaagaaaggggtcacagacggcacctggaaaatcgggtcactcccaccataatactacgctcttccaacaggcttaacaaacatcacaccaggagattatatcccgcacatggctcagagggtcctacgcccacggagccttgctcattgctagcacagcagtctgagatcaaactgcaaggtggcagtgaggctgggggaggggcacctgccattgctcaggcttgagtaggtaaacaaagcaccgggaagctcgaactcggtggagcccaccacagctcaaggaggcctgcctgcctctgtaggctccacctctgggggcagggcacagccaaacgaatgacagcaataacctctgcagacttaaatgtccctgtctgacagctttgaagagagtagtggttctcccagcacacagcttgagatctgagaacgggcagactgcctcctcaagtgggtccctgacccccgaatagcctaactgggaggcaccccccagtaggggtggactgacacctcacaagttcggatactcctctgagacaaaacttccagaggaacgatcagacaacagcatttgcggttcaccaatatccgctgttctgcagccactgctgctgatacccaggcaaacaggatctggagtggacctccagtaaactccaacagacctgcagctgagggtcctgactgttagaaggaaaactaacaaacagaaaggacatccacacaaaaacccatctgtatgtcaccatcatcaaagaccaaaggtagataaaaccacgaagatggggaaaaaacagagcagaaaaaccggaaactctaaaaatgagagcacctctcctcctccaacggaacgcagctcctcatcaacaacggaacaaagctggacagagaatgactttcacgagttgagagaagaaggcttcagaagatcaaactactccgaaataaccaatgcagagaagtccttaaaggacctgatggagctgaaaaccatggcacaagaactacgtgacgaatgcacaagcctcagtaaccgatgcaatcaactggaagaaaggatatcagcgatggaacatgaaatgagtgaaatgaagtgtgaagagaagtttacagaaaaaagaataaaaaaaaaacgaacaaagcctccaagaaatatgggactatgtgaaaagaccaaatctacgtctaattggtgtacctgaaagtgatggagagaatggaaccaagttggaaaacactctgcaggaaattat

SEQ ID NO: 473251 - DNA, 724 bp, Homo sapiens
aagcacgcagtcgcagcagccgcgggatccatgctggaatgcaggtcaggtacagcccactgggcctagtgggcagggcatctcctgtggcaaacccaggcctgagcaaggcctgggcaagggtgtcaccagctgggggtctccagctgataagtgaccaagaaaaatcctgtgtcagtaatacccagttctattatattcagcatgtgctttcaaaccatcatgaaagtcaatgcattctaacaagccaaaaggagaagggagctgggaagatgcatgtaggaggattttataggccaggcctggaagtagtgcatactacttcttctcacatttctctggctagaacacagttacgtgaccacaaaagggaaatggatttgactgtatgctcagtaggaggaggaaatggagaggcccaggagcccagaattctggttttagctagccacaccaccccacaagtggtccagaaatctatacacacagaggacaatggcgagaacattcatcctttgctagtagctgatgctttggccccaaaccataaggtagatctctaaccctagttagctctgctgcctgtcagaactcccctttgctagactgggaaggttgaagtgcttgctttcccttgaacgttactttagctttcacttagctttttaaaggaagtgggaagaggactacctctttcatcatggaaaaagggtacttcttacct

SEQ ID NO: 473252 - DNA, 627 bp, Homo sapiens
cagacctgcagaagacggacctgactgttagaaggaaaactaacaaacaggaagcaatagcatcaacagcaacaaaaagaatgaccactcaaaaaccctatctgaaggtcaccaacatcaaagaccaaagggaacaaaactggatggagaatgagtttgatgaattcacagaagtaggcttcagaaggtgggtaataacaaactcctccgagctaaaggagcattttctaacccaatgcaaggaagctaagaaacttgataaaagattacaggagtggctaactataatacccagtttagagaagaacataaatgacctgatggagctgaaaaacacagcacgagaacttcgtgaagcgtacacaagtatcaatagccgaattgatcaagaagaagaaaggatagcagagattgaagatcaaagtaatgaaataaagtgtgaagacaagattcgagaaaaaagaatgaaaaggaacaaacaaagcctccaagaaatatgggactatgtgaagagaccaaacctacatttgactgtgagaacaaagacaatgtaccagaatctctgagacacagctaaagcagtgtttagagggaaatttatagcactaaatgcccataggagaaagc

SEQ ID NO: 473253 - DNA, 618 bp, Homo sapiens
cagtcacgcagccgtgccccgccaccatcacagtctggcggtaaaccacccacagccacacttccggtcagccggttccgcaggcagccgtattacggtggagagcgctgctcagcaagtcggaagcccaggtttcagaccccaccgtggtcagccagcagccctccgacatcatgggtctgccctacagtctgttctatgttcaactcaccctcttagggtctactttgcttacattccacttttgtgccaaagcttccaatgtcttgccccagcctcttatacaaattccattcccctcacctgagtgctcggggtttacacatctggcccctgatgacctatcggcatttcatcctacggagtaccatgtcttctgctccaggcatccatcctccaaatcatctgaccccttcccattcccatgcttggaaagaagatttaagagcctcactaatgtttggtcaagcaaagaatttttgtcaagacacaatgcaaacccctcctcctcggtgaagcattccagaattgctggacatacaattgttgattctctgaatctctatagctccaatcctgttgtcagtttgggataaatgtcacttataggagattgtc

SEQ ID NO: 473254 - DNA, 554 bp, Homo sapiens
gtcaattgtttctgctaatgctctcagctgctaccttttcatctgacgaaggacccagccaagtgatgaaacatataagccagaattcactctatgcttcatcagacaaatgcttggctttccgggggccaacacaccttctactgactgacatgtttctaggttctttaccacgccctgccacggtacacattaggatgtttccctgggtaaatgccaaggttctccctggaggggaaaagaaactcttcaaacatgtcaaagtattccccattcaagaagagaaaataaataatgaaaaagagaactggattagggctgaagtccctcaactagagttagccaaacactgccttcaagttcaaggctctgcacttcaaaatgccaccagaaccagcagctttagactattctcagtctcaagcaaaatgtcctatcgtgtaaatttacctgccgttttatcagaatcatttcagaaacaattgctgttttcaaagaactaactttgttttagtattcttgcattcaaatgattttaggtaaagtgtttccaa

SEQ ID NO: 473255 - DNA, 515 bp, Homo sapiens
cacctgcagtgttagcaccttaagctgagttccttgcaccaggatgctgtcacgcccagtcagtgtgagacggttcttggctgaaggactgaaaagcttggccaagcattggcccagtaatggcatttcagaaatccaccaaaatattaagatgctttttgaaaaatatccagagcactcatggaaaaagagagctttacagagagacagcgagagctccagagacccgcagaagattgccctgacgtcactagctgagtaccgatcagtgcatacatgtaaggatattactcaatatgtggaaaagaacagaaggaatgatgtccaaagctcacccaaagacaggaatcatttatgtttccaccagccagagtggaacaaccttgtaacgcatatggagtactcaaacgaatatttcctcaataataagttcaaattaactgagactaaagcctgcccgctttgtctggacatgcctaacaaagctttgagggaagcctcaaaagaatgaaacc

SEQ ID NO: 473256 - DNA, 576 bp, Homo sapiens
attcacaacttatgactaaaaaaaagctgttattccattttatggaaagggcaactgagacacaaaatcacaggcaggaagtgatcaaaccaggggttgaatccagagcaatctgtctccaaagcatgtgttccttccgctgcagcccatggcctccaggcatcctgcccagcagccggagccacgcagatgtcgttggaggaggagatgaaatgctgtggatgttagggaaggaaaaatccatttctggatgtggagaatccagggatgcacccatccttgaggaccagctcaaatgctatgcccggcaggacagcttctctgatcccccaactgcacttgagcttctgaggaaacaccccagtttccccggactcactttgtgacacttagtggattctctatgggagtttgggacagttaaatttgtgcacaactttgctttctctctttatgactcaatttggcgaattcctcctgaaaagaggccagattcgatcaacttttgtatcccatccgtccacaacatccccctaatgtcatgcctcatactaagtaggtgctcaataaatgttt

SEQ ID NO: 473257 - DNA, 617 bp, Homo sapiens
cagcagatgtacaaagaagcatgatgcccagctctgtgctgagtcctgcccatgagtttcccgtaatgacctctgaatctcatcacttagacctgatcactgatgagaacatcagactgtgtctccagaagaatgtccggcagaaggagactgctcaatacatgttagctgtcctcttctcctgctcctctttgtatcatcatcatcatcatcatcatcatcatcatcatcatcatcatcatcgtcatcatcatcacctgcatttagagctgtccagtaatggagccaactcttcacaaagcagtagacttcatgtttctagaagaatgctcaacccaaatggtactggggacatagcagaagtgtcttctttggcgagcttaaaccaagtttctaaatttgtttccatggtagaattcgggaccttggatccacccactttctccccaagctggctccaggtttgtacaagcatctctcaccaagatcatcaaactaaaggctcagccaaaacatgcatctttttagtcctcaatcgcagggtctgtgattatttcattgctgagtctcctgcatccatctgatcatttctatttcctttgttcccacctttacct

SEQ ID NO: 473258 - DNA, 858 bp, Homo sapiens
ctacaaggtggcctgtagggtcccttcagcaaggttctgcaaggggcatttgccctcagagctgatggccctgcgtctgtcaatgcaggttgtacatctccctcccttaggtaggaaggtgctccttaggagcttggtgttgggcctgtccactgagaacattcatcttccacatttgggcaagactttgctgaaaacaattgctttccatactctgttggctacagccaggaacagttcaaattttttggtgctcagagtctttagcaggaagatgctcagtaaaggtcattttccttttcatcccaacctttctcacacttggccactctcttgttcaactcccccacccagtgcagacctggacactcccagagagaaggtcacacctcattgggaagctgttcttgagcagttccagcttcaagtcatccctgaatctaccgctcattcagcatataactgctcttcaaatatgctaagtacttttctctcattataaagttgacacatgcattgcagaaaatttgaaaaatatagaaaacataatttggaaagcatccccaataaatataacttgcagtgatgagcactgttagcattttggtatgtttcttcctatttgtgcttgtgtgggcaggcataggttttacaaaattggaatcacattgactgtagattttgtatacagcttgttcttttcactgacattctgacatttctcatatcattaaagtctttgaaaacatattaaatatttttaatggtcaccaaattttctgtggcatggatatattgcaatgtgtgtaaggtattcttagttttggatacctagactgtttctaatttttcaatatt

SEQ ID NO: 473259 - DNA, 698 bp, Homo sapiens
tgctgaggttaactctcagagctgccaggaaaaccaaaggagagagtggctatgagaacccatgttctccatgaagactggcaagggggttcctgctgcctggtggggtatgctaaatgccgattggctgctcgtgatggagaaaggtggagagtgctctcagtgcgcagcacagaggatctctcgattgactggacgcatgctcccaccttgtggcaagggcccccagagggtctggggtgaggttctgagacagtggactttggtgtgtggggcagatcatcacaattatgggctacaaagggagaaggagaagaaagcagattgcagagccctgggtatggatgagaaagagctggctgagtctggactcacttggctgcatgattgtatttatgacaatggagggaagacagctgcagaaagggcacagattggaagggcgtcagagagaggcccgcagaggcagactggtggctctggggcagaagtctccagtcaacacagttgcatagaaactcaaggctggatgctaggctcgcgtcttcttggcagctggccttatacgggcacactgtcacaggcaccaggctctgtgtggataaatcttcaatgctgttacggttgcacgcgacagcaaacccaacccaaaactgcttaagcaaagaggacatgtacaagctcaagtgacagaagag

SEQ ID NO: 473260 - DNA, 490 bp, Homo sapiens
gttaatgtaaccttctcaaggttcctgctgcagctctcctgctagtttagcttagccttctggtttgagggatgagtcacatgtaccatcacttcccaggaccaacaggacctttcaggaaagctatccctgcttacacagagaattgcccttgcctaacactgaagcctggcagaaaaatgttgactgaggaattactctgtgttaggcgctgttgtaggagcaagggatacaatgatgatcaaggcagatgcagcccttaccttcaggtcgtggagtccggatacagactggaggcaggcagctgtaagatgtgtgacaaatgctgcgctggatcagcccatggtattaggagagcaggtaagggagggtggggacgggagcggacaacctggaggaagaggcacctaagcagagtccggaaggctgaggaggagtcagcaggtgaaagagaggggaatcatgacatgccacctcaactgtagggcac

SEQ ID NO: 473261 - DNA, 1772 bp, Homo sapiens
aataggaacagctccggtctacagctcccagcgtgagcgacgcagaagacgggtaatttctgcatttccatctgacggttcatctcactagggagtgccagacagtgggcgcaggacagtgggtgcagcgcaccgtgcacgagctgaagcagggcgaggcattgcctcactcgggaagtgcaaggggtcagggagttccctttctgagtcaaagaaaggggtgacggacgcacctggaaaatcgggtcactcccacccaaatactgtgcttttcctgcgggcttaaaaaacggcgcaccacgagattatatcccgcacctggctcggagggtcctacgcccacggagtctcgctgattgctagcacagctgtctgagatcaaactgcaaggcggcagcgaggctgggggaggggcacccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccggcagactgcctcctcaagtgggtccctgacccccgtgcagcctaactgggaggcaccccccgcagcaggggcagactgacacctcacatggccgggtactccaacagacctgcagctgagggtcctgtctgttagaaggaaaactaacaaaaagaaaggacatccacaccaaaaacccttctgtacatcaccatcatcaaagaccaaaaaaactctacaagccagaagagagtgggggccaatattcaacattcttaaaagaattttcagctttccacagcgcgggggaaccggaggctgcaggatggtcaagctgacggcggagctgatcgagcaggcggcgcagtacaccaacgcagtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagggaacaacaacagaatatgccgtataggtgagggacttgatcaggctctgccctgtctgacagaactcattctcaccaataataggctcgtggaactgggtgatctggaccctctggcatctctcaaatcgctgacttacctaagtatcctaagaaatctggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagaaaggtgggccatcgccaggggatgtagaaacaatcaagaatgctatagcaaatgcttcaactctggctgaagtggagcggctgaaggggttgctgcagtctggtcagatccctggcagagaacgcaaatcggggcccactggtgatggtgaagaagagatggaagaagacacagtcacaaacgggtcctgagcagtgaggcagatgtatgataataggccctcttggaacaagtcttgcttttc

SEQ ID NO: 473262 - DNA, 774 bp, Homo sapiens
agggctcggcacacagcaggcgtctggtaagcggctgctgaaggagtgctcgctggctttacgttttttaatccccttagcccctaccttttcttaccatccaagcagcagtgagagttttgtacatgcactgcccttgcgaactcatctggtgtcaagtgtgtcaggtagtgttggatgggcacgagatcttctgggagccaggggagagagagacagcttggttatggacagagctctagagccacagctacacccgtcttgaatggagaggtacctgccggacactccaggaagcctgaaatacagggatgcctatgacccacagaaagccacaccaaccacgtgtccccttcccagtctacagagcaaatgtcaaagatctggccatttaaaagtgtatgaaaccgagacagccaagtgtaaaggggtccccagagaaactccaaatggcctgcgcactgggaggggtgcacactggggtggagcctcgggaagttggtgctgtttgcagccggaaggagcctggcccctcctcttcctgggattcagactgaacgtgggattcagtctgcgaggcgggaagcacactagcaggaagctgatgctggtgctgtgcttaatgtgcagcctgaagaaccatgagccaattaaacctcttttcttatacattatccagtcttaggtatttatttatagcaatgtgagaatgaactaatatacttctctattaagcttcattttcaggcaggctccctcaccccttctggagaa

SEQ ID NO: 473263 - DNA, 607 bp, Homo sapiens
ctcccagacacttctgagctgccatgggtgcccatttcacaggtagggaaaccaaggctcagatccagggagctgcatttatgtgcgcctccacccgtctttctccacaagccccaggagctcatgggcaacaatggggactatgggggagcccgtgccctgccttgccaaccctgccacaggcccacaggctccccctggggatgtggctgcccacctgcgaagctgtgtcctcatcactcaggtctgagctgtgcagagctggttccagtggctgcaggaaccacagtcgcagacctggaagaagcaaggatcctccccaagagtctgcagagggagcgcatttctgcccacaccttgattttggacttgtggcctccagaactttaacatcttctaccttcctatttattttcccctttttaatacaaacacatgcccattaaataagcaaaataggaaaaaattttaatcacccaaagccctaccatctacttaccagagagacaataatggcacaaggatatactgccaaattacactaacttttagtaatccaaagcaatagaaaaatctccagttttcaatttattcttcttagatttct

SEQ ID NO: 473264 - DNA, 2281 bp, Homo sapiens
ttaatcaaaggagactaagaaggagaggcggttgcagtaggaggaacactagaagagtgtggtggatggaagtcaagaaaagtaattccagaagggaatggcagcaagacttcatcattggcttttgcatcagagaatttgagaactgtttcattgagtgggccaggattaaggcccaacagaagtgggttgaagaggaaaagagaagttgcaacagctggtgtggacaacttattggaggcggttgctgtaaagaggagtggagaatagggaaggaggctagaggggttgaaggatattcttactgtgaaattcatactattttgggactcagactggctctcctttctcctcagcttgcagacagcctgttgtgggaccttgtgattgttcccttgctgaaaatgcttcagtggctctccatggcccttaaagtcaagtacaaagtctacaagcggaaaagtgatctgcaaagcccttcaggatctgaccccaggtcacttgtctagtcaagggatggctattttttgttgttttgcttttcagttcctcaaatattcaaagctttcttttgcctctgagcatttgttcctactgttccttctgcttctgtatctcttcatcttggtccgattagcccttactcatatccttccagtttcagtctaaatgtcactcgttccagaaaccactactgacccccccaagtctatgtcatgcaccctttcttcttggcatctgacacttcttggcatctgacacttggcgaaacttccctgttttgcagcttttacccactttgccatagctgcctgtttacttgtgtgtattctttcaaatactctgatttttccagagggcaggcagtgactcttcttcaatattgtattctcaacgcccggtggacaatgttggtactagacagtgttttgaacaaatgaataaatgaaggagagaagaaatgaattctcagtgatatttctgtaagataagcaaccgctattatttatattacacatttcaaataatcttttcaaaaacaagtataactcatctatggtaatggaaatcaaaatagtggttacctttggaggtactgatgaggaaaaggcacaagggaattttcaggggagcagaaaattatccgcatcttactctgggtgttggtttcataggcatgtgcagacataaaagttcaatgagctgcgtacctacaatttgtaccctttgttgcatacgttaacataaaataagtaaaaaaaaaagttataactacctttatctcactctaatactaaagatacattttaccatttgttagctcaaagaaatctgagatctggttttaaaagcaaccttgtagttctgtttaagattctacaatttaataaaattatctaaaacctccaagcacttagagtgggcccatgcagggccttttcttctacctttatagcccagagaaattccaaaccagaaaaggggctgggtttgatcttgtctgagcatcttgcgggaatcagtttcctttcaggccctccaataatgtgaaattctcttcctcctgtttttaaccccataagcaccaagcgaactgcacttccaaagcttgcctgaaatgagttttagcaaacccatgaaccctgttgatcaatagtcaccctaaactgaacccacttccaatagtgaccaaagaattcttctgaccaacaacggaattcccccattctcagactgacttcttcaaggagacttcaatgaactaagcagaattcttgtgcaatgaagccatcattccagcagatcagcatttagaattgcttcaagaacctattccatatttcaagagagatggagttagctttcctcttataaaatgaatttcatgtgtatgcttgcttatagaattcttgagttatctttatttatagttatttttactcctcatacaactgtggaatgatattggggctccagtgatgaggacatgcaggggttaccgggccccaggacaggaagcattctggcagtggctctgtcctcaaaatgatactgtgctgcagcggcttgggtcccagggactaaggagggacccagtggcctctctggagtaatgtagtcacagagactccaggcagctcccgcactgggctcaacactgcgaggctctcctacagctaggcttgcaggcatttgtggtgggaatgttgcctgcagggcatctcctgcttacatttcctactcaaggcggggcgcccttgactgtgagctgatcctgacc

SEQ ID NO: 473265 - DNA, 665 bp, Homo sapiens
cttcaggaaattgatatttggccagaaatttaaagattgctttttttttgtattagggagagagcagtgatgggagaaaaatttgcaaggtttatccacaggctcaagaattatccacacaacaatattgaaatcaagccaatttataaccctacaatggcctctaagcgttcaagtgaagaaagagttacacatctcccacttcaaatcaaaagctataaaggattaagcttggctatagctgccatagatagtgattcctctgatggatctgggcaaagtacattgaaaacctggaaaggttttaccattccagatgccattaagagcattcatgattcacgggaggagatcacattttcaacattaacagaagtttggaagaaatttattctaattttcatggatgactttgagggatccaaagcttcagtgaaggaagtcactgcagatatggtagaaatagttagggaactagaattagaagtggatcctgaagatggcaaaagaaaatcatgtggaacagcaaagggtgggaattctaccaggaatgaagatgagatgccactaagatgagagctaagatgagagccactgggtcatatctctgaaataggatacccatgatgtatataatttgatgatcacaagagatgaagacaata

SEQ ID NO: 473266 - DNA, 752 bp, Homo sapiens
aaaaccatagaggcatcagaaacaaacaaacaaacaaactacatgccaatatccctgatgaacattgatgcaaaaatcttcaacaaaatgctagcaaaccaagttcaacaacattttaaaaagatcattcatcacgaccaagtggtatttatcccagggatgcaaggatggttcaacatacacaaatcaatcaatgtgataccttgtatcaactgtatgaaagacaaaaacaatacaatcatttcaattgatgtgaaaaatgcatttgataaaactcaatatttctttacaattaaaaaactcagcaaactaggtatagaaggaacatacctcaatgtaataaaatccatatatgacagacccacagctagtatcatactcaatggggaaaaactgaaggaaacaaagtttaaggctaacaatggatatacatacctaggtgccgcctatacatgaacacacatgcttttgccaggtctattttttctaacttaaggtttttctgagggtcagcagaagataacctgaaaatttatgaacatgaatgagcccttttagaattgtatggctctaacatgttatttcctttcatttgcttctctttgataaaataaacccttagtttttcagccccctccatattcatctcaatgttgctagaaactagaatggtgttttgacatagcaaatactaaatactaaatattctaaatactgaatgtttaaatgaatgtatgtttatctcccattaa

SEQ ID NO: 473267 - DNA, 1136 bp, Homo sapiens
gggttataggagctgcgcctcttgtcttccgcactgtagccgagacacgcacgcggggtacctgcaatccgctgatggctgccgactgcaggctggtagttgagttcgtcagtctccctccaaccctgcatgtgtttaggactctgtgtttaggactctgtgtttaggcgtcccttgtaggaaccagggcggcaggctttcctcgggagcctggacgcctcaggtcatcatatagtgatgatgatggggggcccgccgatccagctgacgtgtggcccggactccccggtgagctgtgggtacatcccaggctagctgctgcaggaccgtcgcgccgctcaactccaaggagcaccgtttgctctggaatgtgtgagaatggcgccccctggtggcccgggagttgtgcaacgcggctgggcacgcagccagcgctcactgcaacttgtcactcgggtcacccttctccgaggccacctccacagctggccaccagaaggcacccttcacctttccggggcctccgtattcataagcgaattgatgactagggaaccgatttatgcatggtgggtggcgctgttgggtctcaagcttgcctttctctgcctagccccgggacctcctgaacccagtggagaggacccagcgctgaacatctcccagaagagatgggaacagctagtggctgaagggacatgcatcatattctcagtagcgcctttagaatttctaaaaaagaagaggctcaaaggcagcaatctggttatgttatgggtggagggtgtccaggttcttggcagtttgaacaaaggattggacaaaatgcacaaacaaagcaaggaaggaatgaagcaacaaaagcaaaaatttattgaaaacgagagtacactccacagggacaaaaatttaccacataagattatttctcatacaaaattattctcttttcttcttaatctttgttaccaaaaatacatctttacatctgtgactctctttacatctctttcacctatttactagtttctttttaccttctttcataaataggctttacataatctctgtattacatacaattctttttgtcaaaagaatataactttatgtcttccttatatttttttaaatgt

SEQ ID NO: 473268 - DNA, 1156 bp, Homo sapiens
ataaggagtggatgcctgtcaccaagctgggccgcttggtcaaggacatgaagatcaagtccctggaggagatctatctcttctccctgcccattaaggaatctgagatcattgatttcttcctgggggactctctcaaggatgaggttttgaagattatgccggtgcagaagcagacccgtgccggccagcgcaccaggttcaaggcgtttgttgctatcggagactacaatggccatgtcggtctgggtgttaagtgctccaaggaggtggccacagccatccgtggggccatcatcctggccaagctctccattgtccccgtgcgcagaggctactgggggaacaagatcggcaagccccacaccgtcccttgcaaggtgacaggccgctgcggctctgtgctggtgcgcctcatccctgcacccaggggcactggcatcgtctccgcacctgtgcccaagaagctgctcatgatggctggtatcgatgactgctacacctcagcccggggctgcactgccaccctgggcaacttcgccaaggccacctttgatgccatctctaagacctacagctacctgacccccgacctctggaaggagactgtatttaccaagtctccctatcaggaattcactgaccacctcatagcaaaatccagagatggtcaaatccctgctataaaatggcatagtatttgcatataacctatgcacatcctccagtacactttaaatcatctcgagattatttataatatcaatgtaaaggctatgcaaatagttgttaaacagtattgtttaggaaataatgacaaggaaaacaaagtctatacatgttcagtataaaagcttttttcccagatattttcaatccacaattaattgaattccctgatgtagaaaccctggatatgagaagccaactgtatatatacatatcctattggctctttctctctggagcactctaacatgccttccaaaacatttacaaagcaaatatgatcctgaaaacaaaatctactgtgaatattgttgcaaacttctaaataaaatactagtaaatttaatcaaaaaagtatattacaataacaaaacatggccaaataaggtttattccaaggatgcaataaaatttcaatactaggaaa

SEQ ID NO: 473269 - DNA, 1194 bp, Homo sapiens
gtttgttaatgggtacaaaaatacagatacataaaaagacaattacttttgcaccaacctaatacaatggcctgcagacaggtggggacctggtattttgtgtaagtctaaagactatgattgtcaggagcgaagctgcggactttcgcggtgagtgttacagctagctcttaaggcggcgcatctggagttgttcgttgctcccggtgggttcgtgttctcgctggcttcaggagtgaagctgcagaccttcgcgggccgcaggtggagctgcctgccagtcccatgccgtgcgcccgcactcctcagtccttgggtggtcgatgggactgggcgccgtggagcagggggcggtgctcgtcggggaggctggggccacacaggagcccacggaggtgggggaggcccaggcatggcgggctgcaggtcccgagccctgccctgcgggaaggcagctaaggcccagcgagaaattgagcacagcagctgctggcgcagggcccgccgagcccacgtccacccggaactcgcgctggcccgcaagcaccgcgcgcagccccggttcccccccgcgcctctccctccacacctccccgcaagctgagggagccagctccagccttggccagcccagaaaggggctcccacagtgcagcggcgggctgaagggctcctcaagtgccgccaaagtgggagcccaggcagaggaggcacggagagcgagcgagggctgtgaggactgccagcacgctgtcacctctcagagggaggagtgaatttaagagttaagagactgatgcaatagtccaagtaggactagtatagggaaagtgagaatggagggaagtaattggactcaagataaatgtgaaggtaatactaacaggccttgaagacggacagggtgtgggggaaaaggagtgatggtgaagaaggtgtggcggtgtcctttccctgagggaaggagcactaatggagaagcaagtctgatgggggtggggcatagaaaatgaatttgcttatggttaattgcttctgtgtactgtggaccatgagacagccaggtgaaaataatctagttggaaatgtaatcatggagttcaaaggtagttctacaggtcaggtgtgaatttaccaaatctcccaatttgtttatttgttttgttttgttttgtttttttagaggagggtctc

SEQ ID NO: 473270 - DNA, 1755 bp, Homo sapiens
tgcaagtcaggcccaggaggaggacgaggaggaaaataagtatgagctgcccccctgtgaggctctgcccctcagtctagcccctgcccaccttcctggcactgaggaggactccttgtacctggggaacagcagatgctgcctctaaaggccccaagttactgaggatgtccctgaagctctgactccagctgagatcaggcctgaggggaccctcttgggcattttccggtgcctgcaccaaatcaggaagctcctagtctgtgccccaagatcacgcctcatttggaggtcacacgaggcctggctggtgggtcctgccagggcactggatctggagagtggaggaagcactgggtgccggggtttgggctcggggccatgtacgcctcctcctaccccccacccccgcagctgtcccctagaagccacctttgcccacccccaccccaccccaccccaccccagctcaataatctgcttcttctagaaggaaggaaatcgtctcttccctctgtagcccccactgggagtgcctcagctgctgaggacagtgatctgctgactcagccttggtactcggggaactgtgaccgctatgctgttgagagtgccctgctccacttacaaaaggatggggcctataccgtgcgccccagctcagggcctcatggctcccagcccttcaccctggcagtgcttctccgaggccgggtcttcaacattcccatccggcggctggatggcggacgccactatgccctgggccgggagggcaggaaccgtgaggagctcttctcctccgtggcggccatggtccagcacttcatgtggcaccctctgccccttgtggacagacacagcggcagccgggaactcacctgcctgctcttccccaccaagccttgaggccacagcgaagaatgcaggtgtctgcccagttcactaggtcctggatgaaggaaccgtggtggcctagaccagtcaggggacagcacaggcactgctggaacagcaaaggatcctctcacatctacttgtgggcctagggcaccctgagagggactggcctaccttgcacaagttcacattcaataaacatttgttgaatgaattattgaatctgctaaatgaagcagagggagccttcaccactcccccagcctgggcccaggtacttaggccgtcgtctcttcactcccaggacagaccggctactactgcccactattggatattctgggcctggaatacagcaggtggcgtgtatttattgaaagagtgatcaaataggtcaagtctattctggattcctctaaagctgataacattcttttatcagggcctcctttgttaagtgaaaagtccaatccagtgctgtccaatagaactttctgtgatgatagaaacgttctgtatctgcatggtcgagtacagtagccaccagccactgggggtcattgagcacttggaatgtgactaatgtaactgagaaactgaattgttcattcacgatttaattacttttaaatagccacatatggccagggttccaagtctcatgccttcgcaagtgtgaggggcagtggggaaagctggagaggtcggcaggggctaggtctggaggagcctgggaggcctccataaggcactggggagccatggaggctctgagcaggggtggatgcaggagggatgatggtatcctaggagcatcactctcgttgtgtagtgctgaatgggccagaggggctg

SEQ ID NO: 473271 - DNA, 537 bp, Homo sapiens
ctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtgcttccccttctcccctgcaaaccttaaactttacctaacaaggcctggctgcctgcagtgtggcacctcaaggggccaccgccccgctggacctggctgtggcctatctgcgaagtgtgctggctgtcatc

SEQ ID NO: 473272 - DNA, 764 bp, Homo sapiens
aggaggtccagggtcagggtcagtgggcttcaggacctggcaaagccagagggcatgagagccagccttgcctacccactccgggctgggcccacagctgccacgaccctttgtccccaagggtgacaggagagcttgcaccagcccagatgcttccttctccaaagacatggacggagggtctcaggcttataccagccaggattattccagtgggattccagctctcctcctagccatgtccttcccgcaaaagtttgaagcgggtctggctgggtggcagtgtccggcagccatcctcggacttcttccccgcagcatggccaagggcaagggagagggaagggacgcaggccagggcatgacatacagtggcccaactgagtaccgaatatggacctgtttctctgcttttatgttgttgtctccagaacattcagggatcctcattcaagcagttgacaatttcatggagttcctcaaggcctttgtaactgacaccaggtgtcagcctcatcgtcatgatcaaacatgcccacccccaaacacaacagtctatttcaagcagcagggtagaggaagggcactgtaccccactttatggcccagcgcaggagctgacacaccccttcccctgcctctcaatggccagaatacactccccatagctgcccccaactgcaggggagactgggaaatgcagccttggttttgagcatccacgtgtccagaataaaaatctcaatgcaaaaggagacaataga

SEQ ID NO: 473273 - DNA, 866 bp, Homo sapiens
agagcatgtcataaggtgaaatggctggtggctccagctggaaacgggtgaccagccatccaaaggggtatggaatcttccagtgacaacatccctcgatcccagggtcacctcaaatggttaattcagtgggcgatgtttttaatgaagggcatagggtgtcgtctgcattgtaccatccaaaggtggagctgctcaaggtcacacacctggtacgtgacaaggtgaagatccctctgggcttgcctgttgccaactctggggccctggcatttggccagcgggagaggcagcatgttgaggagaaagagcctgtctggaagcctgtagcccggcttggagccctgctctacctccaccctgcatggctgatcattcctatccaatcccttcgcctcctcctgccccatgggatctcggtgaccttctcctctatttggggggaagttggcacggggcttaggatcagtatgagtggatcctttggtattcagccaagatgtgattttcccagacacagcttggcctctttaaggacaaaattcagtcctgctagagacttctcacacaacctcaccagccacgggcaccccagtcttcagctacacccaagtctgggatgcaagggggccttagcagctggctgacccaggatgcccaaggtcaccattccctagactctaggcatcatgccacatgctgcacatgctgcgtctttgagtccttgcagccgtgtgaggcacggtatcattactcccgttttacagaggaagctactgaagctcagagagtacctgagcagccctggagaaggagtgtcacttttcctccatctctgccactgactggctggatgcacaggagga

SEQ ID NO: 473274 - DNA, 1024 bp, Homo sapiens
tcaggggcttatagataaaagtcccatctccctgggacagagcatctggagcatctggggcagctgtgggcgcagcttcagcagacttaaacgttcctgcctgctggcggatctcccagtggatctgcctgctgggggatctcccagctggagctctgctaagggacagactgcctcctcaagtgggtccctgacccccatgcctcctgatggggagtcacctcccaacagggttgacagacacctcatacaggagagctccagctggcatctggcagatgcccctctggtacaaagcttccagaggagggagcaagcagcagtctttgctgttttgcagcctccactggtgatgcccaggaaaacagggtctggagtggacccccagcaaactccagcagacttgcagcagaggggcctgactgttagaaggaaaactaacaaacagaaagcaatagcatctacatcaacaaaaagggtgaccacagaaaaactccatccaaagaagggggttaattcaaactcctccaagctaaaggagcatgttctaacccaatgcaaggaagctaagaactttgataaagggttagaggaattgcttactagaataaccagtttagagaagaacataaatgacccgatggaggtgaaaaacacagcacgagaacttcatgaagcataccaagtatcaatagctgaattgatcaagcagaagaaaggttatcagagattgaagatcaccttaatgaaagaaagtgtgaagataagattagagaataaaggaatgaaaaggaatgaacaaagcctccaagaaatatgggactatgtgaaaagaccaaacctatgtttgattggtgtacctgacactgacagggagaatggaatcaagttggaaaacacacttcaggatattatccagaacttccccaacctagcaagacagggcagcattcaaattcaggaaatacagagaacaccacagagatactcctcgagaagagcaacccaagacacataatcatca

SEQ ID NO: 473275 - DNA, 682 bp, Homo sapiens
agcctagccctcatgtctgcgtgtggcagctgccactgccttaatacttttggaggccctccaaatcacaaaccttccatcaagcctaatcaccactcaccagcaaaggcaggctatgctatagtatcttccacatctatcattgaggctactgctctgcccccctccactacctctcagcaagtcaaactcattgccttaattcgggtcctcactcttgtaaagggactactcatcaatatttatgctgaccccatatcctgcaccaccatgctgctttatgagctgaaagttttcctcactacacaagggtcctccatcattaatgcctctttaataaaaactcttctcaaggctgctttacttccaaagacagctagaattattcactgcaaaggccatcaaaaggcatcagatcccatcactcaggacaatgcttatgctcataaggtagctaaaaaagcagctagcgttccaacttctatccctcacggcagtttttctcctcatctagtcactcccacctactccccaactgaaacttccacctatcaatctcttcccacacaaagcaaatggaggccctaacttactcactgctaaaaaaaaaaaaaaaaaaaaaaaaaggtaggggggactctgtatatttttaaatgaagaaggttgtttttacctaaatcaa

SEQ ID NO: 473276 - DNA, 2282 bp, Homo sapiens
agacatcacaactccttaggctcctcctgattatgacagtttcacaaactttccttgtttttgatgaccctgacaatttcaaggagtactggcaggaagcagagggggactggagattggagatcagagcagagggtggaactgaggaagagactggtaccaaaagggcccagcagggccaggtgtcctcggataagacaagcccagcaggtctaacaggtggaaacaaaacaaaatgtcgactaaaagtatgtggagtaagctcagcagctgtcaacactggattcaacagaatcacctggtttcttcatgtatgcatcaaagcctttgctgtccgccaggcgccatcttccttccagctgctgaacggtggccccatggtgcgcgcaggctggtgtgcggagcgtgcggaaccagcggagcgggatcggcgtgagcagcgtactggtaaaaatgaaagggttattttgatttacaagcagcaactgagcttggctctccccttcaagatatccttgcacaatgaaaaaaacaaatgttattttgctctataaacattatatttgaaatttttcttcacatgtcttttaaatcatctgtttggcctaaggcttcttgctacccctggctttggaatccctccaaacctggcctcactttatatgggttgtggaggatgccgattatttgaaattctctgttgaaatcagatttcttgcctccagccatatgtatataggggaaattaggctgcctgcttttcctaaagttgtgtcaaggtaatagcttatgctgtctcatcaaacactgggcagggcttagatgacatgtcaaccattttgaattttgcattaacaatctctgaatgaaataaaaactctaaattatattcagtttagggaattggatcctaggtgtaaagttagaaaattggagatggtttgttatttggatgagtttggttttgcagttagctgatgcttcgttttgtctatcaatctgtctatggctttttccaatcacctttttgaagtgtactttttaggcaataataggtatattttaaagtatagagttcattgagttttgtatgtatttaggtaaccacagccctaagcaagatataggacatttccatcccctccaactgttcctcatgccactctcaaagtgacaaggaagaacgcccatcagagactgtcattcttaggagaaaacatatcctttaaacccagttgtaacagtgtggcttccctttaacaaaagcaacgttcactgtaatgactttattataagtagacacacgcaggcagtcaatgagctcttgcaatgactggcagctcaaagaggaggaggggaagagccagtggaggtgggtggatggatggtgggcagcagtttattataaccacaatcagctcaggatgctggtattggcctcagagggacctggtttcctgtggtgttagcaaaagggataaattatagtcgacatctgcaatgaaggacggcaagatgacctggaggggaaaatgtcagatgtggtagaggtcagagagcctggttattcaacaaatgcaggtttgaagcagagatcaaaggcagctgccagagagtaaaatggtgttagaggtatgtgctcagtaataagtatatgggtgtacctaatactggtcacggtattgagccgtcaataaatcaaacaattctgcctgggcaaggcagagataggacttcatggtggtggatgtagtggatgacaggatgaaacaaaggcaaggaagctgctgattgcaattaaacagggtttatttttgatgagggagctggttgtgtctgtgagtgagctggtgagcaccgagcctggttagcatcattggttacgagggtagatgaggctcgtaagccttagcgcaaccttttgggaccagctgcagccaaatcccaaatctcagggtgctcttgccacaaagaaaaaattggtaactatgtgcgataatggacatgttaatttgcttggctatagtaacttttcactgtccatatgtacagttatgtgctgcgtaacgatgtttcagaacatatccctgttgttagtgacacataacgttgtatatatcaaaacatcatattatacaccttaaatatataaaataaaataaaactttcattttaccctgtttcttggggtctggaacgctattgttttattgagaattcaaaatatttatgccagactgtagtagtctatgtcctaaatggtggactgattgatgttcagt

SEQ ID NO: 473277 - DNA, 2255 bp, Homo sapiens
agctgaatctcctgaaggcatgtgttcagttgagaaactgtctgctgtggcagcagcccccataaggaccatgacgacagtttcactgcaaaatagcacccctttgacccggacatgtttcaggaaatggctggtcacagaaaacgctctgcccctaacactgaacgatctttcctcctttgaaatgaaagaagctgactcccataacatggaagtgcaaggcgggggagcaagtgctgttatagaagctgcagcaagttatccagaagatctagctaagatcattgatgaaggagtttggaagaagttgatttcaactttcatggatgactttgagaggtttaagacctcagtagaagtaactgcagatgtggtggaaggaacaagagaaatagaattagaagtagagcctgaagatggaattgaattgctgcaatctcatgataaaacttcaactaatgaggagtttcttcttatttatgagcaacgaaagtggtttcttcagttggaatctattcctggtgaagttgctgagaacattgttgaaatggcaacaaaggatttagaatattaccaacactttgttgataaagcagtggcagagtttcttttgaaagaaattatattgtgggaaaaatgctatcaaacagcattgcatgctaaagagaaatcctttgtgaaaggaataattgctggattgctgacaggtgcatgtggagctagagcagtcacctccatctggcacagacatgggtggttactgagatatttagcatggagagagagatttggagacacagattcccagggaggagtaccatgtgactacaggggcagagactggagcaatacagctgcaagcggaggaatgtcaagaattgccagcaaccaccagaagctaggaagaaaaaggaagactcctctctggggccctcagaaggaacatgatggccaataccttaattctggacatctggcttccaggactcagtgcaagaatggactaatacagaaggctttcacaggaaagtttaggagaagagtaggggactcctcataccagaggtatgaggttcttttcactagagagtacaatacagaagatatcaatgctagtaattctaccaggaacaagactgtatctcatgtttactttgcatccccacagtttctaatatcttgttctgcatggggtggatgctccgcaaataccgattgactaatgaattaattctatgacatagccatgcttatcatgatacctcaaatggaccacacaatcaattccagaattataaggtttctgtgtaaataccaattatcactaatttattcccaaactgtcagccagacatgtaaacattctctcaagtacaaccagtacatgtgaaaataatgtgacctatctacgtcccttttgttgggaggagcctagactacaagagaatgctgacgcatggctctctaggtatatcctctgtgtgtcctaggagtatacaaaggcctaccaagtggtttggaggatgctgttcaaattattaatggctacaaattcccacatgttgcgggagagacccagggggaggtaattgaatcatgagggccactcttacccatgctattcttgtgacagtgaataagtctcatgagatatgatgggcatatcagagatttccacttttgctccttcctcattttctcttgctgccgccattctcaggtatgtctttatcagcagcataaaatggactgatataatctcttaaggtggaatggaataattagtaaagtgaagaaaacaatttgcaagctttgtagctttctgcgtctttagtcagagtacgctgtttacctggttggctgcctctcttatttggtcccttggtggcagggtaagagggaattaaactttgctcattttggtagaactttttaaactttcagatacaagctgaaaactggtctcctattttatagaaacatagatattacattttgctttcaaggagaataagtctgtagacagatcttatatagttgggcacaggagctattacaaaatatgagaacactattgtgactgtttcctctaatggtctcttagccttgctttgttcctgaattttcatcatggtcttaattactggcatggaccaagttattgtctccccttactctccattcataggttgacatccaaactgtcaatgtgatggtatttagagatgggttaccctttgggggtaactaggttt

SEQ ID NO: 473278 - DNA, 934 bp, Homo sapiens
caggccatctggatgtatatctgtagagagaacggcagcaagtggaatggaaatgtcacttcagccccgaagcttcgtaaatatcaggaaagaagacagtaccaatctcccagcccacagctcacaaagccactctctcttccagcaggtattaaacattaatgaccatttctataataaggggcgagaatggctctttgctatagagctgcccaatcatttgagttgtgttagattttcaacagcagcacgtttcacaattttttcctcttccttttatcactgtgagaatcttcagcgtgaagagaaccctcctcaagcacttcttggagtaaacataggtggtaacacaagtccaaaaacgagctttgcccttactaattgccatggaagtccacttggacactttgttccatccaagcccaacagagccatggggtctaagctggcatttgcttctgttgccagagctgttgtgttgatgcttttggagctgcatggtcggtgtgcagcctcaggaatccagtgagattccagggaagggaagaaaaggaggaaggacaaggaagtcatcatttgtttctggtccatttgatactggcaaagaaatgtgtcccctctgaataacagatgtccaagagtgtttaggctgatgggaagatgaacagatagcagagtcacgccttgtgaaactcaggcatggaatatgattgtgccttagtcacaagtcacaaggagactgaagccaatctaataaaaggtatggagaggttgtacaacattattaatgtaagtaatgccactgaattgtacatttaaaaatggttaaaatgacagattttgttatatatattttaaatttaattaatttttaaacattttaaagattaataatgtaacatacccaaagccattgcattatatacttcaaatc

SEQ ID NO: 473279 - DNA, 1002 bp, Homo sapiens
agctcaggtctgatttacagtgggtccagtgggcccttggactcttcttttggtcatttccctagtgccagaatgcataataggcatagacatattaagtggctggcagaatccctgcactggctccctgactgtgccaccatcaaggacttgaaagatgcagaggtggtaattcccaccacatccccattcaactctcccatgtggtctgtgcagaaaacagatggatcttggagaatgacagtggattattgtaagcttaaccaagtggtgactccaattgcagctgctgtaccagatgtggtttcattgcttgaacaaattaacatatttcctagtaccaaatatgcagccattgacttggcaaatgcctatttctccattcctgtccataaggcccaccagaagcaatttgccttcagctggaaaggccagcaatatacctttactgtcctacctcagggatataccaactctcccgctttgtgtcataatattatttagagaggtcttcatcacttttcgcttccacaagatattacactggtcccttacattgatgacattattttgattggatccagtaaactcgtgtcatgggagtttgttgcacagattatttcctcacccagtttgagacttaatatttgcaataacgatattttttgaaatcaaaagcacaatgagatacttaagatataaaggacaaaataaattttgtgattgacacaagatcacttttggggtgccaggatattttacaagaccgccaatagtcctgttgcctatccaggctaccatttctttctgttctggatcacaggaaagattgtggccaacttgtggattccacagccattaatagtactgtttggaacactactcagtaggtcagggactcttcctccaataagattttcatgcttggctgaaaaagagtgaaagccgttagtgcacttgacctttcccagggagagttggaaatcatgaaggacagattcc

SEQ ID NO: 473280 - DNA, 816 bp, Homo sapiens
agggtcctgtgggccttccttcgcaatgtcaccaaatggggatatgctgcctggttcatgtgtgaaggagcgcatagattacctgaaattgggtgcttggggaaagaaagctgggagacacatcggactcacagagagcttggagtttagggatctcttagcagtccttgcactgaactgtgccttcacattaagcaagatacttattctggcttcgcttcagtacctccaaggggaaaagagatacaaagatggcctcttgtggagaacaaaaacatctattcagagtaacaactgtttttggtatgcacagaatttaaggtgcttaagaagatgggaagccctacaacattatgccgttggtctaaaagcaccagatgaaatcaggtcctttctcatgttgaaccgaatctgggctcctcttctcaatggtcctggttctctgttctaaagatggatttctaataatgcatctgtgctccctcttctaggtaacagcctccgaacaggtaaacgcagattgtacatttctcttcagtcttctctaaattaagcagaattgaccttcaaatattccttaaagcacacagtttccttttgaggcttataaatttgacattgctcatcttaaagcctgctcccaaatgattgtgaccttgtaactaaggtttgaccatcatgaacagtgattgtcactctatatctgtggatctaattcaaaatggaaaatttcttggaagtcttatattttaccacattagtctatgtatctgtatttttaatttaaaattaatatttaaaattacctagtgtatt

SEQ ID NO: 473281 - DNA, 1961 bp, Homo sapiens
agtaggctttggactgcctcacccagaagccagagaatatgagaagctggccatggaagaattctgccatcaaagcatttcctgcattgatcaagtggttggaccccagagctgccgtggccaaggcctggcttcggttcgtgttgactctgcgtggtcctgcagccacagtccacgcttacttctgccaggggtccactgggtcagaaagtaccccagagacaaagtatcccttgagagaaagaggcgcagatttttctcctccttctgaaaggaaacgctcggccaccgctttaataaccatttgttgccacctgctggccactggaccaaggcactccatgctggaaacaggagtttggctaagagttagccaggccccagggagctgcacccaaatgcagacagcctgtgttttctccaaagaagtgaccttgggaggatccacaattattccattcattaagccacacaagaaggtggattttataaaagagatatacttcattcatgcattaattagtcaactgcaaacacttttggagctacatgcagcctggtgtccccaaagcagccagagtcgacctttgacagcatatgtcagatggtgtcacccttcggctcaaaatgctgcagaggctcctcatctcacagagaatgaaagtcgaggatgcgtgttgcgtcccccttccctgggctgctccctgacctcatctcctagcagtttccccatctctcgccctgctccagcctgccagcttcctggctatgcccgagatcaccagtcccattcccctcagggactgcgttgctgctcactctgcctgcaatgctcctgcacagatatctgtctgcatctccttcaaacgccacctcctcagtgaaacccaccctacctgctgtgtttaaaattgcaatccccttccagctgtcctggtccccttttatcctgctctgctttttctttttcctatagcaatttttacctgatgacacattaaacaatttacttattagttataacaatttacttatataaattatatatatcttatttatataacatataagaaaaaatatataaaaatatatattttatataaataaaaaatatacatctttttacaatttatatattatatatgtttacatgtataatttattgtatatgtttacatatataatttattgtatatgtttacatatataatttattgtatatgtttgtatattatatataatatataatgtttatatattatgtatgtttatatataatatatgtatttcatatataaatatataaatatatttatatatacatttatatatattttatttataatatatgtatatgtatatataatatatgtttatatataatatatgtaaacatataatacatgtaaacatatatgtaaacatatacagtcaaacatatatgtatatatataatatataaccatatattatataacatatgatataaaaataaattgttaaaaggatatatatcttatttatgtaatatataacatatgtaatatatataaaaataaattgtaaaaaatatatatttttttaatcatccatctcctccaattagaatgcatttttcctgagaaccaggaatctttgtctgctgtgtttattgatgtattccaaatgcctagaacactgcttggcacatagcaaaacccagtgaaaaaatttttagtgaatgaatgaatggaatgcatggaaacagggtctgaacagacacaaactaaaacatcaaaataaatattctgggtagaaggatagcaggtcttttcattcatctgttctctaatttctctaaaataaattcaaattacttgaataataaacttttaaatgaaaaaaacagtttactcctgaggataatattaatagtagttttagtaattttttttagtctatggtttcaactgttcaccttt

SEQ ID NO: 473282 - DNA, 1530 bp, Homo sapiens
ccaggaacccacagcaggcgtcccagagccctcccggccctaggcttctggtgtggttctgcccatgagcctggctgcgccagagccctcctgctgttttccaagctcacgctgcagccctcgctgactctgagccaccccatagccattcaatacactccttttccactgaaaaggcagatagtgagaaacgttgatccaataataacatgaagtccatgaaagcctgtggctatgaagaatgctgagccattgaatccaccagagatagtaaagggggccttgaaatattctgaggcttgtagaagggtaaagtaaatacctaaggatcccatgacccttctgtaaatgtgacgcaacgtggtccaaccactgctgctatgggaactggaactgcacatttcctgcctttcatcttcagcgtgttaggaacgaatataaagatcaaactttatattgttcattggttgaactcgtctatagtcctggcagtggaccacataaagacaggaactggaaatgtggaccaaagtcaagggcagaaactctctcacaggactaggactggacctgagcaagactgtgtcaccacactgggcagagaatatgagaagctggccatggaagaattctgccatcaaagcatttcctgcattgatcaagtggttggaccccagagctgccgtggccaaggcctggcttcgacccagagaaaaagggagattgtgaagcaggacgggggcaaatccatccctgcccctggaagaaacaacaccaagcagttatttactgactgcctactggatgacaagctgtcagccaaaagctaaggatacagcgcaatttttacctgatgacacattaaacaatttacttattagttataacaatttacttatataaattatatatatcttatttatataacatataagaaaaaatatataaaaatatatattttatataaataaaaaatatacatctttttacaatttatatattatatatgtttacatgtataatttattgtatatgtttacatatataatttattgtatatgtttacatatataatttattgtatatgtttgtatattatatataatatataatgtttatatattatgtatgtttatatataatatatgtatttcatatataaatatataaatatatttatatatacatttatatatattttatttataatatatgtatatgtatatataatatatgtttatatataatatatgtaaacatataatacatgtaaacatatatgtaaacatatacagtcaaacatatatgtatatatataatatataaccatatattatataacatatgatataaaaataaattgttaaaaggatatatatcttatttatgtaatatataacatatgtaatatatataaaaataaattgtaaaaaatatatatttttttaatcatccatctcctccaattagaatgcatttttcctgagaaccaggaatctttgtctgctgtgtttattgatgtattccaaa

SEQ ID NO: 473283 - DNA, 588 bp, Homo sapiens
ttattatgatggaattggtggaaatgaaggaaaatgttgtcctggtgttaacctttgtgggaggaagccttgagaaccatcctcccccgcagcaacaggtgggtgttcctggaaaaggctggtttgttggtggtggtggtggtggtgtctttggtggctgttcacccttccacagtaaacatgcttgggaagcaactttgccaaaagccttcggacagtccagcgtcaacaccgcaagccaagtggtaaggcccgcggggacagaaccgtcggaccctggtggcgaatctgggatggatgaattctggaatcggtgggcactggaaggacccgacgcaggtgatgggatgcagcgcttccaggtggtgaccccggctggacgtgcgtgggtgcgaactgccacccgggctggggccagcttgctgcgccgctgcctccgcaagccctcccagcccggagctgaggaaaatttatagcggtgtggattgaatttttgttttaagtctgattgtgttctttaatcttgctaagggaatcgctaagggtagccattaaattattttgtgtcgtttaatttgattttcccat

SEQ ID NO: 473284 - DNA, 1067 bp, Homo sapiens
cttaaagaaaggacatctgaaccaagtcattactgatgttggcttaaagccaaaatgtccccaaataaagttgagtctgatgggcatgttgtgccaccacagaatttgggaaaggtactgatgcaggatttttctcatccccttcatctgactcacagcaggggtgccccccctacttggcccgccacacttgcactcggtcccttgtgggagggaacacgtgagcaagtgagtaaaggatccagccagcagctctgggcactgacacaggagcaagcttcatgcaaggcccatgaccagaccaggtgcgaggatgcctgtgaccctgaagccgcagagagggtgttacagtgctcctttagttccaccatccccagtgtgatggatggtggcatgttggcagctcagttggccccttgtcttgttgcatggggcagctgtcctccaccagcaagagcaaggaccactgtggcagccttttctgggtacccctacttggtgggtcccgagctcttttccagcatcctaaaagaatgaggtcacatggacagttgaatattggtgaaggcagagaattgtattgagtgatgaaaatgcctctcagcagagaggggatctggagagggaacagaaaggacaggttgtcttcccctaagtcatgttgtctcttgcctaaagtcaggccatctcctcctctactgactgactctggggtctttatagacacaggatggggagtgtgtgctgattggttggtgagtatgcaaaaaaggttgaagcaaagatatcactcaaaggtggaaggaagaacacacaggggaaaaatttaaatttatatcccacaaattagatgtttatttgttctccactcacaacttattgactagaaaatgtatattaacgtatagtggtaagaagagaaagttgattacaacggggcatggagaaaatttggaggtgattaaaatattatgtgtcttgattgttgtgtgagtacagtgtacatatttgtcaaaacttgataagcatacacttaaaatgggtgcagttcattttatataaattat

SEQ ID NO: 473285 - DNA, 958 bp, Homo sapiens
agctgtgactaaaaggggccaagggcagtgcagaagggaaatatggggtcagagcccccaaacagagtccctactggggcaatgcctagcgaagttgtgagaagagggccatcaccttcttccagaccccagagtggtaggtccaccaacagcttgcactatgaccctggaaaaactgcagacactcaatgccaacccatgaaagcaaccaggagaggggctataccctgcaaagctacaggggcagagcgacccaagggcatgggaacccaccttttgcatcactatgccaataggtctaaaatgtatttaggagttaaattcaaagacaaactttccttgggcaaaactgagagacgtaaagaattgctaaaagatcagagacaagcaaaatgcactggatggtgctgcttggagactagaaagccttctagagaccttagctatgatgagtcagtaataggaaatggtgatcttccactgtgctttccataatcccacattgtttcaatgtgtctgaattcttttcgctcttacattaatttttatcttaacttttcaactctccaggatttctctcccttctaaatcttgcatcatgctactcaatacaaagggcctcagggcttggagtcaattaaacatgcttcggaatcctgtcattcataagttctttttgtgtactgttggacaaaagcacctgaccgttctgaacttgatttagtaggcatataaaatgtgaatggttaataatatcgccctgcaattgtgattaagcaaacatgtcagttcaattttatttagaaaaagcacattgtttagtgaattattatttttaataatatgtagatctcaaatttgctaagagcttttattcttttctctgtatgatacatatgattcttccacgaatatttccatttcagtcaccaattatagcactaagttttcccaagtt

SEQ ID NO: 473286 - DNA, 782 bp, Homo sapiens
actaattaataactctggagtagatctaaaaatctgaaaagagtggggtgttgctgaaaagatacccgaaaatgttgaagcaactttgcaagtgggtaacagggagaggttggaacagtttggagggctcagaagaagacagaaaaatgtgggaaagtttggaactccctagagacttgttgaatggctttggccaaaatgctgataatgatatagccaatgaaagctgggctgaggtggtctcagatggagatgaggaacttgttgggaactggagcaaaggtgactcttgttatgctttagcaaagagactggtgacattttgcccctgtcctagagatttgtggaactttgaacttgacagagatgatttagggtatgtggcagaagaaatttctaagcagcaaagtattcaagaggtgacttgggtgctgttaaagacgttcagttttataagggaagcagagcataaaagtttggaaaatttgcagcctgacaatgtgatagaaaagaaaaacacattttctgagcagaaattcaagctggctgcaaaaatttgcataagtaaggagtagcctaaagctaatccccaaaacaatgggaaaaatgtctccagggtatatcaaaggtcttcattgtagtccctcccatcacaggcctggaggtataggaagaaaatgtggttttgtgtgctgagcccgtggttcccatgctatgtgcagcctagggacttggtgctttgtgtactagccattccagccatggctgaaagggaccaacat

SEQ ID NO: 473287 - DNA, 517 bp, Homo sapiens
aataaaagccaaaatgtcttacccaagcaacagtatagttaccctacaacctgagctgagtaacattagctgggtgctctctgactcaccaagccacaaagctgggtgtgcacagcactactccaccatcatatggagcagtgggtatgtaattgaggccaagcaggccctgaaggcacaagttatacaaagaagtgacacaaatgcctatgatttcccctcctgctgctacactgccttctctctccctgcttgtgtgtatagcctcattgtagcagtttcctatgataagttgacagaggcatccctgaaggatggcaaggaaggcaaatcttcccagtgggcaaaacttcggacagtctacctggttgtgcactttacttggaaggataaatagccatatgtgtgactatataccatttcatgggctgtaacaagtggtttggctggatggtcagggaatttgaagaaacttgattgaaaaattagtgagaaacaaatttatgaaagaggattt

SEQ ID NO: 473288 - DNA, 1362 bp, Homo sapiens
gctagcatggctgacaagtggggagtcggtagtactccttagggagcagtttattggggggatgaggtggtcccctggcctgcactctgtccacaacttgagaaggacctgccctccatgtgggaattggcaaagtggaaactgccctgcccgaggagtcccagccctcaggccaaattggataccctgtcaagtacagaatggtgagattatatccttacttcctgactttcttccatcaggggagcttgtcccattctgcaccccatcccccatatcaaatctgggtctactggaaaaggagtgtgagcatccccataaaacttatggaccagttgagtcttacctgaacctagggaatattgtggcaagactgtattataaaagaaaatatttttttatgcttcgttggttcccaactaaaagcaatgcagttctggagaatgtaatccaaagggctgcatttgggaatcaaattagttcccttaactgagaattagattgaacagtaactggtacaggatggctgctaaattgtattctttcacctaaattaattgaaagatgtttatttataagcaagcatctgaaataaaataattaaagaaaatattttaacaggagtcttaagactgtatttgtccatgattgaaagtttatgtacctcacagagcaaaatatcatatgaaatttacatcaatatttttttctgaaaataggaatacatagtttacatttttatttagtaggtctagttcaaaggtgtttcttcactgaattaacaattttaaaggaaatttagagccacagaaaaataggatatttacaataaaatgattgtaaaccggatgatttatgctgatgctttccacaaatgtgccaataaacctatatggacattattgctgcaatggcaaagatcacttttacttctatactttaaaaaattaggatataataaaactttcatgagtttctatgtagtgctgaaaaagtaaaaaattacattgtgtacaaccaaattgtgatattccttccaaattaaacaaggaaactctaagaccacaaaaatgaccaacttctttttcttttcactgacatattttctgagcgatttttccttccttgccaatgaaaactctactattgcttaaaacttccacctcctagtttaaaatattaaaatatccaatttctgaatttttccaatttcttaaagacagccaatcaaaaattggtgttcatgggttttttgtttcatcatggctgattagaggcattgctagcacacctctcccacttggaaggacaaaatagtgtttagaaattcacgccataaacacttcctttcaataagtgatt

SEQ ID NO: 473289 - DNA, 541 bp, Homo sapiens
agacctggagaactaggaggaaaaaatggtttcatggaacagcccagggccttgctattctgtgcagcctcaggacatggcagccttcatcatagcctctccagctccagctgtggctgaaaggtgcaaaggtacaacttggaccatcacttcagagggtgcaagcaccacgccctggaagcttccatgtggtgttgagcctgtggggccaccattctccagaccccagaatggtagatccactgacagcttgtaccgtgctcatggaaaagccacagacacccaatgccagcccccgatgaaagcagccagaaaggaggttgtatcctgcaaagcccagctctccctgccagctcgtgtgtctgtgagggtcatcaggtctcctgcagctaagatcctggaggtccatggtaagaatgtgccattccttgccttttcagcttactccttcactaggagttgctggaggcctggaagcagtcctggtgctcgctagccccatccggggtttccagctttctcccttttcagctcagcatcc

SEQ ID NO: 473290 - DNA, 871 bp, Homo sapiens
gtgctggcacatagtaggtgcttaacaaatattaactgaaaaactggatgaatgttttaagccccgcatgcattaggtatttgtcctaatgctctctctccccttgcccctcagccctcaacaggccctggtgtatgatgtgccccctgtgtccatgtgttctcattgttcaactcccacttatgatagccttgaacgctgtcttctgacacttcaaggcaacaagaatggcattcttccaatatcaagccacgagctgtcacaattcatgagctttggactttgggcatcatgggatatctggctgtggaatggaagaaacactttggcagacttcctgattattcacgttatatattttcttctctctaaacactgtgatgaagtgggagctgtgtgcttgtggacttggcatgtccacaatggccatggttggagtggggcaatgaaacctcttgcaaataccatgatttcttctctttccaaaagtattctaaggaaaatttgttcaaaaatatgaagtagaaggttttaaatgcactgtcatcaaaggaaaaagtaaaatctttgtgtatatcataactaaataaccacatgctttaaagaattgatattaaaatcaaatataatttcccttttaataacatgagagacttcacttaatacatatgaggctgacatctgagtctttcatgctactcctgtcgtgacaactgtattaaacctttccagtgtgacacttttcaactctgaaaataatatgactgcatccatgtagagcttccattttcacagagttgacagaatgcggatgctgactgccttacctctgcagactgtctcaagctatcccaggctgtgaaaaacatgc

SEQ ID NO: 473291 - DNA, 646 bp, Homo sapiens
gcattttcattttgcactcagccctttggcattggtgttttcctgccagacaggagccaagaaagcagggatatacccaaactgcattggaggaaagatatgagcatatcagaaacctcttctgcagcctattctctcatttggctcttggccttgctccaccttgcgtccccattttcttctcttaagaggatgctaccaaattcgtgctcctcaaagcaactggatcataacaatcatgcaatgatacatcaggaccctcgacctcacaacattttgtctaccatatgcttaaaagaagactccaagttcttcagcttttggactcttggactttcaccagtgatttgccaggggcactcaggccttcagccacagactgaagtctgcactatcagcttccctacttttgaggttttgggactgggactggtttcctggctcttcagcttacagacggcctattgtgggacttcaccttgagattgtgtgagtcatttctcctaataaactccccttcatatgttcatctatcccgttaattctgtctctttagagaactgtgactaataaaatatcttagcccaaagtaagtgaatttctatttagggctcatacaagtgttactggtcagcaagaggctttc

SEQ ID NO: 473292 - DNA, 1430 bp, Homo sapiens
tcatcacagcaggtgaacaaagtctcgatcctgtagtggggaaatggggaagtgtagccggtggtggcagaagcggctgcaggaggagcagtggcagccgtgggtccccatgtgccctgcatcgtctgtgccccatgtccgagagagagagagagagagagagagagagctctcacccctcaccactccacgcctggcttgcatggcaggcatgggatccaggccagtggtgcaagccaagagcagccttccaggccaagtgggtggaaagaaatcagtggacagagcaaaactcgagcaaaggcccaactggccacagagatttttggccggggaaatgacacctcaaggatcccaggataacgtctactgctctactgtgtttaaaaagcactctgttatttgggcctacctaactgcatgtgatactccactgagagcatgcactggaaataaccatttcatgattctagtctaatcatgaagctaattgcagtggctatggattttttaagtttattttgtcctatattagtcattactgactgtataattttcaaatattgggctagtagttggctaggattacatgaacttttagtaggcctgtatactgtattcataaatcaagcccaacctttgaatactatcccattggtgattcgatttcaaaatatgaattctggggagacacaaacattgagaacatagcccttgacatgaatttcttcagatttattgtgttttgggtttactcagatttttgaatttttatgtttatgtctcttgcaaaattagggaatttttcactcattatttcttagattatttttccaaattctgcttttatctctccttctggagcatcaatgacacaatatattgttataatcccacatatctctaagatactgtttttgttcctttttaaaatattttatctgtatggttcagattaatttctgttattctgtcttctagtttactgatttttttaccttgttatcttcctttcattctacttttaagttcatctattgatcttttaatttcagttttcagttctaaaatttccatttgattcttctttatattttcatcttctttgctgaaactttctatttcattgttacgactcttttttttttatgtgtttcaattatgtttgtaattgctccttgaggcatttttatcacggattctttaaaatcatcaaaaacgtctaatatctcctacttttaacatctattcattgttctttcttcattcagtttgagattttgctatttcttggtatgataaatgataatttatattgaaatctgaatatttttatattataagactggatcttaagccttctgtttttgttggcatttatagtagtctggcaaggggaagggggtagcttactatttcaaggtggaggt

SEQ ID NO: 473293 - DNA, 603 bp, Homo sapiens
tttgagccaggatgagccaggagaaggaacttcacaagacaatgtcatcagttaaggcaggaattggccatctggatgttcatgatgaaaatgccctcttgaggctgaattccaaaatggcacataaattagcacaaaatccgtggtataaaatccaggtacctctgagtttacttagagttccattcaaagaaatgatggctagtgggccatatgccaagtctgagtctgacagtcatgagcagagctttagactccagcccactgggcagctgaagcttattattcttacaacagtcaacaaaaatggctatttctgggaagcactcctcttttcacataaagaaacccaagtgaatgaacatgagaaatatgggaaccattgcctgccttccagtcgaagcttgggtccacctaacagttcccaaacagggttttgagagtcaatcctattagtatatgaggattgaaggagtaatttaaaataatcaaaataccttcccactcttctccaactccactctctcaccctaaagaaacaatgatgttgaatcctggatttcaagcaaaatgttacagaaattcaactgtccagattttcaa

SEQ ID NO: 473294 - DNA, 610 bp, Homo sapiens
taagtgccaagacagcagcacagaccaagtgccctggggctccaaggagggagtgagcacagacagccgtgggtttcagggaagacaacttcagggagggaacgcctgaaatgagccatgggtccattagatggacttcatgttagagcaggactcagggagagatactggattgcatcttcaatttcccctggtcaggtggtgcttcagtctatgtttcccggccaaatggtgccactggcttggctccatattgaggtggggtctcaggctgtgctctgtgattgggtggggctgcacgctgtgcgtagcagttggttgggatcacagttgggtggagcttctgccttggccctctgggcaggcaaaaccacaggttgggctctgcagccaggagatgttggtattgaggacaggaccagaaggaaatcacataaaatcactacttcaaactggtcctctgaggaaatcaaaataggacaatccatttccatggattcccaacttccaaaagtattctaattttcccagacatggctttcttatttaaattaaaggctcagtttcctgtcttcttttcctgcctaactccagaaaacttctaagggag

SEQ ID NO: 473295 - DNA, 810 bp, Homo sapiens
acatctcataccaagcagtgggctctaagggcagagcaaaggttggcctgcagctttctccccttcctgctgcctgtcaggagaggaaatcgcagctttcagagggacctgacacagggggaactggatagcaccaaggggtcaaggggccaattagcttcatacaatggggaaaaaaaaagactgtttcctagacttggactgtaccccaaactcagcccgccttgtccctggggaaaccagcattctttgctgtcaacaagaacagctgaaggaacgcagcaggaacacagggccaatgagagctgctgggcccagatgccgacgccgactatggaaagtcacggaaggctcttctgttcctcagcgttccaatccaatttgcggaaactgtttatcaggtttctatgcagacaggattaacgtggcttctcaattcccgttccccacattttgtgacacagaagaccctggatgcctgaggaaggaagactccctttcccctcggctctaccctcctgttaaaacctcacggttcccaggtaaacaaatgattctgattcatgagtcttgtttgagaatagcagagacgttcagagttttgtgagattagtcctttgttgtccaaatctataatatgctagtttttctctttgtatatggaaaagcgtgctttggcaaacttcattacaacttaaatatgttactattctgtactggtttttccttctctctaacctcctcagtagaagccacgttttaagtattcagaatcttttcacttcctgtattttcaagcagttatttctc

SEQ ID NO: 473296 - DNA, 593 bp, Homo sapiens
tccacttatagtgaggggcctggagatacacaggttgttgggttttttttggtggggggtgggcggggggtgagcgggtggtggcggttgtcatgtgtatgcgtgtgtgcatgcgcttgtgtgcgtgcacacgagccaaggccacctgtgaagtcactgacagagaacaaatagctgaagaagcaggaggaaaatatgtttcagtgaaagtgcactcacatccagccaccccaccaggccccacttcccaagagacacagttcctgtctggccacatggccttcacagagacatggtttgccacgacaaaaacatgtcactaccgaggactgaggcaactgccttccagggactctattgagactcagaactatgctctccaaaacagagagacttctttagagcttcgagaactcccttctattgactcaaacggtcaacctcttgatgtcctacctgttttccccaaacttaattcagctgctgtggggtcctagccaaaccataaatcctaaactcattaatataaatattaacaaattaatggattggccagataggtttaagtccaagatctacaaaatactgacttc

SEQ ID NO: 473297 - DNA, 870 bp, Homo sapiens
ggtcctgtgaagacagtagctttactgaagaggcatctgagcagtggaaggattaaatggctgctctagagttctaaaatatggaagaatgtgagcagtcgccagataatataattttcattcacccaaatatcgagcacaattcaatgaagaaaatgcaacttttgccagtgatcctgctgggatgggcagctggtgttgttgactggcctgtagctcttcccccttgtcctgaaataactcggcattccagtagaaaacctgcatcatgttggtcgagtggagatgaagctggtctctcttcaatccctactacaagatgtcatgtgacacaagctgaaccaatcagagaatcccatcctggtgaaagtcattggtggaaagataccctttctcacggaggagatacggtgtcacccctaccagtgcaaaacgaaaaactagcctacaaggagctgccaacgtttaggggttacgaagatgacaaacccctggaaaaaggagcaaagaatgagcaaagaaataagataataagacagtgcaacgcccttggagagaagcccctggacacttctagaaatgattttgaagccgttggagtaggcttcaaggacaagagcagctcttctggtcccagaaagttcagcatctcttctataacatctacgccgactctctcctttttggtcaattctgagaacattcagcaatagctaactcgaattcagttgctccttccaacaagaacatggaacttctttatttgttctctctgtgatccttggcatgaacaacattaaaaatatctgatataaaagtttccaggacaaatgtttctatttcattcgtgatgacatcttaccatttttt

SEQ ID NO: 473298 - DNA, 618 bp, Homo sapiens
agcagtctcgggtggacatgcagcggctgacctgtaggagagtctaaatgaagccatttcagccacgatatgttcaatttgaagttgtacctagggaagccctggcagaagacacaggagacgtacggaatgaagcaggatttaagacagacgacaacaatgggttgggggttggtttgcgagatactactctcttactcagttgggggcagtgtgtgcatatgtttcaaccaagcaaggagcgcatttcatggcccgaggtcccaccctggacctaccgaatcggaaactctgggggcggggccaagaacctctcttctaacaaaccctccagcgattctaatgcaagttcaagtttgagaaccaatgttctagagccttgctcctccaagtataggccactggaagcttactacatgcatggaatcccaggccgcccctcaggactgttgaatcagaactgcagtttaacaagatccccaggtgatgggtgtgtacatttaagtttgggaagcctggtgattttcaggtgagaagtctaaactttttaaagacaacaatgggaagcagctgaaagttataaagtggtggtataactgatgagcgccccaggaagaa

SEQ ID NO: 473299 - DNA, 1380 bp, Homo sapiens
aggcaagatgggtcaaagtcagagtggtggtcatggtcctggaagtggcaagaaggatgacaaggacaaaaaaaagaaatatgaaccttctgtaccaactagagtgaggaaaaagaagaagaaaacaaagggaccagatgcagtcagcaaactgccactggtgacacctcacactcagtgccggttaaaattactgacattagagagaattaaagactatcttctcatggaggaagaattcattagaaatcaggaacagatgaaaccattagaagaaaagcaagaggaggaaagatcaaaagtggatgatctgagggggaccccgatgtcagtaggaacctcggaagagatcattgatgacaatcatgccatcatacaaggatcttctggaaactggctgctcggtcctgctcaaccacaaggtgcatgccgtgatggggtgctgatggatgacacggatcccctggtcacagtgatgaagatggaaaagaccccccaggagacctatgccaatattggggggctggacaaccaaattcaggaaataaaggaagctgtggagtttcctctcacccatcctgaatattatgaagagatggttgctgaagagcatgaactatccatcatgtttactgatgaaattggagccattgggacaaaaagatatgactcaaattctggtgaaactgtggatctagcacttatcagaccaggccgcattgacaggaagatcaagttctccctgcctgatgaaaggactaagaagcgtatctttcagaatcacacaagcaggatgacactggccgatgaagtaaccctggacgacttgatcatggttaaagatgacctctctggtgctgacatcaaggcaatctgtacagaagctggtctgatggcctcaagagaacgtagaatgaaagtaacgaatgaattcttcaaaaaatataaagaaatgttctttataagaaacaggaaggcacccctgaggggctctatctctagtgaaccacagctgccatcaggaaaatggttgggcgattcctcgacccctgaaaaggatgaggttgggggagttgcccagaggaatccctgttcccgttgatttttattagcaaaatatcccatgtcttttggagtacgatgtgtaagtgcccatagggtggccttagtcagtcactgtgcagcagtctgttcccaatggagtgtgctctttaacaaacatataataataatctgggtctctgtccattgctagctaattgaatttcatattaggatgcttactattatggctaaatcaagggaattgacccttatctgggggaaatatgaccaacttaattcttggtggtgttattattgacattgccaatagcatat

SEQ ID NO: 473300 - DNA, 797 bp, Homo sapiens
ccagaagaaacactttccctaagcggcagaaagagtgggcaggttgaggagggctggcacagaaaggatcatcttgaatgcaggtctggaaatacactgttggcagcagcacaaggatccaagaagtcaaagaaggggagatggcccatatactccgagccagaacacaaggcagtcggggaccaggccccaagatcccaaagcagtcacccagtccaagcccctcttattctttgtgtccactgaggctcagccctggatacccagagtccatgaacttagaacaaagagaggaagaaaacgagcttcagagaagcattgagacaggaccttacagtagaggcaaaattaaagtgttgactggttgggttcttatcaggaggctctgggaaaaatccacttccaacgactttcaggtttttgacaaaatccagtttcttggagttataggtctaagtcgaaaatatcagtgcaaaaataagtccaaaggaaataatgaaaatgaatatgaaggaaagagatcctcaggttgggtaatggctctgtactgtttacaagtggcacacctaaaacagaatgaaacgtaaaaggcaaaatgtatgtttcattctgttttaggtgtaccattttcttttgcctaccactgccatagccagctcttcttcaatcttgtttaactactgtatgttagaataagtgaatacacgaatgtatgataagcaatttgtcatcatgactccctagtcaaagaatcacacttggttatactgtcccaccaaccatgaattggaacagag

SEQ ID NO: 473301 - DNA, 662 bp, Homo sapiens
ctagaatttagagtgcaggacctctggaatgtgagagatcagaggaggcatattgcccgatgctgaggtttggggtatgatcgaaactgtcacccaggtatttctaaaagtatcatgggtcccaggcactgtacctaatggaaaagtcagccctgggcaggtggagaggggttatacctatggaaaccggcaagtgagccttcaaaggagctctgtgggagcacagtgctctctgggaccccagagcagggattctcaactcaatgaggcatgcagtgagaagtgctaccctgcccagggaagagacttcatggtgaagcttaagccaagtgttgaagctgaaaatgaagaagcaagaaatgaaagcctgtgtgcagaaaaccagaagctgctggatgtgggtgcaaaaagtaccgagcaggaatggtccgagatagagctggagaggtggatgggtccagacagtgacgagtctcatgagtcacttgactggcatggactttgtcctggatggacagtagggatctatggactttaaaatgagaagaggatgatcagatttcagattaggaagactggaaaatacatgtattcatcaaatcaggcaaggagtaagagtgagtgagtgtgtgtgtgtgtgcttgtgtgcacacaagtatatt

SEQ ID NO: 473302 - DNA, 560 bp, Homo sapiens
ggtcctagcaataccaggtgcttaggcaatgtgcctgctcatgactgcaaccctgaagggatcctggaaagctggatgcctttgcatcctggcatcatggctggaggcaccagtagaggacagaattttgctcttctgctgcatgtgtggctgtggctttggtcctcactggacttcacagtactggctccagttcagcctggtctctgagcagaacaagcttaagcactctttgggcctagaaagaaattgtttggaagaactcatggaaaaatacaaattctgtttgtttgcatatctcatccctgttttattggtttatttgcatttgttagctctggacattgtggaaaggagtgaagaaactccagggaaagcattatcagaatcagcgagcaagtggactaggagacgcagctttcagcatctgtgcatttctcctcctatcaccaccctgcataaagtctcaggctagcttcaacttttccagtgttcttcaataaataaaccaaataaaagcttatttaagtctaaaacaaaagctcatggactctttgtgg

SEQ ID NO: 473303 - DNA, 596 bp, Homo sapiens
ttcttcactcagggcatgaggatgaaagaggaggagtttagtgactctgtacataatacatttgaccatatgtggagaaccaaggaacaaaatgaagctggttggttgctcctaagttcagcggacaaagtgatgaaagaaaatgaggaactcagggattctgtctcccggcttcagaagcaaatactgagcctcaaatctgcaaagattgctctgactgagagtcttatctcctatagagaaaaagctgaaattgtgggaaaacagacacaagctctaatcatggtaaccgtgcaatgggtaaagggaaataatcagacattttgggaactactggacactggctctaagctgacgttgattcccagggacccaaaatgcccttgcagtcctccagtaaaagtagggccttatggaggtcatgtacttaatggagttttagctcatatctgacttatagtgggtccagcgcgtccccggagtcatcctgtggtcatttccttagtgccagcatgcataattggcatggacacacttagaaactggcagaaccccgacattggctccctgactggtgaggtgagggctgttacagc

SEQ ID NO: 473304 - DNA, 732 bp, Homo sapiens
tcaagatttccaggttgctctggggtcatgctgatacaagagatgggttcccatggtcgtgggcaggtccgcccctatggttttgtagggaacagcctccctccaggctgctttcatggaatggcattgagtgtctgtggcttttccaggcatgcagtgcaagctgttagtggatctacggttttgggccctccagactgttccaaccactgcctattacccagttccaatgtcacttccacattttcaggtatcttttcagcagcaccccatttctggtaccaatttagtgtattagtcaattttcatgctactgataaagacatacccaagactgagaagaaaaagaggtttaatggacttacagttccacatggctggggaggcatcacaatcatggtgggaggcaaggggcagcaggcaaagagaaagagagcttgtgcagtgaaactcctattcttaaaaccatcagatctcatgagacttattcactatcacaagaacagtataggaaagatccacccccatgatccaagtatctcccaaccaggtccctcccacaacagtgggaattatgggagctacaagatgagatttgggtgggcacccagagccagaccatattggcaacttactaaatggtagaaaatatttgtgagccatatatctgataagagagatcaatgtatcctttgggatatgtaatatattcttatattactgaatttgggt

SEQ ID NO: 473305 - DNA, 644 bp, Homo sapiens
gtagatatttagcttctctgcacaagatgggaccatggcaagtgtctcctactctgccttttccacatggttggggagtccttaggcaatgtacaatcatggtggaaggtgaaggagaagcaaggaccttcctcacatggcagcaggagaaggaagtgcaagcagggaaaatgccagatgcttataaaaccatcagatcttcaatcagtgagagctcctgttgctccacatccttgctgaagtttggtgtagccagtgctctggattttggccaatctaaaatgtgtgtagtgatatctcattgttgttttaatttgcatttccctgatgacatacaagctgaagcatcttttcatatgcttattcgtcacctatgtatcttctttggtgaggtgtctgttaaggtctttgacccattttttattgacacataataattgtataaacatatgaggttatgtgatatttgataaatgcatattatgtctctcacctgaataccttcaagataactcatctcttttctgtctcttttgccctctgcaatctctcccctaaaaaattagtgattttttaaaatgtaagtaatattatatcactcatctgctgaaaatactttgtcttattcttattgttaaagtaaa

SEQ ID NO: 473306 - DNA, 598 bp, Homo sapiens
tgtgatgataacaaagaaggaatggtgaattttggagcaatgctaagtgctgtcaggaccagctgctctcccccagaatcattgacacacggagttaggcaagcgtacagaaaccacaaagcaacaggaaacattataataaatatacagattaatttaaaagaatgttatacttttatagaaggaagtgaaaaacagataacccagtttgtggttacttgttgcaaaagacacaattctcgcttatcctgttttttccaaatggtggatgatgtagcaaatcagctgactcttaggttaaaaaagaaagccaggagaatgggctctgtggttactattgatgaaaaggccacgagcatcttctatgtgaacagataccgcaaaattgctctaagtggttgtgcaaatgcacacaccctgtcatgtatcagagttcctgttgttcaatatcctcgctaatgtattaccagactttcagattttagttatttagccttgtgaagaccatgtttgtttccctttcactttccgtcataattaaggcttatcccacacattggtaaacactagaaaacattgctgttacctcaggaggatg

SEQ ID NO: 473307 - DNA, 685 bp, Homo sapiens
caacgatgtacacgtacataatgccactaaactgtatgaaaatggttaaaatgaacttgagtgtaggaactttacataccctctccaaattgcaagcacctgatctgatccatggatctccaactagtcagttggagaactcagtatggctaatcaaggagcagtcctttcggccatatcccctgcttcttcctgccccggcacagaaaaatgactgcatgtttgaaactctgaagggctcccataggacttcctgtcaacacaaacatactctccccataagcaaacttctcctttctacttcatactctcagttaattgcaaagaaacagagtaaacaaatgtccagtggtattttaatgacacagatacgtccccattcggaacagcaggaacacgatgaaaagtggctgtaccatctactctttgggcctggcatcctcccaacccctctccaccccagccctgcactacacacttctaaggttggctgcctgggctgcctgctctccgtggcttcatgcttggattcttactcctcttttgatttgtcaaatttgattattagaccaacaatgggtttacctttgacctcacaccctgctgaccccctgaatgtggggatccagttttcactccagaccctaactcaggccctggagatctcaacagtagttcactgatc

SEQ ID NO: 473308 - DNA, 586 bp, Homo sapiens
ctcctgcagccagactcctcctcttttgcctctgagtcatttcctctttccttcatggaccccagtggtgcacgcaggcactggctgtggtaggcgggggcagggtgatctccaggccaccagggaaatgcttaggctgtggagcagtggccttgctactggagagtatggggttgctttcagtgggagtagccatagaggagaaggactgtgtgtatggctgaaggagtggaccctgagcactgggcaggcctttcaaggtgccagtcaacttcagtgtaaaccaacagctttagctgggagaggcccagtgccccacatggccctgcatggcacacaggaacagtggcaggtggtcatggagccagtcttgcgagctaaaagcaaccacatgctgttaacagattcagatgggctgacttgcccaaaggggcaccgtaaacgggatgataaatacatccccaagtgcatggaatcaggcaaaccgggttccttggctcaccaactcagccgccatatggtctggagcagcttagagtttctaggcctctgtttcctcatctcataaaataagtgtaaaagcaac

SEQ ID NO: 473309 - DNA, 662 bp, Homo sapiens
ggggcacatgctgatgcccctgtgtgggctgctctggtggtggtggtgctgctgctccggctggtactgctatggattgtgtgccccagccccccagatgttgcgccaccagggtctcctcaagtgccgctgccgcatgctcttcaatgacctgaaggttttcttactgcgcgccctcctcaagcgcccctgcccatgcacggcgacccccagccccccggtttggcggccaacaacacccttccggctctgggcgccgggggatgactggggtggcccagccacagagccacctgcctcgctgctcagcagtgcctcctcagatgacttctgtaaggagaagaccgaggatcgctactcactgggcagcagcttggacagtggtatgaggaccccactctgccgcatctgcttccaggggccagaacaggtccaagactatatgatttgctgagacacttcttggcagactcaaatttttctatgttgaaaacaggcagaggtgtgttgggagaatccaggagaaaagaagtgtaaaaatatcttggaaggaatttatatataatgagcatgtattttgataacagaaagctgtattttattgaaaaaagaaaaagaaaaaaatcattggcaatattgtgaaataccctcatgtgatacaa

SEQ ID NO: 473310 - DNA, 767 bp, Homo sapiens
ctgctctattcccttgttccccacttccctttacggtgaacactccccctctgcagctctctggaccctcttctccacccgggacgtaggactggttgctggcacagggctggggttgcagacttccatgggtgcattggtggaagaattaggtaaagacatgactcaaaaacaggatgtgtgcagagggaaaactctcttttccaatttatgaagcccaaggaattggggtgataaaaggtgctccctttggtagtaggggtcaaatgggattagtatgtggcctgctcacagtcagatggctaatcagcccagagccagaagctgcttgcaggctaatggccaagcctatctctcagcactgcctctgcagcaggcaaggcttggccatgtgtggctgtgtggctgtgtggctgtgtggctgtgtggccgtgtggccgtgtggccgtgccgctgtgcgactgtgtggccgtgcggccgtgcggctgtgcggctgtgcggctgtgcggctgtgcggccgtgtggccgtgtggttgtgtggctgtgtggttgtgtggctgtgtggttgtgtggctgtgtggctgtgtggctgtgtgcttgcttgcatgtgagtttgcaagtgatgaaggggaagcgggtagctgttaggggctgaattgtgttgtctcctaaaaatatgttcaagtcctaatccccggtacctgtgaatgtgacattatttgaaaatagggtctttgcaaataaaatcaagtaaagatgaaatcatt

SEQ ID NO: 473311 - DNA, 1363 bp, Homo sapiens
ctcccataaaccatctgatataaactctggattatgtttctttagggagagttgagtcatctccctgaaatgagagaaggacaggctctggcctggtcccaggcattagagggccccctccaactctccttgtgtccttcctatggggcaagagtctgctgggccaaatgcatgtgcccacatacagcccagtcctcttcttgacatgcttcaggtccaggcacttagaactgtgggattgcctatttcagtgaccgtgggttggcttccagtgggcagcaatctcttccaaaagctttctgtcaggactaggaacttccagacctctgagaaggcagctgctgaaggaaagaagccacttaactggtcagtaaacactgaaatgtccattaatagaatggatgagtccattgttggagagcagggcatcctgaacgatggtcccagtgagactgcacatggtcccagaaagaatctagccggtgttaacaaaagaaaggagggcatggatgttaggttggaaacaacagatttcgaacaccttgactcactaagatctttcttaggtggaaaggctaaaagtcgtttttggttcccttagaagacaaatagaagtttgattttttaaaatgtgtttttaacataatccatcatgagcaaataatggagttggattatatttttttaaactatagtgacattccttttggccgaggttttctaggctcagctaatagtcaatcaaataagttaatttgtgctaagatgtgaagatggcaatgacctggtccagggtaggcgtatgccccaaccccagtgctggcttggacccatgggtactggtgacttgaatgttaatgagcacattcatgtccccttcctagttaattgtaaaccactgggagaggaactagatctccagtcacaaaaaatttgagaactgctctcctaacccaggggaatggctggctgctaagatttctctgggtcctatcattggcaggagccttgtttaaattttatatcttcatcagagtttgaagttggtatgaagtttatatgaacagtaaatcctaaatctaagcaagtcagatactaagtgccttgattctggcaaggcccccctaaagcctgggaggtagaaggtgttaaggttataagatccagttacctttacacatagcatcagaggtaagggcagccccacttgaaattgaaaggaggtatgacccacagcaaggcgatatataattagagtcattttgctctcacttttatgtttaggaggagacttatcttatcaaagcatatgacaaaaataagtaagatatagaagcaataacagaattttaaatagcagtgt

SEQ ID NO: 473312 - DNA, 852 bp, Homo sapiens
ggaagcaggatttaggttctgttcctgaatctggtgaaggatgagcatttcattgtttgctttcctttctttacaagaagaatctaacttgccagacacggcttaagtgacgtgtgactggagaaggcccatgctcagggggatagattttaagatgcagctgcctgttaatggacttggtgaaaagactggggagcaaggcctggtggaaatgaaatactgtgaagagctgatgtggggcagccagtgcaccacgcgccagttcatcggctctccacgcttccctgtgagccgtcatcctcgtgctcattttgcagatgggcaagaggccatggcgtgtccagcatgctctggcaacttaccctgttggtctctgaagctccccaccctctctgccttcggggcaaatccaggcatttgcacaaatttgcacggctcagggtctgtctgcctcccctccggggccttgcttctcacagcccgcttttctctgcaagcttcagtggaacggaaaaggatctatccccgggttgctgggcagaaaagaagaaacaggtttaggcagatgaagtgctcaggatagtccaggaagggccacagggcttgagagggagacaggcctggaaccaaaggcaaacaaccccttcatcattgtgcctgggctagtactgactcagctgcttctgtgatttgcattttggggtggattgacaagttagctatttgaggttaaggttatccctgaaccattaaaagaaaagaacaagaccttgtctgataaacctgaaaacttgaatttggtgaatagagatgcatgagatgttatgctctttgggattctgaaaacccgat

SEQ ID NO: 473313 - DNA, 611 bp, Homo sapiens
gccacccgccagtcatagcaaacaggagtactctttctgtgctaaaatgaagctgtataatgcagccgtgtggcaaaaggagatctgtgaatgaaaatggggcagttggagaaaatgggttcagctatgaagataacagcatttctgacagagtgctgaaagctgtggctgtctttaagactattaggaagactgaatttcctgaaattgatctccagaatgattttgtgtggccggaaatgttcattgaacagagacctaaaggctttggagttgaaggaactgcattttgtcttactctgaatttcatagaccatgaaactgagtttctgagagaaactgacttggagggtgagttcgcaccctcgtttgttgagttcctgtcgctgcagcttaatttgccttcgcaccttcctttcacgctcacaagtgtctggtttagacaatacgttacacgaccaccaacagtagcagcagcagcagcagcagcagggctaagactgctctccagatccacttctcccactactttactgttgttttttccttaagtgtgctgtaacttattctgtttctcaaataggaatttgaaattgttttttaaaaaataa

SEQ ID NO: 473314 - DNA, 612 bp, Homo sapiens
acctcaatacgatggcagcaaagcccctttccacagaggagctgcatttcccaacaatcagcagggaagaatgcctcagtgccccagatcaaacatctttccctggagagcactgtggccagttagagaaagtattcacgttcctcgccaaacagtactgggaccaccacattaggaataatcataatttaactccagttatgtccactgtcaacgtcgttgatgtcaatgatggggcatcctcatcaattactacagaagatgctggcaccaattctccagatgacctgcatactaatatcccaggcctttttgtttttactttgctctcttgctggcaccataactttgtagtgaccaacatcaaaaatgtcacatctcttctgaatcctagcatccagagagttcaaattcaagctgaaactgatttataattgctatgatcttggtggttaagaacttgggtttgaatccggctccaccacttattatctctgaaacttagtttccttatctgtaaaatacagattttatgaggctgtttatgttacaataattcctatgtcacagttgtgttaaaggtgagcttccacttgaattgtattcgcttgg

SEQ ID NO: 473315 - DNA, 993 bp, Homo sapiens
tttttatcaatgggcatttcagttcttttcatttttcactgccatgaatactgctgccagtgtcttctgcaaggcctttccccacaggttgctggagactttatcactgttgcaggaggcccagcggcttcgccccagaggccaccagtgccacccaggctacaggagtcaggaaagaagaagtcagtgctctaaagagcctccaggaagtgagttgtacaccgaacctcttcaactcatggaagacacataccattatgaccttccaggctccagttcacttctcaagtttccagttccttggttgcagaatgaaataaccattcccacatttcagagtacttctagacttctggtcagcacactccaacaggtggtgtcagccaaagtgttttctatgacagtggcagcaggatccatcatcacttgcacatgccagcagcagcagcagtgtggcaaggtgcatgctagtctgctgcagcaaggtgctagcagacactggagtgattcaggagatccatggcgagagcaggttgctccttgccagatcaactcacatgttctcccagtcactgggggccaagaacaagttctggtgtacagcagccccatgtgggatttccagcttctttctccttcagcccagcttctgtgtcttccctctgtccactctcagtgcctttcctctgaagatctgttaggagcatgccagtcatccagaggccttgttcctcatttctgccagagtgttgagcaggaaacgagcagatattcctccggattttgtcctaggaaaaagtcatcttataatgagactttttctgatcaccagaactattcctaaatcaacagaaactatggccttcaattataagcaagatagcaagatgatgtatctcagttgaaatgcagttgcttgaacttatgccaaaatactaagtttgaatttgtgagtgcgatcaacttttagtaacataatattttagaacattc

SEQ ID NO: 473316 - DNA, 659 bp, Homo sapiens
gagccgaaggtctcatgtgcatggggtattcagaactgagttgcagtgaaaaaaccctctatccttctacccatctgtcctgttattgtacctcttctgtgctggaagccgaccctgtgaagtcccatgagaacagagaggtggtagcaccagagactggtaagggccacatcctccagaaagtacaggtgaccacctttcattccaaaaggaaaggcctttttattcttttggcatttcaaccgttactgtgtaagttttcacacacacacacacccacaaaaaggcataatacctgtaagaaggaaagcagtcctctagaattgaagtgtttgaaaaaaagctatgagctcaatgttttggaggaaatcccttctatagcagtggaaagaaggcagctcactttggactttgaatggtaggaccgtatctgctattcagtttttgaaatacagctgtgccatgtgcactgaaccttcacactgggactcagctgccatgcttcaccttgggtataatgatgacagaggttgagaaaggtgactccctccattgatgtatttcgccatgattacctcccaccaaatgatactaatactcctgaaaatacttaacatttataaaatgtttattttctgattcatgccaaagtacttgta

SEQ ID NO: 473317 - DNA, 556 bp, Homo sapiens
tgattcatgcttcaataaattcaatttcaacaaaacataattatgattagaagcagccacgagcccctgaagaagcaggccgaatgcagcaggggaggtctgtgctccagtcctggatttgtcgtttcctttctgcatgtgctggagcaaaccacttattgtctgtcagcctcagtttcctcatctgcatgcactgatgaccataatcctggcaatgacacaactttgctgaggaagtatacgatgcaggcctgtaggtttgagcctccaagggctccaggggctgtacagtcctccaaagggcggtgggaaaaaggttcctcaggttttgagggtgtgttctgcagccctgctgaggaacgtttgtgtatcctatgtgtgctggtgcatttattagaggatgtggtagtgatggcgttgggcagtttccaaagtaccatttcctgaaattatcttggccgcagccaggtatgcgactcgcagttgcaagcccagggagaaggtgagctgccggggagaagtttacagtagggtgggtcgttcggaggagtgccaa

SEQ ID NO: 473318 - DNA, 589 bp, Homo sapiens
aatttaggacattctcctttgaaaaactctctcaggattttcattttcatctggaatgaaatgcggacacccatgaatctggacaaggctactgtatttgtgggaaatagtgccctttccacaggccagcccagccccatgggcagtcaaaccctccctttcattcgcatcctgaagcagcgccctcaggctacctggccttcagatcatagcaagaagaaaccttggaaaatcccctcttctcctccacacctcccagagatgcccaaaaagcagtttaatgctttttcacagcagttcctgaggcctgcatattccaggcatgaaattgacaagagcaattcagctttcatatgggagcatatgaggtcagctcagcttttggcctctgcaaggagggatgtagaaagtctccccacaggaatatctggtggcatcctgacaccaagcctccttttatgttttcaaaattttttaaagttttattttgtttttaattgacatataatagtcatatatatttatggggtacagtatgttttgatacatgtatacattgtgtaatgataaaatcagagtaattagcata

SEQ ID NO: 473319 - DNA, 766 bp, Homo sapiens
ttagtgggtgcagcacaccagcatggcacatgtataccttttttcttgcattcttttctttcttgcttaccctttggccatcagagatgagagtgaggtgggctgggagttagccttatggcaaactcccctcttgctgctggtcctaccctttgcctccagctctccttattccaggaaacattggggatgttctgcctggagctcttccttatctttcctgggccacaagctccttcacaaaggggtcagaacaggatttacttcaatgtggtctctgaatcacagacattctcggaagttcctgctgtgtgtaccagtatctctagagtttattgctgatttaatatgttccaacactgccacaggaagctctgtgtgcaacagctttggacggtttcgatttaatcaagaggaagatgaaagtgggtgtccatttctttcaactcctcggctctttcaccatccatcatagtcaatgtgtggttactcaggacacagcattaatgatagctgtcaaaataatagtctgtgggttagaggtcaagaaaaatatgtaaaagacttcagggtgaaccagatgataaagtagctcatttagtcatttaaatgctagcctagcatggccttggtgagatcagggaggcatactgtttgcaaagtttacttagacaaagaaaaaagtttttctcatactttttcatgaaatgatattatacttgcaataagaggcaccaactttagtagaaacctgaaatatgtttct

SEQ ID NO: 473320 - DNA, 1167 bp, Homo sapiens
gtgggggtgtatgtggggggacctgtgggtgtgtgggtggtgtcaggggagcctggatggagccccaggacagcctgctgagggtggaagcctggatggcagatgctcaggtctgactgctgggctgcagggaagaaagaaatgccaagctgaactcgcaggtagggaggaggagaggtgggacagtgacaggtcactaaagaaaaagcattctgagaaaagcctgtgctccttacggtatgctgcaggggctgagcctgcgtccctgctgacaccctctgggaacccccatcgcaagcctcaccttgttgcttctcactggggccgttttcggttggcgctgcttctctttgttctgttgtcccccagtgcagtgaacccttacattatgggtttctcttgtagttctaacctctaatactcaaccattacatcttatctcgtcttctaaattactctaaaatccaattataaaaccctctctccttcaagagcacacaacttgccacattactgaaatgctgggctgctcttttgtttttctaaattaataataactataccattttccgtctgctcttaccatgggactcttttatatcaccacataaaatgcatattatgattctttttgcttcttttctgggctgcaaaaaagcgaaggatgattttccaaatattcataaaagatctgtcagttggtttttagtgtaaaaacatttgaaactacaatccttaaagaagaaagcatcttaatatttatcagttaaaatttcactattgctttcttttgtatgggcaaaatagaagtctatcatttttaaggttttaagagatttgaatgaattttatgtgttagttaaaatttttatggattgaaaacgcttagtttcactaagatttcaaaagcacaaacgatttttaaaatctaggtcccctcgtgagtttcttgaatttacaggagggcagtgactattcttaaatatagattcaacttctataagttatcaaaatatttcaggaagagagaacatgcccagaacatataagaaaaagctttaacagtatcaggaatatcctcaaacactttttctgacaaaagacaaaactgggttaaaatcccatataccatatatttagctatctgactctgggtaaattatttaa

SEQ ID NO: 473321 - DNA, 498 bp, Homo sapiens
taatgaatggtcaagccacactcatccagctgtctgcagcttctggatgaggaaagtgaggcacacagagaagttacataaactgctgaagataagaaagttgtcagtggacccaggattcaaaggcaggcattctgccctcctgaacatactctatgccagcttcttatgtgataaaaacaaggatgtgtttgttagtgtttttgtactgttacatcaagtactaattcaagaaactctcagttgcctcttatatactggacttgaaaatcttctggtcccaagcattttggataaggaatactcaagctgtgtaagatgctttgggaagccaacacagatagccaaatttgctcagtgctcccctgtgcagctgctccacagctggtggctctccggtcacctccccccaccacttccctgttgaagggggcctggggagagtcagaaggtgctacatcaatgtaagacatttcctccctgcccctcagctgtgcc

SEQ ID NO: 473322 - DNA, 1317 bp, Homo sapiens
cagcacaccggcccatgagaccatacagcatctttgtgcaaactagaaggaggcccatcccctgggcagaccagccccagggacacacagctgggctcatgcacagtgtctttgtggaaatgatcgatgaaatattcagatgtgttacagaatgggaaactgtggcaaccagccttgcagtgaccctgtccaaccggagctccatggagccccaggagccctatctctgcccacgatgtcagcactgcccctgcacagcagggcccagtggtggcctgagagggagcagagagccccttagtgggaagggacccttagattactctgctggggtgaagaactgcacccccagcccttggccccagctcccaccccagctgggctgccggtactctgtcctggggttgcttcctgcctctcgggaacacaggaagccaacattgttgggatctaaatggccttttcctcctggacttgggtcggaaaatgagcacatagcctcagtgtgcacctgaccccggcgataaccactcgcatgcccggtccggcttcagctccttccatggccggcacagaggcacaggcctggccacctgcctgctcaccggccactcaccctgccctgccagttcatctccaggacctgggctggaggtatgcagtggttaatttaatgaatcaacttgtctaggccacggtacctagatattcggtgaaacactattctggatgtttctgagaaagtcggttggttttattttttagatgagattcacatttaaatcagtaaactatgaataaagcacatgaccctccataatttaggtgggcctcatccaatcagttgaaggccttaataaagaaaaccaacctccccaagcaagaaggaattctgccagcacacggctctggactcgagctacaacaggcaggggtaccccacctgccaacctaccctgcagattttgaacctgccacagctctacaatcacgtgagacaattccttaaataaatctctttttttctacacacatcctgttggttctgtttctgcagagaaccttgactgatacaaggtgtctcaggggatggtcgggggacatggtgtggctctgaagtaagaacaggaagaaaccttccagatcaagcttgtccaacctgcaggctgcaggccacatgtggctcaggatggctttgaatgcggcccaacacaaattcgtaaatttcttaaaatattatgagtttttttttttgcaaggcaggggggcacataagatggtttcttatatgcacccaactctttctttcttattttt

SEQ ID NO: 473323 - DNA, 1324 bp, Homo sapiens
gtgcctatccacctgtctcacatatcctcccaaggggcagtatgtcctcctctctaacgtgcatccgtcttgctgtaatctcaagtttgggcctgtcaatctgctggcctctcactttcagatcgatgaaatattcagatgtgttacagaatgggaaactgtggcaaccagccttgcagcccgactaagacaccccccaccaccaatgccacccaccccttcctcccttcaactgagaaaggggaaaaacccaggttccaaccctgggaacatcagacactgctggggagacagccagtcttgaccctgtccaaccggagctccatggagccccaggagccctatctctgcccacgatgtcagcactgcccctgcacagcagggcccagtggtggcctgagagggagcagagagccccttagtgggaagggacccttagattactctgctggggtgaagaactgcacccccagcccttggccccagctcccaccccagctgggctgccggtactctgtcctggggttgcttcctgcctctcgggaacacaggaagccaacattgttgggatctaaatggccttttcctcctggacttgggtcggaaaatgagcacatagcctcagtgtgcacctgaccccggcgataaccactcgcatgcccggtccggcttcagctccttccatggccggcacagaggcacaggcctggccacctgcctgctcaccggccactcaccctgccctgccagttcatctccaggacctgggctggaggtatgcagtggttaatttaatgaatcaacttgtctaggccacggtacctagatattcggtgaaacactattctggatgtttctgagaaagtcggttggttttattttttagatgagattcacatttaaatcagtaaactatgaataaagcacatgaccctccataatttaggtgggcctcatccaatcagttgaaggccttaataaagaaaaccaacctccccaagcaagaaggaattctgccagcacacggctctggactcgagctacaacaggcaggggtaccccacctgccaacctaccctgcagattttgaacctgccacagctctacaatcacgtgagacaattccttaaataaatctctttttttctacacacatcctgttggttctgtttctgcagagaaccttgactgatacaaggtgtctcaggggatggtcgggggacatggtgtggctctgaagtaagaacaggaagaaaccttccagatcaagcttgtccaacctgcaggctgcaggccacatgtggctcaggatggctttgaatgc

SEQ ID NO: 473324 - DNA, 579 bp, Homo sapiens
catctggatactcaataaaggttgcccaagggatggctggatgaatgggtcaggattctcgggcccagagcaggctcctggtctcctctggtctcctgtctgcctcctttctctccttctgtcactctcgtgttccatctgtgtcttcttgtgagtctgtctcgtccactcctcgggagcctcaagtcacttttctaccctctttcttcccccaaaaggcaggcgctcactctccctgtgcctattcctctttctcaccaggccacctgccttcctgggtgttgagaagaggccagcgaacctggctgcttctcggtggttccccaggcagctcaggggtcagcgttctcaggcttatgattcctatttgcctgtcactccccggctcccagaattttgacactgttgtcagaggaatgagggcctccttccagttctggcaccgccactttctagctgtgtaccatgctaggtactagggatgtaggcatgaacactgacaagggcctctgggactggcattctggtaggaaaagggggacctggagggaagacggactgagcacctaccaggtgctg

SEQ ID NO: 473325 - DNA, 634 bp, Homo sapiens
agtggactctctgccctcattgccccatctccagggcaggggcaggcttggacttgctcatgtcccgctatcccgtgctggcagaacacagaagctttgtgtggtcttccaggatccccttgaatgcgcgctctgctgactatagtgccccagggttggaggaagaggaaggagaactagagaaaggtgcaagaaagctccagggtgggccttctcagcacttaactgctattaaagttcaaccttcctcagcaactccctccccttcatcatcactgagttctctcacctgtgggtcgcaggtgaaaggtcgatgcatcgcaatcccagcagctgcctctgcttccttggttcctggaaatccagcaacatctctgcttctcttggctgaggttcctttacccccagggcactcaatgagccagcttccaagtccctgccttcatcctttccccatttcccctagcccagtaaagccctctgtctgcgcccctccatctgaagaccttcgaggttttcaaggctggtccaatccagtctgcccccagactgaaggtactttagccagactgtagaaggcagctgcgcagtggtaactggtttagaaatttccctactctgcacaacaggcctc

SEQ ID NO: 473326 - DNA, 711 bp, Homo sapiens
ccactctaggctagctttttcacaagatggcaccaaaagcgaagaaggaagctcctgcccctcctaaagctgaagccaaagcgaatgctttaaaggccaagaaggcagtgtcgaaaggtgtccacagccacacaaaaaacaagatccacatgtcacccaccttccggaggcccaagacactgcgactccggaggcagcccaaatatcctcggaagagcgcccccaggagaaacaagcttgaccactatgctatcatcaagtttccgctgaccactgagttcaccatgaagaagacagaagaaaacaacactcttgtgttcattgtggatgttaaagccaccaccaagaaccagatcaaacaggctgggaagaagctctatgacattgatgtggccaaagtcaacaccccgattcggcctgatggagagaagaaggcatatgttcgactggctcctaattacaatgctttagatgttgccaacaaaattgggatcatctaaactgagtccagctggctaattccaaatatatgtataacttttcaccattaaaaaaaaatgtatatatattaaactgtatttgctattctggaactgctttttctcacttagccatacaattcagacatctttccatgccagtacacgtatattcatcacaatttttaaatggcaatataatattttataagatatgtacaatagttccccc

SEQ ID NO: 473327 - DNA, 547 bp, Homo sapiens
cctgtatctgccagcaggccaccttctgaagcactaagatgcccaggcctcgaagtcctctgcacaagtcagcaggacttgtccaacagccacccttgactcttcatccacttgctccatccactcacaacaggtctggtttcaaaaagaacccacacctccccgcccttcctggagctcagaaaatgagcttccagcctccaggtttgctggcctctgccagagcccatgccctgtgggcacatgtgcctgaaggaagccgggcccctggtggaggtgccttgctaggggggagagggcatggatcatatggcattcagaggctttttcagtgtaaggaacatggctatgcttcggtcagcgatagccccagagaaagagttaagctgctgaccctgaagggaaagccagcagcgcagctgtgcatgggagcagccagatcaagcagctgagacagagcagaccgtgtaagagagctgctgatgagagagctgctgaataaagctgtatctcacctacctacagctccttaagtgttctttcagct

SEQ ID NO: 473328 - DNA, 704 bp, Homo sapiens
attatgactgcctctactatgtcatgcaggctgtcagggcagtaggggaaagccggcagtcacaggcctcaccaagctcccatgtaatccgaagggccaatctcactcccaccatgcccctgccaacagcactaagtctgtttccaggcagtggctggagatttccttctttctgtggccttttcccagcacctctggctgccctgcagaaggacccctgtgtggccaggcaaaaacggcttgcttggggacctagtgagttcccagggcatttcccgctgcttcctctacccctgtatttcgctcagctctctaaattgactcagttccagagatgtacctctacaaatgtgtcagagaagaagaggagttctccatgtgaagaatggtgggaagagtgttccaggctatggaaacagcatctagagaggtcctggatcaggaaagagcctagacatacaaggaaatggaggacagacaatgtgggtagagcagagtacaccaaaagtggaattagagatgatgctggagcaggagggaagaccaagccatacaaagccctaaaaacagaccagggaattggttaagaggagtcctgtttataatacaccgtgtaccctctttgcaggcaaggtctcatttaatttatttttaaaagtttggaaagataaagaaatcaaaatacactgctagcctcatttatt

SEQ ID NO: 473329 - DNA, 1930 bp, Homo sapiens
tgcagataaaaagtctctcaggtgttgctttaccagccagaaacctctgtggtcagcagcaccttctgcctgagtattgcttgcacccactgggctcgttctgcccactctgtccggcaggctgtactcagctcacgctaccagccaggatcccatacctgctaaacgcaaaccaggcgcagagctgcgaggattgtgtaggtgagcaagcgcggggtccacccactgtgcacagccaggcgtgctggctgctgcagcagggcaagcagctccaggtgccagcacaggccccgtgcaaggctgtgactgaaccagatatactgcacgcagcttctgctgcaggcacccgtacctggacaaggggaatgcagtggcacctggaagcctggaggcagcaggaaccgtagaaccccaaagagggggtcgcagtcctggctcggggcgcccctaggtctgggctccccagaaggctgcagctcttcttctcgttgcgcaatttggagcaggcaccaggagtggggagaggccaggcagtgggagcaggcacacccaagactgtggggggcagggggccttcctggtcgctgagagttcagggatactggattccacatctgcgactgggcagctgcagctgtgccccggagggcagggctcccacccttccaacaaaaacggggcagggctcccatctgttcttggttccctagctccaagcggcgtgcagccctgaggtaattgaatcattggggcaggtctttcccgtgctgttctcatgatagtgaataagtctcatgagatctgatgattatataaaaaacgggagtttccctgaacaagctgtcttctcttgtctgccaccacgtgagacatgcctttcaccttttgccatgattgtgagggttctgcagccacgtggaactcctgctgcagaaatttgcctaagtattgaggtgccaaatgttaatcatgaagacaatggagagaatgtctccaagacctgtcagagaccttcgtggcagcccctctcatcacaggcccagaggtttaggaagaaaagatggttttgtgggccaggcccagggtccccatgctgtgtgcagcctagggacttggtgccctgcgtcccagccactccagctgtgactaaaaggggccaaggtccagttcaggctgttgcttcagagggtggaagccccgagccttggctgattccatgtggtgttgaggccgtgggcacacagaagtcaagaattgaggtttgggaagctctgcctagatttcagaggatggcagtgcagaaggggaatgtggggttggagcccccacacagagtccctactggggcactaactagtgcagctgtgagaagagggtcaccatcctccagaccccagaatggtagatctactgacagtttgcactgtgtgcaagagaaggaaagggcactttctataaatccagatgtggactacacgccctctgaggacagggcaaagtacgggtggttcttatggaccaaatgtggatcctgggtccctcttggatccttccctagaaagaccatgggatcccaaaagagaggtggcctgaaagatgacagggagcgaagaggagctggagacaacatagtgagggccggggaagaggaggacagccacagtgggaaaagaggaccagaagctatccatgacttctccccgactgtcggcttcccagcctgaagcagctcagagctgggagactgacagaagctccaaatcaggtaaggatgtggagttgtgattaagacactaatctaactatttaattactaaaatatccctgataaaatcttctgccccaaaacttgcttcccctgctgaattcctcacttcacctaattgcaactccatccctccagttgctcaggtccgcagccatcaagtga

SEQ ID NO: 473330 - DNA, 983 bp, Homo sapiens
cactctgtaagtgaggaaaccagggtccaggcagacatgcccaaggctgccccatgcttttctacagcttagtgcgtttgctcagatgctccaatgctccttattggattttattcccaaaggaatcttatgagagaaaacatgtgtgtagatgtggatgtggatgtggatgtggatgtggatgtggatgtggatgtggatgtggttgtggatgtggatgtggatgtggatgtggttgtggatgtggatgtggttgtggttgtggatgtggatgtggatgtggttgtggatgtggatgtggttgtggatgtggatgtggatgtggttgtggatgtggatgtggttgtggatgtggttgtggatgtggatgtggatgtggttgtggatgtggttgtggatgtggatgtgggtgtgggtgtggttgtgggtgtggatgtggatgtggttgtggatgtggatgtggatgtggatgtggttgtggatgtggatgtggatgtggatgtggatgtggatgtggttgtggatgtggatgtggttgtggatgtggttgtggatgtggttgtggatgtggatgtggatgtggttgtggatgtggttgtggatgtggatgtggttgtggttgtggatgtggatgtggttgtggatgtggatgtaccatgttccaaatggtgcttgttattttctgtactcactacctgtagccctcacaagaatcttgaaaggcaggaaacgtaagattgttcccatttcacaggctccatctggataagtaacttgcctaagcctacacagctgaaagggagtggggccagggttcataatcaaatctgtttcatccagaagcccctactttctcccttgctctttgatgtctgtgtctttattaaatatcaagacaaataatgttatgaaaagcagcatacaagttcaaagaagggagggatggtagggtagggtctcctctggtgggggtatcggatttc

SEQ ID NO: 473331 - DNA, 715 bp, Homo sapiens
gagacaaggtgagttcagtcgcagcgtgttgcctaggccgttggactgccatcgggcaagtcatgtacccggaggagggaggatgtgacacatcaaacatcaccacatcgggaggcacgcacgcatggactttctggggcttctgggtcaagatgtttgactgtgattttcaaaaatcctttgaaatgacaacaggctttgcctcccagaaactccttaaaaggatagtaaagaggcttaacagggaggatggagacaaacccggtgcttggaacaaccgtcccatatctacaagagtgatcattttcatccagggagaagctgataatggcagaggattctaccccagccactctttgttattaatcagcttagaccttcatcaaactatgaatgaaaacaaaactcacaggtcacctgcagaaaacagtacaaaggagaaggaacaatacgaacacgaacaacaaaagatcccagagaaaaaagaaataacttagggaatgaaagaaaacattcaaagtaattacaattagtatcctcaaaaaaaaaaagagagcaaatattttctcagtaaaagtaagacaaactgctaccaaaagggagaaatcagagaacaagaaagagttggttgaattttttttaaaaaagctattaccaaaataaaacaacaacaacagaaaggcaataagaaaaaccatgaaaaatctcccagagc

SEQ ID NO: 473332 - DNA, 734 bp, Homo sapiens
gcaaagaggcaaggagagaacagagccagacctggtcttttcctttgctgctttcattgcaatttgcaacagtgtcttgtgattctgcatctgattaatgcctaagaccgtcaggctcctgcggacggccaccccagcctggggaaagcagctgttggatgctctgcaggatgtctggaccctgcccttgtgggaaaacgacagcagcgtcagcaccaataacaacatctcctctacacatgcaactgatattcccctgttttcacaatgctttggcgaatgcctactttctgaacgtggtactggattccgctggctaacgttttgcttagcatcttctgcactgatgttcatgagtggtgttagtgtgtatatctgcaccatctttattaggctgagttatcaatgtaatatcaacgcttcatcaaatggatttaggatgtttttcttcacattcagtgctctggaaaaatctgtgcctacatcaaccctcagaaaaatttgaagtcagagagtgcccctgcttcaaaataactctcttatatatatatatatatatatatacatatatatattttctgtatatatatatatatacatacatatatatattttctgtatatatatatacaaacacacatatatatttcctgtatatatatatacatacatatatatcttttctgtatatatatatatacacatacatatatatatatatatatttttttttt

SEQ ID NO: 473333 - DNA, 1414 bp, Homo sapiens
tttctggaatacatggcaggttgggaatacctgccaactcctctgacaaggacgggattgaggctgcaatggggcttccccttcttgagtttttcagtcttgaggtaatcaagttggtgtactttgaaaatcaacccatgcagaataagaaccttcctggagaagagaccacacccccggtgggcctccgccaaggcactcagttccctggcatcggtctgcttgttagccacggtgccaccccaccccaacgagaggtgcttctcagaagtggtgcagcacccccaccctcacccccacccccacctccaccctcacccccacccccacccccaggctgtctcctcacatgcttactcccaaagtattctggagctccactgagcaccgagctgggggagcagctcaggggtgacccgggaggccatgttgtcttggggacatttgcatctcacatgtcccaggatgcaagtgtgaggcccctgctgtctgtgctcctgatcatctgtaagccctccaccaatgaactgatgccaactctggctttgagctaccagaaccaatgaactctgtgtccaagaagtttatgtgaatgtctctctttttgctaataataacttccccttactccttttccctcactgggtgcacctgtgacttgtcatagtgtattacggattgtaatcctcttttctattcccctccaaattcaacatatttggagacatttttctctgatgtctttttttttttaggttgacatactttttcaagattgttttgggtattctggggcccttgcatttttatgtgaattttaggttatcttgtcaatttcagaaagaaagcagctagaatttttatagagattgtattgaatatgtaggtcaatttggagggtattgccatcttaacaatatgaagttttataattcacgaatatagaatggctttccatttatttagattttctttaatttgttttaatgttttgtagtttgtagtgtacaagccttgcacttttttcattaaatttattcttaaatattttattttttgatgctattgtaaatgcaattgttttcttagtttcaattttggtttgttcattgctaatgtataggagtacaattgcttttgtatgttgatcttgtatcctgcaaccttgaagaacttgttattagctctaatagtttctttcatggattcatttggattttctatgtacaagatcatgccatctgcaaatgctgatagttttacttattccattccaatctggatgtcttttatttctttttcttgcctaactggcatagtcagcccttctagtataatgttgaatagaagtgccacctctcaaaagagagctcttaaaacgttcatcttggtgcattttaaaaacaacgtgggg

SEQ ID NO: 473334 - DNA, 544 bp, Homo sapiens
gtggagagtgacagtagatgaggctgtgtaggtatttccgaatgcttacaatgatgtgctttccttcagagatacttcatattagttccacaacgtgcctgtcggcactctcaggcaacaagtcaggcccttcttctgcaggtctgctggagtttgctggaggtccactcctgaccctgtttgccagagtatcaccagcagatgctacagaagagcaaagattgctgcctgctccttcctctggaagcttcatcccagaggggtacctgccagatgccagccagagctctcctgtatggggtgtctgtcaatccctgctagatgccctgcccagagaggagaatctagagaggcagcctggctacagtgctttgccgccagtggatcttagcttgctgggctccataggggtgcgagctgctgagcaagaccacttggttccctggtttcagccccctttccaggggagtgaatggttctgtcacattggcattccaggcaccaatggagtacaaggaaaaaaatcctgcagctagctcagtgt

SEQ ID NO: 473335 - DNA, 537 bp, Homo sapiens
ggatttactgatccactggtagcaaagctgttaagtgtgcaatgagtaaaataaatataaaatcatggttcttggatcaattcattattgcaactacccagatcaaaggttattcattagaatcatggactggaggctttctggtttgctggaaagccccaagtagagactttgtccagggacttacaggcatggacattgatttctctttccaggtgaacctgacagctatactttctggagttcttggaactcatgccgacaagaagatgatgtatgtgtttgtcggagagaggcaggacagcaggcagctgctacttgttccaaccaaacctcatgactgctacacaaagatggaagatgttatagcatgtacatacacatatgctgatctgaagactcccagtaaatggagggagtctcttcttccaactgaacatctgtaagccagcggttgcttcacataggctcctgctgcggtttcttattttcttattagatcttgaaggttgtttaatgaatttgatttcatttggc

SEQ ID NO: 473336 - DNA, 924 bp, Homo sapiens
cagagctgcaatttctattttaatgttagaagacagaaagggacaggaagtttttaaagataactctagtactggtgtgaagagtgaaaagtgtggagaaattggagtaaagaagccagccaaaacctaccaaaaccaagatgctgccaagagtaacctctggtcctcctcattgctacactcccatcagtgccatgatagtttacaaatgccagaaaactgccctatatggtctaaaagggagaggtatgaatgtcaggaagttgccctgtatggtctaaaagggagagctggaatgcacaacgagatcctaaaggctgttccaccatgttggaaggacactggtccctatcttaggtcttttggtggggccttcacaatatcatatcccatgagggaactaagatataatagctattattcaggaactagagagggtgggacttgtgcctcttgcacagagcccattcaacagccagatatggcccatgtgaaaacccaacagcatctgaagaatgacggttgatgactgacaactaaataaggtgactccagccatgcatactactctcccaaatgtggctcaaagcctggaaagactgactagtttgtagccagactgactagtgttcagtgcatgggatactgtcttggatttagcaaaactttatttagcatactcttagacccaaagtcccaggacctgattgcctttacctgggaggacaaacattggtcctctcaggtgctcaggtgctccccagggacacttacctatccccatgatttgctgtgatttaggggcaagagaccttgccattttgggtgacaagtccagcattcactggaaacattacgtgcatgatattctgctaaagtttatggatttaagtcttttgcagaaggctacctagaacgtcctag

SEQ ID NO: 473337 - DNA, 765 bp, Homo sapiens
tccctcagaggaatccagcctgatcgatgctgtttggaaagccgaggtctacaggtttcccaatgtcaaagacatgtcaaatgaatgaatggatgaaatacgttggtgcttggtatccctattatgagatgctgcacttggtgagggttgggaaagacacaccagtggacagcacagtgcttccttcctctccaaaaacttgtgaaatgagtgggcatgacatcatcacaggactggaggacatcaacaatgtcaggggaatacagacctgtcccctgtcctgtgggagcttaaatctcatgaagaagacagacaaagataatataatgacccagataaaatgtaaacttgtggaaagtgtagggaaggagagagctgtgtttgctaatgagacagaagtgactttctgggacttctgggaatccctgcagcttgcaactggaactcttgaatggaacacttgctcttggagtcctgaggggccattgaaggtatccaactactctgaggctcccatgctggagagatcccagaatctgcccgcataggtaaaaacatgctcccttcttgtcattgaattttaagctgtggacacaagtcttatgagttcatctataaacataagcatagaaagcagtagaagccacacctgtggtgaggagctctccatatggggttggtaagtaaagcaataatcatgggtatgctttctgagagaaagtatagcagaaagtagaacaaaatcttgggggaatgcccacagtt

SEQ ID NO: 473338 - DNA, 791 bp, Homo sapiens
aaactaagttgtcattggaattatagcccgcaaaaaatttccacatgttgtgggagggacccagagggaggtaattgaagaatgggggccagtctttcccatgatagtgaaggaatccagtgtcagctttctacatatggtgctctgtcccagggagatgggagttttatctctaaacccctgactggggctgctgctttttctttcagagatgccctgcccagagaggagaaatctagagaggcagtctggctacagctctctgtggtgggctccgcccagtttgaacttccctgcggcattgtttacactgtgaggggaaaactgcctacccaagcctcagtaataatggatgcccctccccccaccaagctccagcatcccaggtcaacttcagactgctgtgctggcagcaagaatttcaagccagtgaatcttagcttgctgggctccctggggctggaatctgctgagctagactacctggctccctggcttcagcctcctttccaggggagtgaactgttctcgctcactggcgttccaggcaccactggggctgcagcagtcaatacttttgaatttaagtgcttttggcaaatgctgcccaagatggcacccaacactgggaatgctcaaagctgagtgaaataaagacaagcctctacaccagcccttcagggagctgccaaacaggtcaaagcacacaaccacagctcttaagaataagctctgaattgctccctctaacactagcaacctgtactggaagtgcagactgccatcttcac

SEQ ID NO: 473339 - DNA, 682 bp, Homo sapiens
gtccaggctgcaaattcattgggtaacaaatggagacttgcattttatttgtgtgtctgacatttggacatgcaactctgcatttggttaatcataagacttttgctggtgaaaacctattaacatccagcagaaatggtgtttcacagaagatgtttgggaaacactgtattagaggctcttcctttgggctgtttcttttcatcctggattttgaagaagacaggaaaatgtgggaaagtttggaacttcctagagacttgttgaatggctttgaccaaaatgctgatagtgatatgtacaatgaagtccaggctgaggtggtctcagatggagatgaggaacttgttgggaactggagcaaagatgactcttgctatgctttagcaaacagactggcagctttttgcccctgcttaagagatctgtgggactttgacctcgagagagatgatttaaggtctctggcagaagaaatttctaagcagcaaagcattcaagaagtggggtataaatgtttttggaaaatttgcagcctgatgatgtgatagaaaagaacaaccctttttctggggagaaattcaagccagcttcaaaaatttgcataaataatgaagagccaaatgttaatcaccaagacaatggggaaaatgtctccagggaatgtcagagactttcatga

SEQ ID NO: 473340 - DNA, 919 bp, Homo sapiens
cgaactcactttctcagggaaaagataggcgagtggggagctgtggcctttctcgcccgaggcttgcatctgccggcagaagggtaacagacgatgccgcgcagccggcgctgttccaagcagctccacctgcctgccgccatctggatcaagtcgaccttgatcccaatcgggcgggagggaaattggatcagtaggctctttctatcaatcttggagaacatcaccgcttcatcagagcagataaaaacaaaggcaggtaatgaacacgaagccgcagaagcagccccaggcaagtctgctgagagaaagaggaaagtcaattcccctaacagactgggctcaccttgacggagaactcagtggaatcctagacctcaccctttcccagactgattacccatgctccttggggcagggattggtggtctggatagaagatcaaaccagccacaacattcccttaagccaaagcctgatccagagcaaggccttaactctcttcaagtctatgaagactgagagaggtgaggaagctgcagaaggaaagttagaagttaacagaggttggttcccaaggtttaaggaggtcaaaatatcaacattaacaggagtttggaagaagttgattccaaccttcatgaatgattttgaggagttcaagacttcagtggaggaagtcaatgcagatgtgatggaaatagaaggagcactagaattagaagtggagcctgaagacgtgactgaattactgcaatctcacgagaaaacttggacagatgagaagatccaaagctggtgggtgagtgggtgggtgtatagaagatgttaggctgccactgagaattgcttgccaggaaccttgtaagggtcatgggaagttagttactaggcctaggttaatgctgaaagatgctgt

SEQ ID NO: 473341 - DNA, 978 bp, Homo sapiens
ctcacttcaggctctgattcctcctatgtgtcatggtgagaatggacatagtaagaaaagaggaggagtgtgggttctttcaggaaaccaacagcaggttcgttgaaaagatcaacgcagttgacaagcctatagctagacaaagaaaaaaagagaagatgcaaatcactaaaatcagaaatgaaagcaaggacattacagctgatcttctagaaattaaaagaattataactgagtactatgaagagtggtatgacaacaaattagataatctagatggaatgaacgaatacctgggaacacacaaattactgaaactgactcaagaagacatagaaaaatcaacaaacctgttacaatgcttggaagtggaattaccacttgtttatgatcaacagataaaactaagcaggggcctcaccaaagcccggagtgatgtcaagaaccacggcaggtgttattcaggaattgttcaaaggggggaaaaatccattcccatgaggcaggtgcatcagagagcattgacactcagtctccctgcagagcattgcgaagctgatctcagacaaacgcagcccatggaagaatgctaagtgctcgtgattggttaaaactcaaataaaaagttgaagtggagacgatatatacctgttccaaaatacagatcctcatttgaaaatggaaaaagaaaagaaatggaggcattgtgtgatatttgcctaaatataactaaagagatccatttatttttagtgtttgattaaaaaccctcaaaggaaaagagaaattttgatctttgagaagagctgtttcatcacaggatgccaccaggacccatttctggcaacagggagcacgaaatgatgcctccaagtgtaagatagaggcttctaggcaggaagtgatggaaaagggctctcttatgaggaagggtactgtggggtgaggggatattcattgcatggcaaagaaagtatt

SEQ ID NO: 473342 - DNA, 1432 bp, Homo sapiens
tggatagctgagctcgtgtgcaaaagagagggcacagccgttatctggtgtatctaaagatgaggtctttctagctggcatatgctctggaggaagggagattttacctcagcgtcaactcccagggagctgactcacacagagaaagtttccggtagtcttttcccgtctctctgctgcagaatcaaggaaaccaacagcaggttcgttgaaaagatcaacgcagttgacaagcctatagctagacaaagaaaaaaagagaagatgcaaatcactaaaatcagaaatgaaagcaaggacattacagctgatcttctagaaattaaaagaattataactgagtactatgaagagtggtatgacaacaaattagataatctagatggaatgaacgaatacctgggaacacacaaattactgaaactgactcaagaagacatagaaaaatcaacaaacctgttacaagtagggagattgaatcaggatgagaaaatcattctttagcggtagtgagtggggtggactcttttaaattcgggacacattttccaatccagggaattcgtatgtaaggtgaaaactatttgcaatcgtagaggaagaaggaacgcaagacggtggaagcatgccaacctattaaaccgcaagtcagagatcaaaccatgtacttgaatctctcaagttcccggcttaaccctcttccaagtatcctcatttgaaaatggaaaaagaaaagaaatggaggcattgtgtgatatttgcctaaatataactaaagagatccatttatttttagtgtttgattaaaaaccctcaaaggaaaagagaaattttgatctttgagaagagctgtttcatcacagggtgaagttgtttcctgagccctttgatctgaaatgaccttgcgacctggaaccagcagacagcctgagggaggcagtgcatgttctgagccagggcctcaggaggcctgcagctgccattctgcttctgttggaacatgacctccttgagaacactcccaggcctgactgcagggtggggagaccacacagagcagagccgagccaccgggatgaggcccctagatcacccagctcccagctgaccacagatcatgagtgatcccgtttctccctaggtcaagggtgatgttttgctcagagaaaactgaagtttggattgttccagtcctgcatcacatcctgtttcaggctgccctaaaacaaaaccagaaacaaccatcaccacaaaacaccataccttcaatagtcttctcagtgttcagaataaaggctctggttttcccttgggctcaattttcatgattgtgtctcctttgtcaatatgtttttcatcttcctcactttcaaactgcacttcctgtccagaaacactaaaccaaaagttgtatttaacttttcacacagaa

SEQ ID NO: 473343 - DNA, 681 bp, Homo sapiens
aatcaacaaagaactatccaaccccaaagatcaaactgccaaggtgtaggctatggtgaaggtttgattggggcagggatgttggaaggctttgtcttaggacccagtggtggcagcagtgagcagatcacgcctgaccttggactccagatactgtgttacagagacagtgaagaatttaagatgcagaagcagattgcctttaaaaacttatgtgataaaacccagatggaagaaccatgccaatctcggagccctagcaagattcacaatacacatgggcttagagcaccctccagtgctgagacagctgcagtgtccgtgggctcatggaacataacagtctgcttagaacctctggaagacccaccgaagaaggtcagacacaaacaaagccagaatatgaatattaaaatatggaatccctccatgtggagaacatattgcatgtccataagcataaagaactttcagagaaatgtgacctcaccaaacatacagaataaggagtcagagactgaccttaaaggtatgaagatatgtgatcttgcaaacaaagaattcaaaatagctgttttaaagaagttcagtgagtatcaaggaaatacagagaaattattcaagattatcagagaaatttatcagagatattgaaataatttttttaaatttaacagaaat

SEQ ID NO: 473344 - DNA, 1010 bp, Homo sapiens
ttacccccgacaggccccagtatgtgttgctccccaccatgtgtctgtatgttctcattgttcagctcccacttatgaatcttagagaaaaggctgttagttttcctccactcaggatgatactggctgtgggcgattttttatatggtgtcaattgttattccttattgctctgtgcagcagaggatcctcactccacggccactgccaccacagttccacagggaatactgccaggctaccaccaatgttcaatcaaggcccaaggtcccttcagtcagcttgtggtgaacgttaccaggcctaggtttacccttcagggcagtaagcttgccctcttgtccaggaaaggtccagaaatgtcatccaagagccagtgcttggcactggtgaccctaagagaccacttggtattctgccccattgcagctgccagacaaagtcactttactcttctctctgcttttctcaagcagaagcagtgcctccccatagccaccacagctgtgaatatgatgagtgacacctgaagtaagcacctctcagagtgtcacctaaggcccatggcatgtactaactgactaatgctgctgattattcagggcccaagggctctttagtcagtaagggataaattctgtcagaatgtggtctttcccttcaaggtagtgggttttcttcttgtccacggtaagtctttctatgtggctacatcttaataccactgctttactcgtatatttaagcagaaaggattggacatcccttttctgttttggtgggctggttccagaacactatataatatattagagccatgagaggtgttaaaatccttaaaatacagagccacaatccctctctaataggtttgggaaatctctacctaacaggagataacaaagtaagcagattcctgaatatcacacttgcttctcatattttcctgaagaatgtggctgaaataaatatcaccaatgaccattataggtttcactttattagccatc

SEQ ID NO: 473345 - DNA, 671 bp, Homo sapiens
ccatatgacccagcagacacaatggcacttgaggtgtcattggcagataaggatgctgtttggatcctttggcaggcctccataggtgaaccacagtggaggcctctaggatttgggagcaagacactcccatcttctgcagataactgctctcctttagagagacagctcatggcctgttactgggctttggtggaaactgaacgtttgactatggatcatccagtcatcatgcgacctgaactgcctatcatgaactgggtgctttctgacccatccagacatacaatgggtcatgcacagcagcattctcctgcactgatggcctcatggggagttccctatgatcagttgatagaggaagagaagactatagccttgttcatggatggttctgcacgatatgcaggcaccacccgaaagtggacagctgcagcattacagccccttactaggacatccctgaaggacagcaatgaagagaaatcttcccagtgtgcagagcttcaagtagtgcacctggttgtgcactttgcatggaaggagaaatggccagatgtacaccagtcaaatgtaggttaggtcttttcacatagtcccatatttcttggaggctttgtttgctccttttcattcatttttctctgatcttgtcttcacactttatttca

SEQ ID NO: 473346 - DNA, 2431 bp, Homo sapiens
ctttgatcatgaagggatgcttgccatgggactgtggctcacttcttcagtgtcctacggctcagacctctacggcagcatacagataggcaggctgtgtggctccaaccccacggcagtgtctaggggtgaatgtttacagctcctgaagccccagtggtttgccgtctataggcagcttgtgttaaccagctcaattagacccccttccttatcacaaggacagaaggaattcttagaagtagctctcagcagagaggggagccagaaaaaagatggttttcccctggagtctggccacctagcctggcggactgctctggccaaactctgcggcattctgctggtgaatggtctgccatcaggccgaccaggggctgtccgcatgcttccgccaggtgtgctctccatgatcagctgcttgtgtcttctgccaatgtgttcctcacaacgtccagccatttgtgtgtctgcctgctagtgtctcgggtttttataggcccaggatgggggcctggcaggccagggtggtcttgggaaatgcaacatttgggcaggaaatgcctgtcctcacctaaggtctgtgggggtggagccctagccagagaccacccttctctacccagcacttcccttcccctcttcgtgccatttaaagggaccatgcttttcccttccctatagtcccctatcataatgactgagccttaacatccttattccataatgtgccattctcgaaacaaaaaggccaatagaaagggccaggaaaaaacacagtaaaataccgaaacttatcaagactcttcaaataaaagattgagtcctcaatttttaatgtgaataaagagagcagttctcacaacaatcaaatggttcttgactgtcagggcttgattagcattgcacaggatgaaggagacagaagggttgtgtgcacgcagggaacagagctcagagattctgaagagaggaaaggattatacttaataatggatatatttttgaactccttaggaatgttttcttgccttgtgactgcagagcactgtgggattttgccattctgtctttccctagggtcttatcatgagatggttacctaattagcacacagcacattcttgcctatgttctatttgcactgcagatgctttcatttcatacatcattcacaacctgcagcaattataaagtggtaaatgaccttatgcgataattacactaatagatctgtattgtttcatttggaagactgtttggagaaaataggtgtctgataagcacagaatggttgcagttatattctttctttaaatctgcaacagaaagcaagcaaaaagataactttcggtcataaaagttgcatcatatacccaatctgaaaaattcctaggtagagatttctctttagaaggaatataaactttttgcaagtatctcaatgttgtaccgttcgtttgaccaacaatatttggatttatcaattagcattggcattttaataaatcaatagtatccttatctgctagaatcaggaaaagagagattattatttctcctaaaactactcaaaaatcagtcttatactaactgtaaaattcagtggataagatatggttctaatctttaaagtggctgaaagctaaacaaattgcaattttcaaaggaagtgcacacataaaatatgaatgctaatatagaagaaaatgaaacaaaaataaatggtcagtgttggtttcttccttcctcactctcccactcatgcaatgaggcaccttacgaagttgtattgagatggtttttagaaagaatttgtatcatatgaacatactaataaaataacctaaaatttgtatagctaagtaaatacatatgttttctttgttaacttgatctcattttattgccttttaaattgagcccacaaaactctttacccacactttctggatttgttgcaaatgtgtgtgaacactctttgaagcttactctataatatattatttaaaatatactttagcaactaattaagtgtaataattttaaaacaactttctatacaagtctaatcttcataaaacatgaattatctacactgatgcaatttacaaaatactggcttagtttcaattttacttggtactgaccagaagcttaaaggtgagagatgcatcatagtatttttctgtaacttaaatcattgttggtggatgaaaacaataattaaaatgataaatgtgatagagtgaagaaaacactttatacttaggaaagatgtgttctaatcattgtatagctaatgcttcagtggatttgaaatgattaaacaagaaaaacttttagctgtactggtagtgatattctgttgaaaattccatcataatcatgatttgcttattaggtattctgtgttactggtttagatctc

SEQ ID NO: 473347 - DNA, 1279 bp, Homo sapiens
taggctccggcactttccccttgataactttttttttttcctgaaggaaactggtttgccctgatgccggaacagcacatttcaggttagtctacaccagcatttctccattagagatgaccgtcacctttcattggttttttcacccttgcttgccacagaaaatgcaaacatgcaaacaaatgaatgagggcatgccccctctaaggaaaattcaaatcctgtatgagcattcacgaagatacggtttggaattggaacttatgtttaaaagggaagcagagcataaaagtttggaaaattttcagcctgatgatgcgacagaaaagaaaaacccattttctgaggagaaattaaagcagcctgcagaaatttgcataagtaacaaggagctgaatgttagccatcaagacaatgaagattatgtctccagggcatgtcagagaccttcacagcagcccctcccatcacaggctcttaggcctaggagggaaagatgttttcctgggctgggtccagggcccctctgctctgtgcagacttgagacatgaaagagataagcatatatacattttatacatttgtatacatataaaatgccctttgtgtcactcatttctgtttttccttagtgtttaattcatatctgtctttcgtgctagtgaaaacagaaacatttagttcaaaatcactttttaattcttaaatgttcggtattgttttctgatggaatgaactgttcaaggtcacactgctactaaataaaactggtattttgacaaaagggtttttaatttcaaaacccattattttttatagtaacctattcagtttttttattatgtcatagaagccacaattatctctaaatgaatgcttcatatttacctaataacaaagcaatatagcatagaggtaaagaggacagactcaggaatcagatagcctggatttaaaacctgcactttctattggtgtgacctggtacaagttagttaactttgtatatttaaatttctccatttctaaaattgaggtaataatatctgccaaatatagtgttgaaatgggattaactgagttaatgcatatacaaaacaatgtaatggtttctattggtaagtactagaaaaatgttaacatatatgttacagtcatctagtatattttataaaggaagatgaagtcagaaattagatcttcataaaataagatttattaaaacatataattacaagaaatttagattataatgggaaaatatttttaaagtcatat

SEQ ID NO: 473348 - DNA, 2969 bp, Homo sapiens
gtttaaacaaacaaacaaacaaaaaaaggaacacaaaattatggttacagatatttcagcaagacgaaatgggaaatgtagaaaagtcaaagaggcagagactgaagaatttgtggtggaagtagcaaataggaagctggagtatttcccagagtggaagggatttacaaatgctgacagtacttgggaaccagaagactacttagaatgtcaagagttaattgaaacatttcttaactctcaaaaagctggcaaagaaaaagatgatacaaaaaggaaatgtttatctgacagtgaatctgatgatagcaagtcaaagaaaagagatgctgctgacaaaccaagaggcttcgccagaggtcatgatccagaaagaaaaattgccacagagagaagtggtgaatggatatttctcctggaatgggaatattcagataaggcagacttgctgcaggcaaaagagacaaacatgaggagtcatcaaattgtaattgcttcttatgaagagcgattgccttgacattcttgacgagaagatgaagctcaacaattgtttgcattgcattttacatatgtatgatatatatatatatatatatatatatatatatatatataatctggatcttggtttttttaatttactaatgtgaagaaatctctacattctaatgaaaaccaagtttgatatgtttgttttcaaagtagtattgggagatttgccaggagatttttttttttttgcatcaatcacattggttaatttcaacaaataaacgaaactttctgtagttgctttctttatcagaaaagaacatttgataccatggcatattttgtcctctgcactagagaacagcgttgttaatgttgagggaaacttccttagtcattatacaatcagtacttgtgtttaattcgtatgcctaagaaccattctgagttttatgttttgtgtgtttatgcttaaaatacaaatgtaaatggttttctttcttggtttatttttaaactatcatcaaaacaaaaaccatgggtatgcccatggtcctgggatgccataattctgtgcaacctaagaaataaatcacttcaagttaaattgaaatttttcctgaagtcgtaatatttcaaattacatagatgattctataattaactggataatttaaaagcatccacatcagaacacacatttctacctatattcatataaatgtgattctttgttttccaaatttctaaacggaagattttttattactaccaacaacctcctcacttagacaaggaaactagacaaatcttgctgttttaattggctaagcaagtgttagtcaaatagacatatttaaagattcctctaataagcctttcctttagaaaaagctgtaatccttgtgctgtattgattaaaacatcatgatttgtggaatgtctcagtcttggctcatggaaaactaatcagataagtttagaaaaggcagttaggacctgctggcataaatgggtaaagagacgtgtataatgtaaacaattgacctgcatgtgttttcctttacccaactcattccttacatgtaggctcatttttttcagtatttgggttactggtttagcagaagccaagaaaatcaacgaaaacaatacttttgtaataatcaggatgttatccaggtgtatattctttatttgaaatactggtgtacagtagtcaataaatagcttcacattcctttatgtatataaatatataatatgaatatttattattcatatatataaataatatgaatatatattatttatatatataaataatatgaatatatattatttatatatataaataatatgaatatatattatttatatatataaatatataatatgaatatatatatttatatataatatgaatattatatatttatatataaatatatatgaatatatatacaaatatataatatgaatatatatttatatacaaatatataatatgaatatatatatttatatataaatatataatatgaatatacattatttatatataaatatataatatgaatatacattatttatatataaatatataatatgaatatatatattatttatatataaatatataatatgaatatatatattatatataaatatataatatgaatatatatattatatataaatatatatatgaatatatatatttatatataaatataatatgaatatatatattttatataaatatataatatgaatatatatttatatataaatatataatatgaatatatatttatatataaatatataatatgaatatatatttatatataaatatataatatgaatatacattatttatatataaatatataatatgaatatacattatttatatataaatatataatatgaatatatagaatatataaatatataatatgaatatatatattatatataaatatataatatgaatatatattatttttatataaatatataatatgaatatatattatttatatataagtatataatatgaatatatattatttatatataagtatataatatgaatatatattatttatatataaatatataatatgaatatatattatttatatataaatatataatatgaatatatatattatttatatataaatatattatatatttatatataaatatataatatgaatatatatattatatataaatatattatatatttatatataaatatattatatatttatatataaatatataatatgaatatatatattatttatatagaaatatataatatgaatatatatattatttatacataaatatattatatatttatatataaatatataatatgaatatatattatttatatatcataaaataatatgaatgtatattatttatatataaatatataatatgaatcctat

SEQ ID NO: 473349 - DNA, 1292 bp, Homo sapiens
ggtggagctgcccaagccttgggagcccaccccttgcaccaagtcaggtgccctgcctagcagcagcattgcttttggcagcaggatttctgttggcaacagcccttcccacagccgcagccacacgagctgcaggtacggcggcagcagcagatcacgggagtgctgcagcagcctccacagcagccgcggcagcaggggcagcagctggagcagcagcccacccggtagcacctgcaggtggtgcagctgccacagccaccaccgcagccaccaccgcagccaccacctcagccaccactgcagccacaacttccacaaccacagcaacccatggtgtcagtagagaggactcaggtgaaagttggtacataagggcctcccccagcagaaggaggcatcagacctcctcacctctcctgagtcctcctcacttcacctgagtcctctctactgacaccatgggttgctgtggttgtggaggttgtggtggctgcggtggccgctgtggtggctgcggtggtggctgtggtggtggctgtggtggtggctgcggtggtggctgtggtggtggctgtggtggtggctgcggtggtggctgcggtggtggctgtggtggtagctgtggcagctgcaccacctgcaggtgctaccgggtgggctgctgctccagctgctgcccctgctgccgtggctgctgtggaggctgctgcagcactcccgtgatctgttgctgccgccgcacctgccactcatgtggctgtggctgtgggaagggctgttgccagcagaaatgctgctgccagaagcaatgctgctgctaggtggccggcctggttccacccctgcccaggagctgtgggaaccctcactgtctcctgctggcaaggctctgcttaaccccattctgtctaatcctttttctaacctatctgtcaccagcagatccccttggcttctgcctcatgtgccttgtgctttgtccttctgggatcttcctttgcccacacacggcaccaacttgcccagaccacacaatgtgaaacaaacgggcaaccgagcagccggtgataaccagataaagtcagagccaaccaggaaacttagtactttattattttgtaatgttcaatctttcctaaatagtcagtcctggatttcaccatttttctgttcactgtctgtgtgcaatcttttccattgcttttgtctatatttgctctttaaaatttcccagtaaaatgacttggtatgtcacaaaaatctcttcattagtcattttttttttaatc

SEQ ID NO: 473350 - DNA, 562 bp, Homo sapiens
ctccaggcttaggcctgcccacgcactaatggaatgtttatttggaatgatcccattcggtccaactgactctacctgtcaggcctccatttcctgccccagacaacgcacagaagaggcccatgcggtggagaccccgcagtccctcttggaacttacgctgcaggttctgatcaacaaccaccaggctctgcagggggctgcatgtcccccaggatgtcggtgtggggctatgaggagtcctcctgctctctgttttgtctgcccagtgccctacatgagacactcgtataatgtctatgatgcccacagtagagacataagggccagactccctcagttggttcctgctacttccagacctgcctgccctgctggtgccatcgcgattatggaggcggcgaaggccccgagctctaggagcccacgctatttattggtaatccaacaaagaaaccggcagtgagaatgtgggggtcaaaagggcagacacatgatccacagctgtgatagtttagtgtttatatggaccatgttctgctacttgagataatgcgaatac

SEQ ID NO: 473351 - DNA, 661 bp, Homo sapiens
ctctccacagctgggctctagcatcatggatggtgacaagacaagtgcaggccattcagaatgccagcgagattgtggcccacagccatcagctgtgtgctggtgtcccagttccctattccctgatcatagcagagtcagccacaggcctagtgaacagttctgcagtgttgctttggcagacccacctgaaaattctgctcagaatctgttctcgcccactaatgatttggaaaacgtacttcccgacagcccagcggaagccagctttacatggcctttaagatcacctcgaaaccccactggttcctcacaccacagtttccagtgccttcatctttatgactccatcctgtgcaaagtagagtcatctggagagcttttagaaaccactgatgtccagccccatcatccccagccagatattcccacgcaaagcattcctaagtaaggccctggcacttctcccagtaaacgtaacaggcagccagggaatgcagtcataaaaattctttgaacaccaatcgtcttaggtcttacaatagtaatgttatctataggagcaattgaggaggttaggaatctggtggcctctgactgcatgactcctgggccataatttctaaacttgtggctaatttattagttttacaaaggcagt

SEQ ID NO: 473352 - DNA, 867 bp, Homo sapiens
agagctccacatctttctctggtaaagaacggcacaaacccaaggtatggtaaatgagcaaagatacctcagtgcccagagaaagggggacaaaggagaaaggacgggaaaagcggtcattggatgccatttctatcaatcatctgggtataaaagagcaaaaacagcagtgaacctggctgaatttggagagcttgattggagacaaacttctctgtcagcctcatctaaggtgagggtggaaggtgcactcttcttagatgaatgtctggattcaccgactggagacctagcaagtctaccaggctctgggttgctactggtggttgtctgcacagagtcctgtgatgtgaaccatctgtggatctctcagccgtgggtacccacaccagttctagtagagatggcagggggactgaaatggactctgccccattccagaccaactgagtcagaaacgccaggggtagattcagcaatctgttttgacatgatcttcagaagattctgatgcatgtaaagtttgagaattacttctttagggattaatagagcagcaaggtagaaggcccctgagtctccagacaactttatgaagcagagataacacatattttgtatattatacagcagagccacctctcctccatagactgcccactcttacatgagagacaaattctattttgcttgagccgccagatttttgtgttcctttgttgtagcaacttagcaggcactctaattaaagctgtagaggaccttttgacttctcagtttataaccagcccactttaatggggaaataacaagcaaaattttccttgaagagctatgaataatcaaacagtatttacagaggagtac

SEQ ID NO: 473353 - DNA, 600 bp, Homo sapiens
agatcagtaattctcaaggagtcttccctcagtgacacatcatgacacattcccataacagcagcaaacaagaatgtcctgcagagggccaaagccagatagacttacacgaagcacactggagtctttttgtttctgtccaccctatattttggaagctccagcaggaatgtggcccgaatttaaacactgggctggtggctggtgtctgggatgatggagatgagaccacaaaggtggtcaggagtcagatggagaagggcctgggagccaccctaatgactcagttgtatggctacaccaagatacaaatggtatcagaaaacacagcctttagctgtgcattatgtgagcaaagagaaatccagacagccctggagactgacttctttccaattttggtaactgaggagacaataggctcagcagttcttcctgaacttaaatttctgaattcttaataaacttgatctagtttattgttgaagctcttaattatatttttatatcattcattaaattcttcagttccacaatttctgtttggttctttttttataacatctatctcttcattaaatttctcatttagatcatgaa

SEQ ID NO: 473354 - DNA, 661 bp, Homo sapiens
tgagggtggagccctcatgaatgtctctctcactctctctttctctctctctcttcctctctccctctctctctcttcctctctccaccccccctctctttccttctctctctctctctctgttctaagctacctgaagctggaggtggagtgatgcaaacacccctgtggccaccaccactatgactgctctagaataccgctgtggataccaattattgggatgtgatcaatatctactgagtgatagtcaagggccctggactccctgtgaggcctgcacttccccagcaagtatccccattcctgagagagtgacacatttaataacaaataaaaaccacaatgacatatggagaaagagaccacagaataaaggcaaaggcatttttcccataaaggaaaataaaacaggaggcctgcattttcattttgcacaggaccccactaattgtgttcctggactccaccctccaacagctgaaaacaaacaagcaaaccaacaaacgaaaccttcaataccagctctctcccatgcccttcacagcacacttgatagagtcatctctatgcactatcttcctttctcctccattcagtcctcagcccacagcaaaccaactttagctgataccattccatagaaacttatcttgttaac

SEQ ID NO: 473355 - DNA, 633 bp, Homo sapiens
tcaatttccacatctgtaaaatacagaagaggggctgcaaatggagccgcacctagcaccccatgctcccagactcattctcctcccggttcactttgctagaaaataccaaaagcattttagggagaggcctgctaggacacttatgggtcagacggaagctccggcagtgggcacctgcagccgctgacatctcagtaagaagtgcaggcaaggatcaaaaccctgggtcgagggacgtgcctgctggcgtggaaagtgcaggctctgagactagtgagatttggttacgatgtaccaagctggaggtgctgactcctcagtttccagatgccgcttctgtggctgaagttttcccagaatgcagctctgctcctgggctccaacacccagaagttcctctctctagtccagtcagctgcttcttccatcaccatatagaacctagaagaacactaaggacagaagggaagatgaagacccatcgttaactccctcaagcgatctttcagagggaaacagactctccactctcaatattgaccttctagttcctgtttttattctgagagaatgtttctgttcctgctcctcaaaggaaataggttttatttggttggctttgccttcaat

SEQ ID NO: 473356 - DNA, 750 bp, Homo sapiens
ctccaacagacctgcagctgagggtcctgactgttagaaggaaaactaacaaacagaaaggacatccacaccaaaaccccatctgtacatcaccatcatcaaagaccaaaggtagataaaaccacaaagatgaggagaaaccacagtagaaaagctgaaaattctaaaaatcagagcacttcttctcctccaaaggaatgcagctcctcgccagcaacagaacaaagctggacggagaatgactttgacgagttgagagaaggcttcagaggatcaaacttttccgagctaaaggaggatgttcaaacccatcgcaaagaagctaaaaaccttgaaaaaagattagatgaatggctaactagaataaccagtgtagagaagaccttaaatgacctgaaggagctgaaaaccatggcacaagaactacatgacgcatgcaaaagcttcagtagccgattcaatcaagtgggagaaagggtatcagtgattgaagatcaaatgaatgaaatgaaaccaaatctacatctgattggtgtacctgaaagtgatggggagaatggaacgaagctggaaaacactcttcaggatattatccaggggaacttccctaacttagcaaggcaggccaacattcaaattcaggaaatacagagaatgccactcctcgataaagatgctcctcgagaagagcaattccaagacacataattgtcagattcaccaaagttgaaatgaaggaaaaaatgttaa

SEQ ID NO: 473357 - DNA, 697 bp, Homo sapiens
ggaaaaggaagctgctacctctggaaatactgaaatggtggtagagcacctctcagatgttttatgtttggggatcgtgccagtggcatcatggctttcattctttacaggaacaagcagcaagtccaatacatacataggaccaatatccgcccccagattcttccctgagtccagagctaccaaaaccatcctccttctgaaaatgatgagaggagttaaggtgagcctcctagctgccagggattctggagacaaaacacatgcagaaggaatagacaagcccaaggcaactaatatggagagttgccagttatacagttggctccaaatatattcagacttagcaagaaagactactcagggaccggcatatttactttattggaccagttatgtcaagtctaaagctacattttcctatgaaacctatggggaagaattctgctttgactcatttagcttctgtgtttgctggaatccttggcattccttggctgatacagaagtgtgttaacttttaacatgatagtcattctgtcgatttctccttgtaaaatgctagaatcttttctcttcatatttttttgaaactatattgttaggtgcatggaagttcatgactaatatagtttcttggtggattgtacattttatcaatatgaaataccatttttaccccttttaatgtttttat

SEQ ID NO: 473358 - DNA, 727 bp, Homo sapiens
aaatcctcaccttcaagcacacgtattcacacactgggatgtgctcaagtgattcggtctaggttgataaccttgtagaaactcagttccttcctgtataaaatggaaacaagggaagagaaactaatcatagagattacttgtgatggaagcaggcacacaattccatgtgggctctcaaggctccacgaagcagtgtgatccctcttatgaaccctcccatgaagcagtgtgatccctcttatgaaccctcccatgaagcagtgcagacgtccagatcagctgggagcacaggaggcaaacaaaagactgcaggagctgcaggtgacttcagccggagccaccgagctctgggcatgttcaagcgcagaggccgcccttgctcctcgttcccgcatttcagagtggactctgagatcctgcttctggctctcctcagagtcctgatttcccacagctgtcttcatctgagtctcgttcacaagcctgacctgctcccgatctccaccccggcccagctctgtgctcctgcttggccaaggtcctcctctccggttgacccactgggctccccggtgccatgaaacttgctggacagttaatgttacctgaaaagaactgagaccattctgtgttgaaatcccaattctcttcctttccaaactatattctctgtggttattttttagatataattcctatccaagaagcttggggttacattgta

SEQ ID NO: 473359 - DNA, 1072 bp, Homo sapiens
cagtgggaaatacgccagaatctgagcagaagatgataaccatttacacacattacctgcttctgtgtggtgcagaaatcagtgattttaatgggaagacagaaagaaaagaagaaaaagacagaaaggaagaaggaaggaaggagaaagaaagaaagaaagaaagaaagaaagaaagaaagagaaagaaagaaagaaagaaagaaagaaagaaagaaaaagaaagaaagaaagaaaaagaaagaaagaaagaaaaagaaagaaagaaagaaagaaagaaagaaagaaagaaagaaagaaagagaaagaaagaaagaaaggaaagaaggaaggaaggaagggcagaggagaggagagaagagaagagagagagagggagggaggaaggaaggaaggaaagaaggaaggaaggaaaggagggagggagagagaagggaaggggaagaaagggaagggacaggaaaggaaatgaaaggaaaggaaaagaaaagaaagaaaggagggagggatagatggagggaaggaaggaagaaaagagggaactagggagaaagggaaaggaagaaagatgagggcaaggaaggactttctaagaaacaagcacttaattgtctatatgtattgccttgtaactcaataatttttagcacacttattttaaattcattgtcaagttattcataaatttttatttctgaggttgattatggtagatgcattttttcctttgattgaggctttaatcacacttgtagcttttattttcacatagttttgatgtaaagcttggtaaattttaatgtattaatttttctcaatttttaaaatattttttctttatgtttcttatttaagaaaattttcccttccccaaagttacaagtattcttatatttgtttctaaaagtttaaatgttgctttttaatgtatttgaaatgtattttttattataacatgaaacaaagcttcaatgttgtgttagttcattcttacattgctatgaagaactacttgagtgatatggttaggctttgtgaccctacccaaatctcatcttgaattatactcctc

SEQ ID NO: 473360 - DNA, 2630 bp, Homo sapiens
gcggcttccctgagcagaagaagcttccctggctccatcattgatcatcaccaagaacatgggtttttacttctttgcatggtcctgttccctagtgtggctactgccattactcagtgttccagctactcacctgcggggcaacttgcccttcatagtcctcgcaggagggcactttcctgccaagtctgggaaaggacctgctaatctgagcaagcagccaccccgaggccaccttgctggcatagattcacgaccttgctcttcccagctagcccatcaggagaaccttcctgcagtccacaggccacggaggtcctgctcacaccaccctgactcagcctctcaagcagcctatggtgggtacaggaccccaagatctattcccgttttcacccagagcccccagtactccccatcagtttcagccacactgggctccctggctcctgccttgtggctcctgtccctttcacacagggatccttcgtaacattgagaaaaaaactaagggtataaaattgtctttttttacctcttaatatctgtgtgaccttgggtacttcatgtcagttctatgtatttgatattcatcatctgcaaaataataacagtgacaacaataataattaacaatgaattattttaaaaatgagagaatgatacacagctttttaaaacaataagaaccaattaaatgctaacttatgattactatttatacagattcagttagttcaccccgttagaacacagacagaattccaaaggtttaactgagtaagtaacctaagtagtggatggcagtctgtatcctcagattgttcatttactggtcaatgtgcagatacggggtttacaggacataggagaaagacctcacactctggaatgaaatactgttatgtgaccttgggcaagaggtttcacatttcaaaatatccatggatgtttacactaaggggttaaataactttcagaattgtcgtggtcatagaatgtgatgcccaaaatacagtgtctggctcaggttaggactgcataaatatatattttcttcctcactttggatagaactgttttcatgagtgaagagatctcaagcaacttttaaaattccaagttgaatagagtatcattattaacaaataacactactagccttcctctcccctcctttgccaacactctaattgtttcattgatttcagactccatttgtgagatgggaatgccccatgagaaagcctcaacacaatgctgtttcctcacaaaataaagacatgcctatttgattgaaggagagagtacatttactagctcctgatggaagccaacttgtctcctctcatatggaccttcaatgtaaatgtgtatctcttttataacttacataaaaactagctttatgcttgaaataatagcattagaatagctttagggagccaaaagtcctggttttaattttactttgacaactcttattcctgataccatgggaaaatctttatcatttcatgagcctcagtctactcatctacaaaatggggattaaatgggtcaaaatatgtaaaagtttataacataataactcatacattgcaggaagtttataaatgtacattttctatcatcttcccccgtaagaccatactttaaatttaacataactatatagatcccataatgactagcaatatgccctgcacaaaatatactcttgagaaatgtttatgaaattaaactaaatttaaaatatatagagagaatacaaatgtttttaatacatcattattttaaattacaaaaaatacaagcttaagtcctaaaattaattttatatattttgaattttatgtattataattataactaaaaatccacagtgctcaaactttttttgttgttgtcgttggttggttcattttttttttcagccaatctcacatgaggccacagagtgtcaaggaaagaataaacaatttggagccaaagttgaatttaaatttagcatatttcattggctcaaagataccattaattatgagatgaacatatacaattgttacaaagactgtactgccaatacactaaggcatgattgctaatgcattaagtgcacaatgaatacttatttcagagaagttaatatggaagaaaacatgacccaatgaaatgttatttaacttacttgatccccattttctccatcagaaaaataagtctaacaataataactaagaggatcttgaaagaatcacatgaagaaagggtatgacagtccacttcaaattataaaacacggaaaatattgtttatagacaacaatctcacttgatgagaagctcagtttggagatatgtaatgtcttctatcttcctgatctatttttcattggttgtttatgtaatgccatgaccaagaagtaacaggttttgtgtcagtttcactgtaaaatgacaacatataatcatgatagatcacctgaatttgtgttactttgcctttggagtaaacttcttaaagattttttttttcttaatctagtttccagtaattattcaaacacaaaagtaattgtttaattattattcaagaaaaactttatatcctatttaggttactcattt

SEQ ID NO: 473361 - DNA, 1064 bp, Homo sapiens
agattgctggctgccagacccacccctgtcttcccttctcgggccagccagcacctgaatggtctctctcgagtctggcttccccttgggcatccttgtcaacgtcccctccaccctcttctccctgaggtccactcaactctagttgtgggtccttgtttctcactcagctctgcccttccttgtggagacgtcttcttgagtgaatatgaatatgaagtgtagaagattgacatccaaagatccatgaagtcagcatggcgtgcgattactcatatgtgcctacaggcacagagaacgggcagctggtcagggctaagggtatcggtgaaggcttcctccagcaggtgatttggatctttggagaacctcctagcgaacatggagcacctcctagtgaagaagggaataattactttgcttccctgagcctcgccatccacacaaataaagcagggatggctgctgagggtgaggctttctctgtcaggaagcattctcataggagcgttgaaaactcagactggatgaggcaactgatccttcacatgtaccagtcattctgccagcaacattatttttttctctccaaaccttcatgcttcaattttgccttgctaattcttgcttacccaagaggactgcacttagaaatgtcatccaggatttctctgactcctccaggttgttaaatgaattttcaatttaccaataagaaaatcacagtactggactgtgctaaacctgactcgactttgcgtttgttgtataattaatatgaattgaatatacattgattttgttctttggactaatagagtaattttaaaagaaaaacttgtttcagtaattaagcagattaaaatagataatatatatttcttgcttaatcagtccaataattgagttccactggtttaaattctcatctacttcgtatttaatcaaagttaaatgctatgttcatcctaaaactaagtaatgcatggacagtatatttaacctaaaaaatcacattacaaaaattaccattagcatagatgctttattcttgcttaaagttc

SEQ ID NO: 473362 - DNA, 646 bp, Homo sapiens
agttgagtcggacaccatatcttccaatgggagtcccttttgccaaccctgagctttgcagcggagaagataaaaggcatgttatgctgactccttcattgccacgtcagcagctggaaatctctgtggctgccatggcctttttccaggacttagctcaggcccactggggtcactttaccaacttggtcctgcaggctgccctcggcttgccctccagccaggatccctcacctgaacagggactccgtgctcagcctgtggatggagcaggcatgctgcaagcagcttccatgttgggagccagtggagtcccaaggtctcagctcccaaggaatgcggcatctgttcactcccaaagctccacaagtgggactatgttacaagcccttttattcctgccactcacagcttggcaaactgagggtatgttacagcttattcattcctgccacctacagctcagcaagtttccggttctcgttcggcaacgaagaggaattaaggtacgcagatgtcagagtgtgagtaaggcagagaagaattttattgagtgacaggaggaaagctctcaagtgcaagaagggaccctgaaggcaagttgccctcagctgcaagtggtggccccaaaatgggtagccatctg

SEQ ID NO: 473363 - DNA, 537 bp, Homo sapiens
agctccagcacgtcacaccttcgcctgtcctctggtgggcctagggaatgctagtgtttgtcaccctggttagtcagcagtcaaggtctgctgactcagaggctgcaatgttgggttttgtacaagtccctgatggaggattggtccctaggcatgtgacacatagcctaacattcttcgctaggggtgacagatcttgggatagcgaggagactgttctggattatttcctgaaagattcgcagctacgagtcttcaaaactgtcgactcttacccggtgacactctgcttcttcttacccctccctgaaaatgataatggaaatgttcagaagattagaggcagacatgaacaaatgggtgaactcatgagcagaaggacagaagcaacagagagctcattacacaattcttcatgggagctcataaaaaacgaggaagtaggcggtctgaaaagcctgttagagaaagcagacttaggtttgcactttgaatttaaaaaaggatgcaaataatggagggaagataagaacattt

SEQ ID NO: 473364 - DNA, 820 bp, Homo sapiens
ggccacattcactgagagtgctatactcatcctacctgggcatccccacgtcctccctcctcgtgactcagatcatcatgtttaattctgctacgcccaggctcacagaacatggagttgtttcattttgtgattcctgccccacttctccgtgcaccctccaagggctggaacagccaggacatgtgtgccctacacaggggctacagtgggctttctgactcatggaagaagaatcagcagggcgagctctcagaacaagcagtgttctgctgtgtgaagatgagaagggcatctatccaggtggaaggaagagagagtaaagccctgggggatgagaggatggggaaggggagtgaacctgttaagccctatgctgcagaactggaatttcagctcaaatctgcagacacaaaagccactgccttgccctgtccagcccacactccaggcccaggaaccatagggaggaagtacagaagaaccgtgggctccatcggagagccaggtatgaggcttctgaggaggcctccaggacgggcagtcactcatcctgccgagaacaagctgaaggaaagtgtaatgagtcttcaagaaaagaaagctcatgtgctcagaagattacggttggatcaactaatttctgaagacttagtagatcgcagcactttaaaacaactcaacctccagaggcagcagtgaatgactttcaacccgtgtccttaggcctggatgattaagagcaggaacgctggacccagaagacctgggtttaaatcccatctgcagaaagtggagaatacgactagagctgtgagga

SEQ ID NO: 473365 - DNA, 1139 bp, Homo sapiens
ccagccagacagcacacttccccatcacaaacagctcctaaatctgattctaagacgttattctcagcgagccacatcccatctcctgtcttgctacgtcgtgcggcagcacctcccttgctgctgctcatctgtgccatgtgcacccccgccccaggacctttgcacctgctggatccaactctacacaagtgtcctgtgtcagaacaagaccaaggatgcaaccagcacatatgtcctggctatctgcatggtgccttgctattctcccgctctgcggcccaggaagagcaaacaacgtacagttccagggccacgttcaaggtctccaacttcttgccagtagctgcctggaaagcccacctctgtccttttccttccacgcaccttcaagactcaggcattattcctgcctccccagccggggctgccttcctgggctggcgacttgctcaccccagtgccagctctcagtgtgcaggtgagcattgcagatggcctctcaaactcggctctcacacatctggctactacaagcccctggagacaggaaccgtctttcatctgcgtgtgctcaacaacacccaaagcttcacgcacaacaaaattttgtagaatgaggcatgaccaaagctatagagggggtgaggcagattgtgcttattaatagaaaacttattttttggctcaaagaaactgatttttgacaaaaggattgtgtgtgtgtcattccttcactgacttaagagctatgattggcagccactggtctgtggctgaacagcctttgagttagttgaatgcattggttaaagatatagactccaggctttttttcaaatacatggaatctgtattctgggaagtagactcagaaacctgtacttttgattgtgtgattttgatgtttgtttggtacgtttagaaatgagatttctgttttatgaaacattatattatcttattaatgctataatattggtatgctctctcagttaaagaagtttgttaactgaaataatgatataaaaagaagcttttttttttttaattacctcaaacttgagtttgaaaatttgctgtcctggaagacaattgtttctcttctccccattgtaaagttcacaatagctctgtcc

SEQ ID NO: 473366 - DNA, 577 bp, Homo sapiens
gctgcttccaagatgataccttaaatgttatccccttcacatggtgggaaggacaaaaaaaggcaaacagctcccttgaacctctttgtcatgggtattttgttgcagcagcaggaagggcctgagacaccaggtgtggtgcagaacagggccaatggggtgcagcttgaaggctattcaagcccccagcttcacactcctcttgctcataaccctcctttccctgctcctccaaactcactctgtgccagccaaaccagcccatgtgatgccccaagccctggaacctttttggacctgcacactcttgcaagtgcagtttcctcagctgaggatgcctttggctccctcaggtgcccagaggtcaacttcgagagcctccttctgtcctatttatttataaaatgggctaatattagctattgtgtagcattagctatcaagattaaagcagaaaacacatatagaggccttggcactgagccttgacacctcagatgacagttccacactgctgtttactggactggaaacagcccatggctgtgctttctaaatatacttctatctcatcagc

SEQ ID NO: 473367 - DNA, 623 bp, Homo sapiens
gactttatcataactgtgcaacttgatgttgccacggatcctgccagagctgacattgcttcttatcagaaaagcgtgggctgcccctatacctcatggttttccagagagatcacgtgagacaaactacatggaagtaagaggaagactcgctcctggcccggtaaagaaggcaccacagtgctctgtgtcggaaaatagcatgtattactccacggacaccattactttgaccatccccaagaacatcagcccccttctcaatggggctggccacttcaaggacctctctaaagagatgggagtgagtcttcacaaactgtccacagctgacattgtttctaggcactatgaattgaagagtgatggcaagacaatttctatcaagattcctcttggtgcagaaggtggttattacaagcttgagctcagagggagaccctgactctaaaaaaaaatgttattgctcaagacaggacatcagatctcctactttcttttggtttaaaagctagtttcaaggaaggatctgactttagaaggagcaagaaatttagggatctgaaaatgaatattaaactgtttttatagaaaattttaaaatagcaaatcctgaagctaag

SEQ ID NO: 473368 - DNA, 728 bp, Homo sapiens
agcagtgctggtcagcgctcctccaacaggggcagactgctgaggggaggggaggcggagggttgcaaggacctggctcagagcagtcagagctgctggttgagagaatgcttgggaatatgaatggtttggtggtgcctgtacattttattttctatagaaggaattggagggctattagacatgattctctgagtgctagtctgccccaagaagataggaatatcacttccctgacaagtgagaattctctggcatctctgagaaataagtggcagacacttttcccaccaggaaggccctatgaaggggagaaagctggaaatcccaggcacatttggaaaaatcccatggcaaaggataccaatgccactttcacaagcaatatctgcttccagcatggcgatggaaccagagtagtgacagctgaaggagcaggcctggagcggggaggacaggagctcagggaggagcttaactcacactctcatgcagtatcctccatgaaggtgtacccattgttctcatggccccaaatggctgcaagaactccagtcacctcatccacattctagggaggaggttggaagacaaaagggaaaagggcatggctcccctttttaaaaagactccctggaaacataagagaatgtataggcttacatctggttctaaaagttggtttctctacactagttgcaagagaggctgggaaatataatgtgttt

SEQ ID NO: 473369 - DNA, 517 bp, Homo sapiens
atgtacatttctgtgagaaaggaatgtggttctgcttagacatactctgatgaagtcagagaaggtggagaacagggatgttctcctggatgctttgataatctctgccttcagtccacatggaatgccacctaaagtggccaaagcagcagccttgtcccacgggaaatccagccagtcactggaggaatttgtgacacaccaaggatcagggccagcggtgcatgtggcccactttgatggggagcctggtttcatcactgtctttgttcagaatttgcagcataggagaatacttgattttattattgtttttaaattctgtacaacaaaggacccccatattgttagcaccaggggcagactgctcccctgtggcaaactgcccctcttcatccccttagtttaccaggcgatgacacagcggccactccctcccacttgttttcctagagattgaagaacaattgtatcccatgcttgatctgactgatatggaaatgcctgatgaccattt

SEQ ID NO: 473370 - DNA, 490 bp, Homo sapiens
gcagctataatcccagagagtgcttctgagaatacatggtaggaaacctttgtgtggttcctgggcataaagacccatggaaagaaggtcgtggaaaagagatactggaagctctgacttcctccatgtacatactggacctttctccttcacccataggtagatactgctcctttaggtctaatgcctgtaccatagcttcccctcccttacaagacctgcgtgacttcacaatccatgtgagtaatgtgatctgtacctgggccttacattccttcacttcctcacttggtggcctcacctttctcttttattttagcacccactcttcagcatcacttggaaccacttcgtgtcagagatctggtcagggtctcatccgctcaagaaacgaatgctttgtttcacaactcctgttcttctgtttcccagagacctctagttccttgatctgtctgcttcctgccagttaatcagctccccttttctt

SEQ ID NO: 473371 - DNA, 1312 bp, Homo sapiens
gtgatcaatctttagaccttctgagctcaaattgcaccgattgatggacatcaatctgatgacctcatcacctggttatgatgtcttgaacagatttaaactacaaagcacggcacagatattagttataaatactaccatcaatgttttggggatgagagagactaaaggtggagaacttctgactcctttctttggcaaagactggggcttactggtaggtcctacagagatggatggcggccacacagggcctgttacccaggcagtgcagaaggcaaatgtgggctcagagccccaacacagatttcccactggggcactgcctagtggagctgtgagaagagggccaccctcctccaaatcccagaatgatagatccactgacagcttacaccatgcacctggaaaagctgcaaacactcaatgccagcccgtgaaagcagccaggaggtgggctgaatcctgcaaagccacatgcgtggagctgtccaagactgtgggagactactttttgcatcagcgtgacctggatgaattaaggacaacacaagctaccaagttcagagctccttagaactgaatgtttccaatttctagtctctggctacacctgaagggaattcttgggatctaaatccctattagcaatggaatgagttataacatgttttattttcatgctgttcattaatttagccatggaaatgatgtttattcattaaagtattcaagatatgtatatgaagaatcgtaatcccctcacaagcttgactaagttctgatgttctgttctaaggttgggaacacttgcttttcccacactgttgagctgcctagtttttgaggggaagaactataaacggaagggacagaagaatacctctgctgcattttaataaagcagaactaccgatgttaaatatacttcttgaaatggctgaactaaacccgggtggctcagtgcttaaggtctacttttcagtagaaaatgtgtatttttttaacctcttctcattccaactatttgaattctcacccatttcctggtgcacacagagtgctataccctgtactgtgctatgccatgtcccggcttgtctctttacctccaaccacttcatgctttcaaattcctatcttctcatcttcccaaattaaaattctcatctcttcagtatggtcaactcttgttggaatagtaataagatgactatttcacctttatgtattaaaaccaaatatgctttcagaggactaaccatttttaaaagagaatgtaattaccatcagtatatttttgttgtagcat

SEQ ID NO: 473372 - DNA, 706 bp, Homo sapiens
cagcatcgggaatggacctccagcaaactccaacagacctgcagctgaaggacaggactgtagataaaaccacaacgatggggagaaatcagagcagaaaagctgaaaattctaaaaaccagagcaactcttctcctccaaaggatcgcagctcctcaccagcaacggaacaaagctggacagagaatgactttgacgagttgacagaagtaggcttcagaaggtcgataataacaaacttctctgagctaaaggaggatgttcgaacccatcacaaggtagctaaaaaacttgaaaagggattagatgaatggctaactagaataaacagtgtagagaagaccttaaatgacctgatggagctgaaaacgatggcacgagaactacatgaaacatgcacaagcttcaatagccgatttgatcaagtggaagaaagggtatcagtgattgaagatcaaattaatgaaacaaagcaagaagaggagtttagagaaaaaatagtaaaaagaaatgaacaaagcctccaagaaacatgggactatgtgaaaacaccaaatctacatttgactggtgtacctgaaagtgacggggagaatggaaccaagctggaaaacactctgcaggatattatccaggagaacatccccaacccagcaaggtaggccaacattcaaattcaggaaatacagagaacactacaaagata

SEQ ID NO: 473373 - DNA, 793 bp, Homo sapiens
cctcctgaggtcctcgccagaagacaagctgatgctggtgccatgtttgtacagcctgcagagctgagtggagggtgctcctgtggcatggagaatgatggtggtgcagggcctgagactggccttgatcctgagtcaggaggagagacttcctcagaaccagaagaaatcagtcaatgggggcagagtggatggagaggtacccactgttcatctgatggacatttactgagcaattgttcagcaccaagcttgatactgaaaacagtggtgactgagactgtgaccacctgtgaatatttcatcaagtgcaaaagagagaaacaagcagataccagggtggctttcagcacacagcagggtaaccacaatgttagagggatgtatgtcctctgtgtacactgcagaggacataatgaactgcactggagaagggtgggtgtgagggaaggatgcacagaggaggaagtatatgagctggacctggaagccagagtgagatttcaccaggtgctgagtcgggctggtggtagggaagaacataggggctgggaaaaaaatttatgcccagggattggcattcacaaagtaatgttggcctgaaatgttgatatttacttgtgcaaatccatgaagagcaaccactttggacttggactgaccaatcaccaggttcccagaaaccagtcttccagttctgcagaaactataaaacaggagcagacaaaagaagaaatggatgacaactactaggtatctaccaggtcaagaactctcttgtctcatcactgcc

SEQ ID NO: 473374 - DNA, 778 bp, Homo sapiens
aggaaaatgaaggaaactgtcatagaagaggtggcattgagtgggacaatgaatgacaggttcttgaagtcgcctttagaacgtttgggctgtgtgagcttgttccttctaacagtcccctctgatgcaggtctgctggagtttgctggaggtccactccagaccctgtttgcctgggtattaccagtagaggctgcagaacagcagagattgctgactgttccttcctctggaagcttcatcccagaggggcacccaccagatgccacagagtttgagcgctgtgctgggagatccgctgcactcttcacagctggcaggcagaaatgtttaagtctgctgaagctgtaccctgttcccccaggtgctctgtcccagggagatgggagttttatctataagcccctgactggggctgctgcctttgtttcagagatgccctgcccaaagaggaggaatctagagaggcagtctggctacagcggctttcccaagctgtggtccagtttcgtgcttgaaacccagggccctggtggtgtagatctcgtgagacttattcactaccatgagaatagtattggggaaattgtccccatggttcaattatctcccactgggtccctcccacaacaggtgggaattatgagagctacaactcaagatgagatttgggtggggaccagctgaaccatatcaataactataaaattatttataatttaataaaaaagttattaaaacagattttaataacttagttaaagcctctggatccagc

SEQ ID NO: 473375 - DNA, 579 bp, Homo sapiens
ttctcatccgagagggtttcagttattgcgaatatgctcatacgtgtcctctggagcgcatatacaaaggcttctatagtatatacagcaagtctagaaagactggtcaatgaggtttgttgtcaactgggagagccctggtactccattcccaggatcagccatcagggtgcagacattgcaggtcaaaacgtcgtctcagactttaccctccaaccattgagaaaacatctctgcttagtgccagagatagccccacctaacttggtggaagtagcagatattaatggcaaaatgaacttgtctggtgatggctccgtcacattaatgtctgatggacgaccccaggaaacaagtatagaacgaaatagagcaattaagcccaaggtcttggggtatgggacaagacagccagacattgaaggaaccactaagatttatcaatgttctttctcctccatcacagggtgtgttggcagcttcaaaatatgagccttgaatgactctagttgagaacatagtgaaagccatcgtataacttgcaaaagcaaaagtgttttgtgtctcttcacatgccat

SEQ ID NO: 473376 - DNA, 508 bp, Homo sapiens
cctacgagagcttctgtggagctacctgaaggggattttacatgtgcttgtctgacatcgactcccttggaggtctctttggtaccgacgttcactttcactctactgccttctgcccatctgctattcaattcttcccacccttgcccctgaactacatggcagtggagcctttgcttttacgcacacaccaagtatctcccaactccagaggtcctgagcttccctcacagggtgctggtgatgcagtgtcagaagagaggaagataccctgctcagccccactcagccaagaagaatccagcattggcttcacaagccagaagagctctcttttcttcaataaagatggaactcatttcctagggtatagtgagagaccatctaccaggacagccaaatcagccccatctaccctgaccatcagtaatgtggtagacacctgagctttcaggtcattaattaactaattaatttgtcaacctaatattttgtgagtgattgatat

SEQ ID NO: 473377 - DNA, 595 bp, Homo sapiens
cttcaaccatcaatttataaggcatcaactcatcacgcatgcaggctgctcatgtgatgatcaatgcacaggaatggttagactgctaatttcaccccacaagaacgccctgagttccagcgctaatcggaaggataagtgctttgacagtaaaggtgagggagcagggaagattcaggacaacctcatgcacaagagaatttcggattggcagcatcccaacccttcaatcactcaagatctgtccaatatttccttttgtaataaagataaaggaggaggagaaagaaaaggaggggataaaagcagcagttatgatgatactccaaataaaactgagttaatacctgggaatttcctgtcatgggaagttggtgagcaagtttttgtaccccttaaaactcaacagataggcagttactgctgcttcctttcttacctagggcagattccaaggaaggagagaggagagaaatgcttgttgcctggttgccacagtttatagtagcctattttttaacccaggtagagcatagtctatacattccattttactttctgctaagtcagtgagtggccttagtaagtggaattc

SEQ ID NO: 473378 - DNA, 664 bp, Homo sapiens
gacagctcaagggggcagtcattcctcaagcaggctggtgctggggtctctgagcctcatggtccccttacacagcccctgcagacttcagcaggacagtgtgtttgggacccatgtctggctggtgccagaactcactatttccttccacttttgcccagagataactctgctggagaagaagaaagaaggagaagaagaaagaagaaggagaaggagaaggaggaagaagaagaagaaggagaaggagaaggaaggaagaaggaagaaggaagaagaaggagaagaggaagaggaagaggaagaagaggaagaagaagaggaagaaggagaagaagaaggagaagaaggagaagaagaaggagaagaagaaggagaagaagaagaagaagaagaagaagaagaagaagaagaagaagaggagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaaaatgatgattgaatgattggtgcaggatcaagtgaaaattagtagtgatgtctgt

SEQ ID NO: 473379 - DNA, 715 bp, Homo sapiens
cagttcaatctcagactgctgcgctagcagtgagcgagcttccatgggcgtcggaccctctgagccatgcacaggatataatctcctggtgtgccatttgctaaggccattggaaaagtgcagtattagggtgggagtgtcccgattttccaggtgccgtctgtcatggcttccctttgctaggaaagggaattccctgaccccttgcgcttcctggggcatcgctataaagatacctgaagatgtgaaaatggctttgaaactgggtaataggcataaattcaagagtttggagagttcaccagaagagaagaagatgagagaaagtttggaacttcttagagactggttaaatggttgtgaccaaaatgctgatggaaatatgaacagtaaagtccaggttgatgaagtcttagatggaaatgaggaagttattgggaactggagagcccaccccttgcacctgcatgccctggatgcaggacatgaagccaaagacgattatttggagctttaagatttaatgaatgccctgctggatttcagacttgaatggagcctatggtccctctcttttggttgacgtctcccttttggaataggaatgcctgtaccaccattgtatctgggaagtaaatgtctttttaaaaaaaatcttacaggctcataggtgcatggaatgtgctttgagtctcagataagattttgggctttc

SEQ ID NO: 473380 - DNA, 544 bp, Homo sapiens
gtctcctcctcctcctccttcttctctctctctctctctctctctctctctctctcccatgatgtggcttcctgtgacccaaactgcagtgattgatgtctctcctctgggtctagccacccagcaagtctacctagcttcgggctggtactgggggttgtctacacagagtcctgtgatactgtttacagctaaaagaagggaattatatgcttttcacaaatctccatgggccaatgacttgcatgtagagttctattaccctctttccaaaaagaaacatgtacttccccggcacagaagagaaagaagcttcttctggcccctcctgaaatttctccctttgcccagaaactactccctgggacagccacagcacatattggctaactcttcacattgtcaaaacatctggggtgacaaatgcatttacccattcaaattattttcccctgaagcaatgccaaacatctgcctaactagaaacagctgtgtattggtttgcttgggctgccataacaaaatgccatagactggtgacttt

SEQ ID NO: 473381 - DNA, 638 bp, Homo sapiens
ggaaaaaaaagtactggtcagtctgaaccaggtcaagttaactatgaaagtagcaaatccacaacacaaactgtacaaactggaagccactaccccgatctgtgaaaagcggtggaaggaacttggctactgggcaggtgtggttgtacagtacattctcatggcccataccaggttcccacggagagctgcacagtcagccctgcagcattcacaacagtgcacggacaagattccgatgcagctcagtacccgtgtgtctgacgtgggtcctgtggagcctgctgggaggaagtgggtcttcgaagaaacagggaccccgttctcaggtatcattgtgctagaagacatgccagaactccaggcatccactcacagctgtcaacactgtacgtccctgaaccagtgtcatctaagaatcagccagcaaatccaaggtcataaagatatatccctgttttcttctaagaatattatagttttagctcttacatgtaagtgtttgagccattttgagttaatttctgtatatggtgtgagataagggcccagttgcattctttcacatgtggttatccagcaccatttgttgaaaatatgattctttccctcattgaatggtcttggcacctttgctg

SEQ ID NO: 473382 - DNA, 521 bp, Homo sapiens
ttgctgagattcgagcataacgatgagggagtggggctgctgtttacagataaacagagacctgctgcctgttaggatcctggtaacaaaattcagtgagaagactgaaaacacaattgtgtttacagatcagcagcgacatgccaatgtcatgttggcggtggaaggcaaaggtcatgtttactgcaagcagaggtgcctgagctgccacaggggctgctggcgggggattttgaggaggaggaggagggctgcagcagcagtggatctgcagtcgcctgacccacatggtctttcttcctgtgtcattgacatgccaatgttatcccatgatattcgtgattccctctgcttggagcatgctgcccacagttgctggcccagatgcctccttccagttagtccagcctcagaaagttgttatgttcccagaaaggccttccttgaccgatgtatataaacagcatcctccttgtaacccatgcatacaggttttatcttatgtatttgtttatgtgtct

SEQ ID NO: 473383 - DNA, 612 bp, Homo sapiens
cagggctcctcctagccacccccaggaaagaggaaatagaggcagaagcaagatgagcagatggaaccagccatgcacccagtccactgggcaaatgccagcgaccccacctgtaagctgccaggccctgtgcaagatcaaaaccctgcagtctccaccacctgtgcaccaagcagcccagccctgctgcagcagggtgtgcatgggggtgagggggagaagcaagacgtagtgaagtggttctcaaagtgtggtccaactggcagcgtcagcatcacctggaacctcattggaaatgcagattcttataccgctccaggcctcctgagtcagaaatccaacaagtgctccaggttaaagcagatgctacgccaggagcccagtgccgtgcctgtcacagcaactgcctgtgaaacagtcgatgcatgtcattgctgtgactggtcagggctccgagagaatggagaggctctgaagactaacccaggctgcctctctaactgcctgaggcattgactggggcatagagggtggtgggtccatgaacagcaagaggtgggaggagggaagcaagttctccaggagtccaagtgaaatacaatgagggtatct

SEQ ID NO: 473384 - DNA, 876 bp, Homo sapiens
aggcgcggccccttacctcggagcgggccggagcggccccaaggagcatggcgaagacgggtgctggtagacaagttcagtggacaaagtgatgacagaaaatggtgaactcagggattctgtctcctggcttcagaagcagatactgaccctcaaatctgctaagattgccctgagtgagagtcttgtctcctgtagagaaagagctgaaattgtggaaaaacagacacaagctcttaccatgcgagtggctgacctgcaacaaaaggttcatgcacagcctcgccagctgtctactgttaaaacatttgggggactactggacacaggctctgagctgacgttgattccaggggacccaaaacataattgtgatcctccagttaaaggaagggcttatagaggtcaggtaattaatggaattttagctcaggtccaacttacagtgggtccagtgggtccctggactcatcctgtggtcatttccccagtgtcagaatgcataattggcatagatagcagctggcagagcccccacattggctccgtgactggtaggaagacagatggatcttgtagaatgacagtggattatcataagcttaaccaagtggtgactcctatatcagttgctgtaccagatgtggtttcattgcttgagcaaattaacatatctggtacctggtatgcagtcattgacttggcaaatgcctttttctccattcctgtccataaggcccaccagaagcaatttgcctttagctgtcaagaccagcaatatacctttactgtcctactttagggatatattaactctttggctttgtgtcataatcttatctgagagactttgatcgcttctctcttccatgagat

SEQ ID NO: 473385 - DNA, 799 bp, Homo sapiens
ggtactgctggtgtcacctgtgggtaggacaacacagacagccagcatgggggagcctgccgtgcctggggcattctgggaccaggtgtgggtctgtagaggttcgcgaagctttgcttacactcacttcaggtccacagacactgaactgtgtgctcagggatggtttcttcccctggctcctcaggacagagacatgaccagagaggcggctcccccgtcccactgtagatgctgcttggagtctgaggcatactgggctgctctctgggctcttggtctgattacaactctgcgactacacacaaggtctgcaccagacaggtctgagtcaaatggccacacctctccatggggctgggtgattcggtctctgagctgtgatcatttctacgggaaccgaattccatgtagttttggatggttgctgggtgtcagctacaagctccattggaaatcacattctgaaattatcatgtgttagtgcttccagtttctatggcaccttccctttgtgaattaaaaataggatatgatttatatgtaacagctggttttcttcaattttgaggggtcaaataaaatgttttaatatatactattaatatattcacctttgtactgacacaatcggaaaatatgcttttgtaattgtttttttaagtggagcaaggggcataggagggaaagtgctggcaccccttggtggtgacagccctgggtgcctgtgggatgaccgctcagtgaaggctttggaaccagctgtgccccatttgtgaaagctgcagagacagtgcct

SEQ ID NO: 473386 - DNA, 460 bp, Homo sapiens
ccaccgtcctccagaccccagaatggtagatccactgacagcttgcactggaaaagctgcagacactcaacaccagcccacgaaaatagctgggaggaaggccgtactctgcaaagccacagacgtggagctgctcaagaccattggaacccacctcttacatcagtgtgacctggtagctggcaggcagaactgtttaagtctgcagaagctgcccccagagctaccccttcccccaggtgctctgtcccagggagatgggagttttatctataagcccctgactggggctgctgcctttctttcaaagatgccctgcccagagaggaggaatctagagaggcagtctggctacagtggctttgcaacactgtgtaatggtgaacacccttcccccgaccaagctcaggcatcccaggttggcttcagactgctgaactggcagtgagaatttcaatac

SEQ ID NO: 473387 - DNA, 586 bp, Homo sapiens
tcagttaaggcaggaacaggccattttcacttcttttgtggtggaatgtcatcagttaaggcaggaactagccatctcgatgcgaacctgtgttgatcagatgaccacagggtaccacaaccatatagcctcaccactattggtggcaatacagcatatactcagttttcaaagagttgctctaagtttagaccaggttgaagtgagaaagggcatggaggaagaggagaggagaggaggagaggagaggaggagagaagaggggaagagaagagaagagagaaggcattctgggttgcacagctttgtgtaccagattaataagaaaaaatttcagggcacagtacccaattttaaaataattgccattttgaggaggatcctcaatccttctgggccagtggaaaagtcacagtcctccactgctggcgtggaagcctcccagctgggaagagtgggcaggaccattaccgctgcccacgtggcctccaccagcaccacagtgtgggcggcttcatcgctgctgagcctgaccctccactaggcctctcttaacaccgcccctgcacagggagagggtcgcatc

SEQ ID NO: 473388 - DNA, 492 bp, Homo sapiens
cgagtccttggacagctatgtttcaaccctgagaaccaatgggcaactttctagatggacttgtaaaccaaaatgtatccgagacagatctcaatcaatttagaagtttattttgccaaggttaagaacatgcctgtgacacagcttcaagaggtcctgatgacatgtgtccaaggtgaactgtgcaagacacggatcagaagatcccactcggaagcccaagccactgaggccttgggccccaaccacagagccacacagattctcaacacccacttggctagaattggcctcagcctgagagtttcttgggggagggggtaccataaccactgctgtggctgcctgaagtctaagccatctgagctttttaggggaggggccgcagtcaacactgtggctgtagggccttcctgcaggaactccaactccagtgaggagctcagggacagaactctgatctccctgggcctgaacccctagggggaggga

SEQ ID NO: 473389 - DNA, 1610 bp, Homo sapiens
ctcactgtatttgtggtgtctcccgggtcctgcaggagcagtccacttccttcagagggtctgtgggtcgtctcctgaatttctggttcaaagagagagagaggatgtaatggcgcacacttggaagcttattcagaaaaggcgaatagaccaagcacaggtgcaagggccaacacactcttgtattaagatgattgaaattgtctctacaccacacaaatatccaagaggatactccctccttcatcatcagcagcagcagcagcagcagcaacagcaatatcaacaacatcaacatcttcatcatcatagctaccgttttagtgggatgcatgtgcacaacgtgcaggtactaaccggcattggcagtgctgttggtgccagtgatggtgctgaccacagcaagaacactgggggtgagttcagttgttactgtggcacgattgtccatgttagcaataatgtcagctgtgctagtaaaagcactggtttgtattcaaaagtcatgttcctgccagaagcattggtagaggtgctatggatgacagcatcaacattagcctcttcagcatctttggctgtggccattaatatcagcttctaggcgttcatggcattttttttaaaattgcctatctcggtatcaaataattgggagagacaaaggcaatgaatgtatttatagcattttttctttcacagaatccttctcttttgtccttttgaaatctcagtctaagtctctctgcttttctttttctttgtgaattcatctcagtgtcagatgattgcaagcatggacacacaccattgaaagtcagtagggaattcatcatatgatgctattattagctatgtttaaagcagcacttaaacagtgcgtgtttctctattttgcatttgccaaaaaagccaaaattagagaagtatatgagaaaaaatggctagagaaggataaatttgaaagcagataaattatgacacatattttataagaaaataattatgcaaattctaaaacttctaaaattgttagtattctgtttcatcttcatgtggagaacacatggtcagagaagccatccctctctgaacatccttattaattccactgagttgctataggaacagcctctgttaaccaccaatctatgctgtatcatcatgagatccacttttttgtatcttggcttatttcacttaatataatggcctccagttccatccatgttgctgaacacgacagaaaagaatgtaatatacatacataatggaatattattcaaccaaaaagaagaacagtacatgcatatgtgttcgtgtgtgtgtacatataaaaagatttcaatgaaaaacaattagtctgagacttaccatcttagcatgctatcattgcacattatataataaataatgactaaacttagcctggatctgagaactgaagccaatatattttcctgttcttgggctaaaaatattctaaaacatttcctcgatcgtgaacaatactaaaaataagcagataattgaacaaagacggtagaacaggcctctgaattttagcactattgacctttggaccagattttttgttgttgtaaagggct

SEQ ID NO: 473390 - DNA, 818 bp, Homo sapiens
aaggttgttagtgtgggagtttgtcctatgcagtatgtcatccaaaactgtgattcacgtttgttgctcacaaagataaccacaattggaaattctgtacgaatttcagcatatcttctccaactcctcttcctctttgtcttcttcaaattcttgtttttcttcaaattcttactgtctctctctcattattattttgttgctccagtcccatggaattgccaaaggttctgctgtttttctgtttccagcagcagtgttctccacggaccaagcccagattctcaggctccacctgcatccaaaattgacaaagacccccaagaacagcctcaaatcctcaacttatattttttaccagaatcacagaaacatcatctcctagagccagaagaggttccaaatgaactccacgtaacactttacgggaaattagaaaacactgtcaggttaactctaactggttgaacgcagactttggaaccagactgcctagtttgaattccatctcttacccttacctactgattgaccttgggcaaattaccaactctgtgcctcatttcctcatctgacatcagagatactagtagtatctatctcatagtcttatttcaaagattaaatgaatttatctttataaagttctaaagcatcagtccctggcacataatgcactcttcagctcaaattaaattactctcctctcctggagttgtagaaagctactaagtacccccttcttgttataattgttctgacacttgaaacaaatacactttctgttatccttggtgatgtcaacatcatattacttc

SEQ ID NO: 473391 - DNA, 469 bp, Homo sapiens
accagcagtgtataagtcttccattttctccttgccgacataatgatgatagcatcagagaggcggcagcagggcaacgggctgtcccatgcatgtgtgggcatggacagcgtggtggcaatggagtctgtgcatgcccctcacaatttggcagggggaggctgcaggttggtgcacgttagtggagaatggttgtgggcagacttattcactatcatgagaatatcactggaaagaccagcccccatgattcaattacctacccctggggcccttccacaacatgcaggaattctgggagataaaattcaagttgagatttgggtggggacacagccaaaccatatcattccatccctggcccctccaaatctcatgtcctcacatttcaaaaccaatcatgctttcccaacactcccccgaagtcttaactcatttcagcattaacccaaaagtcttcagtccaaag

SEQ ID NO: 473392 - DNA, 741 bp, Homo sapiens
tggtacatccactgacagcttgcatcattcacctggaaaagccacaggcacacaacaccagcccatgaaagcagtcatgggtgctgtaacctgcagagccacagcagcagagctgcccaaggccttgggaatccatcacttgcttcagtgcatcctggatgcaagacatgaatcaggtccctcagctgccagtctgttggagtttgctggggttccactccagaccctgtttgcctgggcatcatcagcggaagctgcagaacagcaaatattgcagaacagcaaatattactccctgattcttcctctggaagctttgtcccagaggggcactcgcctgtatgaggtctatgccctgcccccacaggtggagtctacagaggcagcaggcctagctgagctgcggtgggctctgcccagttctagcttccaggcagctttgtttacctactcaagcctcagcaatggcagatgcccctccccccaccaggctgttgcctcgcagttagatctcagactgctgtgctagcaatttaattccaaagtaactggaaaaatactttgcatgatttcaatacttttgaatatatttatgcttgttgatggccaggtaatttataaagaaaattaaaaattatgaagaaaataaaactcaagaccaggtaatttataaagaaaaagagatttaatggactcacagttccacatggctgtggaggcctcacaatcatggtggaaggc

SEQ ID NO: 473393 - DNA, 513 bp, Homo sapiens
catcaacctcaaagatcgaagatgaggaaaaaccaggacaaaaatgctgaaaattccaaaaagcataatgcctcttctccatatgatcgcagcttctctccggtaagggcacaaaactggatggagaatgggactgataaattgacagaagtaggcttccgaaggtggttaataacaaactcctctgagctagcggagcatgttctaactcaatgcaaggaagctaagaaccttgataaaagtttacaggaactgctaactagaataaccagtttagagaggaacataaatgacctgatggagatgaaaaacacagcacaagaactttgtgaagcatacacacgtagtggaatcaatcaagcagaagaaaggatatcagagatggaaggtcaacttactgaaataaggtgtgaagacaagagtagagaaaaaaaagaatgaaaaggaatgaaaaagcctccaagaaatgtgggactatgtgaaaagaccaaacctacgattgattggtgtacc

SEQ ID NO: 473394 - DNA, 1335 bp, Homo sapiens
tattttcctcctcctcctccttctttttttttttttttttttttttttttgacatctgagtttaaaaggaggaagcacggggccgctccacatctgattggctgtagtccactctctggtactgtgctgacgcagctgacagtgctgagatgattaaaggatttcgagaatctgtgaagaaccaagtacagatatttgaatttttggagggctcagaagaagacaggaagatgcaggagagtttggaacttccgagagacttgttgaatggtttttaccaaaatgctgatagcaatatggaccacaaaattgaggctaaagtggtctccgatggagatgaggaacttattgggagctggagtaaaggtcactcttgctatgctttagcaaagaaactagcagcattttgcccctgccctagagatctgtgggactttgaacttgagagagatgatttaggctgtctggtagaagaaatttctaagcagcaaagcaatcaagatatgacctggctgttactaacaacatacagtcatatgtgttcacaaagagatgggctgaatttggaatttatattaaaaatggaagcagagcatgaaactttggaaaatttccatcctgataagaaaagaaaaaacccattttctggggagaaattcaagccactggctgcagaaatttgtataagtaatgaggatccaaatgttaacagtcaaggcaatggaaaaaatggcaatgcagggggatatttggggctggagcccccacacagagtccccactggggcactacctagtggcgctgtgagaagaaggtcactgttctctagatcccagaatggtcgatccactgacagcttgcgctgttcatctggaaaagcttcaggcactcagcaacagcccatgaaaatagccaatggggctatattctgcagagccacaggggttgagctgccgtccaaggccctgggagagtgctcttgcatgctcttgcatcagcatgtcttggattcaggggcatgtggcaagatctgcagccctctcctgggacatgcagagagtgatacttctccagaactgctggggcttactgacatctatgatgcaactttccgttaaagcacagcagaaattttcctattttgaaactcaactttctcagatgtaaaatgatcccagaagtcatcccagccaggctttatcttggcaaagaaacaactacaacaatcaaaagctaaaagtcaagaacaaaacttggaaaaaatcaacaccctaattatgtacagcattctagaaaatttcaaatcgtttctctgttatcacattatatttgatt

SEQ ID NO: 473395 - DNA, 727 bp, Homo sapiens
tgaggaacctctgggtcaaacgccagacaagttgtcttgcagcaaggcaagctggtctgctagagccagtgccctacaaccctacaaccctttagaattgtttccttcctagtttcacgggccgaaaaccaaggtgtcggcatgctggtgtcttctggaggctctaggggagcgtctgttccctcacctcttccggcctctggaggttgctttgactattagggattaaactactatgaacatatttgtatgtgtgcttctcacgggtaaagtgcataggagtggacttgctgggtcacagaagaccacattgaacattctggatggcctaatgcctaagtgttgcctaatgcctaagcgttcaacccatgaccaggtgtcccactcacaggaaacatgcttataccagcaggcccccttgtggctcttgtctgacctatgcccagtttatttctaccaagatatccattgtgtaagagagctttcccttggaaagaagttagattcagggccaatgggtagggggagccattctagacatacatgctcaaccagaaccagaaagtggagagcaaaagagagagtgaggggcctgtgtgctaaagcttttattggactccaagatattatccaggtgggtttccatgggagttctaatttgcaagtttaaattagacaagctggtgcaaaacaagctggtgcaagttctatgtggccatgctgttaa

SEQ ID NO: 473396 - DNA, 606 bp, Homo sapiens
agcagcttcagcagacttaaacattcctgcctaccagttctgaagagagcagcggatctcccagcacagcactcaagctctgctaagggacagactgcctcctcaagtgggtccctgacccctatgcctcctgactgggagacacctcccagcagaggtcaaaagatacctcatacaggagaggtctggctggcatctggcagcttcccctctgtgacgaagcttccagaggaaggaacaggcagcaatctttgctgttctgcagcctctgctgaaaggaatagcgtcaacatcaacaaaaacgatgtccacaccaaaaccccatttgaaggtcaccaacatcaaagaccaaaggtagataaatccacgaaggtgaggaaaaaaaatcagcatcaaaaggctgaaaattccaaaaaccagaacacctgttctcctccaaaggatcacaactcctcgccagcaagggaacacaactggacggcaaatgagtttgatgaattgacagaagtaggcttcagaaggtggataataacaaactactcccagctaaaggagcatgttctatctaacccaatgaagggaagctaagaaccttgaaaaaaggtt

SEQ ID NO: 473397 - DNA, 570 bp, Homo sapiens
gtcagtcttgacgtgttgagccagtttgtaagcgactgcagggcggcagctgcccaaacaatgagaatcctgggtcatgattataacagcgaactagcattttttgttcatctacaaaatgccatccttagaatatcactccaggcaagcttatcacaaatgaggaaatggagactcctagaggctcctcaagaggagagagtagagatcctcaagaacacatttggttcccctgtgtgtctcatctacctaaaacagagtctgcctacaacagcatttaatgaatatttgctgactgaacgaatttcagaagaaactgaagaacgtgggccaaatacaggacagtgtcaatgcagaaaagggacaagatataagaaatttaaaaagcaccaagagagagaagggagtggccaaaaaacaagtttgagagagtctgcctatcacagatttcatgcagcttacaaatttgtgaatggtgtttgagtgaaatgagagataggacaatttgaaaaattggcctttgtaccgtataacattctattaaaacacttcacatttaaattgtgtgtt

SEQ ID NO: 473398 - DNA, 642 bp, Homo sapiens
acaaattctcataactttcctcacctcactttctccccatcttttctcacactgttctctccagtgtcagggagtcgaactactgtgctggagtctggattgaggatgaagttggggaatgggcaccagtcaatgtccccgctggtcctgggtgtcctgggctgtggcctgctgactcagctctggccggcctgggaagcccttggatcccttcatccacttgagaagcttccacacagcctggaggatggactgccctgtatcaagctggcgagaggaaggacagagcagaaggagcctcgtggagcccctccagcttccactctgggagggcaggcacgtggttttattgtcccacgaagactgcacacagtgagggccaaggtgattccctacaaggaaatcagagcatggttgggaagtgacactactgagtgcctcccaccattaaacaggattcagtatagcagatttggcgctttctgtgatgaggtgaattgccactttggtcttctttcggtttctgcaacctcttcgcgtgtggtgccagggaatgctctgccccagaaccgttgtttggctgactcctccttgccattctggtctcagttgagacgttgcctgccctaagcgggctctatt

SEQ ID NO: 473399 - DNA, 747 bp, Homo sapiens
tctcgctgatcccacagcttttgtttatagtcatgcttctaccctgttggagtcttatcagtggcttcctactggctacagtttggattccttggcttggaggttgcatcattccccagctggccccatctccatcttccaccacacctcttcacaaactctatgctggtctgcatcctgtcccagtaaaccctagaggttcagaccaagcccagctgtgtgctctttccagctgccacatgccaaatgcagcggctgcctgctcagttttctgtccagagcacagtgttccctcactacagggatgctcttcatggtctttgaatggatcaacagaagcaccttctccagaaagcaagtcctgcttcctctgcatggaaggtggccctgccttatggcagttcagcagctcctgcaaagtttctactgttcagtttggggaacttcctccaccttggacagaatgctgcctgcaggactctggctggctttctgccagaaacctggagcaaggggctgcctttggggtagagggctgaagtggtctctctgcatgtgagctcatatcctgttcattcccaggaatcctgacatgttcttcctctatccacacagcctaaccattttccaagtcttctgctcaattccccctcctccattaagccctccttgatcactgcctggaagccctctcaccttgaggtcgcacagcagcattgttatttacttcctttcattgttgctgtg

SEQ ID NO: 473400 - DNA, 636 bp, Homo sapiens
ctcatggctcaccacttgctctcctccttgcccctcaccatgaacgtctttgacatgaggctagctgcctctccttccttctgcttaaacattctagagaatcatccaaatcaccaacatcaaagaccaaaggtagataaaaccacaaagatggagagaaaccagagcagaaaagctgaaaattctgaaaaccagagcaccttttctcctccagaggattccagctccttgctagcaacggaacaaagctcaatggataatgattttgatgagttggcagaggtaggcttcagaaggtcagtaataacaaacttgtccaagctaaaggaggatgttcgaacccattgcaaggaagctaaaaaccttgaaaagagattagacaaatggctaactagaataaacagtgtagagaagaccttaaatgacctgatggagctgaaaaccatggcacgagaactcttcagtagccgatttgatcaagtgaaagagagggcatcagtgattgaagatcaaattaatgaaataaagcaagaagagaagtttggagaaaaaagagtaaaaagaaatgaccaaagcctccaagaaatgtgggactatgtgaaaagacaaacctatgtttgattggtgtacctgaaa

SEQ ID NO: 473401 - DNA, 926 bp, Homo sapiens
agtgttgctggctttgattttttttttttaaagaaagagacttctgcgggctctctctctctctctctctctctctctctctgtattgtgaaaggaggacatctcagagggtcccacgcgcacagagccttgctcattgctagcacagcagtctgagatcggactgcaaggtggcagagaggctgggggaggggcgcccgccattgctgaggcttgagtaggtaaacaaagcagtcaggaagctcaaactgggtggagcccactgcagctcaaggaggcctgcctgcctctgtagactccacctcttggggcagggcatagccaaacaaaaggcagcagaaacctctgcagacttaaatgtccctgtctgacagctttgaagacagtagtggttctcccagcatggtgtttgagatctgagaacggacagactgcctcctcaagtgggtctctgacccctgagtaccctaaatgagaggcaccccccagtaggggtagactgacacctcacatggccgggtacccctctgagatgaagcttccagaggaactatcaggcagcaacatttgctgttcagcagtattcactgttctgcagcctctgctgctgatacccaggcaaacagggtctggagtggacctccggcaaactccaacagacctgcagctgagggtcctgactgttagaaggaaaaataacaaacagaaaaggacatctacaccaaaaccccatctgtacgtcaccatcatcaaagaccaaaggcttcagatgacaaacttctctgagctaaaggaggaagtccaaacccatcacaaagaagctaaaaaccttgaaaaaagattagacgaatggctaactagaataaccagtgtagagaagtccttaaaggacctgatggagctgaaaaccatggcatgagaactac

SEQ ID NO: 473402 - DNA, 677 bp, Homo sapiens
ctgcgcttcagtccagccttgcacaacaaataattatctggtccaaaatgtcaatggtgttgtggatgagaaattgtgatctagacatcacatatgatcacttcttccatatgctgatgttcctgcagacaaattctgatctgatgtggaaaggtgtaatacaagggtgtgaataccaggaggcaggatcattggcagccatcactggctaccaccactctccagtggtttcatcttgcaattggaatagaaagcaaactccttgccatggtcttcaggtcctacctgatttagcctcagcctcctcctacctcatgtcccaccatgttcctcttcttccactaggctctagccatgctggctttatgtctcctgaacacacgaacttgaccctgtttcaggtctttgtgaatgagtcagtgcaagtttccttccagattcctgggtcataggctccagagaggctttgaaaatgggaaggcactaaatcaggatataaattcctccagtttgagaggaaggtgatatgaaatttcagagtaaaaaaaaaaaacgattttactcaattaacattttcttgatggtaactcatacatgtcatacatgtgcatctttaaccaagacttgtcctctacctgcagcttattagacaacatattgtgcacattgctgaggtc

SEQ ID NO: 473403 - DNA, 814 bp, Homo sapiens
tcacggggatctggtgatcattgacacatccagcagccagtaagatggaaggcagaggctacaatttgggatacatgaagaatggctttgaattacagacagtggcaaaacactttgggagtcctagctggctaggagcagtagggacgtgcgaagtcaccaatgtgcctctcagtgcttcccaggggaccatggaactgtgtttgcccccagagttcaggcacaagcaggagcttcctggggggacatggagcagtgcctgtgccacagacttctggctgaagcagggccactgggctggaagctggcaccgagccttgtatggtaatggggagtggaccaatatgacggttcctcagcaccgtgactgcagcctctatcagggcatagcagttggtgctgggctgctccaaggttcaaagcctgtggaattccctatggacttgagtgttgcttctgcaaaaaatccaggcagttctctgggagctgacagcagcacggcacaagacaggagtctagcaacttacctgtacttgagcagtagatgggacatcaatgacaaagaagccttttgtaatcttcgcaacagatccatgactaatgggtaaaagttacaggatggcatatttaggctcactgtatctaaatttaaagtaagtacatttaaagtcatctattttccgtgttaaagaattttgaatttattatttaggcagtagtaagctacagatgggcttttaagcaagagtatattggatttggagaaggtagggaaaataagataaaattattaccttagaagattgttgtaaat

SEQ ID NO: 473404 - DNA, 608 bp, Homo sapiens
aaacggaccaatcggctctctgtaaaatggaccaatcagcaggatgtgggtggggccagataagagaataaaagcaggctgccctacccagcactggcaacctgttggggtccccttccacactgtctgcagcttcactcctgaagccagcaagaccacgaacccaccgggaggaatgaacaactccagatgcgccaccttaagagctgtaacattcaccaggaaggtctgcagcttcactcctgagccagcgagaccacgaacccaccagaaggaagaaactctgaacacatccgaacatcagaaggaacaaactccggacccaccgcttttaagaactgtaacactcaccgcgagggtccgcggcttcattcttgaagtcagtgagaccaagaacccaccaattccggacacactaacttatgccattcattcaacatttaagtgactgaatatttgactcaattcgctgcttcagtggatgggccattgtagacctgggcagcaactccctgggtggcaagtccaagatactggcttatgtttgcatttatcacttgtgttttagattgggcttctttatctatgtgccttctttagctcttcct

SEQ ID NO: 473405 - DNA, 632 bp, Homo sapiens
ttgtttgtttttttcttgatttaggagcaggagccggaacgtgaagcacatggctattggaggtggaaaggagtgtcctgaacttcttgagaaagaggcctgcattgttgaaggagaacttctgcagcaatgtcccaggagagttccaactggcatctggtgggtgcccctctggggtgaagcttccagaggaaggaacaggcagcaatctgctgttctgcagcctctgctggagatacccaggcaaacagagcctgaagtggacctccagcagactccagcagacctgcagcagaggggcctgacttgcaaaaatgctgaaaattccaaaaaccagaattcctcttctcctccaacggatcacaactcctcgccagcaggggaacaaaactggatggagaatgagtttgacgaattgacagaagtaggcttcagaagatgggtaataacaaactcctcccagctaaaggagcatgttctaacccaatgcaaggaagctaagaacctaaaagtttaaaggaatctcactaactagaataaccagtttagagaagaatataaatgacctgatggatctgaaaaacacagcatgagaacttcatgaagcatacacaagtatcaatagctgaatc

SEQ ID NO: 473406 - DNA, 3841 bp, Homo sapiens
cagctccctcgctcaggggagtcgcagcagtaaattggttatgctaaacactccacctgagggcttcaatctggatttttttcacatctctagacctgtggaaaaggcattatgtgtgggacccgccccgttgccctctcagctctgcaatatcccttgctctacggactgcatagtatcttcctggtcagcctggggcctgtgcatccatgaaaactgtcatgatcctcaggggaaaaaagaaatccttccattaggaatcatggaaggcttgtggctgttggttattcagagtacattagaaaatcagccagtgttcacagccttcacacccttccatcgcgtcatgacaggcagacaagggaaccatgatcggcaggttggtgcttgtcaagtaaagctaggatgcctttcagaggaatttaaattgggatttagaacgaggcagcgccatgtcctcatggaatctacagggcctgcagggcattgccctcatttggtggagtctgttccttgtgaggatccaatgtgctaccgatggctggcatcagaagggatctgtttccctgatcatggaaaatgtggcctgggacatcgtattctgaaggccgtctgccagaatgaccgcggtatgacccagtgacccactagaggtgttaggatgttaagtatcagccaaataacacatgaccacccttcaatagatcattctcatgaggaagagaagcacagcctttcttatccttgaatatttatgtttacatcgagtgacacattgctgcaaagtaaggtgccgtgacttaatatgggtccacatactccatgacagaacactatttgattgtacttaaatgcaatacagcaaacctagagatttcttaagagtttttaatttgtcaaaaaaacagagaacaaatctcttggatagtgttcaacttatcaatataaaacaagtaaaagccaatgtataacatgcctttatatattataaacaaatgtcatcttgttaagaatccaggactgaaacatcctgcaagttaaaaaaagaaccaaacaaaactaggtggctttttgtttatatgacattagagttgaatcagctatagacacaatactaacatttccaaagaactgtttttaaatacaagttgtcaagatttacaaaactattaacaatgatgtctttcctcaatcagcaagcacctgtattctccctgttggattgggctgccaaaacagacatcaataaacctgttttcaaatcttgctcatggtgcttgaaatctcagccagctttagcaccagaattattcccatccttgtttaaatcaaagtagataatggctactgggtcgtgacaaatggcaggaatcattatttacatatttaggtgaagtagccaatgcaaacttagaggtgaaataactcacctagagacacccaacttagaatggcaggctagaattcaaacccaggtctatctgcttgtaaattagtgcctttagcagtattcatagcagtagaaccttgatcaaatatattgatggtgatacatttctagtcatttaaaaatttcctcagtttgtgctagctctatggaaaccaaaaacatctcagatgctaaaacatctgttcagctcaattatgctcatttcagttcaattagcatttattgactacttactatgagccaagtactgttctaagaagtggggattcagaaatacataagatacatcattttctttggccaaggaggtgatataatgggttaaagacttaagacattatgcaaccctgaatttactgagcagctgtttccctccatttgttatgtctcaggaaaaaatgcatgtgtacaaataacctaataagtgcagtttaactgcctagaaaaattagaaaattattcttttaatcagtaggccagatagaataagataaattatcagaaatatctaatgttcttaaattgcttccaaataaactatgccttgcaggcaataattgtcaatataattattaatgatataattacaatttgacctcttaagtagacatccaataaaataatccttatttcatggacatgtttcttttttattttaatgcagaggaaaaaggagtacatgtatttcaaatgtctgtattcttcatctttttttactctgagcacacaacttgacttaaatgtcactattattgttctgaagtgttgaggagaatttgacaatgatataaagtgatgtttggatttttgaaacatttgcttaagttcactccttgtgttttgaaatatctcagcatatattttatttatatttaaatatatcttaagtgaaagtgtgatttctttctgaattattagagattggctagaaacatggcagtgccaaattgagtgttgtaataactggtagatttgttttcccaagtacaagaattcttagatgttgatgagctctacaaatttttcataaattccaaaatgtagaggatccaaagacaagaactggcaatatcatggttgctataatagcaggcatataattcagacaaaaacagaagaggttaccaaccaactcaagaaaaaggcaagctcatcttgctttttgcatactttattcaaagtcaagcttcctagaggcctgagctgaaaaatgtgttagagtgaaaatggtttgccatggtctgtaactttcaatatgttactgtcacaattatatcataaaaactagtaggagcaaatactgtaaaagcaaaagattgcttatgcattaagtagactaaacatctttccctttacttctcatttacttcttcatccaaaatttattgagacctactatgtggctgacattgtgccggatgtttgcacaatgttataaacagcagtctcaccttcatcatggtgcattatactaaatggatactaaataatatttcagccacaaggtaattttcattgcatcatacaggttgacaggatgttatagtgctagactctcagttgttacttcagtaaacattcactatggaaaaattgtgctatagaactgtaggtgaaaactagtgttggtgttgtatactaggacacactggttggagaattcactctatccaaaattataaaattatatgttctaatacagaagtttcaactctctttttttgtgtgtgtgcatagagcaatgtattttctgttccttcctgaaaatttgtatttttaaatacaaactgaatacagcaccacaatctatacaggaaaaagttaataagatgacttcagcaaaattaaaactttctctgcagaagacactgtttagaaaatggaaaaaaaaaagactctaaaaggacattttcaaatcacatgtgtgacaaataatttctttctagaatgtataaggaacttacaaaactcaacaataaaaaaaaatcccaattaaaataataagccaaagatttgaaaagactcttcaccaaagatatacggatggcaaataagcacatgaaaagatgcatcattagtcaataggaaaatgcaaattaaaaatacagtttaataacactacccacctataagaatgacaacaattcaataaagaacagaaagaaactggttataccaagtgctattaagggtgtagaacagttagagcaatgtagaactctcaaacattgctcatgggaaggcaaaagagtgcagacactttggagaacagtttggcagtgtcttataacatctacacttgccatatgattcagcaatttcacccttaattatttacccaagagaaatgaaaacttgtagtaatcttgcatagcagctttatgcacaatc

SEQ ID NO: 473407 - DNA, 808 bp, Homo sapiens
aaaccaggtcttcccaggcctgttttatcatgtggggatagtcctgaaattcctgagtgtccctgtatgggctgtggaaatgttgactgctccaggaaactagaactggcttgaagtcaggtgtaggtggctgtgaagtatgtggaccagaagataggaaaactgtgtcatggaccctagaaattcgcagtggctgcagaggaagtcttgtgaaattccctgccgaatggactgtgtgctgagcgagtggacggagtggtcatcctgttcccagtcctgttcaaataaaaactcagatgggaaacagaccaggtcaagaactatcctggcactggctggggaaggtggaaagccatgtccccctagtcaggctctccaagagcatcgtttgtgtaatgaccattcctgtatgcagcttcactgggagacatcgccttggggcccttgttctgaggacacattggtaactgcccttaatgcaaccattggctggaatggagaagccacgtgtggtgtaggcattcagactcggagagtcttctgtgtcaagagtcacgtgggacaagtaatgaccaaaagacttaagagaaaaagagagagaaagggccatatcatggagagttcaagtattacccagtgagtgtttatgtctattaactgtctgtttaaacttgctagactggtgttttttcaatcataattttttcaggtgctttgtctccatgaagctttgggtccattacttatttcaacatctcagcttatcatatgaaaatgaagattataatgctcatcattgctgttaaga

SEQ ID NO: 473408 - DNA, 884 bp, Homo sapiens
ctgagcaccagtattccttgatagagaaacagctagcagctatatatgccacccttcaggcttgtgagagtatggcaggatgggctgcagtcatcatgcagatgacttacccgatagtgggatgggtgcattcatgcataacaatcccctggactgggatggtgcagacatccactttagcaaagtggggcacctacttagaacagcagagtacactgagtacaagccccttaggagcaaagttgcaagaggtcttgggatctgtagtcctaatgcacaataaggccatggggtctgaggcacccctagaccctgagccttcactgtttaaggaagggtgtcccccattcccaatgggacatggtatatggatgggtctagccaggatgctgctgctgcctggacttctgttgaagtccagcctagtactgacaccatatggtttgatagcaggtgtggatatagtagccaatgggctgagtttagagcagcatagatggtgatcaccaaggaagcgacacctatggtaatctgtaccaatagctggatgttctaatgaggcttgaccttgtggttaaccacctggaaaatacagaagtggctagttggccaccaacccatgtggggccaagccatgtgacaagacctgtaggtggaaggatgacctcctccaaccaagcatgggacaaatggtaacctgttgttgcctgccccagtgcccctaaaggaggagcataaatttaatccatctatgtcttttaaaaggaatgtaaatttaatctatttacattcaagttaatacttacatgtgaggttttgctcctgtcatatttgtctttaggtgaaattgtctttaggtgaaattctgttgtgttgccattaga

SEQ ID NO: 473409 - DNA, 1588 bp, Homo sapiens
cctcctcctgcaagctggtttctgattcagcagctctgcgatgggacccgataatttgtcattctacaaaggtatccagtgcttctgctgccgctctgaggaccatactttgagaagcactcgcctaacagggaacattgctgagatgctgccagattcccaaagtactgcagattatcattcaagctcaacatggctacaggtctcgagacttactgacaaggatggagactggtgtagttgctgctgttcaggctctcaccagttcctcctgatgctgcctgagaaggcagagattcctcaggtgaggcacctggtgcttctaagtggaggaagaagcttcatggcctgggttgcctttgtcttctgcccacccaattcctcttggtggaggaggaaaatctcaggcccagcagaaaaggaaaactcttcctgtgctccttcattgccaacagggctcccagtcaatgcccttcggtagagctgattgcatgttccatgacagctggatcttgtctattttactcactgcagtattcccagtgccaagcacactacctgcttttcaaatgaataaatgaatttcactcattcaaatatggaagcccaaagcaaaaagctccttattctaaaagtaataataattaaataatttgaaaatggttagttttaaaattattaggacaaatttttaccaattatatttttattaaatatttggtcattgcttgttctataaaaatgaaatgtatctgaaatgttgatttggattatattgcatgttcataatctcaaatgttacgtctctacatactatctgcaataggaattaaaaaatgcatttccagagtgtccttttacatagtgccttatacaggggagtgcttactaatattagataataatcagagatcaagaaaattttcttcttggctttgttcttgtgttctctttcatcaatgaattagaatatgctgattaaaaccatgttaaagaactcctagaaagaagcaaaagcatctgtgactagtgtatctctacttcatttcaattgtggtctccaaatttcatcttacataagtattgtcttatgtacttatttttagcagcttcttgaattatataacacagggcaaaaatgcttatttctcactggatttgtatgacttctagtaaattaaattccagagataatttggaaagaaaaataaaaagtatatgtagcctgttccataggattttcgttagaacgcccttgagaatattgagtgtgtgtgtgtgttacactatcaccttacttaaattcttaaactagagttgtttcctctttctattcactgctcttgggatcaaccaccctcctacttccttgatttatcctaggattttaactttttgtaattttcctttcacaaggatatggtttgaatgtcataacaactcaactgttataaaatattttaaatccaaatatcagagaaaagcatactgatatttagctttgaaaaattttatgtttgagttgtaaaatttggttagtatcaagttatgcatggaaacatatataatttatataaatatataaaac

SEQ ID NO: 473410 - DNA, 3546 bp, Homo sapiens
tgctcatcaaaaactttattttccttgctctgggagagaaaaaaaacctagtatgtccggagttggttccttccggtgggtttgtggtctccttgacttcaagaatgaagctgcggaccttcgtggaggattcaggcaaacaattgcatctaaagatgcaattggacaaagatcttctaagcttactcgtgtgggcctccattcctcacgggctattgagctgaaggcctcagtttcttactggctattttttgctacagaactgcctcatgacaggacagctggcttctttaagatgaaagttgttactgataatttgaagggcaggggtgaaactggcattgaagtctacaaaaaaagtgaactgttttatgtagtagagacaaaatatgacaaaacagaaagtcaattaggtcccggtggcaaatggtggtatcattttttcctggcatactaagattttaaatataatataaaaagagtaaagtttgaagaaacattacaatcatttttttcaataaactttccaaataagaaataccttttatgccatctttgaagggaaattggatacctacagtaaaggacaacatactacttcttaaaatagaccaatctctaaactggaaagtttaagtttttgatgttaccagctaacgttgtagataaacatctctgtaactgccaagagggaaactatactttcatttcttttcatgtctcttgttcaagcacatgttattttaaaattaaaatagcataaatagtaaaacaaattctttagttgcatattgatgatttaagaataaattgtgatttcagaactgtgtaaatggatataatacttgcttattaacggtgtgattattgtagcaactttagtggactcattacttggttggctcatcttgaccttgtagtgaccgtaaacaccaatgtattttatgtgattttataagtgaatactaccaggctggtttctcccttcttgaacttttttttttttagcataaaagaatgaattaaaaatagctgtgttaagtataaatacattgctttacaaatttctagtcattcagcattatttaacaatttgaattgtgagagatagagaaatagttttgatgactgaatcctagcatttactccttctcctatccaagatttcccattaaaatagcatactaaactggattaatttaaaaacagaaaaaaaatggattcatcgtcaaacaaacattcattacccacatggaaatctttatcaaagttagtttgtggaatataacttgaaccaacattgtaagtatagcatggtagattccaacttgaagttaaatatttatacatatataattgagctgagaacacttatcacgtggccagttctatgaagcctggaaaactatgtcttttatttatctaaaggctttcgaggccaaagagaaggtaagaaatagcacttcatgtgaatattggagatgagagagtatatggatactctgtattccactcaacattttttaaacctaaaactgttcttcaaaataaagtctattaatttaaaataataatcttataatgtccattgaccaaaattttcactaaaaaatgggtatgcaagccacagacagggaaacatatttacaatatataaattaaatatttatttttagaacatacacagtatccctgcacatttttaaggcaatcaacccaataaaaatggtgaaaatgtcaaatacctgacagaagatatatcaaatagcacacagccaatagaaaaaaaacaaaaacaaaaacaaaagtaatcaacataattaatcgttgggggaataaaaatttaaaacaataaaaacagtcagatgccaataaaatagctgaaataaggctgacacactaaatactggcaaggatttgcagcaactggattgctggcaggagcgtgcacaacaaggccagagaaccattttacagatttatgtctgcttgtattacacctattgctcagaaataaaccagggggagaaaaaagcctgctgtaatacacagcatgaatggatctcatgaaacattttcattaaatcattcagacatactaataaaaaagcagtttctcttacattcctaggggaaaaatgcaaggaggagaaaaacaaacaaaagaaaaacggaggtgacattaaccattagtagatgtaaagtattgttattaagctcactaattcccactgtatcccattgggatggttatcattgcccacattttatatgtggagaagttgaaatttagagataagttcaaaatcacacaaaggagacaaagctggaaattgacatctaaccattctaatggaaaaattatgttctcgttatggcagaattgttctttcaaagcaattattttactaacgaaagagaccaacaagaatcattatgtttctcctcaatatttagtaagacctcacttctttggagctttcagataaatgaattaatataactaactaaaaagcatacatttagaagctttaaatgtaaattacgcatatgagtttaaacatattattttaaaacatatttagtagaaaaaagaaaataaatttagcaggaagtaggttgttaaaaatttatttttattagcataaatctggatataactctatttggctaatcagtatttgatgagggtgcctaacaaaataaaaccagtcattaatacatgttaacaagcacttgttatgcttacagttctctgaaacccactgtaatgaacaagataatattcctgaaaccgtggagattacagttttacataaactgaagggaatggggagagaaaggggatactgggtatctgttcaataggctctaacttcttgactaaatattcataagaatataaaattgtctaggttgaagttattatttttatgtgagtgatatgactaaatttttaaatgaaattactatatgtatacaattacaaagataacatatttttagacatttatggaaaactacattttctaggattttgaaaatatattaatttttcactctattgattttaaatcatttagaactctaatattaagtaaaagaacactattgtatttgaaccactatattcataatttattaaactatagtctccaacaattgtttgccccaatatggaaaaaaaatcctatttgcaataattagctttagtcataataaatgaagcagatttattgttagaagactcagaatccctctttggaaaaaagactgtttcgtatcttccacatgtgaatgctaaggctgtccagtggaatgttttccatgaatcatgctctgcgaggacattccttctccattacccccattagctacatccaaagaagaaacaggataaaataccagttataagtcaatgttaaaattcagactatttcatagggcaataatatatgaatattatgctgcaaaaggagtaaaatttagaggaaagaatattaattgaacaaaaatgtagaggaacaatattaaattgaaaatatc

SEQ ID NO: 473411 - DNA, 570 bp, Homo sapiens
gttttgaaatttgccaggcagtgtgaaaagaaaatatggggtcagagcccccagacagagtccccactgtggcactgactagtggagctgtgagaagagggctgccattatcaagatcctggaatggtagatccacggacagcttgtactgtgctcctggaaaatcttcatacactcagcaccagcccatgaaagtagctaggattggggatgtaccttgcaatgccacaggggcagatgttctcccttgtgggatgcaacattcaagaaactcttggaagcagcaacgtggccctcaccagaacttgggagacttcctagccttcaaaagtctcccagacatttctagacacagcctggacatgaaaggaactcacttcctaaaagggaaagactccacatcctggatattggatgacatctctcgacccacttggggccagggagatctcaccaccctgaagggaaggacacaagcctggttgttggttgttgtatacaagatgtacacaaaatctgctgattatagaacccttgggccttgagtgaacataaatggtagcctctcag

SEQ ID NO: 473412 - DNA, 632 bp, Homo sapiens
aggtgatttcattgaccccaattttggaagcaaggagaaacaagcatggtcgcattaccagccaagcctctcaaagctgtagaggtgaaagctgaaggtgagggtaattcagaagaggaagtgtatgggaagagaatgagttacggttgtggcttcaagaccatttgggatcgcttccatcagtgttgtaacgagctcttctatgcagtttgtactcactgcaaaatgtaccgaagccaagagcaaggagttggtaatctgggcacccacagttgtgatgaggcatcttcagttcattcctctaaagctgctgcaccccttggacaagggccaaacctttataaagccaaggaagaatggtggaaaagcacatacgtctttgtggctccatatgcaaatggactggtgcatgactcagtcgtagagagccaaaccaactatggcatggaacagatggcaggatttagaagattctactctgtatctccagcacctaatataattggtgtaaaaaatttaacatacacaaacttcaaactataggagcgagagaaaaaatatataaagatgttaggttgctgactttgaagatgaagttaggggtcacaagtcaagatatgaaggaagcctct

SEQ ID NO: 473413 - DNA, 1424 bp, Homo sapiens
ccaggtctataaaaccggaaattgcggttatgtttggactgaagtccactgaagaagaagagactacacaattccagagtttaggatgtggattagtcggccaaagctcggagaagtttgatcgtctgaacccttcttctctcaactcatcaaagtcattttccatccagctttgttccattgctggagaggagctgcattgctttggagggggagagcaccccaaatgcaatccatgggccattgttgtctgctctaccttcaaaaggggtctagaacctaaacaattcgcctacatctacgatatccctggtccaacccaatctcacctccatcttggattttttttcatatcatctatcccggaattcctacttccaccattccctgctgcagaagccagagggattgttctaaaatccaagtcaggtcatttcactcctcctctcagtggagcagcgattcactaactttccattgtatgaataaaaaagacaatgttctatcttttttttcacttaagctttttattttgaaatcattcatcaagtggtattttatcttaacctaagatgtctttaataaaaaggtatcaatgatgtgataattcaattcagaagcctccagagatttgctcatgttatatttgtcacacaaaagcagagatctactcaagtggaatgtgaatcactgtgttcatttatatttagcactattaataaactatgaattgaagatatgacaagtacttcttaacatggtttatacaatacataaatataaaatgtttaatatatattaactataatgatacatttatgttatatattttatgatacatttaatttaaaagtacagcaattaattcatcttggatgtcaagtaataatcacatctctgcaactttgtagttaaattttatgtttccttctttccccccttccttctttctttttgaacaccatgaactcctcaagatgcactgttgtatcattttaatatataataaattgcattgcttttagcatatgatgtgctttcaatattttgtagtagatgggataaaaaaattataatttaggtctaccaaacaattttatgtctttacaaaaaccctggtgggattttctaggttataaagattgaatgaatcctttcataccctgcattggaatgaggagtactaaaagctaaaactatccaataaacctacctcctttattttacagtctcttcaggcttgcagtatatatgaaaatacaatgattacttagtttgttgcatcaagaaggtttagagtattctcttagttattctgaatctttccatatgaagagtgtaagataggtatttacacaggtatcaggtatttggttgtcatttcctaccgttactgaaatgtagcatttgaaaaattattgctc

SEQ ID NO: 473414 - DNA, 533 bp, Homo sapiens
cgtaatcaatgttgtcctttttcaaagctgcatgatgcaaaaagccgaaggctcgtttctctgcaccagaagcgtgttatattccaaggtcctcagacagctccccttcgccctagtgaagtatactcctatttatttgcaaaaaaagctaagtgtaaaacaggcaggttcttcagggggtattcctgaagtaggcgttgttatcataggagatgacagttccttgggtgatattgcccctgaagaccctttaatgggacaagatgtggaggtggaagacagtgatattgaggatcttgaccttgtaatatcttattgtactgtactgagggtaactgacactgtggatggcaaaactgcaaataagtggggactactgtattcatttaggtttgtcaggtttttcggtggactgacttttatcatgttaaataatgtttcactgtctgaatgtactgcagtttatttatccattcatttactgaagatatcttgattatttgcacatttgggaattatgaataaaactaaag

SEQ ID NO: 473415 - DNA, 643 bp, Homo sapiens
aaccatttgggtccagcctccaccggtgataaccgggcaagcagggtctggagtggacctccagcaaactccagcagagctgcagcagaggggcctgttagaaggaaaactaacaaacagaaaggaatagtatcaacatcaacaaaaaggacgtccactcagagactccagccgaagttcactgacttcaaagaccgaaggtagctaaatccatgaagatgaggagaagccagcgcaaaaaggctgaaaattccaaaaaccagaacgcctcttcttcaaagaatcacaactcctctccagcaagggaacaaaaccagacggagaatgattttgacaaattgacagaaatgggcttcagaaggtgggtaataacaaacttctctgagctaaaggagcatgttctaacccaaagcaaggaagctaagacccttgaaaaaaggttagacaaattgctaactagaataaccagtttagagaagaacatatatgacctgatggagctgaaaaacacagcactagaacttcatgaagcatacacaagtatcaatagccgaatttatttatgtcaatttttatccacaacaggaagtgtatactatttaataaatgatagtctaatgaatgaatggatatgatggaaaga

SEQ ID NO: 473416 - DNA, 850 bp, Homo sapiens
tgcagctgctgtaccagatgtggtttcattgcttaagcaaataaatacatctgctggtaccttgcatgcagccattgacttggcaagttcctttttctccactcctgtccataaggtccaccagaagcaacttgccttcagctggcaaggacccagcagatccaacggtgcttgaggtgtcagtggcaaatagggatactttttggagcctttggcaggctccaataggtgaatcacagtggaggcctctagaattttggagcaaggccctgccatcttctgcaaataactactctccttttgagatacagctcttggcctgttactgggctttggtggaaactgaacgtttgactatggatcatcaagtcaccaatgtgacccgaactgcctatcaggaactgggtgttttggacccatctagccataaagtgggtcatgcacagcagcactccatcatccaatggaagtggtatatatgtaattgggctcgagcaggtcctgaaggcaaaagaaagttacataaggaagtggctcaaatgcccatggtctccactcttgccatcctgccttctctcccccagcctgcaccgatggcctcattgggaattccctgtgatcaattgacagaggaaaagaagacaagggcctggttcattgatggttctgcacgatatgcaggcatcacctgaaagtggacagctgtagcactacagccctttctaggacatcactgaaggagagtggtgaagggaagccttctcagtgggagaacttcaagcagtgcacctggtcgtgcactttacatggaaggaaagatagacagatgtacaattatatgcgaattaac

SEQ ID NO: 473417 - DNA, 796 bp, Homo sapiens
ggaagaggggcacaaggaatgtgaatgtcaggccccagtggtggaagcagcaggccaactgtgcctgtttttgggtttgcaggcagtatacataggcgctgttgtaagcagtttctagcaggccaattcttgggcttccaagcagcttgcttgggtgctgacagtggacaacagtgggtcaagtggatggaggggtccttgagcccctgggcagcgagtgtggcatggatgatagtagtagtagtgatgggacaaaccttgggctcccaagcagcacatgctggttttagcattggctgcaatgggcaaggcaaccagttcccatgttcccagggagtgtgcaagaatgcagcagccctgctgctggtggaagaagattgctatcagtggcagtttctgtttctttcccttcatctgaagattgatttacttctggttcatgcatgtgctcatggtcactaccatcagaggggtgacagaagtcgcacagctgtgattgctgctggcagctactccataaccccaggggaactagccttcagaggaagcttactctgaggttgcaggggagagagacagagagaaattaggcatttggtgacatcattgagctgatggatagaccaaccctgaaacttttcttattctgtactttcagtgtacaattcaataatttttagtaagtttacagaattgtgcagccattaccatgatccagttttatttttatttatttatttatttatttatttttattatactttaagttttagggtacatgtgcacaacgtgcagg

SEQ ID NO: 473418 - DNA, 883 bp, Homo sapiens
caccacagcctaccgcgcctactgcgcccccaatatcgccttatgaggattttgtggaggatctccttcccccagatccaaaaaaatccctctaaaatgcactatcagcagccgttgcggcccaaacctcctgtactatctcagccttgctatagggctctccaccatccgcctgttcagcccggttatgaggctctcaaccctatccctgttcggctcgataatgaggccctcaacgctatctctgcactcaattctgcctttctttctatgcatcaggctcctcagaagtctgacttgcagtcagtgcaccagcctggaactcaggccctgcagtcaatgcaccagcctggaactcaggccctgcagtcaatgcagcagcctggagttcaggcctctgaaagacctgcacagcaggcaaccgcgcgtcagcctggcttaaaggctctcaatttctcctctattcaaaactccaatttcctttctgcttctgggccatttctcaggcaagggaatatggggatcccgaggcatggcagtttcctgttattttacaatctgctatacctgctgcctctattcctgccgcccctgctccagctggctgcaccagttcagccacagccctttgaccaagctcagcaggcagctgatcccgctgccgctgctcctccagacccgcagcttaatgatcaggcccctcagcatttctcctcctcctctcactcttctcccaactttagaaagccctcttgggaatgattttattgaaagcatcagaacgaagaagatggctgcatcatttctgtagtgccaggggtcagaatctttgactggtttggtgtaatgtgcacatataaaatttcactcagtccttattcat

SEQ ID NO: 473419 - DNA, 470 bp, Homo sapiens
ctctgtgaatttcagctaagaattctaaagcaaaccataaatgaaaacggaatctaagaatggatttgaaccctgtgctacaatgtctaaaccaggagtttccactttttgtggaatggaataataaggactcagacatgagtctatatggattgggcaaagaggggccatttatgcctgagaccatcatcctcaacttgccctcaaacttctttgccccttctagacccatgcatcatattcatatagcacattatctggaaagacaaagaacacaacttgcctggcatcccacgcttcaccctgacagaatgggcttaggttacagatcaagccaggaactagtgactaaggccagggaaggggaatatgatgacagattaagccaatcaagggtcgtcctagagcttcgccctaaacacatgagcttcctaggagaaagaataagtattattagaaaagaataagag

SEQ ID NO: 473420 - DNA, 1954 bp, Homo sapiens
ttgacaccttcattacagtcttgtgagaccctgagcagaggatccaggctgcagccacagacaggcactcttacgctcccagatggcggtgctgggaggtgcccctcaccttgggcctggaggctctttcttcctatgcccctggtggagctggggggacacctccaagccgctaacatgtcacaggaaatgcagggagacaggaagattgcatggtctagaacttctctctgggagatcgctgcacttgtttcaaaggaagccctggacaaggcccttgggctcccaggccctccccgatacggaaatattaactcaattgtacatgaatatcagtgtgtcatgcccccagtccttaatctccctggaaccccaagtccttcacttgccctgggccaccccacatctccatctaggcccagtgacaagcccttgtttactctgaaaacccaactcaaacggcaattcccttgtaaattctcccataaatttccttgtaaatactcttcccaggacaaaactccagagcccattgttccaaaagttccagagaaatccaaacaaatgcccaacaacaatatggggtccagctcaaccctgcttgccaagcctagggcccttcgcagtggtgggaaaaaggaggcagccatggataagacacttgcagaaagttagcaattgactgaatctcctcaaacactacaagattttcatgggctaatatcttcagcagaaaaagaaaaattgctgaactcataaattgtgattttgcatgctcatctatttccagagcgccttgctagataactaagagcttgttctttgattatggccatttagtaaatgggatctaacaggcttgttttgagtctcacgagccttgcagtttgctccaagaagctgtctgttccagcgcttccatctggcagatggcctcactgtgatgcactcagaagtcaggagaaccgcagcatcaacagaagcacaattaatcagtgcaattgttttccctgctgtgaacatgacacttccctgggtttttgagggcaacccacacaggaaggacctagttttgcattctctatggcattcaaaaccatgttgagtgtccaagaagcttttgtttctgacattggtcttcctgttcattctctatgtccctgaaaacactgctgcagtcaccaaccaggccaccatgcagggcagcaaagcgcttggccctccttgtcctggtggggatggcggtgttgtgtctcacaaggagtctgaagttacctcgaggtcagcaccgatgaatggtcctgaccggaggctgtctggattccgggctttgctaattgttatttttatgagaaaattacttgtttttgttccttgcagaccagaaggaggaaaacaacttaaactagtagctgaacaggaaggggaagcccatagctccctaatgagatatcagctgagagctgtggatttgtggagcctctggaagcaaaggcccgggaggctgcgactcctttagagctgttggcccagcccgagccaggccttttttgggaacctgtgaatctcaggttttcagtctacaaaatgacaactcaaaacctgctgaattatgtgatcctcaggattaaaagcagttaggggcttggggggtctccctgggaagaacaagtaacaaagagactcaaagtaccacgggttgtggtggagacagaggaccccatggttaaagaggagagggtggtttaaacacagaaatttattctctcacagttccagaggcctgaagttcaaaaccaaggtgtcagcaggcccatgctccctctgaaggctctcggggagaatgctttgcccctctagcttctggaggctccgggcatgtagacctaccctaaatccagaaaagtctcatcccaagaccttcagcttaattatatcagcaaagactgtgttt

SEQ ID NO: 473421 - DNA, 942 bp, Homo sapiens
ctgtcatggacacatgcctggaggtgggaggcagagtgggtggctgaaccaggaattgcctgagagacagacgaagtggacaaagtcgctgacagacctgagttactgccttggtcctggtgaccctgctccaggcagtccatctctgtctgcgatcccggcaccactcccggtggttcattattgcccagaggggcctctggagtgcaagcctcaaacagggagacagacctgggaagactccatgaggctccacagcaaccagacagttctaaagtcagcgtccctggcttccagctccaacactggacattcccccgtggctcccctgcctgggaatctggtggaggctgattgggcagcccaggggatgccggtggggtgcggggaggaaaggctgcaagggcagcttggctggatcatggaggcccgggtgacctggggctgtgacagtaggtatgagggacgtgaggggtctgagacaagcagtgagggtgcactgcccagccttcctgcttgtgggttaggagctgtcggtgaggattctaagggtgtgacccttgatgatgaggtgaatgtgttatggctcacaggaacagggaagatgggaggaggagtgggcttacagcaaagagaagcgttttattttattcagcttggccgtgagacttctctgtggcgataggtgagtttgccaaatctggagctcgagaaccaagtcaaggctgtagctgcatatttaggagtaaaggtagaaattgaagtaatgggagggagtaagagtgttgaagatggaagtttttcatgccagaaataagctgtttaaggaaatgaccaatctcctagaaatctccaaggcctatgttaaaaccatcccttacccctgcaaagataccatatgcacgtacctctaacattgcctggtttatgtcatgtgcacct

SEQ ID NO: 473422 - DNA, 2047 bp, Homo sapiens
ccgtggacatactgtcttctctggagttacagagggagttgggttcattgccaccctcattagatgctttgctccaagcaggcaggtgaaccaggattctcgaatgcttactgcacagacccagccacttacacgtcgtccccgtggagcttggagccacgcttggtggttcgcgcctccgcgcctccgggggcgcagtgtccagctcaggccgcacgatggcgcccgcttcctgcggacccggcccacggcggcggcacagacaaagacgggcatcgggcctcccccgcggggcggtggaggcggcgggcgccccgggtggccgaggccgcccctgcgcgccgaaccaggcagctgccgcccgagtctttgtcctacgctgctcgcccttgtgctaaaggacaagcaaagaggacgaggggagctggcggctccggccaggcatccacccgactcccgtcccagctctcacaccccaaagcccggccccgcgcgagctggggtggctgcaagcgcctgcgtggggacgaccccaaaggcctgcccaggaagctttcctccacctccacacctctgtaaagaattttcccggaattccgcactgtggaggttttgcagcactgccctgacttcccatttgaaaggctacagggcctgggtgtcccgggtgcagaggagacatgcatttaggttgactgcaaactcgtgagcatctgggcctggctgttccaagcgcagctctgcaggggtccaggaaaacttctctcctctcgtgttctggcaccctctagtcccgcagtccagtagagtttactgggatgatgccaatgttctgtctccactggccaatatggtggccactagccacacgtggccatggatcgcttgaggtgtggctgaagaactgaattttaaactgtatttaattttaataaacttgaatttagagcaaaagttgaacataaaattcacaagttacctgcagcagcaatcatcagggttctggtacctcaagaatgcctcgtcacctgtctcctccaagaatgtaaaccaatcaacgacttccatttatttttattgaaaataaacatgtataccttcttataggttccttggtctagtgtattgaatctttccaataagcaatgcaattatgtgactgttttctaaaatctgaggtggatgccaccttttagcatccaccttttgatcttccagctgaggtgtcctggcaaggctccttgcccatagtaggcattcaataaatttttggtgaattttatgtaagaagggaaaatgggccaggattccatatccaagctatcgttgtgggctgtccatccatctctttttgtttttgtttcttttcccctggagatgttgccgaccacaaataaagaacaagggggaaaatagttaagcacacctagagctgcgtccaaacaaaagaggaaagagactaaacaaacccaaggttttctatttctccctgagccaagtaatccctttgattacatctaatacctgccaaaacccagatggtgtgcccacccatctcccgtgtgataatgccacattgtgaaatctacctattaatattaattgtcagttagagaatctgtctgaactactaaagcttgagattgccttgagaaagcaggccctgctttagcagggattttaagataattctcattctttcattctgtatctcacatatgtagaatgttaaacaatagcctgagaatgcttttctaatttcggtacatgcctgcctcttgcaatccaggtcttaaaccactgttcatttggggtctacacctgctgaccaaaatattaccttaaactgctgtgggcttgccagcgacatgtaagcacacactgttcaccatatagagagaattttaactccctgggagctgtttgaattgaatgtgccctagcatgtgatgctcaactatttcctttttatttttctccctctcagtaattgacttggtaatccttgaaaagtattaccaaatctcagttttttcaattattgtat

SEQ ID NO: 473423 - DNA, 545 bp, Homo sapiens
tgagagtgcagggcctctcctcacacgttggagctaactcatgaggatgagcttcttggaagcagtaggaattgatctggggcttcaaggatcagaatgtcgaaggacggtagcagtgcgctcagtggaggccacgggtgcctcagagggatttctcttggacctcctgccctaccccagcttcggcgttgcacttggagaaggccctggatatctcaggggaaggtgtgtctacttgcagacatttgagcagatacctgaagataaagaagtgggccatggagatctttggggaaagggtgctgcaggcagagggactggtcagtgcaaaggcccaggccagagagcatgtgtcatgttggaggagcagcgaggtggccagtgtggctggaatggtgagggccaggaaaaagtgccccaaccgcactgtagaactggcctgaagatgaaaccaccattgcagctactgagaactcaatgataagaacttgtcatttctaccctgtgcactgctgcttcccaagaactgatgctaccgtgtcagc

SEQ ID NO: 473424 - DNA, 594 bp, Homo sapiens
cgaatagtgtccccagatactgccagatgttccctgggggcaaaatggaccacggtgagaatcgcagctctatacaacagaaagaggagaagcagtctagatcatggaaagcagttggacctgaagctacatgtagcaagcagtcagtccaatatttgctctggctgcccccacacaggcttgcaagccctcagcttccgcaactgtcagagaagacactggacagggttattcctaatgatttaaaaaagcatccttgtcggtcacattccagatctttctttttgtctcttcttctctctgggtattctggtctttctctttggctacagtctctacataaccagacccacacccaatatatcagcgaggcattcagcatcctgggccagccacaatctcacagcctgcacagcagtcacattcccggttgtattttcaacctcgtttcagcacccctaggcggtgtacacgctgagaaactttggttcttttagctgtctggatgatcttttattttagtgaccctgggcagaacacaaaccgagctcagtctgctgacggagacctgacctctttttatgtagctatgtc

SEQ ID NO: 473425 - DNA, 483 bp, Homo sapiens
cccgggaacaggatgaaaggggatggagaacagtttcactgggatgcggaatttgattttgatgcatcctcttgttccttttaggtcactcttgtcctggaagcgcccacaggcaaagccattttatgcatcaggcgctgtaggcacagtgcctaggggatgtgggaatgctgagtgtgatggcgcagcccacatgatcaaggacaactcgatgctggcgggagtgcctaaacatatcttggtcctacttgcagtcagctgcgaaggtgaggagtctgaacctatttgtttaattgttagagaatctaagagtgatggaaaagttaaaaatacttttgtccctgactcccatgagattacacctaaagtaatcaagactagaggaaacttaacctatgtatacataccgaacccagaaccctcactggaaacagtacaactgtcatacccaagaggcagtttacacccagtatgaatcccagc

SEQ ID NO: 473426 - DNA, 506 bp, Homo sapiens
acgcatgcaacaagcattcgttggcaggtgtaccagggaccaagatgaaagagacttctaaggatgagaacactgaggctactggcaatggcaaacaggggagttctgtggctgcagaggggaaacagctgatgagaattccccacgagatagttctttcctcttgcacaaaggggctggctggtgtctggaaagcttgggagatgtcctttgtagacctggtccttgagggatgcctcatgctgggaggacaggtccccggggcctggcaggtgatcgtgcatgggtctggaggactgcaagggagtctgggaaatgttttcctggactggacagctaagttccctgttaaaacctctacgactgtggacagagaagacaacagatactggagtacaacaagcactttagcatttaatcgcaactctagcgtaacagaggccaagccatgtggtaggccagtgtttcgcacatttaatatgatgtgatgtgaatcacctggggag

SEQ ID NO: 473427 - DNA, 656 bp, Homo sapiens
gcagaaagcaaaagatcaacaacctgtagcaaaatgagcaaaagtatgaacagatgcgcattccaaatgtcccagggaaaggtctttgttttagggatgctgaaagacggaaaagctctgagttgcttgttagaggtcaaagttgatggaccagtggtttgtttctctcaggccagtgttatagagccagaggctcttccagaagaaggaacaaaggacctggatgaaaacaacaacaacaacaacaacaacaacaacaacaacaacaacactttttttaactctccaaaatggtatttgttcacgttcagtcctggtcgattgtctgccgccatattggatcttactcctgtgactttgtctcctcacgtcctctacttgaaatgctctgtacaaacccacttgtctttccaggcccatttcaaattctctttcttccatgaaaccttccctttctactccaagtcgatgttacccctgaattaaacatatactgcatatctccttatgtgttctcatgggactaccttaataagttacagtggctttgttcaaaacaaaaaaaatgattctaaactctgagaacaaagcagacaaggcctggtgaggtgaacattagacgtgggaggaaatgagggtatcagaagtaagctggc

SEQ ID NO: 473428 - DNA, 587 bp, Homo sapiens
tgtgttgtgggagggacccgggggagccatgaaagaagagcctttgcctcccgccatgattctgaagcctccccggccatgtggaactgcaagtccaattaaacctttttttgttcccagtttggaacatgatgccctttgtcatgaagctaaacatacacgtctggtccaccattcagagaagctgaaggagaatccaagggaaagtagggcagttgcaggtcccaagctgcttcacaccaatgaagtgagtcagcagatcagcaacagtgtgcttcaattacaaggggactgtgctgatagtgatattcttgggacacaagagggccagactcagaaggcagctggtttgataacattccagagaccacctatggcttctgtgtgcccccggtggggggtaagaggccaccagtaccctggacaccctttcttgtttcagagcagcatggaaatgttcttggcctgctgtctagaggtcatccttccaaacctgctagagcatcttcagctgagttgcccaatcctgttcatcttggaaactacaaaaatgatgggtggagagagatgagctgggatacttggct

SEQ ID NO: 473429 - DNA, 646 bp, Homo sapiens
gagagcaggagggtggaaagacagtgtgtatctccttaaggggacggcttcagtggagggtagtaggtactatgggattgcccaagacagaagcacttaccttaatggtgaagagaggggttgatggggcagctgtctgcgcgttagcacacagcagctgtcctcgtcctggtgacaacaatgatgacaacaagagctggcacttgctgagccaataccatgtgtcagcattgagattcagatttcggcgaccatgcctgggagacttgggaagggctggttctgacagatgccagattgcagaaaaggacagtggggctttgtgtcgggttggccactgtgcagacatttgtagaagcgtgaaatacagacgatacaaagcagactatgatagcacacggggcggtggcagagagaagacactgcacaaagtgttggggagatctatagtgacttggcatcagtgtgttagaggctcaagacaagtatcagcaacatggtgggtcagtgtccttggcatgggtgtggatgactctagagaaacagagcttgcctgagaagggtagtgagactaatacctgtttataacaacagttatagtttctaggcatctactctaagtcaaatgccatgctgtctgcctttt

SEQ ID NO: 473430 - DNA, 740 bp, Homo sapiens
cagcttctctcctctttttttttggaccactctcaagctctgcaggccgccccaggtgctgttttgcacagcatgatgggaaagagagggtgtgtgaatactccaatggacttctcaaagaagggaaaaggagacaagaggggaagaagggaagggccttggaatccctataacaggccagcagacagaggaagaaagcatttcaaaggctcaaaactgagctgctcacattccattgctaagaacctcttcagaccccatctaatgaagagttcaggagggggcctggttcattgtgctacaaacatcacacttcttggtggaaataaacatccagattattgcaagaacgtagagatttgctggcagttccggatcaatgactattttgaatgggccaattcctcaaactcagaagtagaacacctgtttgtagcccatgctttggtggacatccttgaagaaggcaagtcctcaaagagtggaacatgtatgcgtgttggggatagaggaaagttcctcatggtggtgaggaaacaggtttctgaactgcttgtttataagcatatgggccttgggtgactttaaaataaacagttggagagccactttctttctacaatctttccaagaacatttaaaaggatggtccttgtctcttaggccttaggagcagttctagctctgtgatttcgtgaagatcattcttttgtacttgagatgtccagaagaatttcatc

SEQ ID NO: 473431 - DNA, 2304 bp, Homo sapiens
tggatttgcatgaagtgggatgagtgtttgacagtgtgttcacaggatttcccacagtcccgcaggcagagacctttgcgcagcccctcccatcacaggcctgaaggtttaggaggaaaaaggggtttcatgggtctggcccagggttcccttgctgtgtgcagcctagggacttggtgccctgcatcccagcttctccagccatggctgcaagggccaacgtagagctcgagccatggtttcagagggtgcaagccccaagacttggcagcttccatgtggtattgagcctgcaagtgcacagaagtcaacaattgaggagcccacacacagaatccctactggggcaccacctagtggaactgtgagaagaggacctccatcctccagatgccagaatggtagatccactgacagcttgcaccatgcacctgaaaaagctgcagacactcaacaacagcctgtgaaggcagctgggagagaggctgtaccccacaaagccacagtggcaaagctgcccaagaccatgggaacccacctgttgcatcagtgtgccctggatttacaagaaataaaacaaaggagttccctgtaccaggggttcccaacccgtgggtcgtggactggtattgatctacagcctgttaggaacctggctgcccaagagaaggtgagcagccggtgagctttggtatcagcatgatggtggtgtagggggaggggggaggggggagggatagcattaagagatatacctaatgctaaatgacgagttaatgggtgcagcacaccagcatggcacatgtatacatatgtaactaacctgcacattgtgcacatgtaccctaaaacttaaagtataataataataaaatttaaaaaataaaataaataaaaataaataaataaaatactgtaatataacgtatttaaaaggatttcagtgttcatgttatttggaatttttcttataaaagaaaaaagaaaatatatatttttacaagccagttttatggtaagaattttctttgacttatgttatttcttgatggaaagcagctaaatattcaaaatgtgatacaatgtaagtattcaaaaactattcagcattatggttattgacatatttatttcatagtcattgttatatggaatagtaattgctatatttatttcaaaataaaattattgaacatgaatacacatttccagtagttatagtacattttaaactgataatatttaaataatgctttcagtgtcaaactttctttcagtttcaaattgtaattaataattaaaaaaatttttcagttcatttttctaggaggtgttcttatgcacacagcagaaaggagagagtgttggcatttgtttagtgcctaatatgatcaacaggttttattttgtgttgtgactatgaggaattgcctgaggagttgtctttaaaataatttatgagatccggcacgttcagggtggtatggccatagacatttagtttctcatactactaataaatattcaagtaataattagttgtgatgaagcacaacacttccccttctaaaactgcttctcatttgcatggtatgtttgttcccttcataaaccgttttaaattgagaatatattgttatccaaatactccattcttatttttctttcttgaatcatttattcacactctttgaagtaagatgatgatctggatcttaaacctgtctgtagccatatcacaaaataacaaatgctctctgaagcacaatgggaccaatctgacaccgcataacccaaaaacagacacctgaatcgtgtttcctctggaagcattttattctctgtcattgtctacaagagctgctgcctaatacacacaatggaagattcatgaatcactgaggcatgaaaaaatgtttttgtagcagcagaaatgtaattaactgcaactttggtaatattctagagtgaaaaaagaaaaacttagagacatttctcaggcaatgctaaatatgtatgaaattcccaacctttttatctcacacttaaatgatttcataggctctttaagagtcttgctcttgatgccctttaacattggaatgtctattctgcttgcttttccaggtagcattttgacgcttagctgatttactattaacagcaacattttactaatacttattaatatttggagttttttaacaatagcatacaagttatttaggagcttgttagagattcataagcgcattaaatttttaaaagattttgaagctcatgaagcatgaagaaatgtccaac

SEQ ID NO: 473432 - DNA, 583 bp, Homo sapiens
cagggtcaggaactggctgggctgcaggatttgaagtgctcccatgctggtggggaagcatttaagtggagccctgggcaaagcacctaggctcagcagcagaggctgcactgtgcacatgctcctgtgggagcagccaggcagggaacttgggaagggtggcaggcaggggggcctgctgaacacatgtgccccagtactgggtggtaaagatgaccttgttctctcttggccctggtgggggcagatccccctgccaattcaaatgtctactggggtcctgggatcttttgtagctaagatcccagaggcccgtggcaagagtgggctgccccacctgcacttcactcacacttccctaggagtcgtcctaagcacttctctcttctgccgccatgtgaagaaggatgtgtttgctgccctttctgccatgattgaaagtttcctgagacctccccagccatgctgaactgtaagtcaattaaacgtctttcctttataaattacctagtctcagatatgtctgtattagcagtgtgagaaaggacaaatacaataataaaatttaacattaagtgtatcc

SEQ ID NO: 473433 - DNA, 640 bp, Homo sapiens
agtgttgcaacaggactgttgagtttctctaccaacacccagaatgggctgtcgggggctgtgtcccgtccagagccctttgaatcacaccacggtgtgctctggtcagaaattcccagttgcctcagaacttttctcagtctcgcgccatggagctcttgccagtcagcttctagctttcccttttgccatatgtactagatatggggtgtacatattaaagaattgtggaaaaattcctccccaaaccaaagatttgctcactcaaacacacatttcagtgctctacctgtttcactacattaatgataacatactaacctgtgagtctcttacggacctggagactgtcctactaatcgtcttggacagcctgaaggacaaggaatggaaagtcaacctcaagaagaaacaggggcccagcatagagatcaaattcttgagagtttcctggttaagatgcaaaacctactcggagctgtcattgataagacagcacagcagcccatttcccagacatcaggcactacagaaggtgcttgaatgcatctgctttaaataagtggaaaggaccagcatggcagtggagatacctacgaggcaaaccaccatatatgaggagatctcactgatacgtact

SEQ ID NO: 473434 - DNA, 682 bp, Homo sapiens
tgtaggagaatgaaactggatcctcatctctcaccttatacaaaaatcaactcaagatggatcaaggacttaaatctaagacctgaaactacaaaacttctagaagaaaacactggaaaaccccttctagacattggcttaggcaaggacttaatgaccaagaacccaaaagcaaatgcaacaaaaacaaagaaacatagctgggacttaattaaactagagttttgcatggcaaaaggaacagtaagcagagtaaacagacaacccacagagtgggagaaaattttcacaatctatacatctgacaaaggactaatatccagaatctacaatgaactcatacaaattagcaagagaaaacaaacaatcccatcaaaaaatttcaaagatatgtcttatattagtagctcagaccttcactccatcataatattccgctacaataccatcaacttcacatacacaacaatccatttctcagttcccagttactgtttctgccaagagtacactgataaatcactatgaaatttgtgagcattttctgcatctgtaaagacatcagtcccattagattagagccctacctctatgacctcattaaactttgcctccttacaggccttatctccaaatacggtcacattgatggttaggtttgcaacatatgaatttggggagg

SEQ ID NO: 473435 - DNA, 929 bp, Homo sapiens
ccagcaggtccttctccacccaaatgatgagaaagggaaagatcctaaagagtggacagttttgtggaggagagagtaccctgcaatcgggcaactgtgaaagaaaagaagagcagcaaagcattcaagatatgacgtgtgtgctcttaaaagcattcagttttattcattcacaaagatacagtttggtattggaacttatatttaaaagggaagtggagaataaaagtttagaaaatttgcagctaactgcaatagaaaagaaaaacctactttctgaggagaaattcaagctggcagtagaaatttcttctcaggacttggtgccctgcatcccagccgtggctaaaaggggccagcgtacagctcaggccattgcttcagatggtgcaaacaccaagtcttggcggcttacatgtgctggctttatctgctgctccagtaggaagaggggtggcactgctttcttacagccacatgaagtagaaattcaggttcttcacacagtctttgacactttgggagtggagatcctcattactgccagactccctatggggtctccactcaccattctatggagtcatctcattatcactggtgatgatgaaactaacattggctagaccttaagttttgccaactgtaaatgagttggaatgaattttaagttatgtacccttttaaaataaattgaactaattaatgattaaaataaatgactaagttttatctacacatgttgtaaaatatttgccttagaatttcttatgcatgtcaatacacatatctttggggatatataagctattaagccacagaatttgaaacatgtataatgtattcaatatggaatcttccaacacaagcttgatgcttttaatgaaatatgattataccatcaataagactaatcattgttctattac

SEQ ID NO: 473436 - DNA, 1171 bp, Homo sapiens
ctaatgctaaatgatgagttaatgggtgcagcacaccaacatggcacatgtagacatatgcatcatggctggctattttccaaggaagacaggtaatgcttggtgcaggtcatcgggagtagataatcaacttgtttttgttgacagtctaaaagaagaacccatgagacccttggaagatggacaggacaagaaaacagataggggttgggagaaaactctaaattccaatcactctacaggaaatgccagcactaacatttgcacaatcaatgtaagtggtacggaagaaatcccagggatatggaccactctgaagaaaagtggcattggtaatgtctttgacggctgcaagagaaatatggctgaaaacaagataattagttcctgccctcatgaaagcaataatcaagtgtggaagacagacagaggtaccgacagacaaaagcattcaggtaccaactggcagtagagagacactgatgttttcactgatataaaatcagggaataatgcctgcacttttttcttaacatcgttttggggaacataaaacaagatagaagtaattttaaagacttaaataaatttaatgcacttatttgctgttatgtggctaagcatatgaatctgcttataatacgagtatgaaatatttttatgagtagtttaattccatacagccaggaatatattggaaaacaaagataaaagagaattctcaaataatataacttttacagtttcttattcaaaataatatcatgtaacacaaatcaagtttattcttgtgttgacatctaaaccattaaagattgtccatgactacagcttttacaacagtagttattgctatttcctaagtcagatgggtcttttttttttcattatctttgatctttgtcacttgtttgctatcaaatattctttttaaaagaggttactaatggcatttgtaagaagcaggcaagcatccaatcagggtacttataatatcatacagtttacagtgacatattcactaatataacaggcgtaaaggccatctcatttcatttcacttttatatttgtcaatacaattattccatcataatttgtcattacttaactttgtcagtcctcattgacatgacttcacaagttgtgaattccaacctatattttatgtc

SEQ ID NO: 473437 - DNA, 704 bp, Homo sapiens
acatcagctgcctctggaattgcccttggcccttgaacaacatgggggaccaaggcttagctaaggacttctggactgtgtgctctaactctgggggactggtattaggccttggctctgatttctggctccttgaggttaggaacgtgctgtgctggagaggcagaggtgctcccagatggctggtcacaacactacaatggctggtgccagccaaagtacttcacagggcagtggcagcaggatgtgccctcatgtgcatgtgccagcagcagtggcagcagcagcacactgggtgcatgctcatcagctgcagcagggtgctagtgggtgctggggtgctggcctctgtgcaggcatttgcagcagtgatagtgctagtatggctcaggaggatgggagcccccgccagcaattgtgtgcacatttgcactgatcgtggtgttagcatggggactgagtgctggtgggcacaggactatgtatgccttccgtgcgtgttcactctggtggcagtggctgctcagagcagggatcagggggattattctgaattctctgacatttcatagatcttcaaatcttctgggtccattggtggagctttgttggtttcttttggtcatatttccctgagttttcaaaatctttctgtcttgatgccttcaaaatctttcttgatgcctgcacatttgagaagacat

SEQ ID NO: 473438 - DNA, 1492 bp, Homo sapiens
cggcctgaccagtttacagacctgaagaatttcagggcatcagcatgacaaagtgcttcctgccccccaccagcagccccagtgaacaccacagggtggagcatggcagtgggcttacccagacccccagctctgaagagatcagccctactaaatttcctggattgtaccacactggtgagccctcacctccccatgacatcctccacaagcctcctgatatagtgtctgatgatgagaaagaccatgggaagaaaaaaggaaattttaagaaaaaggaaaagaggaccgaaggctatgcagcctttcaggaagatagctctggagatgaggcagaaaagaagtatggcatgaagtgtgaaggcatctacagagtatcaggaattaaatcaaagatggatgagctaaaagcagcctatgaccaggagaagtctacaaacttggaagaatatgaccctaacactgtagccagtttgcggaagcagtatttatttgaagaggcttatgggaggaccacagagactgagaaagtgcaggaattccagcgtttactcaaagaactgccagaaggtaactatcttctgatttctttgttcgttgtgcacatggaccatgtcatcacaaaggaactggaagcaaaaatgaatatacagaacatttatatagtggtcagcccaactgtgcagatcagcaatctagtcctgtatgtgttcttcacacatgtgcaagaactctttggaaatgtggttctaaagcaagtgacgaaaactcggcgatggtctaacgtggccacgatgcccacgctgccagagacccaggcaggcttcaaggaggagatcaggatacaggagttgcttttgaattgtttacatcaagatctgcagggtgggataaaggatttgtctgaagaagaaagattatgggaagtacaaagaattttgacagctctcagaagaaaactgagagaagctaaaagacaggggtgtgaaaccaagattgcacaagagatagccagtctttcaaaagaggctgagaaagagatcctgactaaacaggaggagctcctgggcatggagcagtttctgcgccggcagattgcctcagaaaaagaagagattgagtgcctcagagccgagactgcggaaattcagagtcaccagcagcagggcctaagcgagactgaggagtactcctccgagagcgagagtgaggatgaggaggagctgcagatcattctggaagatttacagagacagaacgaagagctggaaataaagaacaaccatttgaatcaagcaattcacgaggagagtgaggccgtcatcgagccgcgcatgcagccctggctgctccagttgcagccagacagggccaagcagcaggcgcaggaggacgaggagcccgagtggcgcggaggtgccatccagacgcccaagaatggcatcctcgagccagtagcagctaaatagccaccaaaggcaggcaagaagcc

SEQ ID NO: 473439 - DNA, 659 bp, Homo sapiens
ttacaagcagccaccccataagagcaggactgaagtcctgggaagagttctggtgacgactgcctttcagtgcctaagcagctgagccaggttgattgatgggcaagcctccaaatcaccacaggaatgaccaaaggggtgaggagctgagagggcaagagttacacgatgccagcaccaagcagaggatctccagctgctgtgacactcctctcactctgaaaagaggtgatgtgacacaccctagtctggcagctggcattttacatcatctagacatgactttaattcatttgactgctacattatcccattctccacaggctccacagcctgaaggctggcacactgatgctctgagcagggcccaggcagggctgctgactgggcatgttgacttatcgataattcaggaagtgaagctgagcacttcccctgtggctgaaaacaatacagaggcctctgccttgcaagacaacacagccctccttctcctccccaactgggatctacccacctcttttctccctgctgccagaccagtaacttggatcatgtcacaatttagccaagctagagaaatgtcggacacactaagggagaaaagggatgatatgttgaaggagctgcaggacctagccaatgtgtactagtaggaa

SEQ ID NO: 473440 - DNA, 738 bp, Homo sapiens
tttctgaggaacctaagaaaggcatacactcacttgcaggggagtggttaagataacaacatggaaaacaaaacaaaacaaaaatccatggatcaaattgagtttaagaagaaggaggagaggcctccaaaccttatttcactgcatgtactgtcctatgaaatgaccttttccaagcctaaaaatcaagggtcaaacagttctcagggtgttaccatccactccacctgctccatgtttcttcccccactgccctcaccggaaaggcataaggaggaaggagactggatccctattccctctagagcctccataccaccccttggtgcagaatgggaaatggggaagtgtttggttggtgctttagaggcacctaactgtcaggggtccactgaggatggaaaggaagagagttccagaacaaatgacaagcatgtggaaaacaggcaagacttccaagtgagaggcagcatggagagcagttcaagaatataaacaatgcaagtgtgagtggaacacagcatgggggagagtgggttcagctgagcttgcagaggtgaacgagtcctggctatgcatagacttgacataaagtcatgacaataatattggctttcttttcagagaaatgtgaagccttaaaggaagtgaaatcatgctgtggcttgaccatctttgcattcatttaaaactgaccttttaagtcattctggaggacagattagagtgaggtgagac

SEQ ID NO: 473441 - DNA, 765 bp, Homo sapiens
cgggccttcgcgttggttccacctccagcttccatgactgtggagttctgcagtgggttcattgagaaagtggtgctgctgcacagcgggctcagagcctgggctcaggaggcatcccggttactgttgctgtatcctggagggtggcatctcctgggagctgtggtccgagccccttgcaacagcggggccaggagaaggctggttgctgggtgcatcctgttcttggggttccacctgctgtatccatctcccgggggattttccgtcgccgtccttggttccagcacatgccctgagtgggtaacagtgcagctgcgggggcagccccctccagcccttccttggtcagcctccctgctgctggcccttcctggagacgtgatttgccctagaagtggcagaggaaatggcatggagtgtccaggagcccacgaatcagctggcattgttgaatcatggagaacgcagagacggtctcagaagtcggccggagcctgagtcattgggccacgcggcttcagtccttccttgcagcctgtggggagtctcaggggaattctgaggaggaaagggggatgctcatgataggtatttattgtttttgtttgtttgtttttaatcacttattttcacaagtgtaatcgaagcacctggttatcagaggctggggcttggtgggcctgagatgtgagcccaacactgaatacagacttacaccaaccagattcaaacaccagccctgctcctggggcccctctgctc

SEQ ID NO: 473442 - DNA, 541 bp, Homo sapiens
ttttaagactcaaccagatccttcatgctccaactggctcatcaggaagttcaaagcagatttttccagcatgcgcagaggactctgggaaaacttccaggattcctgaaccaggcggaaacttcagagctgtcagacactgctgcgcctcctcctgctgctgcctggctgctgagattggtgcatctggatgaatctgatgtgtatgttttcattcctttccttccagaacccttggtaaagaaagtacacagagggattcatgagtgcttggccaactccaaggtcctgggaggacatgaaccagtgactttgaatgtgatgctgagcccagcagggagccagtatgactctccccaaatcacaaaggttgaagcccacagctacaaaatttcagtagtgtggattggcccaggactacaaggacagctttgattaatagtttaggaagcctggaaacaaatccaagtatccttaataagttactgtattattaaggtgatatttcaaatcagtggcaagaggattgattattcaataa

SEQ ID NO: 473443 - DNA, 721 bp, Homo sapiens
tactgccgctcatttcagcttcgctgtgaaggggcaaatgcaactgatgaccttaagttgaagtcaaatgcttatttaccattctgaaaatccaagggcctttaggaattgtactaaatctactctgtctgtgctctataaatgcaacaacaaagcctggatgacagcacatctgtttacagcatggtttactgaatatcttaagcccactgttgatacctactgctcagaaaaaaatattcctttcaaaatattcctgcccattgacaatgcaccttgccacccaagagctctgatggagatgtacaaggagattaatgttgttttcatgcctgctaacacaacatccattctgcagcccatggatcaaggagtaattttggctttcacatcttattatttaagaaatacattttgtaaggctatagctgccgtagatagtgattcctctgatggatctggaaaaagtaaattgaaaaccttgtggaaaggatttgccattctagatgccattaagaacattcatgattcttggggggaagtcaaagtatcaacattaagaggagtttggaagaagttggttccaaccctcatgggtgactttaagactttagtggaggaagtcactgcagatgtggtgaaaatagcaagaaaactaaaagtagaagtggaaactgaagatgtgactgaattgctgaaatctcgtgataaaacttgaatg

SEQ ID NO: 473444 - DNA, 630 bp, Homo sapiens
ggtggattggatagtgcccacccatattgagggtggattttccccatctagtccactcagactcacatgctaacctctggaaacactctcacatacagaccccaaaataatgctttaccaggtttctatgtatttcttaatccagtcaaggccacacctaaatttgttatagacatttgtgtaaaaatcattgtatggacatatactttcttttttgggaggggaggggtaaggaataatggaatggaatatggtggatggttgtttaaatttttaagaaactggcaaactttttcaaagtggtttcagcatcttatattcccaccagtgatctatagagatcaagttgctcctcatcttcaccagcacttgatatggcacagccagctgctactgtttctgctccttctcccgacaggcgaatgtttaatgtctctttctcctgtcccctttctatacatttggtatcaacatctctttcacgaagccaaagaggaaaaagctcccaaaaacattcgcatacatattaaatgagcttcatctagggtctcctggggtgcctctgactgggagcctgcggctgggcaggcttgatctgcgccttcattcgtgttatgtatttttttcatt

SEQ ID NO: 473445 - DNA, 1008 bp, Homo sapiens
gccacagtgtctttaggttgattgcctgaattctaagtcttgatttaaaccatctcatgtctgcaggttgagcctttcatggggtggacatctcaccacactgaatggaatgccagtgtttcaacagatgtactcctagtacaccatgaattcaaagtggaagccaattcttttcatctggtactcaactgaaggaacagccttctccacaaaggaactatcagacactactgtttctgaccatggaattacctttgtctttgtgagatttaagcagtttgtggacatgaatctcatctgtgaagtcctcatcatgcctcattcctggcaaagtaaagatgtcatcaccatctcttgccacccagtccatcactgtgttcagcatgaaacatgttgttttgactatatttaccctccacacatctattatcaaagtatcaaaggagctgaaactggggggtcttccagccattatgacttagttgatggggtctctgtcatgcactacgctgtcaagaaagaagatgtggcagtttatcagccatgtgatctacctggcattggtgagcatgtcagaccaggctgatatcttctgaaatgtttttcatggtgaagaaggaaatagttcttctctggtcagcataactgctgaaaagatagtcacttctttttctggacagtttatttaggaatttaaaccatggcttactccaaaaggggatatgaaattgcttacatgtaaacatatagttcaagataaaaggagtaagtgaagaaattgtgggaaagggaaaattagagtaggacaaataagataaaaatcagggatagcattattacacaaaatgcatatcaaaaagtccagtacaagttgtaaaatataggctagaattgaccgagctgcctagtatcacaagtgaaagaatgaaacctattcatgaaagttgttcatgaaaattataactattcctgatactgagttttgagaaaaatgtctccattgaataa

SEQ ID NO: 473446 - DNA, 594 bp, Homo sapiens
tgcattctgaagtaaagaaggctcacaatgaaaaggatttggggaattattgtggcaataatatgcagcttcgaggaacaaaaggtgagtggcaaggagacaagttaccagcaagataggcagcaagataagcctgaagtgaaagcatttgatggaaacatcccttgggtccactttgactctgtcactctgggacataattgcttgaattcaggcaactatggaccactcattccctgccccacctcagtcaccctctatgcaccagtagaagccaccagagaccagaagccaagggctccagagccacatgtggctgggggctactggattggacagcatagcactaaaggaatcacaaacttctttggaaaacagaaacgtctggttgtcccatacatggcccgtgtgaagagtgcccagtcagggatggatggtgttccaaaggttcctgtgtaagtccattgttggaaaccctgaatgcattttataaacaaataaattttataaataaataaatagctggtccctattttcagggttttctctgtctagcaggatacttggggtgagaagcctggttgctggagttac

SEQ ID NO: 473447 - DNA, 1414 bp, Homo sapiens
ttataggaacagatgtatttttattggtggaggaaggagaaggatctaattccagccctcgattttgcttttttaaaaaccactcacctgacttttatttgcagccactttggcaaacagggcttgagacaccttggcccttttcatctcctgttggatctcgtcataaatggcagctgtgatgttgatgttggcgccgtccaccttaatagggagaatctcaaaccaacagagttatctccaaatcacaagtttccctgtgcggatgccctgagctgttctctactggatccagcagtatgcaggtccagagaaagatgtaacaggcagtgtggactctgtgacaaatggtatgaagaaactgaaataaaagaggatcttaacctaggacacccagcagccagtgaaggaaccatgatctgaacgcaagtctttcaggctcaaaaacatgggctcaggacactgcactacacactgcctccaaaatctccaatttatgccagctactaataaagtatagatggggtctggaaaataatctccctgcatcaatgtcaagctgcttgtgtgcactaaattgctgactccaactaaaaggctgagtcaatgcgatctcgctccacttctggcagattgaggaaattctgcatggccctcaggtttactagaagagactgagaggctgtccgagggtcttcttccttacgcagaatctcagacaacaatccctgattaaatgggggaaaaaaacagaccaagtcacatttgcaggtatatgtgtgtggtttctgtcttccacccctctcctcctttgtttggtttaaccagctcgctgtgatgtcaagaacctcacactaattccttagggttctccgatatgaagtcaatgtgcttgccttccgggggatatgcattattttaggactgttctattctgacactttatcatcactgtaataatcatcagtgtacagacatgccagctagcaaggtaggcacttgggaagaattgtgaaactgcaattaccaccaggtgcctcctacaagtatttcaggaactgttagaactctctctgcttgaaactgggaacacttggcagtcctgcttagctttacaaatctgccaagtttggtaaatttagtttcgacatttaaacagcatggtagatttacatcaatttaaaaaaaaaactggctgaatttctgtatgaccggccactgttttcaatagagatatttcttatgcaaaaaaaaaaaaaaaaagacgcaaagcaaatggctaaattgtgttaaccctctgataatttcccaatctatacacacaatagttatccttacatatgtacaaagggcacccaaatctttcatgagacgtcttcatgggggaaaccctaatgtcaccattaaagcaatg

SEQ ID NO: 473448 - DNA, 673 bp, Homo sapiens
ctaactgcctgctcacttgcaaccgctgactgagggaggaatgagtcatgatagaggccagcttttccatctcagaggcagaacaggagatactatctactccctcgtcccacagacaaagcatccaggcgggcaggggttcccctagacgctggcggcactgcttgcctaatttccgcaactcagctgttcatggtctactttctgacaaaccactgggtgagcctgcaacaggggttcttcctcctcagtatcagattgaggactgggtatgcacttctcgtaacacagtgaaaaatgcccatccaactctgctggcaaagggcccatccttgcagcatggctaccaccaggtaccacaacccatgttgtggccacatggtcgacccagaatcagtggtgccaaggctcactcacctcgggatcctgccaactatgccaagtgtcaggttctagcccaagctgaggtccaaggagagtgggtgtgtgagtggcaggtagctgaaagaccgcttgaggaatcgtaggcagttgcaacatggctttattctctttctgggtgcaagctgtaggttgtatttcttcttgtagtttggcatgtcttgtgattttttttgttgaaagcaggacatgatgtatctgacaataggcatcaaagcaacaggctttcagt

SEQ ID NO: 473449 - DNA, 732 bp, Homo sapiens
tttttgttttgcctcttctgaaactttaggggcaccaacctgatgccagtaggattgctcctgtatagggtgtctgacaacccctattggagggtctcagttgtgtggcatggggagcaggatccatttaatgaagcactttgtcccttggtggagagcgtgtgcttcgctctggggaaacccacttgtctgggctgcctggattcctcagaactaccaggaagagaggctaggtctgctggtctgcagagactgcaaccacccctgcccatagaggctcaggcccagggagatccaaattctgtccctgagcctctggctggagttattggagatcctgcagggaagccctgcccagtgaggaaggatgggtcagggttagccctgaagaggcactccagctgcagactgccacagccaatgtgttcagttgtggggacaagtcttgggatgaagccatccagcttccttggctccagcagggaaagagtgcagcctagagttatagaaattggtgcctcccttccccaaaccagggagcttagcatgccaggtagttgtgagtcccagtgctggcctcccctcctgcagttcagcaggcttaagaagattccagctgagaggctgtaagagtctgcacattccagggttaggatgctatgccctggtagtgtgggtttgcgagtggtctcttccaatctgtgtgtttcacacttccatggaaaaagtaca

SEQ ID NO: 473450 - DNA, 790 bp, Homo sapiens
gaagctcctcaagcctttctctctgtaggacccccgatcctcttgctaagacttcgtctacactctgcatatgtctgctgatagcgcctattcattggtgccctgtttattgacatcttcctactatagtggtcatggacaaccacagataccacacaaagcaaagctctctatgatgactaggcaatacagggtaaaagagttcagaggaaggagagcttgtcccagcagccaaggaagtcttcacagtggagattcgataagagggaatcaaaacaaattcttgatcagggaaaacaaacaatatcaacctacagatgcagaagcttctaaacatacacctctcctggcatctcctccctcctcatcctctttccctcctattactgtgcaggtggtaaatgccccacaaatactgatctggaatgaagggatgacccttctctttctcaaggacctgtttctccccttagaaaatgattcggtggaatatccacccaatggactttattcggccatgaaaataaaagaaatactgaaatatgtcacagcacagatgaaccgcaaaagtattatgctaagttaaagaagccagacacaaaaagccacatattgtttgccagagttcttgcactgattctttctcatctgtgtgggccgatgttcctttaactgtggaataatttgagaatagtcagttggcttctttttgggatgttttcagagagctgcggctttgtgtggggtctttatttgcagctgaattattgtccttagtttcacaggggag

SEQ ID NO: 473451 - DNA, 635 bp, Homo sapiens
ttattttaatctgcatttacaattcaaacatgacagaactgggtaatgggcagaggttggaacagtttgcagggcttagaagacaagaagatgtgggaaagtttggaaccatatagaaagttgttaaatgtttttgaccaatatgctgatagtgatatggataatgaagtccaggctgaggtggtctcagatagaaatgaggaacttattgggaactggagtaaaggtcactcttgctatgctttagcaaagagactggtggcattttgcccctgccctagagatctgtggaactttgaacttcagagagatgatttagggtgtctggcagaaagaagttgtaagcagcaaagcattcaagaaatagcctggctgctgctaacaacatacagtcctatatgttcacaaagagatggtctgaagttggaacttacatttaaaagaaaaacaaagcttcaaagttttgaaaatttgcagcctgaccatgcagtaagaaaaacccaatttctgggaagaaattcaagccagctgcagaaatttgcataagtaacaaggaagtgaatgttaatagccaagacaatggggaaaatgtctccagggcatttcagagatcttcaaggcaacccctctcatca

SEQ ID NO: 473452 - DNA, 856 bp, Homo sapiens
ccgaccccacaacaggccctggtgtgtgatgttccccttcctgtgtccaagtgttctcattgttcaattcccacctgagaaacctgaagccgtcctctccttggaggacttctttgtcattccatatctttcctattgcacgtacactttcctctgccttttctctgtccaactccaaaaaaatccgacatcacttaaatttaaaagacaaataaatcacctattgccaaagtttgggggtaggatttttgtcccagcaggatgcaggtgttggaatgatgcagttaaccagctgtctcctgcatctcttggccctgcattcctcagagctgtcttcactttgggtaagttagcaaagcatgtccataggaggcaaggtggccgccagccactcctggggaacctctggccgactaagactgcccagcagaaagagagcacttcttttagaaaacttccatcagaagccccagaatgggtctcattcacctggctttgctttatgcccaaccctgacccaatttcagtgttatcaggctctgcatcgggaagcaaacccacatcttcatcttcaatttcatttgactaccagggtggaggagaaaatgtcctcaggcaacagctcttcacctttccttacctctggtgatatttatgcttggcctgattatctgtgcttccttcagatttattgctggtctcttagactttaggtcaaacgtgatctaaacttggaaagcagttgattttctttcatccttgacttttgtctaaggctagtttatttcatttcccaaggcatggctttctatatattgtttgattgtttggcattctgttccaggttcatttattt

SEQ ID NO: 473453 - DNA, 737 bp, Homo sapiens
ccataagcaacagaaattgattgtctcacagtggtctgccatggtaagaagtgctggcttcccctttgcctttcgccatgattgcaagtttcctgaaggcttccagtcatgcttcctgttatgtctgcagaacttgtgcacacagaagccaatgcctaaaccatgtatgacgtctgagcctccagctcccttttctgaggacagactgcggcaggcacaggaggggaggttggttggaagagctgacacagagctcaagtttcttgtactgcatttgtccttaaagccacactcctcacaagacattcctaaacttcttgtctccatgcgggaccttaggtacacagaatcaaatggattcagtcaatcatctaccctgataccaacacaatgtcatttctgttcaaataataactccatgactactaatggctgtgtcaaccttttttcctacctggagtacaggacagtacccaaataaatttacgtgcaagcaacagtcatctctgatgactagttatgatactatgttatgatgtggttatgatattacctaagggcgggaagccatgcatttcatttttctctgctgctgtgtggctttctggcatcttttctaatttcctcaaattgttggtgggaattgcttgaaactactttgttatctttctcagatgttctatggaaactgaaatgaatgtgtcatttgtaatcatttaacagttttttaaaaagca

SEQ ID NO: 473454 - DNA, 1244 bp, Homo sapiens
cgttagagttgtgcggccaagatgaattttgaggaactaaccctaaacaggaaaaatgctttttcaggacccttagctgcaggtctgttggagtttgctggaggtccactccagaccctgtttgcctgggtatcagcagcagaggctgcagaacagcggatattggagagcagcaaatgttgctgcctgatcgttcctctggaatttttgtctcagaggattacccggccatgtgaggtgtcagtctgcccctactggggctgcctcccagttaggctacttgggggtcagggacccacttcaagaggcagtctgtccattctcagttctccagctgtgtgctgggagaaccactactctcttcaaagctgtcagacagggacatttaagtctgcagaggattctgctgccttttgtttggctattccctacccccagaggtggagtctacagaggctggcaggcctccttgagctgcagtgggctccacccaactgctgtgctagcgatgagcgaggctccgtgggcataggaccctctgagccaggcacgggatataatctcctggtgtgccgtttgctaagaccgttggaaaagcgcagtaatggagagcgcgcatccagcgagtatctgggctgttggctgtatcgttattatatcggagaccgtagcattaccgcgggagagcataaatctaagattccacgtcaaggcgaacctcgtgacttactaacactccatccatcatcgtggtctgactacatggcatgcgtgtgagggtttgaaggcgatgtagaaagagttgctgaatagcgtttatgttctagtttgtttgcagagttgttaacagtattctttgctgatcttttgatttctgtgggacctgttataatgtcatctttgtaatttctgattgtacttattttaatcttcatttttttcttttttaatctagctggcagtcagttttggtgattttcacctttcaataaatttctgcatgttttctaagttacaaattcattgaaataaagttatttataacgttcctctgttatctttttaatattttggtatctgcaatgatttttctcgttcaattttgataatgataatgtgttttctatttaattattttgtcattagtctgataagggttttatcaattttactgatacttttcaaagtgtcagtttttggttttattgatttttctgaactgggtttaaaaaaaaaaatgtttc

SEQ ID NO: 473455 - DNA, 3043 bp, Homo sapiens
cacagatgttgctctcgcaacaaatgcatgagaatggtggtctatcacagaaacaccaattctttcatgagctcacatgtgaggaatctaggttgcacactccttataagaatccaatgcctgatgatctgaggtggagcagtttcatcccaaaagcatcccctgactccctctcctctaccatggaaaaaattgtcttccgtgaaaccagttcctggtgcgaaaaagattggggaccgctgcctgatgttgatgttctatctcctcatctttgctctaattgtaggtctcacccacagttgttcagcatggcactgcctagtggagctgtgaggagaaggccaccattctccagaccccaaaatggtagatccaccaacagcttgcaccgtgtgcctggaaaagccacagacactcaacaccaacttgttaaagcagacagatggagggctgtaccctgaaaaaccacaggatcagagctagccaaggccatggaagctcacctcttgtatcagcctgaacttaatatttcatataaatgaaatcatataacatattgtagcatgtgttgtcacttcattcctctttatgactaatactctattatatatattttatatattaatacgtaatttaatatatgatatattaaatatatcatatatttaatatataattaattaatatatatttatatattatatataaataattaataagaaaatatattatatatcaaatatatattatatattaaatatattatatatcaaatatatattatatattaaatatattatatatcaaatatatattatatattaaatatattatatatcaaatatatattatatattaaatatattatatatcaaatatatattatatattaaatatattatatatcaaatatatattatatattaaatatatatcaaatatatattatatattaaatatattatatatcaaatatatattatatattaaatatattatacatcaaatatatattatatattaaatatattatacatcaaatatatattatatattaaatatattatacatcaaatatatattatatattaaatatattatacatcaaatatatattatatattaaatatattatacatcaaatatatattatatattaaatatattatacatcaaatatatattatatattaaatatattatacatcaaatatatattatatattaaatatattatacatcaaatatatattaaatatattatacatcaaatatatattatatattaaatatattatacattaaatatatattatatattaaatatattatacattaaatatatattatatattaaatatattatatattaaatatatattatatattaaatatattatatattaaatatatattatatattaaatatattatatattaaatatatattatatattaaatatattatatattaaatatattatatattaaatatatattatatattaaatatattatatattaaatatattatatattaaatatatattatatattaaatatattatatattatataatgtttaatatattttaattatattaaattaaattaaattatataaattattaaatttaaattatataaatatataatatattaaatttaatttaatatataaatatatattaatttaatctataaatatatattaattatttaatatataaatatatattatataaatatatattaattatttaaatatgtattaattatttaaatatatatgaattatttaatatataaatatatatgaattatttaatatataaatatatatttattactttatatatttattatttaataataaatatatatttattatttaataataaatatatatttattattttatatatttatttgttattttatatataaataattgttatataattatatcaatataatacataatatatactatataaaatacatggtatttataatatataatatataacacaattatatgtttatattctatatatcatataatatatattacatatcatttattgtggatattatatattatatttatatatacacacaccccacattttgtttattcattcataatttgatggtcttttcagttgctttcacttgttgactattaggaaaaaggttgctataaacatcatgtacaagtctttgtataatatcaacataaggtttcagttcttgggtggggtatatacctagcagtagaactgctgggtcatatggtaactcaattttacctttttgaggaactgccaaattgttttccacagtggctgaattattttacatttacaccagaaatgtatgaggttctaatttctccacaccttcaccaatacttgctattcttgtttttcattttaaaaaatcacagcttttctactggatataaagtggtatcttattttggtttaagtttgcattttcctagcgaggatgataatgatgaacatcttctcagatgtttatttgccatttgtctaccttcttcacagagatgtctattacatttgttttgctcgtttttattttgcttatgtgtctttttattgttgaggtttgagagttctataaatatatccttgatactacacattatcagatatacgatttacacatattttcttccattctttgatttgtcttttcaattacatgatactgtcctctgatgcacaaatggctctaattttgctgaggtccaatttatctattattccttggttgcttgtgcttttggtgtcatacataaaaaaaaaaagttgcctaattaaggtcatgaagatttacatctggttttcttccaagagatttagagctttaaatcttagcatcttgaatatatcatcctattttcccctgtcttgtaaggtgtctgctgagaaacctgctgttaatctcatggaggttgtctttctcagagaaggaagctgatccacttctgcttacgaaaatgatttccacttcc

SEQ ID NO: 473456 - DNA, 690 bp, Homo sapiens
gctgcaaagtttaaacctacaaaggttggttcatgagactgaaggaaagaagccatcttcactaacatgaaagtgcaaggtgaagcagcaaatgctgatatagaagctatagagtgggaacttttacctgaggtcactggactcagctttagaatcctggaagaccaggatgcagttttctcaggagagataattgatagtgtgatggttaatattgagtgccaacttgattggattgaaggatgtaaagtattgatcctgggtgtgtctgtctgttgcagttttctggaggtccacttcagtccctgtttgcttgggtatcaccagtggagactgcagaacagcaaaaattgctgcctgctccttcttctggaagcttcgtcccagaagggcactggcctgatgccagctgaagctctcctgtatgaggtgtctgttgacccctatcaggaagtctctcccagtcaggaggcacagggagctggcaggcaggaaagattaagtctgctgaagctgccactgcagtcgcccctccccccaggtgctctgtcccagggacatgagaattttgcctgtaagcccctgcctggagatgctggatttcctgcagagataccctgcccagtgaggaggaatccagagaagcagtctggtcacagccgctttgctgtgctgtggtgagttccatcc

SEQ ID NO: 473457 - DNA, 691 bp, Homo sapiens
gtgtcgcaagatggggccaagatggtcaacgccgcggtgaacacctacggggcagccccgggtggctcccggtcccggacacccacgagcccgctggaggagctgaccagcctcttctcctccggccgcagcctgctgcgcaagtcgtccagtggccggcgctccaaagagcctgcagagagacaaactcaaggaaagaagacagcccaggacctggaagtcagcttggggccagaaatgcagcgagttcttaggtccaagctgcatatggagaagtctgtaaaagaggatagaggctctagatgggcacaggctcttggcttcatggactccttgtcccatgttgagagctgcgcagatcttcccctcttccaacttgccatgggcattgcacaaatatttccctctgcccgcaaaactaatctaatccaccctcaccctcccctttgccatttttgaatcactaatcaagatttctcgacttccctccttaaaaaaaatcatctattatatcttttcattatatctatcatctcttcttgtagctcttatcagagctctaattccatatgagttcatgtaattattttctccctaccttacattaggagttctattcaggcagaggtcatggtgttttagttcactgttctattcttccagatcacagtgcctggcattcaaaatgtct

SEQ ID NO: 473458 - DNA, 693 bp, Homo sapiens
cgcactttggaaaacttggactaaatgtaatacaccagagacatggccagtgagtggtataagagtgaggatggtagaaaagtacataatagatgctgtctacctgatggcaataaaagggtatttgactggctgccctccaactcatctgctagagctgtaatgatgaagagtaagagaaaatggaaagtgaaaaatcgtgtaagggtagctttgtcaactgagaatgcacctcagattcattgcacaaagtcagttccgatacatgggatggccgatagtagatttgtaattactgtggcacctcagaatgatatctggcctcatgggagcagtgaagaaaataatatgggtactatagacagctgtcaaggaggtggcaataagagtaacaaaaagggcacaggtattggtgtatgacatgtttgtagtttcaatgatgaggtctttagagtaaaagcctgtgaagaaaggcatacttaaaggcagtcttcaagctctgaaatttttttctctgcttggattattctgctattaataattgtgattgcactgtgatattcttgtagtgtatttttcagctgtgtcacactagttatattcttctctctactgcatattttgtctgacagctcctgcattgttgtattatgatttttggctttcttgcattgggttacaacgtactcttat

SEQ ID NO: 473459 - DNA, 579 bp, Homo sapiens
cagtgggtcttaacttgtgatatgccatgggagttgggcctgctgaatgatgccacttggcttcctggattcagcctccttcctaggaaaatggatggatctcctgcctcactggaattcccagggccagaatatgcaaaagctcctgggtctccatgcatgcccaagcagccacaagaagtctgcacagctctgtgctttggacccaaggccctggtggcatgggctcatgtgggctgtcaccccacgctgctgttcctcactctccatagattgcaccgactgcctagtcagtgccaatgtgagaacctggatacctcagttgaaggtatagaattcactagccatttttttcctctccttcagccctgtggactgcagctgcttctaattggccatcttggaccacccctagttatttattcttaattgacatttgtatacttttgaagttaaatgtgatgttttaatttatgtatacattggagaaatattcaattgagctgattagcatacctatcacctcatcaacttacctgttttttggaattagaacttttgaaaatgaaagacacattt

SEQ ID NO: 473460 - DNA, 538 bp, Homo sapiens
tcttctcggcttagcagctgaagactgacactgcccgatcgcctcagaagcctacgagaccatcacagacacactaggacatctctactccttccctggcaactgatcacatgcctattaccatcccattaaaacctcatcacccttaccctgctcattgccaatatcccatcccacagcacgatttaaaaggaataaagcctgttatcactcacctgctacagcataggcttctaaaacctatacactccccttataattcccctatttcacctgtcctaaaaccagacaaggcttataggttagttcaagatctgcgccttatcaaccaaattgttttgcctatccaccccatggtgccaaacccatatactctcctatcctcaacacctccctccacaatccattattctgttttagatctcaaacatgctttctttattattcatttgcacccttcatcccagcctctctttgctttcacttggactgaccctgacacccatcaggctcagcaaattacctaggctgtattgcc

SEQ ID NO: 473461 - DNA, 1181 bp, Homo sapiens
cagtggagagtgggaggagtctttgtttaggtttcagtcactcctttctgctttcctcaagccttggatgcagctgaagccatgagattaaaggctcagggtcacagccacatgaatgcccaggctctgctggaagaaggtgatgcagggagctcggagaattcatctgagaaatctgatatgcttggaaataccaattcttcagttttgtattttatactgggtctacactttgaagaggataaaaaggcgttagaaagcatccttccaacagcacccagcgctggcttaaagagacagtttccggatgacgtggaggatgcacctgacctgaacgcccctggaaaaattcccaagaaagatctctcacttcaaaggagcccaaactctgagacagaagaaagtcaggggctctcgcttgatgtaactgactttgagtgtgccctctgcatgagagtttttcgtaggattgaagacttgatcatttctgaccacaggtgagtccctttaggcttttacagttgtcagttattattgtctttggtctgaaatcaaaaccagtaaaattcaggtcccatggggaagctatttaatgatatttagccccaatataaactattaaatccaggttccatggggaagctatttaatgatatttagccccaatataaactattaaatccatttacgttaggtatggtaaatacaatgaagagtatttaaaagctgaagaccttctgatcaattcctgaaatagtgaatccatatcagctgtattgggctgtggtcctattagtgccatgaactttctatggagcaagtcatataacatcttaagggggtggggagtatcttcctttgttttgcattcattaaatgagactgataatatttgccttaattactttccagagattaaacttattgaatgcattttaagtaggataaagtttttttttctttttacaaacgtacagtaaaatttattttttaaatctgatgtgataagatgagatattatacttaagtgaagttttaaataattataacctttaaaatttactgccaaaacattaaaataactagttacaattgaaaacattttctaaaacattgtatgcacatacttgctttattaaattgcatgcatactgaatctttttaaattcttcagagttctc

SEQ ID NO: 473462 - DNA, 1087 bp, Homo sapiens
tttcacagctgacagggtggctgccctcagcagccactttgtttacctactcaagcctcggcaatggtgggcacccctcccccagcctcgctgcctccttgcagcttgatctcagactgctgtgctagcaatgagcggggttccgtgggcgtaggaccctctgagccatgcgcaggatataatctcctggtgaggcgatgcctcgccctgcttcggctcatggtcagtgcgctgcatccactgtcctgcacccactttccgacactccccagtgagatgaactgggtacctcagttggaaatgcagaaatcacccatcttctgtgtcgctcatgctgggagctgtagactggagctgttcctattcggccatcttgctgagtgtttcaaagaatgcctcaatgacagtttgctaggccaaaggggtagcaggggatggagctggaacctgaactgcaggctgtgtgattctggaggccaaatcccaactcagaaggaaggtcctcagaaatcttggaaggaacagcctctcccaaagtggccttctgtggctcctccagggatgttcagaaggtctccttagccaaagataactggtcctgggaaaacaccacttaaatccacttaaagcaggaccaaaatttgacattcagtaaaagaataataggtttaattgtgattttatcttgaaaaatagagtgaaaattatgaaaataagtttatcttacatttattaaaatgcacattataattgtaattatgtatgtgctaatttgtaagatagaaaaggaacaaactgagtggtattagggtggcttttgggtacaacattcccgacaaaagagtagggtagctcatcaggacatcctttacttcacacagagtgttacgtcacaagcataaggaaagtgtctcttttattaaaaaaaaaaatagatgcaaaggattcatatatttccctgatgcctctcttaatcctttggcattaaaatcactttcttttgcagtgcctaagcattggttttcctttccatttataactggagaaattgccaaactaaacaggttagtagttttacatgtggttc

SEQ ID NO: 473463 - DNA, 558 bp, Homo sapiens
ttgtttgcaacaatgattccagccatccctcttcaccccagcccagaggtccccagagctgctctcagtctcagagctgggggtcccgtggtgcaggctggggcagttccagctgttgctgctgctggctttggagtcgcctttctcaggtcagctacgcctgggacactcaccttctgctttccaggatccaaaagtgctgtttgctcctctgctctcacctgccatgcggtccagggggccagcactgacccttcagggcagggacacactcactggcttctgagcatcgccaggccctggtcatggaatgaggttggtggtgtctacctctccctccctcccccacggtgtctccttgaggaaaagacagtctcgctctgtgcccgggccctggccggcaggtgctgtgggacagcccagggaatggccaagtcctcctttagatgagggtcggtgcctggtcactctttctgttgagtccttttagcgaggggccacataagaggctgggccccagtggacccatggagagccatcctgtgaatgcgcggcacc

SEQ ID NO: 473464 - DNA, 578 bp, Homo sapiens
ttgaaatctggcagctcaagagccatgtggctggttcccaggcaccatgccaagcgcattagcaaagactggcagccccagtggcaaggttctatcaaggggagcttccagctgcttgttggtgttggggtctggtgtgtgcactggcagtcaatggtcagctgggctcgccatatgccttgccacagccctgagcagtgggcgccccaagagctcatgtttaatatcaagttccatgctggcgccttcacccttcatgcagcaaacaccatcgaaagatgtagagaaaacactgccgaagattggaagaaactcatgttagagcaaattacccagtgtgggaggtttgctttgcagtgtgctgaaagcacagatgttcccaacatggctcagctgaagcgcagggaagaggtagaagcctggagggcatagaatgttgcagaccatcagtgggctaatgttataaagccaagactgtggcattacagtagaatctttcccatacttggtaaggagattgggtggaccatgaaaactttccagccacacagaatgacttatcttcatagcaaaatacc

SEQ ID NO: 473465 - DNA, 646 bp, Homo sapiens
ctctgcctcacctctgagaaccacttagttgctaggagacagcaagctcgcggttactatgggaactgggctgatgtggaaagtggagagttggtgtccaggcagcaatgagaaggctccagtggccccgcgtgaaaagggggatgattatgattatagcccctcctgcatgcagcttctgtgggggtcactgagtctgtacctggaggattcccggagccaggactgccatgggctaacgcggctcttgcccagacctgagagtcctgactcaccttgccaagccatccacctatccacatctcaattgccgcatctgcaaaatgggtacactgtgaggctccgtggaagtggtgtgggacccccttcccctgcagtgctagcccctgccctgctcagctcacggagctgcccgctgcagacggcccccacctggtgtcccgctgtgctgttgcccctgtgaattgcttaataactgttgaacaaggaggctgcggcgttgcttccttgattcctgatcaaggaattcaaattccatgattcctcctgggacctcatctgtcctttccagcttggctggggaagtgagggaagctgctgtgctgtgccaaggcccccctcccctgtcctgttttcctattcactc

SEQ ID NO: 473466 - DNA, 694 bp, Homo sapiens
ttcttctgggtccctagaatttccaaatgaaatttagcatcagcttaataatttctgcaaagaagccaggtaagatctgggagaattccctggattcccaggcagagacttgttctctttgcttactttcctttaaacaaacagagtctctctctttctctttttgtctctgtgctgagctgcctggggctggggaaaaggcccatggcaattactgcctgcctactgcctatgatgttcactcaaggcccaagggctcttcagtcagcctgtggggaatgctgtctgtcctgagtctctcccttcagggcagtaggcttccctctggcccaggggaggtccagaaatactgtccaggagccaagggctacgactggaaggagtctctctccatagccatcatagctgggaatgtgctgggtcacacttgaagccagcacagctctgagtcttgcccaaggcccttgtgtctctttccttaatatgatgttaaaaccagtactgtgattgcttacttgatttttggttcttatgaaggtgattttgtgtgtgggtagttgttcaattttgcattcttgtgtgtgtgtgtggtggggcaacaatcactggaggcttctatttggctatctagctctgccccctcctcatcaactttgcaactagttgttttgacatccattttatatgattgcct

SEQ ID NO: 473467 - DNA, 564 bp, Homo sapiens
aattcactgttagaccccctcactttctgctgatgccacagaaatggactcaattccgcagggatttgagactcaaatctccattctgactcaattctgcagggattttcagagggcgggcaggcagattataacatccaaaaaatggccacaatttctccctggagaggctacatcacaaaaggtgatacagctgctaccggactctccctcttggaaagcctacccttggagcctagtgaccatgttgagaggaagcccaggccacgtggagaggccacgtgtgggtgtttcagccaacagccccagtgaagggcccagctggagccggcacggatcctgggacatgtgcccgactggacatcggaaaagaggagaaggagaacaggctttgggctgtggccgctgggtgcctggtggacacagccctcaatctttgccccttgcagatgatgtgccttttgagaggcaccaggtgactgctcacagtatgcaagcgcattatctaaaagcactccctcatttggaaacacttcaatgaaaaagtgaaattttgttcacaat

SEQ ID NO: 473468 - DNA, 563 bp, Homo sapiens
ggcctctccagagcgctgttctgataatccacagcaaactgagtctctgccggcctctagtgagagagtttgaagctgcaggtggttgaacatggctgaccgtcggcctctccgtgggcatcttgctgtgtctcttgctttgtatttgacaatatccacgctctcaggtacagctgatgccatggatttcagagacctgaaaagccctgccggcctccaggtgctcaacaattacctggcggacaagagctacatcgaggggtatgtgccatcacaagcagatgtggcagtatttgaagcagcatctggcccaccgcctgctgacttgtgttatgcccttcgttggtataatcacatcaagtcttacgaaaaagaaaaggccagccttccaggagtgaagaaggctttggtcaagtatggtcctgtggatatggaagacactataggaagaggagctaaagatagtaaagatgatgatgacattgatctctttggagctgatgggaggagaaaagtgaagaaacgaagaggctaagggaagaacaccttccacaatatgaatc

SEQ ID NO: 473469 - DNA, 562 bp, Homo sapiens
acccaacagctcattgagaacgggccatgatgacaatggcggttttgtggaatagaaaagggggcaagaatctagcacaggaatatcggggggtagggaaaggcaggacttttggaaccacagctgccacaagaaacaaggacaaggatgggcttggacaagcgcgaggaatgcaggggccagagacacgaatcccagatttctgcagcatttcaggagcagatgggcaagctgagggacttccttcagagaccccattcatccgaagttcagacagccccaaaagaaagtggtgggataagatcgtgaatgcaaagagatatggcagacctccgccaaccacagataactggagctatggcatagtcacagtgagctcagcagtgcctcgtgccgtggcattcacgcgatctcaagcaccccgctgctccggatctcgggaagatcctgccagaggttgaaccttgagtgggggttactgagcaggcagatctggggcagagtcttcctctctggtgggctggccggctcctcctcctcctcctcttcttcttcctcctcc

SEQ ID NO: 473470 - DNA, 526 bp, Homo sapiens
gcacactgcatgctgttaagccgcgctgactccggaattttgttcccaacggctgaacctgctgggctggtggcagaagtccgaagccggctggcagggtcccgagctctagtgcctggtcgtttggggcgtcactgtgctcatctgggaagcagcagggcatctgatgttctgagtctttcctcctgctaccccctgcaggtgtctgctgacttgaggtctgtgctaagcggatccctgcagcagcccagctgccttcagctctgtgagttcagcaattctttgccaagtgttaggaaaggatggcagcttcctaagatgattaatggggaaggaaagcaggatgaaggctccaagtggagcctgccagttccacttggaggtaattgcaagtgcaagcctttacagaaaaaagtatgaagttttaagaagactctaaggttacttgtattgatagtctttggctgcagtttagatatgtttaacaattagataaagaaggaataatagctaacagttgtactgc

SEQ ID NO: 473471 - DNA, 1455 bp, Homo sapiens
ctgagaggccctggacagctgcggtcctaagatgtcaaggggcatggaagggagaggctgcagagttccaccaaagggtgttttcctggcacccaacaagggccagaaactagcacaatctatatctggccttagaaacagggtcaagcgaaagggcaaaggactattcagccatggcataggcagcaaggtcagagtcagaagagatgtgacaatgaatacagaggtaggagtgatgtggccacaaaccaaggaatatgggcggcttttagaaactggcaaaggcatggaaacagatgtttctctagagcctccagaggggatgcaggctttgattttgttgtcatggttgggctctgagaagttccataaagcagtttcctctgagctgcttggactttaccctagacaggcagaagacggcaccatcacttgggctaaatcgcacccaccaaatgtcctactgcctgacacctctccatagactttgcagagaatacatcagttggtcctatctaaataaaccacagcttctataagatgccaacgcacccaccaaatgtcctactgcctgacacctctccatagactttgcagagaatacatcagttggtcctatcatctaaataaaccacagcttctataagatgccaacgcacccaccaaatgtcctactgcctgacacctctccatagactttgcagagaatacatcagttggtcctatctaaataaaccacagcttctataagatgccaacgcacccaccaaatgtcctactgcctgacacctctccatagactttgcagagaatacatcagttggtcctatcatctaaataaaccacagcttctataagatgccaacgcacccaccaaatgtcctactgcctgacacctctccatagactttgcagagaatacatcagttggtcctatcatctaaataaaccacagcttctataagatgccaacgcacccaccaaatgtcctactgcctgacacctctccatagactttgcagagaatacatcagttggtcctatctaaataaaccacagcttctataagatgccaacgcacccaccaaatgtcctactgcctgacacctctccatagactttgcagagaatacatcagttggtcctatctaaataaaccacagcttctataagatgccaacgcacccaccaaatgtcctactgcctgacacctctccatagactttgcagagaatacatcagttggtcctatctaaataaaccacagcttctataagatgccaacgcacccaccaaatgtcctactgcctgacacctctccatagactttgcagagaatacatcagttggtcctatctaaataaaccacagcttctataagatgccaaggcctctgcagtagcacaagggcccagcatgtgattaggattatggattgacttggcgacgcgggct

SEQ ID NO: 473472 - DNA, 1067 bp, Homo sapiens
tcatcaagtcaccatgcgacctgaactgcctatcatgaactgggtgctttctgaaatgagtcatgcacagaagcattccatcatcaaatggaagtggtacatatgtgatcagactcaggcaggtcctgaagtcacaagcaccacccgaaagtggacagctgcagaactacagcccctttataggacatccctgaaggacagcggtgaagggaaatcttcccagtgggcagaacttcaagattcacaggaccggtccaggaatcaaggggtgaaagtgaaagtggcaccactcaccatcacccctagtgatacaacagcaaaatttttgctccatgttcctgcagcattacattctgctggtgtagatgtcttagttccagagggaggaatgctgccaccaggaggtacaacaacgattccattaaactggaagttaagattgccacctggacactttgggctcctcatacctttaagtcaacaggctaagaagagagttacagtgttggctggggtgattgacctggactgtcaagatgaaatcagtctactactctacaacagagaaaatgaacacataagctcttcggatgccatacagtccatattggctgccagcctttcacagatgtttgggaacaccagcggtccagcgcatgtttaccttgggaacaattggaaaccacaggccttctatttagggaaggcactggagcccattcctacgtggagaacgacaaatcctcattaccatgtaggtcacagtccaggatatgcagagtgagttcctggggttgttttcagtacttctgttccatgcatcaaactaaaactttttgataaaattggttataatgttttgatggtgaaaaaaggaggaatcaaagataaattctaggtttctgccttgagaactgaaaaggctagtggtatgctaacatgtaaagaatttaagaatgaaaaatttttaactaagaaatgatcatttgttttgcacatgatgcatttaaaataagcactcacctgatactaccaagaagagaaaaaagacaacagctcaaggaagt

SEQ ID NO: 473473 - DNA, 853 bp, Homo sapiens
agctctggagctataaacttccaggagactttcttgggtcatcacaaacacaacacgtcattggtgtcttagtgcattttctgttgctattaggtggcagccacagcggccgccgcaggtccccacagaatgtagacatcggtttgttgcctcttgggcctctccacaggcattccctcagcgtgagcagggacacaggcgagagagagcaagagtgaagccaccgtcagtgtgtaacctggtctaagaagtgacatcccctcacctttacacgagggtgtcagctccaagaggccagggtctacgggtctttttggtgaagtgtcatttcatccctggagtttgcccctggggttccacatggttttccagccagtgttggggctcaggtggggccatcgagagccgctgaactctcatcctctccaggtcccgccagccacctctcagcgaggccccgaggggccagcagccctaagcggagccacagagcccatggctggctcttctccagaccaggcttatctgaccttccccaaagcccccgaggggtgccagggccacaccacagccagctgcaaggggacagaaaggcagtttgcctcagcagccatcagagtctgtctccctggggaaaggagaggcaagcccagcctgctccaccgcctcatggagcctacgtcgttcagaaccctgctctgccccacagagcgcactgccccggagtgtgattttatattcattgcagccagcccccttcttggcctccagtttccaatttccacgctggagcatgagctctgaggccaggggccatttttggcacagccttgatcattgcctgcccacaggg

SEQ ID NO: 473474 - DNA, 506 bp, Homo sapiens
caccgccgccgatgttgacatctgcagatgccaccttctagaaagttccccttccccaacatgtccggagtcctcaagggatgtgatactttcagttccgctgccctacagaatttgtcccaggccattgtatgttcttcaaatcctgtattccagggttctccagcccctggaccatggactggtactggtccatggcttgttaggaactgggccagacagcaggaggaccatctagttgcaagaaaacaagctcagggctcctacatgatggtcttaattactcagtgttcacattttccttccactgttggctttctctccacatatgatgaaactccatggtcagcactggaagaggcgagaggcgttttcatctggatgtgggtgaagggtggacaaggtaacagcactgggaaactttttctccttctcattgagcacagtgtgaatgtctatgtcacttcatttgcttttaatttctattaaggaaattttaaacatac

SEQ ID NO: 473475 - DNA, 448 bp, Homo sapiens
gctctggtgatccttcgacctggattcgagcccccacgtatgggcgctgcttgccgagaccagcttgctgtggctctgaacccagaaagggttcttacaagctcagaagtgcctgctgtctggcctcctactgtctggcctctgtctgctcctggtgcccactctagtgcaagcctgggtgctgtcacaacccagccaggtgtgcacgtgctcaggccagtgctgacatgccagccccctgccaccttagccctcttgggactttgggtactgacaatcatgggaaggaggtgcccacagtggaaaccgcttgtgatgcatctgatccagccacaggcttgcatgaagccagagtctgtgctggcatctggagctgactaccccactgcagcagccgatgtgcctggctgtgcacagtggcctgaccccctacttgctcactgacgca

SEQ ID NO: 473476 - DNA, 1075 bp, Homo sapiens
ctggagctattatctacgtgaatatggggaacaagttacccatttgttgtccactacttgaagagggaatcaaccctgaagtctgggcattggaagggcaatttggaagggcaaaaaatgcccgcccattccaaatcaggctaaaagaccccaccacttttccttatcaaaggcaatatcccttaagacctggagctcataaaggattgcaagatattgttaaacgtttcaaagctcaagccttaataaggaaatgcagcagtccctgcaacaccccaattctaggagtacaaaaaccgaatggtcagtggagactagtgcaagatcttagacttatcaatgaggcagtaattcctctatatccagttgtacccaacccctataacctgctctctcaaataccagaggaagcagaatggttcactgttctggacctcaaggatgccttcttctgtattcccctgcactctgactcccagtttctctttgcctttgaggatcccacagaccacacgtcccaacttacgtggacggtcttgcccccagggtttagggatagccctcccctgtttggtcaggcactggcccaagatctaggccacttctcaagtccaggcactctggtccttcagtatgtggatgatttacttttggccaccagttcagaagcctcttgccagcaggctactctagatctcttgaactttctagctaatcaagggagacccagggcaaatactcatctagtagaacgggaaccaggggcagaaacagccttcaaaaaccttaaagcaggccctagtacaagctccagctttaagccttccgacaggacaaaacttctctttgtatgtcacagaggagcaaggatagctcttggagtccttactcagactcgtgggacaaccccacaaacagtggcataccaaagtaaggaaattgatgtagtagcaaaagattggcctcactgtttacggatagttgtggcggtggccgtcttagtgtcagaggctatcaaaataatacaaggaaaggatctcactatctgaactactcgtgatgtaaatggcatact

SEQ ID NO: 473477 - DNA, 609 bp, Homo sapiens
cgtatcacaaccatttcctcacttacctttataatttcaccagttatgttttgggaccatgcgcagagaaagcagaggcgatcggaggcacggatgtcgaggccagtgtgctcggcagggcctggagttccggagctctcagaccttctcctcctccgcccccaggtcagcagtcccctcccgtgcagcatgtctaacacagaactcagaatcgtccccaaaccaactctcccctctgctttccacacaaatgccaaagacttcgtcacagccatctcctgcccagcggtgttcagtgactccccgtcccttgcagaatctgattctaatgagcttaggtggacaaccaaggccctgcgatatcccaccccaacttactcccgcacaaactccatttctcagctgaaacttaaaaacttaccacaatccaaggaagtgttaattcacgcagccactgctgtcatcaaggtgctgggccgaggggcaaacttgagcttgttaacagaatttattcctgaaagagctgcaataggccaaaacataattggatctcaaaagtttttgagaagaataatgaatgatgttaagaagaatgttcttgtgtaactt

SEQ ID NO: 473478 - DNA, 563 bp, Homo sapiens
agcaagcaaaaggggtccgatggtactcaccgcttggtgatagtcccatctgggtcaccaaaatgtgtccagaatttattccttctgtaagaacaatccctcctcttcctcctcagcctactcaatgtgaagacaatgaggatgaagagctttataatgatctacttccacttaacgaattgaaaaagactccaaatcatacagcataccagcctgaagagaaaatgacccagtggctgccatgtctaccaggcactggatgctacagctgtgttccactcagacctcgaggtccttgtgttgagatctcacttcgcaatcactgctgtcctccaaagtccaatgcctctgctgcccactcaccagcacactggatgcatatgcagagccgtttcaaaagctacaagaaggcagtaagtgacaagtctctttcccattcctgtccaccagtggctgagtaccactcccttcaggcagcccatgctagcaatttcttgtgaatccttccaaagatatataggcaaacactacattctatccagactgtaatatcctattatatc

SEQ ID NO: 473479 - DNA, 1320 bp, Homo sapiens
tgtcaaactgaatattcccacaaaatgtggaactgccaattattggatagtgagagaattgaggctgaaggtagaaatgtgatgcctgaaaatgactatgaagtgagtcatcacaaagtggacaaagcgatgcagagagaaggcggaaatcaaaggagtgaactttattaccttctgtcagtgttcagaaaagaaggctctggtttcattataaactgtgaccacttggggcttacggctggccctgtttacccaggagaggacataccatggttaggctgcattgctttgagtctcactggcctcctgatacagtttagacgtgagtctcctccaaatccgacgtgcaaatgtgatccccagtgttggaggcgggggctgtgtggagtccagtccgacttcacagcttgtccttgcataaggccagacctggtgttgaaaagcaaggctagcaaacgtttcaataaagttaaaacacatgagatgtcctacactcgcttgtaccttcctggcctccaagctggcaaactgcttcttccaggaacttcagttcattctagtgaagagtgggatttggagatcaagatgtaagtacttaaacctatttaaacgccgtcttttaatatgaacatatattttgtataaatataaaatttaaacataaatatgttagaagcatagtgagaaatttacaaaatacaactgatggaacaagcaaaaatagaagcacataaaagggcatgtaatcttccttgaggcgaaaactaagtcctgtaaaatttgtaatcttctcaaaatgaattaatgagttaatgaaattagaagccaaatcccctattttttagaacatcatagaaatattcctattcatttgaagggaaatacaggaaactattggtaaaataaaatagacataatggggctagaagacatgaaagtacattttagctctgaaataaataaagcagtgtggtattcacctaacaatggacaaagaatagaattatttcagagaaacaaaatagcatattgaagaaattagtacagtacaaatcaggggggcaaagatggacatattaaatgatactggagaaattgctagcaacttgacaattgtaatactaattttcatcattttaagcttcagactaatcagatttatttgttaaaaaagtaaatataaggagaaaacgtcagtaattgaacagtggaatttaacaacttgcaagcataaacatttcatgacatttttacattgaatagcatcataaatagaattaagaggcatgttatacatgaataaaaattttggattattac

SEQ ID NO: 473480 - DNA, 655 bp, Homo sapiens
tcctttctgcgtcagcgtcttcactgctgtgcacctttcattctctgtggaaaaatgctcacttctagacttataataatgcagtttaacttggctctgtttggaaacacaatgccagtgaaccttgcattttgttgtcattggctagaagccacggctttcactcagcccctggtcctagagctcacatccagtctggaagagaccaaaatttctgtatatgctgctactctgtgctcatggagtatccctgctcttcaagagcagtcacagagcagtaacactgccccttcaacaaagctattttcttctatctatggctcgcctttgaattctttcctgcgcaaagccaagaaccctcactggctaagctcaactttcgggttcatctgccctgcatccattgttttcaagatgtggaagtggcagttttcaggggctaagaagagcctcttggagttcttggtttgcaagcaacagaaagcaacgagggtgagccttaagcaagctaatgagaagaacaacaatttctttataagtagaaaaaggaataaaagataaatctaaagaaagaaacaaagctcttcctgagtctgttgactttggctctgagccctaccattaacttaaaccctcaatttcatgtctctatggt

SEQ ID NO: 473481 - DNA, 548 bp, Homo sapiens
atggattttctgcccgctgcagatatgtgatgtatctggtgataggaactaagaaacaggagaggattcttcttatgcttttaccaggagaacttggtggggttcctggaaataaagcccatgaaaatgtgcatggtcttctaagacaagagcctccactctcaagcaattgcaacaaagtcgctccacctcctccctggttgctgcaggcctctctgttcccagttcaacagaagcagcatggatggatgcagcaggctctcaatcaagggcagataagaatccctcttcgcatgtgctgctgctctactttggggatggctcgagtcttcacactacacagtcactgtttcctctggacttttaagaaggagatcatcctttctgctccttttactctcctctcagtgcctctccatgctcaggccatcacttttcacgtctccaagttctctctccgtcttccctctccccacgcagcccacacagctctgaggggccatgtgatcatagggccatgactcacaggcagacttggagagccgtct

SEQ ID NO: 473482 - DNA, 1048 bp, Homo sapiens
caggtagtatttggttacatgacctgcttgggaacgtggcgaagcacacagacctcccacgtggacatcgccttgggcggctgcctgcttgcaatgctccatggatgattctggggcagctcttccacacatctcacttcggcaagacagtgctagggaacaccccgcaagcacagccaaatgatgagacgcttccgacaggtaggacagttgcagaaaatgacaccggaaaagttgagaaggtcactgagcttctcatttatgcggcagttccaactgagaggccggagaagctgacggtgtcgcacggttcagatcttttccacgtgaaggcattctgtacatgccaccacctcatggaagattcgatggacatggacacgagcaccctgaggccccagaattaccttttcagttgtgaactaaaggccaacaaagatgatcaccttaaggtagataatgatgaaaatgagctcaagttatctttaaaaacagtcagtttagtggttggtgcaaaggatgaattgcacactgttgaagcagaggcaatgaattacaaaggcagtccaattaaatgtggctcaggaccagtacatattagtggacagcacttagtagctgtggaggaagaggcagagtcaggagatgaagaggaggaggatgtgaaactcttaagtatatctggaaagcaatctgccccagggggtggtagcaagtttccatggaaacaagtaaaacttgctgctgatgaagatgatgatgatgatgacaatgataattttgatgatgaggaaactgaagaaaaggtgccagtaaagaaatctatatgagatactctagccaaaagtgcacaaaagtcaaatcagaatggaaaagactcaaaaccatcaacaccaagatcaaaaggacaagaatctttcaaaaacaggaaaaaactcctaaaacaccacaaagacctagttctgtagaagacattaaagtaaaaatgcaagcaagtatagaaaaaggtggttctcttcccaaagtggaatccaagttcatcaattac

SEQ ID NO: 473483 - DNA, 1404 bp, Homo sapiens
gcaggaagagcacaggctgtgatgggatcctttggcccctgcccagccctgtgtcctggagctgcccttcatccctcctgccttcaggaactcagcaccccccattctggagaaggggttacagtccagtgggagcatcttgagctcctcacaccaggggccaatgcctggcacgaggctcagaggctgcccctcacctcatgggaggacttccatcccatcatgcatggaggaggaggaagagaaaaaggaggaggaggagatgaggaggaggagaaggaggagaacaaggaggaggaggagaacgaggaggaggagaacgaggaggaggaggaggagaacaaggaggaggaggagaacaaggaggaggaggagaacgaggaggaggagaacaaggaggaggaggaggaagaggagaaaggaggaggaggagaacaaggaggaggaggaggagaacaaggaggaggaggaagaggagaaaaaggaggaggaggagaacaaggaggaggaggagaacaaggaggaggaggaggaagaggagaaaaaggaggaggaggaggtggaagaggggaaaaaggaggaggaggaggagacgaggaagaggaggagcctctgatttgtgtgactttccactggaatgtctgtggtcgaagacctgagagcctctggcaaaccactggtgtaagttcaagagtccaaaagctgaagaacttggagtctgatgttcgagggctggaagcatccatcatgggagaaagatggaggccagaagactcagccagtctagtccttccacattcttctgcatgctttatcctcaccatgctggcagcagattggatggtgcctacccagactgagggtggttctgcctctctcagtccactgactcaaatgaaagaagacaatcaatcagctatgaagcaagaagcagccctcacaggacaccggatctgccagtgccttgatcttggacttcccagtctccagagctgtacgaaattaatgtttgttgtttaagtcactcggtgactgatactttgttataacagcccagactgactaagatacctcctgtcaggtataaccccctgcctagaaccctaattttaggtacagagagattttccagtccacttaagttcatatttcaaaaatgttcattcttaaagcagacaattctaagaatattattgtagaaaatgttatgtaattcaatttttactaaaaagtttgagagcaaatgactgttcctgctaccagtcttccaaaataaaatattgatgtttaaaactctgtatgcacacttgctagtgtaatataagtgtgattgttgtagcaacaattttgagactgtcagaaagcagatgagtctctctgtgtgaatttcagaccttgatccat

SEQ ID NO: 473484 - DNA, 1750 bp, Homo sapiens
tgggtaggagaggacggacctctccttctatgatgaagaaggggcagatggcacagattaaacatcctgtaccctgacagctgcctagcccacagccacagctgcctagcccacagcgacagctgcctagctcagagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagcgacagctgcctagctcagagccacagctgcctagcccacagccacagctgcctagctcagagccacagctgcctagcccacagccacagctgcctagctcagagccacagctgcctagcccacagccacaggtgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagcccacagccacagctgcctagctcagagccacagctgcctagtccacagccacagctgcctagctcagagccacagctgcctagcccacagccacagctgcctagctcacagccacagctgcctagctcacagccacagctgcctagctcagagccactccctaccatcccatgtctcagtgtgccagccacagcagagactgccaccttgagatcatgaggagacaagcccaaggccaaaggtgaaggcttggagggaggcagtggaagaatggggtgcccagccactccccgaggctcgagggggccaaccccagagcctctcccacacggaaggctcgagtccttctgttaggtggcctgataaacgttcctgattgtttaaaccacttctcttgaagtttcccttcccacaagctaagccttccgtcctattcacaaccacttagttcaggacaaatgagtttcagtgactctgaagcttcccactttgatgacccaggtaactgagatcactggattaactcaggggccaaggacgggccacatccttcatttctccaaacctgacaatgggagtttagtaacagatattgaaggtgtcacaggaaaatcgaagtgtccttccacattggacatcctccatggatgctcggatgctgtgctggccaaaccgtccttcactaatggcctggaaagttctcacgacacggatatacgcaccttccctgtgtccatgggtatgccagtcaccctgacgcagagccaagagcctgcccagcaggcagcacgggccaggcgcagagtggggccaggcagccagccacgctcgcgcaagttctccaggcttggcccactcggatgcagccacccacccggtccatgactgtcccaggaacagagggtctgcacaaaccacatcctatg

SEQ ID NO: 473485 - DNA, 526 bp, Homo sapiens
ctgtttgatggtgccaaagcttcacgcgttcagtggaaagccgtaggatactctcggaatgctgggcagtgacggccacagctccctgtcagccacatgccctctgcagtggacggcgatgccaaaagacttttcccgcctccaggccaacgtggactccaaaggaaaagaaccttgtaaatatgatggcataccccctaaaacacaggattctgtttattatgccaaagaagaaaagaagaaaacattggcagaacctttagtccaaaggggtgcagaaggtgacgtgtataaagcaccgactcctagcaaggaaacccaaggggcgctggacgtcaaagaggagcacaatgtgcagctggaggtgcctgtggaccaggacattttaggctgttacttgtatgccaaatataccgttgtcactaggatgttactgtggctttctgggttgtagactgtgtgtccaacacaacttttcaacacaggcagaatcctcgtgtgacaagcactgttgtcataactttgc

SEQ ID NO: 473486 - DNA, 693 bp, Homo sapiens
tttcgtgtaggacatgacttgagggcttactaggaactttcctggagctagttctttgtcaagttttcaatgatcattatctcgagcaaagaaaaagagctgccatttttcatcttatggtggagcaggacagatggtttgaacaccatgcaggtggccagccttcctctatcctttaggttttgtggtaccagatgtgacagatatcaggccggaatggggcactcattgattcatctggtcgtccatgaggccgtggtgaggtgttggcagcatgctaagcacactccgctagcacgagacacaaagatgagtggagtagaagcacagaagagccgattcactttgcaaacctgtgtgcagcctgagaggggagggctgtgtggccagcaagcaaccaaccacactcgcatgtgttttgttcctgagagtggtgcaaaaggattgccttcgactctgcagggctgaagcaccagcaccaaaatgtgcagttcagacttccttccaaggccatgaagttctaatttaagctgttggagctgcactgtccagaatgtttgaaagatgtgagagcacagctcttcgcctcttagttctcagtttccattttgaatagaagaaaatatttttttcttaattcagcaaaagaacttgcatttgcactgttaaaaatgcccatttccctaccatttg

SEQ ID NO: 473487 - DNA, 730 bp, Homo sapiens
tgacagggtcctggaatgcttagagggcagggaggtgagaaggagcagagagggctggagaaagtccaggtgatttctttttcctagaccaccttctctctgattcagctgttcatgtgctaccttttctttctcctcttgaaccctgattttggaaaagaaaagcaatccaatcaccatgccgttgtttgcagaacacacatccaagtcaggtgttgctacaggaacggagtgcattagagcctcactggccgctgccctgggatgccgctggcagtgccaggcaccgaggtgctcacttgggacctgtgcctgctgcttcgctctgaggctgaggatgtctcccattgtggaaaacagggctgagaatatgcagcacactgtgaggagagttggcgagggagtgaatggcttgttgagctgtgttctgcagcagccagatgctggagagagagcccggggctcccctgatggggtcaccgggggattgagctggtgggagtatgaaaaggcaggagaatctatgggctcttgttccatgatctcggagagaagccaactgtgtcatggcatcacccgctttgttccacggttgttgggacagtcgtctgcctctggctgtcatctgctgcctgaggctgtcaatggaactgtggtttgagatctctggttggagtgctttccagtcggaatcatatctatgtatatatgatataatatatatatattt

SEQ ID NO: 473488 - DNA, 650 bp, Homo sapiens
caccctcaggctcccaatcactccatgggctccagctcacctaagtctacgctggactttctgtcaaaaatcccacccactggcagttgtttaaagtttatgcccaaactctatgccagtgaaatttctaccctgctgatggatctgagcatattcaatgttaagggagttttaaagtatgctagatgtcttctttctgctctgtccttcctgtgctgtcctggaagcactgccacattcacagagctggcaggggagatgaaagcagccccagccagtgatagtcttctttcaactccttgtcagaatctatcctgtggacccaatttcctggttcagcagggagtgtttatgtatggcccactccacacagtggcctggacaaaggacaatgatgacagacttgcaggtggttctaatcacttcaatgagaacagtccgtggcagctgggcagttctcaagcccacataagcttggctaagatctggccagtggattctagtttaattgatagcaacaattttgaggtctcatctagaagtgaaattgagaattggccatatgtttcttagaatgtaatgtgataattgtacagtaaaggtgagctcttcatttaatcagcaaatacttagagttgtataccctttac

SEQ ID NO: 473489 - DNA, 603 bp, Homo sapiens
tcatgcagagtacagcacaaatatgctgtcactaagcattggacagcttgaacaacagaaacctactgtctcacggttctggaagatggaagtcgagatcaaggtgtcaacaggtttggttttccgtgagggaggatctgttctggacattgctcttcggcttgaggatgcaattgccgccctgcgttttagggttttcctgctgataattttggaatccaaagaacttttcaaaaatcgtattactggttctgatcccggtaatgagtttttcagatggagatgtaagggacgtggaagggaggcttgtgggaagatgtcaacagcgacagagacttgcttgagaaaattcaagaatgcaagcctgggccaatggggaccaggaggacaggagtggagcccatgcaccacgtggggtgagagcatggtttccagcccgaataacatcttccagagattgcctggaagattgatgaataagccttttctctgttaacagaattaatatcatatggagccttcagaaggcgatacccgatgtagagtcagatgccagggagggttttgttgtttttttttttctaaccatccataaacctgcac

SEQ ID NO: 473490 - DNA, 599 bp, Homo sapiens
gcacacagcatccccaggctaatgttatttgagctgtccctcagacagtccagtggacgacctggggcaagtgctgtttctgctgtcagatcaaggggagcctgtgacagcctgggtcctgtcaagtcaaggtgcaggatacagcttggggttggcttccaaaaagagtcagtgagagatgagagaccacccgcttcagacatttctccccagtcactattccacttgcagcttccgggaggaagtttgagcggggtcaccttgaagccagaagatgtagctctcctcttaggcttcagggcaggttacaaactggtgtccaggagagcttctgcttttgtgttattttgcctgctcactggcctccagtgtgttgaatttgagttcacattatttcacgatgattgcacaaaattcctgcagatataaggaaccacacaattcttaattcaatactgcattcaatactgtccatttcatgtcaccccagtagacacataagcggaagtgaataagaggccgtgcgtacttctctgtggtccaggacaacaaggcaaaataataaatgcaaataaattaccctgtggctgaggatcatc

SEQ ID NO: 473491 - DNA, 1071 bp, Homo sapiens
ctttctttcgtgattatacactcgtaacaaagaatgttataatgagagagctcagctcagccgaagtggcaatcacactggagaaccctgggatggagaacactgcgtgtctcagatgccctgggatggtgggaggagatgtcatgaaatctggcacagagaaaggagttagaggagacacatttgtgcccctggaagtgactgttcacagagctacaggatttggctgtctttctgcaactctaaagccacctcgctccctgcacagagagccctacttaggcaatgccacgtccccagtgccaggacaggagctgcatgtcctgcttggaaaggccggacccttaagccgtgagtgctttgtcctcctcgaggcacccacctttctgattttgttggctagtatctcattctcatgtgaacacagtgtacagtaatgggtggtatacattggacacattctatttgccaggagtcttgcaaatctgatctcatttagactagattcaaatcccttttctgccattgctaatggtatgcacctagggaagttaataagcctgtccttcagtacgggcttggattaaggtgggctaacaggagactcaaaatatgtaatggctcaaacccaacagaagtgtctttcttgctcacccgtctgtcagtcatccaggagcctaagctgatgaaagttctgcccatgtcagcatgtggctttccggttttgctctggggtccttttccttccacatttctaggaggatgcttgagtgtgatggaggagattgcttgagtgtgatggaggaggatgcttgagtgtgatggaggaggatgcttgagtgtgatggaggaggatgcttgagtgtgatggaggaggatgcttgagtgtgatggaggaggatgcttgactgtgatggaggaggatgcttgagtgtgatggaggaggttgcttgagtgtgatggaggaggatgcttgagtgtgatggaggaggatgcttgagtgtgatggaggaggatgcttgagtgtgatggaggaggatgcttgagtgtgatggaggaggttgctgggct

SEQ ID NO: 473492 - DNA, 629 bp, Homo sapiens
agtaggtagtggcacagcaaagcacctgggtcatgaggcaaaaatgattcttgttttcaaatttaattcagttttctccttaggccagctgaacttgctgaatgatcactggctgcttagtatgattagacctcaaaatgctaaggattctactgctaatggtatgcagaacactgagaatccttggtatgaatggttcagagagttacacaaaataaatgcatttgacactcctgattcattgctcgtgagaggcaaggagtttgttgactctatacataacacctttgaccatatgtggagaacccaggaacataatgaagctggttggttcctcctaagttcactggacaaagtgatgaaagaaaatgatgaactcagagattctaactcctgccttcagaagcagatactgagcctcaaatctaagattgccctgagtcagagtcttatttcctgtagagaaagagctgacattgtggcaaatcaaacagaagctcttatcatacctgtaacttgactaacgtcttggcaggcccctagaggtgagggtgagagtgtgatccatgaggaggtgtgtgacacttgaaaagaactgctcgatgtttgtaatttatataaacagaaat

SEQ ID NO: 473493 - DNA, 668 bp, Homo sapiens
tcactcgtctaaatctcccagtgtcttcacgttgcctctagaccaagatgtcgaggacttgctggaacctacagagtcctacacgacctggccctggccccatcactcattgctctgttcttcaaaccaccaaacatgtttctgctgcttccactacctactgttccctatcgcatccacagtctttgattctaagagaaactggcaatagccaactagacgcctggaggcatctgattccagagtcacattccactacccttagttatccatggaactaccttccacctccaggaaccatggctgccagtgtctctaaacagctcctttgcttttctgacaacagccctggtccctccaaacgagggaattatgggatctacaattcaagacaagatttgggtggggatacagctaaaccatatcagaattggtgcatacagaggcgcttaacctcacaggcaggacttcatgggacgttcattcaaactgtgtcagaaacacagcgtgcccggcgctttcattccacagttgctggagaggcctactaagccccacactgattccaagagaggctgttatctaggaaaacgttcaatcatgtgttttatatttgattcatttgaaaaattatttttcagaaatttgttcccaagtaaccaagggag

SEQ ID NO: 473494 - DNA, 582 bp, Homo sapiens
atatcccacagagatatggccttaggtcagaccaagactttggcattcacttatgggcatctgacaacccatgttgcagggtctcatctagttgggtgccatgggggagaggacccatttaatgaagcactctgtcccttggtggagaaggtgtgtttcactggggggaaacccactcacctgggatgcccggattcctcagaactaccagaaggagaggctaagtctgttggtccacagagactgtggccacccctccccataggggctcaggcccaggaagatccaaattctgtccctgagcctctggctggagatcctgcagggaagctctacccaccaggaaggatgggtcaagtcccggtgctgactgctgcccttcccctaatgagctcaaagggcttagagagcaggcagccacagccggtgctggtcgcccctccccctgggagttccgcaggcttaagcagattgcagctgagaggctgtaagaatctgtgccttctggggttgggatgctaggccctggtggcatgggtttgcaagtgggatcttctgatccatgggttgcacagttctgtg

SEQ ID NO: 473495 - DNA, 1012 bp, Homo sapiens
ccggcctccccaggctgttaaaagcagatggtagctgaggttgattcaatgccggctgcctcttctgtgaagaagccatttgttctcaggagcaagatgggcaagtggtgccgccactgcttcccctgctgcagggggagcggcaagagcaacgtgggcacttctggagaccaggacgactccactatgaagacactcaggagcaagatgggcaagtggtgctgccactgcttcccctgctgcagggggagtggcaagagcaacgtgggtgcttggggagactacgacgacagcgccttcgtggagccgagataccacgtccgtcgagaagatctggacaagctccacagagctgcctggtggggtaaagtcgccagaaaggatctgatcgtcatgctcagggacactgacgtgaacaagcaggacaagcaaaagagccaaataaaaatagcaaagttttagcgtttttaaattacacatgctgtcttttattattgtgataaattaattttttgtaacagaatggaaaaaggcttgcttttccagatatcaaaatgtgcatgtgttatttatttccacaaattgtttactaacagctgaaaagacatcaatgaatagaacagaataggaaatttagaaatacccaaatatatgtaagaatttagcacttgataatggtgatgttttgtattatttaaaaaagatggattgttcataattcatttttggagaaaactagctagatttttatgtcacaaaaataagagtatagattaaaaattttaaacatacaaaaggagaaacataccagaaaaaatataaatgcctatttatatacgcagatatatatatatatacatatatatacacatatatacatatatatacatatgtatatatacatatatatgtgtgtgtatatatatacatatatatgtgtgtgtgtgtgtgtgtgtatatatatatatatatatatatatatatatatatatatatatatcctttttttttt

SEQ ID NO: 473496 - DNA, 565 bp, Homo sapiens
tgaagtctattttcaaggtgctggctgatttggtgtctggtgaggacccacttccatagatgatgccttctggcggtgtcctcacttggcaaaagggaaacttttgtggtgtgatgtatggctgtatgtgccagagtggctttgcagacaatggaaactgggaaaatatccagagactgcttttgaacgctcacagccagaagagtcgatttggttctaggctagaggggggaaattgtgatgtggctgaaaggaacaagagtgcccctcagccggcaggcattcgctggggctccgaagttaaaccccaacataggaatgggctgaacataccagccctgtgctggtacaagtccttatgcatcccctgcgtctcctcccagtgtcgctgccatgagcccagcattgctcttttctctcctgagaagtttctcctttttaactgtctccctggacgcctgggctgccaaaagaaaatgccttttatcttcaaattctccttgtcttttcagagctaggtacttaagggcttctcagttagtagacagataaatggtaactttgg

SEQ ID NO: 473497 - DNA, 4177 bp, Homo sapiens
ggctgcctcttctgtgaagaagccatttgttctcaggagcaagatgggcaagtggtgccgccactgcttcccctgctgcagggggagcggcaagagcaacgtgggcacttctggagaccaggacgactccactatgaagacactcaggagcaagatgggcaagtggtgctgccactgcttcccctgctgcagggggagtggcaagagcaacgtgggcacttctggagaccacgacgactccgctatgaagacgctcaggagcaagatgggcaagtggtgctgccactgcttcccctgctgcagggggagcggcaagagcaacgtgggtgcttggggagactacgacgacagcgccttcgtggagccgagataccacgtccgtcgagaagatctggacaagctccacagagctgcctggtggggtaaagtcgccagaaaggatctgatcgtcatgctcagggacactgacgtgaacaagcaggacaagcaaaagaggtaaccaggcctgggctgggaggaggtgggaggtcgggggatgatggggacataccctcctggcgggggaggagggggacctggctttctcacctccgcaggcctcacagcaccctggttgtggaaacctcagagaggtcagggcacaggcccctttatgaacagcaacacacacaaaaaaaactttagctgatttccaatcaaattataatttccctcgtagaacactaatagactgttttaaagtgatttaacttgcaaaattaattaagtcaatgcagcagattatttttaatctacagattttaaaacaatgttctatacattatagaaaagtgtatattgagaactaagaatgaagccccataacacatcaacttcagggctaaatattcttcaaataaaatccagatggaataatatgtaactattgagggtgtcagtagatacagagatatgtcgacgtgcaaagatgtactttgctatatcaagtgagaaaaaaatcagtttgttacacatatacacgaacagaatctgctcgtgttagctgcaaatctgtagaaaatataatcaaacttgtttctggggatttgtaagtgaagtttttccctttctcttatctgtgatttctgcaatgaacatctgaagttgtagttaaggttcattactaatgcaataatccttgggaagagaaggaatatgcttcttgcatagatgcaaataattcctcacattctattatttatttttatttctgtggttggctattttctgtgaacttttaccctcttcagaagaagaggggtcgtgtttacctgttcctgtagattttattatatatacattttattccataattatcttttcattatatatagattaacatgtaaaaagtatgaattaatcattttagttgagttatatatttatgaaaattaaaatagcaaatataaatgattattgctattgcaaatgtattgcgctactctataggagttttctttaaaaatattgaactcccaagctgtgttcatccatttttcctatccatttagtcatcagacataagccagacacctattatgtggcaggcatattctactatctctcaggatccttccgtctttgaaaactacatgttttcctgctgggcttgagcaagctgagagatttaaaattggggcattaggacttaatctcaattgaagcttttcctccctcctttcaaacaaaagcatttctggaggtagaaaatagtaatagataacctttaactgcccttttgaaaatttatgtcttggggaaaagactgttttagttgttttaagaactaaaatgtggtacataaacagcatggaataatatgcagccataaaagaaggaacgagagcatgtcctttgcagggacatggatggtgttgaaagccattatccttagcaaactaacataggaagagaaaaccaaatacagcacgttctcaattacaggtgggagctaaatgatgagaacacacagatacctagagggaaggaacacacactggggcctatcagagggtggagggtgggaagagggaaagaagcaggaaatagaatgaacaggtactgggcttaacacctgggtaatgaaataatctgtacaaccaacacccttggtgcacatttacctatgtaacaaacctgcacatccagcacatgtatccctgaatgtaaaagttgaaaaaagctccacaaatagtttcataaatccattttaaaacaagaaaatttataacagtcttaaatcctaatatgaatgattggaaatatctgatgtacatacattgtataaatctaagtgttgacaaaaatgagcccatgctattcatttgaattccaagttttctttgacttaaagtttattgaaaaccaaagtaagaattggtttattttagaaatttgtttttgttttcacctctgctctcttattccatagttcttttaggaactaaaatttatctaaatgctggtcatctgactggaaccgccccagacctgttgtaacatattctacttaatgtaagacaccagggattgtatgatgccccattattttatgcctcaataagagaattatttaaatgccgcaaattatagtaaatcatgaattgtaagtggtatttcagtggagacaacatggagacaatgatcatctcagaatcactaaaatacaatgttagctgtaatatttaaaacacacctgaaagtgcaggtataattgtatcatctcaattcaaatgttgtctttagtggtattagtaaaaattaaaatatctaacaattattgagctgttatttgtgttaggaactattctatatcttttgtgcagagtctcatttaagcattacagtggtttcccgtaagaaagctactattttcattcctattttattgatgaggaaactgagaccccaaaaggctaagcaacagccaggaagtgacagagcttcaagtaggattccagctcaagttgaatgtcatccaagggctatgctctttgtattcatataggatgctctttcattaatacagcgagtaaagagagataataaatagtgtgcttttttcatgggaaagttaaatgtttgttttgaaggcagagtaatagcaggctattcagtgtttgcaattacatgaatcattgctatggctgtagctagtgcactacaatttcctaaaaagtcttgtcactctcataggactgctctacatctggcctctgccaatgggaattcaggagtagtaaaactcctgctggacagacgatgtcaacttaatgtccttgacaacaaaaagaggacagctctgacaaaggtatgcagtagccaactatatcagcatgaggtgggtttgatttcaatacatagcataaaaatgagttttctcctttaaatataacttaggtggtgaaagctgtggaatgttattttgaattcctaggatttgtaatttgtttttggtctaatactgacaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaaggtatagatctaccaattttatcttcaaatactgaaatgcattcattttaacattgacctgtgtaagggccagtcttccatatttggaagctcaagcataacctgaatgaaaatattttgaaatgacctaattatctaagacttcattttaaatattgttactttcaaagaagcattagagggtacagttttttttttaatgcgcttgtggtaaataatttttttgaaagcactgaatttgtagaaggtaatacttactatttttcaatttttccctcctaggatttttttcccctaatgaatgtaaaatggcaaaatttgccctgaaataggttttacatgaaaactccaagaaaacttaaatatgtttcaatgaatagagatcctgcccctttggcaagttcctaagaaacagtaatagatacgaaggtgatgcgcctgtcagtggcaaggcttaagatatttctgattgctcatgaggcagaagtggaaagc

SEQ ID NO: 473498 - DNA, 1001 bp, Homo sapiens
acccccaggccagctcccagtcgcccaccctgcacttggggtgctcccaatgggtgttcagccctgcctgggccaactccactgtggggttttcctattccctggccatctgtggccacagcagagggcacctgcgactttaaactggggacccaccttggggatcccctctgtctcttcccaggttctaggcacaatgctgtccctcctgcctcctcctggcttctgggccttggcacccacgtcccccaaccctatgctccctgctggacccatcgccatcccagcgctgccaccttcagcccacacacattcctctggctctgaaaccctcccctgccagcaccaggccccatgctatggcctagcgcaccctttccaaggacagggagcagctccttccttgactggtcccaggcacaggagaacccaggctcagggagcaagcggcatttcaactgccctcaaagaatggacagatgcaagtggtgggaagataagatgctgccccaagcatgagggaaaattccttgtccagtctcaccagatcagacgctcccagtggagcagcaaggactgaaatttaaggtgtttgaaaatgtctcgggatagagagattcccaacatgggagaaaaccccaaaccaaaaagacccaaccaattgagaactaggttcacgacctgtgtacaaaagtttttaaatgtagccaaagtggctattggcagggtttttatcatgcacccaactgaaatggtttgttgagggaaaattgtagtttcatcattccatccattctgggtgtggtatagggtaaaaaacaaaaccgttcgggaataggaagattatgaattgcccccaaatgatggtcagaatagttttctattatagaatcttattcattttaatgtgccgcttttaagtctttttagtggaaaatattcatttcgtgtaagttcggcatgttaccatcttggctccacacaaagccactttctctccc

SEQ ID NO: 473499 - DNA, 1658 bp, Homo sapiens
gtgaaaagacccgtggaggtcctactggaagcatgttcaggactttcatgtggtcctaaacttcgtgagggagagtgagaaactgccccccatcgcagtgatgagattaccgcgtggaggtgacttggaggtccgcccgcgccctgggatggagcctcggccaagctcccgggaaagtacttaaaaaggccactagcaagcgcgcgatgaacggcgcaaacacctacgggacggctcgagatcgcaggctggcgagggccatcgcagctgccacccgcacgcccgacaccgtccgggtccacctgggatcgccgtcccggcccgggtgggcggaggggccccgacaccaccccagagccccagctttggagctccccaacgccacagccaggcacagtgcgaccccggcagcagagggggcacttggaccatttgttcatagtctgggacctccggtcccacgagagcagctgcgagaaggcgaccgactcctcctgcagctccggggccgcgcctgcggggtcgcagctccggagaggacagggccttgctccaggcgaggaggccgggggcgcctggccaggacttgcccaacgggttcctggcaggcatggacctgaaacctgaaaccaagaaaggactgcgagagaaattggaccccattgagaccaatgaaattgctaatgccaactctcatcagcagatccagaagctgatcaaagatgggctgatcatccacaagcctgtgattgtccattcccaggctcaatgctggaaaaacaccttggcctgccggaagggcaggcacatgggcataggtaagcagaagcgtacagccaatgcccaaataccagagaaggtcacatggatgaggaaaatactgcaccggctgctcagaagataccgtgaatcgaagaagattgatggccacatgtatcacagcctgtacctgaaggtaaaggggaatgtattcaaaaacaagtggattgtcatggaacacatcaacaagctgaaggcagacaaggcccacaagaagctcctggctgaccaggctgaggcccccaggtctaagacctaggaggcacgcaagcaccttgaagagtgcctccaggccaagaaggaagagatcatcaagactgcccaaagaggaagagaccaagaaataaaagctccccctttgtctgtacatactgccctctgtgattacatagatcagccattaaaataaaacaagccttaaaaaaaaaaagatgagagatgaggatctagtttcattcttctgcatgtggcttgccaattgtcccaggaccatctgttgaacagggtgtcctttccccatgttatgtttttgtttgctttgtctaagatcagttggctgtaagtatttggttatatttctgggttctgtattctttccattgatctatgagcctattttcatatcagtaccatgctgttttgatgaccatggccttatagcagagtttgaagttgggtaatgtgatgttccagatttgttctttttgcatagtcttgctttggctatgtgggctctttcttggtttcctgtgaattttaggattgttttctctagctctgtgatgaatgatggtggtattttgatgagaattgtgctgaatttgtacattgtttttggc

SEQ ID NO: 473500 - DNA, 1731 bp, Homo sapiens
tccctgccacccagtggccagcgtgacaaggcttttctagctttgcccatctagctgctccaagccaggctggaggaggaggaagaggaggagtcatctatggtacattggagcctgcagatggcatggctttgcagctcgccttatgcggttggtggcagcaacagagactgcagctcccccggagcaggtgggctggcgcattgagggcgacagcagttgtattggcatcggtgctagtggtggtagcagcagcaagtctggggatctggagcactgcaggacccagcccgacctggggtggggaggaacttgccgccgctgcttctggaccagcagcaggtctgactctttgccagcacctccacctcacgctgcagctccgacttccagccgtggaatcccgcaggtgctcactcaccctgacgtggagtcccataccacacctgtgcctgggtctgggctgccagttgctggctctcgggccactaccactctgactgctggcagtctgactgctggtgatctgcgaaggcctggtggcagtggccatagcagttctagaaccactcgtccagcagccagcagaattactggctatttagcagctggctctgctgagcagcaaatactggccctgtacacccctggacaatttctaacggattcccccctgccccccatctcagagttcaaaggacccctccccctgcaccctctcagtgcttcaagaactccctcagctcctatgcaaagggccaagggtgcctgcccagtgatggaaacactgagagtgcaggaacagaggcaaactcacaggacagaggggcacaagacttgtgccctggcacacaaggagaagtacatggcctaccgcgtccattatcccaccatcgtacagctggccagctaccagcgagcggctggcactgtgcaggcaccatccagtgcttcctgtcccccgcttcagctcacaatacccctcaggacagggcactcaccccatccaaagctcctcccactgctggatgtacctgctggggcgaccccccagacagggccttgcccagacagtgccccctttagcagcccctttctgtccccaatgtcagtgcccaccccccgcccagttctcagtgcccaggatccccgaggctcagatgggcagatcagcaggggcacgtggagctcccacagcactccgcaggacgggacccacccagaaagcatgtgggtggggggcccttttccaggacccaggcccacagggctcttgtcccagcctggaggggatgggcgggtaacaggtaccagcccctctacccatgtggacacccagctgggcatgtactcccacagggcagggcgtgggcaggtagcacccaagctctctgatctcttacaaggacacaaatcctattggatcagggcccacccttatgacctcacttaacctttaccatctccttataggccttgtctgcaaatacagtcaggttgggcattagaacttcagcatctaatattgggggtggggagcgggacacaattcagtccttagccctctccttcctcaggactccagccacatcatgcacagaactatggcctgtatcccatggtgctcctcagtacagtctgggatacattctcagaaatgaatcattaggtgatttcattgttgtgagaagatcatagggtgtatgtagacaaacctagacggtgtagcct

SEQ ID NO: 473501 - DNA, 706 bp, Homo sapiens
ctgtgagggcctgggtcaccagtgaccccagaaactgcaatgcactccagagctatcatgagggaaccttgtaagtgcctcgttgaaaacctggagcactctagctttgtcacagtgtttcccaacagttgggcctgggagcaactctgtggaaggaggttctgtggtgacatcactttggagaactctgactatgagattcctcttttggaaagatatagtataccttcatgtatcaacagctgtatagatgtccctgtcacaattgctggaatctgtgactatagtggtttatataacaaaggggaaatcaaggttgcaggaaccaaccacagcaactgctgtgagcagaaagtcacgagcttgtgctcactgttgctgccatgcaaactagcaaactaggcccctctttccccgatcctatttttaatatctctgacaatgaaacagtgtgtgctaacccaaagaaaaggtaagtcatgtccatggataaccttggatttgagatgatcccttttgaatgctgtgctcctgtttctccatgtccacccactctctggagagcagccaggcagataacgtgggaacgtggaaatgtaaagtggagactcatacccccacttccagtagtaacgatttcttaagtttttccagctagagagtaggtgtactctggaagctggggagctgcaaccaggcttagggg

SEQ ID NO: 473502 - DNA, 1070 bp, Homo sapiens
agcaaacggcacaccaggagattatatcccgcacatggctcagagggtcccacacccacggagcctcactcactgctagcacagcagtctaagatcgaactgcaaggcagcagcgaggctgggggaggcggttcgccattgctgaggcttgagtaggtaggtaaacaaagcatccaggaagctcgaactgggcccaccacagctcaaggaggcctgcctgcctctgtggactccacctctaggggcagggcatagctgaacaaaaggcagcagaaacttctgcagacttaaatgtccctgtctgacagctctgaagagagtagtggttctcccagcatggagtttgacatctgagaatggacagactgcctcctcaagtgggtccctgagccccgagtagcttaactgggagacacttcccagtaggggctgactgacacctcgtacagccagttgcccctctgagatgaagcttccagaggaaggatcaggcagcaacatctgctgttctgcaatatttgctgttctgcagcctccgctggtgatacccaggcaaacaaggtctggagtagacctccagcaaactccaacagacctgcagctgagggtcctgactgttagaaggaaaactaacaaacagaaaggatatccacaccaaaaccctgtctacaaatggctaactagaataaacagtgtggagaagtccttaaatggcctgatggagctgaaaaccacggcacgagaactatgtgacacatgcatgagcttcagtagccgatttgatcaagtggaagaaacggtaccagtgattgaagatcaaatgaatgaaatgaagaaatacagagaacaccacaaagatactcctcaagaggagcaactgcaacacacataattgtcagattcaccagttgaaatgaaggaaaaaatgttaagggcagccagagagaaacctcaggctgcccacaaagggaagcccatcagactaacaacagatctcttggcagaagagagtgggggccaatattcaacattcttaaagtaaagaattttcaacccagaatttcatattc

SEQ ID NO: 473503 - DNA, 783 bp, Homo sapiens
tcaaaccataagaagaggggcaagcactccacttccagcagctcctcagccctgccagtccccccgtgcgtgcatcctccagaggaccctcgggaaggactcacaccggctggaagtcagatcatgcatcacagcccagagctgcttcagttcttggctctcctctcctcacctgtgaagagccagctgaccagcggcctctcacagctgcagaatcctataatttagagagccctttggcatctatcgagaggataaatccacacatctggttatatgcatgtcctgctggtactctggcatagtcttccctggtcccagtgggagccttctgtgttcaccagggcccctccacactccctgttcccagcaccatgagcctgtgggaatctctgctcagatattcatctccgtgctgctcctttcatcttggaccctcagtgccttgttgcaagaacatacagcttggaagaagaacttttaccagcttggtctgaaagagactgatacaactcaaaatggaaagtattatcagaggcctcagcagtctctgggaaggaggcagcctgagaatgctaagaactacaagtgggaccactccccatggacaggaagactcagaagacagagccaatgccatggagaaccattcccagaggcaggactgcagagttgcggccacatcaattacaggatcgaagtggaccagtgatgtccatataacttcagtctcccaccttttctcctacaagtttgtctgctgtaatgaatgcatctctgcct

SEQ ID NO: 473504 - DNA, 826 bp, Homo sapiens
tccaacatcaaggtggaactgatttggtgtctgagctcctctgtgtggtttaacacaagtgcttccatacaagtgcaatgcctaaagcagtgacccagcatggctccgtgtccacagcagtgacccagcatggctccgtgtccacagcagtgacccagcatggctccgtgtccacagcagtgacccagcatggctccgtgtccacagcagtgacccagcatggctccttgtccacagcagtgacccagcaaggctccgtgtccacagcagtgacccagcatggctccgtgtccacagcagtgacccagcatggctccgtgtccacagcagtgacccagcatggctccgtgtccacagcagtgacccagcatggctccgtgtccacagcagtgacccagcatggctctgtgtccacagcagtgacccagcaaggctccgtggccacagcagtgactcagcatggctccatgtctatagcagtgactcagcatggctccatgtccacagcagtgacccagcatggctgctccactcagaacagtcatcttggccaactgcacaaaggcctcctgaaaccttctcctgacctcatacagtgcgcagtcgctgaagaccattttctcatgtttgcaagaatgaggggcatgagactggctgggacacccactgtcaggctcggtccaactcagccaggctccagagtgctccagggctcagctcttcctaggagccgcaaaagttcgatttaaagtaatcttctttgccattatcttctttttcttctggagagcatgcaatttttaatctttattgctgaccaggacaa

SEQ ID NO: 473505 - DNA, 760 bp, Homo sapiens
gagggctgtgctgttactatgaaagctaagtcaggggaattcatccaaggtgttttggaatatttgggtcatttgaaacctgcaggttatcaggatgtacccagccctccacacggcaggtgtctccctggagggtccagatggctgagcctccactgtgtgccctgctgggacatgccgagctcccaagagatggggcaagggagagcaggcacccccggcttgggagccctgcaggaacaggcatcggactgtgctggctctgccatccccttcctgcaaggctggcaggctgcagggattccgcctcgctggctgcctcaagatgctgcctgctgggcttctgaccccaatgtcctgggacctcctcaagccctgtggtctgtggcccttaggtggccctgctccaattctgcttcccaggctctgactgctggggtggggagagtcatccagggtggcttggatttggagagccttcacccagagtgctctgctccaggcaagctgggcattcacagactagactcggggaggatgccaggagagaggaggccaggctgggcattcacctgctgcatcacgcccaccaaggggattggggatggcaacctggcagaggatcctgtcctcagccacaggttcctgtgagagggaactgtatggaattggggtggcatacctggggctctgggtgacctttaccttgcagctgcccagcaacaaggctgcccaaggagcatggaaacgctgcaggcct

SEQ ID NO: 473506 - DNA, 1432 bp, Homo sapiens
gggaaggggatgggcagagtgaccagaaagtgataatgatggtgatggtggtggtggcgatggtggtggtagtggtgacagtggtggtcatggtgatggtggtcatggtggtagtgacagtaatggtgatggtggtggtagtaatgatgatggtggtggtgatggtagtgatagtgataatgatggtgatggtgatggtgatagtgatgatggtgatggtggtgatagtggtaatggtggtgataatgatgatgctggtgacagtggtgatggtggtagttttggtgatgttgattatgatagtcatggtggtggtagtgatggtggtggtggtggtagtgatggtggtggtgatagtggtggtggtagtgatggtggtggtggtgatagtgatggtggtggtggtagtgatggtggtggtgatagtcgtggtggtagcgatggtggtggtggtaaggatggtggtgatggtggcagtgggtgacggtggtgatggtggtggtagtagtgatgatggtgatggtggtgatagtgatgatgatggtggcaatggtggtgatatgatggtggtgatggtagtgatggtggtggtggtggtagtgatagtgatgatggtgatagtggtcacagtcgtggtggtggtagggatggtggcggtggcaatggtggtagtggtgacagtggtggtcatggtggcagtgatagtaatggtaatggtggtggtagtagggatggtgatggtggtgatagtgatgatggtggtgatagtggttttggtgatggtggtgatgacagtgatggtggtgatagtaatagtggtggtggtgataatagtgatggtggcaatgatggtggtggtggtggtgatagtgatggtggtgattgtggtggtggtggtggtagtgatggtggtggtggtagggatggtggtgatggtggcgctgggtgatggtggtgatggtggtggtcatggtgatggtggtggtcatggtgatggtggtcatggtggcagtgacagggatggtgatgtggtggcagtgatgatggtggtggtgatagtggtggtgatgatgatagtgatggtgatggtaatggtgatggtggtggtggtggtggtagtgttcattactgtagttaagactgtgttgcagattgttgaagctgttgaaagcctaaccttagagtataaagaccttcattttggtgggggaaaaaggatctttacatccacctctcctctgtaagtgggcctgtatgtaaaactttccaggacaagtgagaaatggtggcactcttttaaaacctctgtgagatgattagcaattagcttttgtggtctaacctttaaaccctccctctacagtgaagaaacaaagcccttgaatgtgtatatgctcttagggctccatgtgaccaagatgaataatgatgt

SEQ ID NO: 473507 - DNA, 692 bp, Homo sapiens
ccagcactgggcaccatctgggtggaaagagatggaatgcaagctgccagcagtgggcaggagctgggcagcagggcctggtgatggcagtgctggggtgtctgagaccagccctgcaaccctgctccatagtgcctgcacggctttcctggtgcaggtgcctgcagcagctgctgcactgtgggtccccttgcccctgggctcctgcagttccacatctatgatgaccctgtttctgtatggcgtctttggactcttcctggatcctgttcttctctcaggaaagctggccctgggttgggctttgctgctctgtcccctcttcctgcattcagagcacaaagcctctgcactcgtgggggctgcagactgggagctgctcctcggccctagacagaatgtttcttcaatccctttcctggtacccacagcccggctggatatagacaaggctcgatgttagaagtcagtgagcttgcctgactgctggactgcaggctgctctcagacgcagaaacactgccccttgtatttcccttggctgtcttttaaatcacatctcgtatataaagttttcataaatgtagctctattttctaatgtgtagctatggtcctctctttggagacagacctgcacgctcttgttatccccttccatggtgtgatattcccaatagaaccagagtgaac

SEQ ID NO: 473508 - DNA, 568 bp, Homo sapiens
tgcctctgtctaacctgaccatgacacctaattcaacacgagcccttcagctaaagtttttctcaccaactgctgatagcttctttgcatacgccggctccttcatcccccaggcacagtgctcccctcctcctcagagccaggaccattcagggggtgttcaggaaggcacaggggcctgcactcaaggctcaggaggcctcctccaggaagctgccctgaaacatcttcctttaggcttggctgggggctccttccacagccacagggccccagccttctgtggtcccagccctggttttcctctggatggcggtgggagcctcagtttcctcatctgtaaagtgggtctggtgctgacagaacggtcgagagtgttacagcaggtgttggcaatacgctcctgcactcaatgggtctctagctctgcctctcaagccctgggtcagtgaggtttcttctccctccagctccattccgaggctgaatgtccccacccacacgtgctgatgaagcccgtcttaactgtgcatttgctcagaaatgcagccccacagtgggggctggc

SEQ ID NO: 473509 - DNA, 4643 bp, Homo sapiens
agatgcacacgggagccaactccaccgtatttgatacattgaatatgcacgtccttaaatatgcacatctctttgtaaaagatgtagtggtgtttggtagatatacatatgccataaattatgggaaagctctaaataaatgtaatgaaacaatcttctgcagagagaaacacaaaatcaaaaccaagaaaactgaagctaaaacggagttgaggctctaccttgggcacagtgcactgaaagtactgcagcctgatagcaactcttccaactcgggaggtgatggttccacaccaggagaggaccccaggataccgccccccaccctgccaagcattcagttactggaatggggaacattattgaaaggaagcattatgcaaataaccaataagtacatgaaaagatgcttgacatcattagtcatcaggaaattgcaaatacagatcacaatgaaatactactgcacacccaccaggatggccataataacatagtcagataataacaggtgttggcagggatgcgaagaaatttgaagcctcatacactgctaatgggaatttaaaatgatgcagacactttgaaatacagtgtggaagttccttaaacaattaaatgcagatttaccatatgacccagcaatcctactcctaggcatatacccaggagaaatgaaaacatatgtccacacaaaaacttgtatgtgaacgttcatagcaacattgttcataatagacaaaaggtgggaaaaacccaaatacccatcaattgacaaacgaagtgtggtatagccataccattccataaaaagcaatgtagtactgatacgtgctacatcatggatgaaacttgaaaacatgctaagtgaaaaaaacaggcacaaaagaccacatattatataattgcatttaaatgaaatgcccagaatagggaaatctatagagacagaaagtagactagagattgcttaggactgggggaggcatatggagagataggaagatgagctaaaagttctttctggggtgatgaaaatgttttaaaatcggctgcagtgatagttatgctaaaaaccgttaacttgcagactaaatagttaaactttatagtatgtgagttatatcttaataaagctgctttcagaagtcttaagctgtttccatgagtagacatatagaacagtctcatttttatgatgacttcatagcattccacagcacagatgtgccatgattttgtcttaaccactaccctaatgacggatactcatgctgtttctgattttgcactattactgacaatgaagtaaagaacgccttggcagtacttccttgtgttcatatgtagacatttagtgggctgttttcctagatcttttagcccacagaagactagagttattgctaaagattttaaaagttaaataaataattgtcttctgagagcaacatgacagggttttgtctgctacggcaatcctggctcaagccttctatttttgaatattttgaaatattatacttactggttgagcatccctagcctgaaaatttgaaatcaaaaattcttcaatgagcatttcctttgagcatcatggcagcattccaaaagttctggatttttttagagcattttggatttcagactcttgggtgaggaatgcttgccctgtctatgacccttataacaatatactgtgttttctctcctgcatttgtgctagtgtctcacagtttacctgtccatattttacaaatccccaatgcactgttattttgttttaaaaagttgattctctcttttaaataacatttctattgcttttcattcctttgtgtagacacatttccatctggtgtcactttccatctgcctaaaggaccttccttcacatttcttgtaatgcaggtctgaggctcatcagttctttccgtttttgtgtgttagggggaggaaggtctttatttcattaagtgaaagatattttctctaggtaaatgttttctttcagcactttaaagatgttgttctgttgtcttctcattgcattgtttttaatgagaaatttgctgtcatccttatatctgttcctttgtacctaatgtttcttgtgtatctgactacttttaagattttcccttatcactggatttgagcaacttgattatgatgtgtcttggtgctattttctttatatttcttatgcttcgggtttgttgagcttctcgagtctatgggatataatttttaacaaatttggaaaattcgaagaaaaccgtattccttaaaatatgttttctgtctccctctccttctacaactataattactcatgtatttggatattcaactgcttaaagttaacccacagctcactactatttttttagtcttcttgtttctctatttttcatttctctgttttgtatttcttgatagtttctttccttgtctttaacttctctaatcattttctctgaattgtctaaaccatcctaagtatttttgtctcacgcattgtggctttcatcttgagaagtttgttttggatcttttctaaatcttccttgtatctagttaacatgatcaacctcttcctctattatactaaatatatgaaacattcctataatacttgctttgatgtccttgtctaccagttctattatatcatttgtcatttccggatcactgttggttgattgatattcatacccattgtgggtcattttttcttcttcacatgctagtaacttttgattgagtgccgtgcattgtgaattttactttgtcagatgctgtatattttatattcctgtaaatagctttgaactttgttttgagtttgatctttttgatcttgcttttatgctttgctaagtgggatcagagcagcatttagcctacggctaatttaatccttcactgaaggaaaacccttctaagtactctaaccagagcccactgaatttgttttctactctggctggggagaacaggcactattcccagccctgtttgatctatggagaatgctccttctaacgttatgtgtagctctttctctttcccatcctctgaccagtatagctgagtggtcggggaggatcctctgcagacctccacagctctcactgtgtacccttctctcctgtgaattccagctgccttggacttcctaacttcatctctggtttttcatcttagtgagtataccgagctttgcctggcctcttccttttaccacctgtgtcgtgcactgggcccagcgcaaggctccactcacctgcttccctgttctcatggatcattcccccttcattgcctggtacccaatagctggacaactgttatttcaataatgtgtcccatatttttacatttatcaaacaggaggtaaatctggtccttattactctatcttttccagaagtagaagctatagaaatgtttgtgtcatccgagagtcacacagatgaatgctggccatgccattcataccctttctccaggaggtgatgctctgtcagctggcaagagtctggcttgacaggcaacctcagccctgatgtgcaggtgaggacctcagctctccgacttcatgtcattaaacaccaagtcagtcacaccctttggaagtcatctgtaactcaattgcaaggagggaatccacaactcagatagcggtgagtgtctggtaattgcgttccccatggggcaccagttaaattggcaagtctgtgatgccaggctctcctgtgagctttgtgagcccaactcaaccttgggaatgtaaggatgtaggctttctgagtccccaggctctgggtagattatcaaggtgagagcagctgtcagaaactggcccaactgctgttcctcatgtgacacccaaaacacactgcatgtcatcatgcctaacattctgcaagctgctgcatataatagggttacccaaacagttggaccttgtatctctaaagatccaaaaacttcatgttaaccgttttgatggagtttatgctaatgtgtctattttaaatattttaacaataacaggcagaaataaatgagcaactaaagtcacacactattgtcagcacagtaaagagaacataacataacccctgcatggtcatgcatcaggatcgcaagcaccccttctgtgagagggtgttagctctgaggacctgggagggtgacagcaattggaagatgtcagttccttcccatttctatgaacactaatgagctgtgtggcatacagccaagtctgtggccctctctgtctccacttcctcatctgaaacgatggcagtagaactttcccttcctgggttgtcaaagtccacggagaagcataaaccatgattcacatgtgaggaagtacgcaggtttcaaaggccctggtctttgtataacagcatgctgttcaggccacactcaacagaaccagtcatcagtttccaccacatcagataaaacacttcccacctgaggcctttgcctctgacagggtgttttcttaggagagacattctgttaaatgataaagcagattgcttagaggggcagtctgcaaaggctcttgtttttctagagaagttatccttaaagggacaatctgggatttcagaaaa

SEQ ID NO: 473510 - DNA, 485 bp, Homo sapiens
ttttattttaggttcaggggtacctgtgcaggttccttacatgggtaaattgcatgtctctggggtttggtgtacagatgatttcctcatgcaggtgctggcagtcctgctgtattcgttaaacagcctgtggccctcccttactgcaggcctcatccttctaacattgagcccaacttttgtcacagtgttgggagaaaagcttgggatgaccgactgcgggggcgagtggcggtggccagctgaggtcggccctgaaggtgctcctaacacagcctgcgagctgcccacggggacggacagacgcgtgtgcctgcctcatgctggtgttggagattttgctatccctgggtcctgggatcaatcccttgtggataccaagagacaactgtattaacattttaagaatctggaccttgctcccctcataaaatttctggtaaccacaagtgcctctggcaccttaacttgtttccattatcttc

SEQ ID NO: 473511 - DNA, 544 bp, Homo sapiens
ggctttgcatacaacaaaaacgttcaggaagtactggctggttggctggctctgctcccagaacacacagccatgtgcgtctccatcaaaggaaaggtgcttcagacagctgccatcactcacacgctgagagccaaagacaacgggagacgttgctcttcctggacaccgatgtgcacaggcaccaggaccacggacagcccacacctggctcagcagctcatccccaggggacacacaggaggcccaggcctgctgagcgaagacatgcccctccctcacaacacctaccccaagttgggccttgggataggtgtggggattccggggtccctcatggtgccatatgaaggccaagcaggacatttgagaaacagccccctgggacccaaagcacaaaacatgcatggccttggtgctggacatgccctgctgaccctcgatgggagcatcaggctgctggaaggaggttcttcccagctgcccaggtggcaggccccacccagggcgatcagtctgctctgagcctccagatggggcagcc

SEQ ID NO: 473512 - DNA, 1136 bp, Homo sapiens
cctctctcttttgttaattgcccagtcgcagagagagagagagagaagcggccccgcccggctcgcagcggcagcatggccgcagcgcgggggcagcagcagcaggcggctgcgcgcggatgtcgcagggtttcgcggcagcatgacggactacctgatcaggggcggcaccgactatgtgcccgataactggctccccgcgcagcagctctttgccagcgccgactgcctcacctacgacgacttcctgattctcccaggattcacagacttcatagctgatgaggcggacctgacctcagccctgacccggaagatcacgctgaagactccgctcatttcctcccccacggacactgtgacaggccgacatagccattgcaatggctctgatgggaggtattggtttcattcaccacaactgcaccccagagttccaggccaaggaggtgcggaaggtcaagaagtttgaacagggcttcatcacggacccggtggtgctgaccccctcgcacactgtgggtgatgtgttggaggccaagatgcggcatggcttctctggcatccccatcactgagacgggcaccataggcagcaagctggtgggcatcgtcacctccagagacatcaactttcttgctgaggaggaccacaccaccctcctcagtgttggctccagcaggcctgatctggtggccatgatcacctgcaccgacctgaagaagaacagagactaccctctggcctccaaggattcccacaagcagctactgcgtggggcagctgtgggcacccctgaggatgacaaataccgcctggacttgctcacccaggcgggggtagacgtcgtagtcttggacttgtcccaagggaactcggtgtatcagattgccacggtgcattacatcaaacagaagtacccccacctccaggtgattgggatgacagccgcccaggccaaaaacctgattgacgctgcggtggacgggctgcgcataggtatgggctgcggctccatctgcatcacccaggaagtgatggcctgcggtgggccccagggcactgcattgtacaaggtggccgagtatgccctgtgctttggtgtgtccatcatagccgatggcggcatctagacc

SEQ ID NO: 473513 - DNA, 568 bp, Homo sapiens
actaggaaacttcagctttttgccatgtctaacacatggcaagcaatattcagaggtgcctgtggaagacagagcagccctgcttctggctttgtggagatcaaggaaagccctttcagcgtgtctgagagccagatccagggtgtctcaggcaagctggggagcaccttggagaagtttgttattaccaaccttctgaagcctacttctgtcaactcgtcaaagccattctccatccagctttgttccattgctggcgaggagctgcgatcctttggagaagaggttcttagaggaggagcagccaacctccactggtcttgggtgacaagaaaagcccttggcacaacccgctggggggtcccgggaggccctggttctagtgtcagtaccgtggagtcccctcaccttgtccctcctcagccagcagaggcccaggccaggcaaatggaggaagtggctggggcccttcttcaccccagaacccaaaagttagtcagggctcaacccagaggcctgtgacagtgtcaataaagtttagctttatttaataatattagcaaatttg

SEQ ID NO: 473514 - DNA, 2189 bp, Homo sapiens
ttttgtcacagggcttcaggactacaatcccagcatgcaccgtgctcaaggagagcgcgcctcagtggacgaagaagtggacctgtgctcttctcgctatgctttttcggagatgtattctcacacactcgcagccctttggtcactgggctgccctttggtcacagggctgcagcactacaatcctagcatgcatgggactgagggagcatgcgctaatcagtggaggaaggagcgaggctctgcacgcctctctgggcttggtggaagatgcagtctcataaacactcacagcccttttgtcacagggctgcagcgctacaatcctagcatgcaccgggctcagggaaaacctttcatcaccgggctgcaggactacaatcccagcatgcacccagctcagggacagtgcgcattactggaggaaaaggctaggctgtggacccctccttctgcttcctgggagaggtagtttcatagagactccagaactttcatcacagggatgcaggactaccatcccactgcacccagggttccttccagagcattgcaccttctgcagctcagggcactgccttttttcctaaactactgtggaaactgtcctgatgtctgagacactgtccattgtgcagcagccctcttttttctctagccagagcgcgtgctcaatggcttttgagagaaatcttccacatggcctgcttgtgaacagcttcagagctctgcaggggctgacaagggctgagccttcctggaaacgtcactctcaatggcgcctttttcacgaatgtgaaagtcgaggcatcaggaagttagtttaatgggttgcagaaaatctaagagcaagggagaaaacccgctttccaaggcgtgagttttgtgagccattttcatcaacccatttaagtggacaagctccaaaatgtaacctgaagctgctgactatttaggcattttacaattaaaatcatcggtctcatcccaagtcgtgcctcacttgccagtgtctcagagacacaaatgggacctgatccctcaggaacagatagtgttccaggttcgtgggagcgacttttaagttgtggagcacttggggtcgtttgaaacccactatcttcagtagggacttttacgtctagagagcatgtgcattttgattttatctgtcttcaagctgaacctttgctcattttaacaagtaaaaacacattcctgggtgaaatgtcattgcatgctaataagacatgaaacatatgcaaaaatatgtacagctactgcacatgtgcacccagaagaccactcaaagcatgccttctataacacttctttccaccttcttatgaataatcatgtaaaactcccagaaggagggtttctccagcaacaattaatgctgtctcactcttatgagcaggctgccctggaatctctttctcagactgtaccgtctattctgcacttgattttcaacgtattcttttcttttttgtgtgcaataaattactctatgctgtacttcttttgctgcatgtttcctgtttaaattcttttaagctaagaagataagaaccaaggtattacatcagccatcaacatttcttttgccatggcccggagagaggtttgtctgcttcattaatttcagtttcccttttcttgcagtgaatactatggcacttccagactacctggttaactatcgctggttgttccagcgctgtttcactaaagttctgggggaaacgtgtttaaatcacctatattctctagagagagaatatatgtctgctctccttttggctgctgcatctgtactatccataaatgacactcaccgcatgggttgctctcaacatttcatattcgggctagtttgctgcttagtttcacatctttctggccacacttcagactcagcttatcgtttgctgtcccttcggcaatactcgatcgccacctagtggctattgtactttattttctgatcgggttttctgtttacagttttgtcttgttttgttttgagtggaatattaagagaaccctgtcccttcaggctttatgcatttcccacctccttgaaattgttcttcaacaggttttctttgctgaacaaacgactcaaagtcatgtagatgcccggtcgtggggtttgaatctgagcattgcaggtgttataattc

SEQ ID NO: 473515 - DNA, 9638 bp, Homo sapiens
cattcagacgctagaagcagtgttccggagtcctatgtaggaacaaacactcagaacccagcagcactgttctggaacgctatgtgagggacaaagattcagaccacagcaggattatactggagtcctatgtgagggacaaacactcagaacagagcaggagtgttttggaatcctatgtgtcagacaaacattcagacactcatagcagtgttctggaatccaatgcaagagacaaactttcagaccacagcagcagtgttgtggaatcctctgtgaggaacaaactttcagaatatcgtagcagtgttctggaatcctatgtgagggacaaacattgagatcccagcagcagtgtgctggaatcctatgtgaaggacaaacattcaaacaacagcgagagtgttctggaatcctaacaagtagacaaacatttagacaccagcagcagtgttctggaatcctatgtgaggaaaaacatattcagaccctcgtagggttattctggaatcctatatgaggaacatatattcagaccctcataggattattctggaatcctatgtgattcagacaccaggagcagtgttctggaatcctatgtgtgagacaaacattcaaacaacagtgtgagtgttcacgaatcctatgtgacggacaaacattcagaccttcctcgcagtgtttggaattctatgtgagggagaaacactcagaacccagcaggagtgctctggaatcctatctgacggacatacatgtagaccccagcagcagtgtcctcgaatctcatgtgagggagaaacattcagaccccaggagcagtgttctggaatcctatgtgaggacaatgattcaggacctcgtagcagtgttctggtattctgtgtgaggtacaaactttcagactctcttaccactgttctgcaatcatgtgtgagagaaaaacattcagacccacagcaggagtgttctggaatcacctgtgaggaacaaacattcagatcctcctagcactgttctggaatcctgtgtgacggacaaacatttagacgccagcagcagtgttctggaatcctaattgcgggacaatcattcagacccttgtagcagtgttatggaatcctttgtgagggacagacatttagaacccagcgacagcattctggaacactatgtgagtgagaaacattcagaccacagcaggattgctctggaatcctacgtgagggactaatattcagaccttcgtagcagtgttctggaatcctaagtgagggacaaacattcagacaaccgtagcagtgttccggaatcctatgtgagggacattcattcagacgttcgtagctgcgttgtggaattctgtgtaagagccatatattgagatcctcaaagccgtgttctggaatcctacgtgagggacaaacattcagaccacaggaggattgttctggaatcctctgtgaggaaaaaacattcagaccctcgtagcagtgttctggaatcctatgtgagggacgaacctttagaccccagcagcagtgctcttgaatcctacgtgaggaaaaaacattcagacactcgtagctttgttctcgaatcacatgtgagggacaaacattcagataatcttagccatgttctggaatcctatgtgagggacaaatattcagaccccagcagcgttctggaatcctatgtgaggaacaaacattcaaacaacagcgggagtgttgtcgaatcctatgtaacagacagactttcagaacctcgtcgcagtgttctggaattctgtgttagagagaaacactcagaaaccaacaggagtgttctggaatcctatgtgatggacatacatgtagacgccagcagcagtgttcttgaatcatatgtgaagacaaacattcagatctcaaaagcagtgttctggaatcctctgtgagggtcaatcattcagacccttgtagcagtgttctggagatgtttgtgagggaggaagcttcagacccccatagcagcgttctggaagcctatatgaaggacaaacattcggactagagcaggattgttctggaatccaatgggaggaacaaatatccggaccctcgtagcatagttctggaatcctatgtgacggaccaacatttagagcccagcagcagtgctctggaacctcaagtgagggacaaacattcagacactcagtgcagtgttctataatcctatatgagggacaaacattgaaacaatcgtagtagtgttcaggaacctatgtgacggacaaacatacagaccccagcagcagtgttttcgaatcctatgtgggggacaaacattcaaacaacagcaagagtgttctggaatcctctgttacagagaaacattcagatcctcgtcgcagtgttctggaattctaactgagggagaaacactctgaacccagcagcagtgttctggaaccttatgtgacagacatacatgtagaccccagcagcagtgttctggaatcctatgtgagggacaaatattcagacagcagccgtagtattctggaatcctatgtgaaggatagtcattcagaccctcatagcagtgttctggaattctctgtgtgggacaaacattcagaccctcatagcagtgttctggaatccccggtgaggaacaaacattcagagcctcatatcagtgttctggaatcctatgtgacggacaaacattaagtccccagaagcagttttctggaatactgtgtgaggaacaaacattcagaccctggtagtagtgttctggaatcctatgtgagagacaaacactcagaacccaacagcagtgttttggaaccctatgtgagggtcaatcattcaggccacagcaggattatgctggagtcctatgtgagggacactcagaacatagcaggagtgttttggaatcctatgtgagggaaaaactttcagacactcgtagcagtgttctggaatcctatgtgggagacaaacattcatacaatcttagcagtgtacgggaattctttgcgagggacaaacattcagaccccagcagcagtgttccagaatcctatgtgagctataaacattgatacaacagtgggagtgttctggaatcctatgttatggacaaacattcagaccctcgtcacagtgttctggaattctatgtgagggagaaacactcagaacccagcaacagtgtactggaatcctatgtgacggacatacatgtagacccgagcagcagtgttctggaatactatgtgagggacaaacattcataacacggcaggagtgccctggaatcctatgtgagggaaaacattcagacaatcgtagcagtgttttggaatcttatgtgagggactaactttcagaccccatcagcagtgttctggaatcctatatgagggacaaacattcaaactacagaggctgtgttctggaatcctaagttatggacaaaaattcagatcctctccgcagtgctctggaattctatttgagggagaaacaatcagaacccagcagcagtgttctcgaatcctacatgagggacatacattcagaccacagcagcagtgttctagaaccctatgtgagggacaagcattcagaccacaatcgtagcagtgttctggaatcctatgtgaggggcaaacatacagacacttgtagcagtgttctggaatcctattatgtgagggacaaacattcggatcctcttagcagtgttctggaatcctatgtgacggacatacatgtagaacccagcagcagtgttctgaaggcctatgtgagggacaaacattcagaccccaggaacagtcttcgggaatcgtatgtgagggtaaatcattcagaacgtcgtagcagtgttctggaattctgtgtgagggacaaacattcagaccacagcagcagtattctggaatcctatgtgagggaaaaacattcaaacaactgcaggtgtgttctggaatcctatgtgagggaaaaacattcaaacaactgcaggtgtgttctggaatcctatgacaaggaaaaacattcagaccctcctcgcagtgttcttgaattctatgtgagggagaaacactccgattcctgtagcagtgttctggaaccctatgtgacagacctacttgtagactccagcagcagtgttctggaaccctatgtgagggacaatcattccgaccctcgtggcagtgttctggaattttgtgtgagggataaacattcagaccccagcgcgagtgttctggaatcccaccagtattctggaatcctatgtgggggcaaacattcaatcatagcagtgttcaggaatcctattgttctggaattccctgtgagggacaaaaactcggaacccagcggcagtgttctggaattccctgtgagggacaaaaactcggaacccagcggcagtgttctggaatcctatgtgagggacaaacattcagactccagcagcagtgttctggaatcccatgtgagggacaatcattcagaccatcatagccgtgttttggaattctgtgtgaggggcaaacattcagaccgtcgtaacagtgttctgcaatcctgtgtgagggaaaaacattccgaccacagcaagagtgttctggaatcccctgtgaggaacaaacattccgaccctcatagcagtgtactggaatcttatctgatggacaaatatttagaacccagcagcagtgttctggaatcctatgtgaaccctgatagcagtgttctggaatcctatgtgagggacaaacattcagaccacagcaggactgttttggaattccctttgagaaacaaacttttagaccctcatagctgtgttctgcaatcctgtgtgtgggacaaaatttcaaaacctcgtagcagtgttctggaatcctatgtgaggtacaaacattcagacaatcgtagcagtgttctggaatcccatgtgagggacaaacatgcagaccctcgtaagagtgttctggaatcctatgtgagagacaaacattcagacaatcgtagcagtgttctggaatccaatgttagtgacaaagtttcagaccccagcagcagtgttctggaatcctatttgagggacaaccattcagacactttcagcagtgttccagaatcctgtgtcagggacaaacattttgaccactgcaggactcttctggaatcccttgtggggaacaaacattcagaccctcgtagcagcagtattatagaatctcatgtgagggacaatatttcagaacgtcatagcagtgttctggaatattatatgagtgaaaaatattcaaacatcctcgggagtgttctggaatcttatgtcacggacaagcattcagaccctcgtcgcagtgttctggaattctatgtgagggagaaacactcagaacccagcagcagtgttctggaatcctatgtgaaggacatacatgtagaccatagcagcagtgctctggaatcctttgtgacagacaaacattcagaccccagcagcagtgttctggaatcctgtgtgagggacaaacattcagaccccagctgcagtgttctggtatcctatgtgatggacagtcataaagaccctcgtagcagtgttctggaattctttgtgagggacaaacattcagacattcatagcagtgatgtggaatcccatgtgagtgacaaacattcagaccacagcagaagtgttctggaatcccctgtgaggaacaaacattcagactctcgtagtagtgttctggaatcctatttgaaggacaaacatttaggccccagcagcagggtccttgaatcctatgtgagggacaaatattcagaccctgacaatcgtagcagtgttctggaatcctatgtgaggggcaaacattcaaacaacagcgggagtgctcttgaatcatatgttatggacaaacactcagaccctcgtagcagtgttctggaatcctatgagagggacaaacattcagaccctccagaccctcatagcagtgttctggaatcctacatgagcgacaaacacactgaaaccagcagcagtgttctggaaccctatgtgagggataaacattcagaccatgccaggattgttctggaaacctatgtgagggaccaacactccgaacccagcagaaaggttttgaaatcctgtgtgagggacaaacgtttagactctcgtagcagtgttctggaatcatatgtgagggacaaatatacagaccatagcaggagtgttctggaatcctatgtgagggacaaacattcagaccctcatagcagtgatctggaattctatgtgagggacaaacattcagacattggtagcattgttctggaatccaatgtgagggacaaacattctgaccctcatagcagtgtaccagaatcctgtgttaggaacgaacattcagaccacagcattagtgttctggaatcccctgtgaggaacaaacatacagaccctcgtagtagtgttctggaatcctatgtgacggccaaatatttataccccaggagcagtgttctggaatcctcagtgaggaaaaccattcagaatcttgtagcagttttgtggaatcctattgttctggaattctgtgtgagggacaagcattcagaacgtcgtagcagtgttctggaatcctatgtgaaggacaaccattcagaccacaggaagagtgctctggaatccccagtgaggaacaaacattcagacactagtaaaagtgttctggaatcctatgtgacagacaaacattcagaccccagcagcagtgttctggagttttatgtgagggaaaaacgttcagacaatcatagcagaattctggaatcctatgtgagggacaaacattcagacctcagctgctgcgttctggaatcctatgtgagggacaaacattcatacaacagtgggagtgttctggaatcctatgttacaggcaaatattcagaccctcgtccgagtgttctggaattctatgtgagggagaaacattcagaacccaccagcattgttctggaatcctatgtgacggacagacatgcagaccccagcagcattgttctggaatcctatgtgacggtcagacatgtagaccccagcagcattgttctggactcctatgtgagggatgatcattcagaccctcgttgcagtgttttggaattctgtgtgacgcccataaatctacaccccagcagcagtgtggtggaatcctatatgatggacaaacatccagaacccagcagcagtgttctggaatcctatgtgaggtacaaacattcagaccccagcagcagtgttctggaatcctatgagagggacaatcattcagacccttgtagcagtattgtggaattctgtgtgagggataaacatccagaaactcatagcagtgttctggaatgctctgtgagcagtgttctggaatcctatgtgacagacaaacatttagatggcagcagcagtgttctggaatcctatgtgaggtacaaacattcagaacactgcagaagtgttctggaatctcctgtgaggaagaaacttttagaccctcataaaagtggtctggattccgatgtgatggacaaacatttagaccccagcagcagtgttctggaatcctatgtgagagacaaacattcagaacctcgtagcagtgttctggaatcctatgtgagggacaaaccctcagaactcagcaactgtattctggaatcctatggagagacaaacattgagaccacagcaagattccgtgttctggaatcctatgtgagaggcaaacattcatacactcatagcagtgttctgcaatcctatgtgagggacaaatattcagatcatcctagcagtgttctggaatcctatgtgagggacaaatattcagatcatcctagcagtgttctggaatactatgtgagggacaaaaatgcagacagtcgtagcagtgttctggaatcctatgtgagggacaaaaatgcagacaatcacaatcgtagagtgttctggaatcctatgggagggataaacattcaaaaaacagcgagagcgtctgacatcctacgtttcggacaaacatgcataccctcgtcgcagtgttctggaatttatgtgagggagagacacacagaacccagcagcagtgttctggattcctatgtgacggacatacatgtagaccccagcagcagcgttctggaatcctatgtgagggaaaaacattcaggcaccagcagcagagttctggaatcctatatgaaggacaatcattcagaccctcgtaacagtgttctggaattctgtgtgagggacaaacattcagaccacagcaggactattctggaatccccagtgaggaagaaacattcagaccctcgtagcactgttcttgaatcctgtgtgatggacaaacatttagaccccagcagcggtgttctggaatcctatgtgtgggaccgtcattcagaacctcgtagcgtgttctggaatctggtggacaaacattcagacaatcataggagtgttctggaatccgatgtgagggacaaacattcagactcttgtatcagtgttctgaaatcctacgtgaaagacaaacattcaaacaatcgcagcagtgttctggaatcctatgtgagggacaaatattcagaccctcgtagcagtgtactggaatcctatgtgagggacaaactttcagaccagagcagcaaccctcatagctgtgttctggaatccaatgtgacggacaaagatttagaccccagcagcagtgttctggaatcctatgtgatggacagacattcagacaatcgtagcagtgttctggaatcctatgtgagggacaaacattcagaacccagcagcagtgttctggaatcctatgtgaggaacaaacattcaaacaaacaacagcgggattttccggaattctatgtgacggagaaagactcagaactccgcagcagtgttctggtattctatgcgatggacatacatgcagacctcagcagcagtgttctggactcgtatgtgagggacaaacattcagaccccagcagcagtcttctgaaatcctacatgagagacaatcattcagtccctcgttgcattgttctggaattctgtgtgagggaaaaactttcagacaatcatggcagtgttccagaatcctacgtgagggtcaaactttcagaacacagaagtagtgatctggaatcccctgtgaggaataaacattcagaaccctgtagcagtaacctggaatccgatgtgacggacaaacctttagaccccagcagcattgatctggaatcctatttgagggacaatcattcagaccctctcagcagtattctgtcatcctattgttctggaatccgatgtgagggaccaacaatcagacaatcgtagaagtgttctgaaatcctatctgagggacaaacattcagacccttgtagcagtgttctggaatcctatgtgagggagaaacattcagacaaccgtagaactgttctggaatttttctggaattcaatgtgagggacaaactttcagaccacagcaggggtgttgtggaatcccc

SEQ ID NO: 473516 - DNA, 876 bp, Homo sapiens
tggaggagccagaagtgggagatggttttcccctggagttggctgctctgtggcctgggctctcctccaaccaccccagccaaactctgcgttgttgcgctggtctcaggtcttttggccggcgggttctgtccgtgtaccgctctgccggcatgttcccctcgccgtcatctggatgtccagccgcttgtgtcttctgctgatgtgttcctctggacatccagccacttgtgtgtgtgcgtgctaatgctaagatttcagggttttcataggcataggatgggagtgtggtgggccagggtgggcttgggaaatgcaacatttgggcatgaaggcaggagtgcctgtcctcacctaggtctgtgggtccatggaaaactctcttccccgaagccagtccctggtgtcaaaaaggttggggactgctgctctagacaatgaattaacattaagtgattattaagagcaataaaagtcaccagttatttagtactacagtaatactgtgtaataatactatataacacaataactgccataattactatataataatgttatataatataataataatattaaatgaattacccccaaaataagtggcttaaaacattccttagtacgaaagtagcaataggctgcatcccttatatttactaatttggtagcggtcattttattttatttacttagtatttgtcaaatgccttctagtcctttagttatttttccttttaatggatgacccttctgatctaaaggtgatgggtaagaaaattgaaactgtgaagtctggttgaatgaatttacctgactaaataaatctgtatccactcattttgataaatgtattcacaacatcaataaaaactc

SEQ ID NO: 473517 - DNA, 527 bp, Homo sapiens
acttatctctatgtttttgtcatttgtactttttgtgttacatctaagaatgcattgcccaatccaagcctccgaggtagctggttccacaggcacatgccaccatgcctggttaatttttgtatgttttgtagagacagggtttcgccatgttgcccaggctggtctcaaattcctgggctcagaggaaaagcaaagtttctctggtatctttgtgaggagttgttttactacctggggcaaggaactcacagaagttaggctcctaaccttccagggaaactgggagatagcagtactatcttccttgatgtgtagatttcaaagtgatggccccaagccctggaggaagacattcccaggtcataaaattttcaagaggcttttagatagatttacatctcaaaggaacagcgattacaagtttcctaagctattgagaatgggagtttattcatgatttgactctctgcttacctgttgttggtgtaaagggatgcttgtgaattttgcacattgattttgta

SEQ ID NO: 473518 - DNA, 1051 bp, Homo sapiens
gacaatttacaaaagtactcaactcctactgaattaagtataatgggaaggtttagatctagcagctcgctcggtccccaagcagcctattcctacctggcactacagggatccatcgagagggtggccagaggagcagaagagactacccaaatgagaaggaaccagaaaaccaaccctgttaatatgacaaaacaaggcttttcaacaaccccccaaaatcacactagtttatcagcaatggatccaaaccaagaagaaatccctgatttacctgaaaaagaattcacgaggttagttattaagctaatgagggaggggccagagaaaggtgaaatccaatgcaagaaaattcaagaaatgatacaagaagtgaagggagaaatattcaaggaaatagatagcttaaggaaaaaacaacaaaaaattcagaaaactttggacacacttttagcaatgcgaaatgctctggaaagtctcagcaacagaattgaacaagtagaaaaaagaaattcagagcccgaaggcaaagtcttcaaattaacccaatccaacaaagacaaagaagaaagaataagaaaatatgaacaaatcctccaagaagtctgggattatgttaaacagccaaacttaaaaataattggtgtacctgaggaagaagagaattccaaaagcctggaaaatatatttgggggagtaatcaaggaaaatttcccaggccttgtgaaagacctagacatccaagaagcacaaaaatacctgggaattctttgcaaaaaggtcttctcctaggcacattgtcatcaggttatccaaagttaagatgaaggaaagaatcttaagagctgtgagacagaagcaccaggtaacctataaaggaaaacctatcagattaacagcagatttctcagcacaaaccctacaaactagaagggactggggacctatcttcagcctcctcaaataaaatacttatcagctaataattttgtatccaggaaaactaagcatcaaatatgatgaaacgatacagtcattttcagacaagcaa

SEQ ID NO: 473519 - DNA, 2438 bp, Homo sapiens
cggtgagggaatacgagagcgtcatcgtgatgcacatgcgccatgcggccgagctgcaatggctgatctcagacatgcaccagcaagaccgagaggggcagcccacggctgatgcagagtactcaaggacaaacttggaaggtgttcagactttattggagaaaatgtgggtcagttcactggataccaggaaagttctcaattttggtcagaccacagctgatccgagttccttggcaagtgaaaggccacctgcagggtgtaggggatcaacaactctaagcaagtgtatccaagggattcccggcaattggtggggccggagatctttagagcggacagtctgtgggagctccggtttccagagagtgctgtgcaaagataatcaccagacagaggctgcaatgtcacagagggacaaaggctgggcaggtgactggggcaggctctactagctatcctcaccccagtcctgctgacacccggctcacacaggaagtctctttctactgcactattcctcaagcaccctctactgctcttatcaaaggaaaaattatttaaaatattctgttttagagcatacgttgaaatgtgaattcagagccgagaaataataaactgacaactgacacaaatgattattagggatactttaagttatctttagtcatctgaggagaaaactaagtcatcaatgaactgcatggaagtaaaaaagtcaagcaataaaagcataactgaataaaccgagactgcaacatcattttgatttggtcttctcattcataaagtatggacacttacataaaccttacagataacttatgatcaaattcctgtcttcacaagcaagtggcttagttctaaatgcagacatataattccaagtataatttaaatactagaaattcctcacaaaattgctatactaggttttcacttatgggtagaaatactaactgagattgcatctttctttaggatttataagttcagccaacaagcctaagcagattatattcacatactgataaatttaattatggcagatgagtggttcttaaatttattttgttatttgtcctttgttttgctatgtcttgtgcttccttaactactcttagttcaaaattcatattcgtgatttcaaattcaggcttctcagagttgacatttattgggcttcacctgagctatctgaacatattcagtaaaatcattatgttcccaataaatatgtaataaaagaatttgtctagtctttcttactgtctgttactgaagtagtggtagagggtgtggagggagagctgggtaattccattacattttcattctcccagaacccaataactgacatgagttgcctgctatcctggcccagccagggttcccttcactacctgcaaagcagtctcaccttagacagatttggaccacatagaaaaaaaataataaaattaaacaagaaataggcagggacatataaacaagtaagatatgatgtttctttagctcagagaaatatatagagcaatcaatagaaataatctaggagaagaacataaactcattacactaagcactgatgagaatcagaaacgagcttcattcattggaaagcttccagactcgagtttctaggtgatgacttagtcaaatcaccaatcagatgttcttatgaaactagcaatattttgaactgtgcttgcttgggatgaatgaaagaaaaattgagaagtatccccttatttatttggagaaatgtagacttcgtttgtaaaaatcagcaataaaatttcctaatgtttaataagtactcagaatattatgtcatcgatcacattatataacaaaagtagcaaccaccattttattctccatttctatgagtttgactattttagattccacttgtaatttatcaaagtattgatttagttaaaactttaagacaagcatacatagaaaaaacataaaagtattcactaaaaagtagagtagaatgtaaatcttctaatctattaaaaggtaaaaaagcacaaataaattttcatcaatataataaaagactaaaatgaagatttttttaaagggttggccaataaaaatataactattttaatattcaacacattatacatacttatataaagaaaactacaaaaccattcatggcagtagtgaggttttaatagtaactcacagttctttaaagataaagtaatgtatagcatcatattggacatcattgctgaatgtctgacattgttaaaatagaataaaattttggcatttattattcaatttgttaaaatgtattattatttaaatgattataggcatgtagatgtaattatattattttctatgtttagtatatttaaatattttaaaattttaataagatattatctaccatacctctcaaatac

SEQ ID NO: 473520 - DNA, 1815 bp, Homo sapiens
tccttattccttggcttatgttctcctttatttattttcaaagccagcagtcatgtatctttctgatctttctctccttctctctacagctcccagcgtgagcgacgcagaagatgggtgatttctgcatttccaactgaggtactgggttcatctcactggggcttattggacagtgggtgcaggacagtgggtgcagcccatggagcatgagcggaagtagggcgaggcattgcctcacccgggaagcacaagcagtcgggaattccctttcctaacctagggaagccatgacagactgcatctggaaaattgggtcactctcaccctaacactgcacttttccaacagtcttaacaaatggcacacgacgagattacatcccgtgactggctcagagggtcccacgcccagagggcctcgctcattgctagcacagcagtctcagatccatttgcaaggtggcagcgaggctgggggaggggtgcccatcattgctgaggcttaagtaggtaaacaaggcagcctggaagctcgaactgggtggagcccaccgcagctcaaggaggcctgcctgcctttgtagactccacttctaggggcagggcatagctaaacaaaaggcagcagaaacttctgcagacttaaacgtccctgtcaacagctttgaagagagtagtggtactctcagcacggagtttgagatctgaaaacagacagactgcctcctcaggtgggtccctgacccccgagtagcctaactgggaggcacctctccgtaggggccaactgaaacctcacatagccaggtactcctctgagacaaagcttccagaggaacaatcaggcaggaacatttgctgttctgcaacatttgctgttctgcagcctccgctggtgaaaccgcgggcaaacagtgtctggagtggacctccagcaaactccaacagaccagcagctgaaggtcctgactgttagaaagaaaactaacaaacagaaaatacatccataccaaaatcccatctgtatatcaccatcatcaaagaccaagggtagataaaaccacaaagttggggagaaaccagagcagaaaagctgaaaattctaaaaattagagcacctcttctcctccaaaggaacgcagctccccaccagcaacagaacaaagctggatggagaatgactttgacgagttgagagaagaaggcttcagacgatcggtaaaaacaaacttctccgagctaaagaaggatgttcgaacccatcgcaaagaagctgaaaaccttgaaaaaagattagatgaatggctaactagaatgaacaacatagagaagaccttaaatgacctgatggagctgaaaaccatggcacgagaactatgtgattcatgcacaagcttcagtagccgattggatcaagtggaagaaagggtatcagtgattgaaaatcaaatgaatgaaatgaagcaaaaagagaagtttagagaaaaaagagtaaaaagaaacaaacaaagcctccaagaaatacgggactatgtgaaaagaccaaatttacgtctcattggtatacctgaaagtgacggggagaatggaaccaagatggaaaacactctgaaggatattatccaggagaacttccccaacttaggcaggccaacattcaaattcaggaaatacagagaatgccacaaagatacttctcgagaagagcaactccaagacacataattgtcagattcaccaaagttgaaatgaaggaaaaaatgttaagggcagacagagagaaaagtagggttacccacaaagggaagcccat

SEQ ID NO: 473521 - DNA, 914 bp, Homo sapiens
ctgcaatgtaatggttcacagtcaggatttgggctgtttttagtgtcatgtgcttacaaatatcgcagtgcattgttaaaattcccatgcatgaattagagctaacacgcacgtgctcacaagccatcttttggacagaacaaccaggtcgccggtgggtgcctcgtgctgctgcaccggggactccctgcttaccggccagagtcacgggtcacaggccaggctgtgaagatgaagaagcttcccttctaggaagcaccctcacagccagtcccagagaaaaacctcaggcccaggaagccactctggcgatgtcctggcggacctattacctctatacagagtggaaaccaacaaaatgccagttggacagatggacggacagtggatgccaggatgggtgctgctgaacgggaacggggacaggtcttttttgctggatatcctttggtgacttttgaattctgcactgagtgcttctttctaaaataaatacataaaatgacaaagaggactaatatcctacaagcagaataaaagaccacttttgaaggatctaaaatcagcttagctcctgctttcatttttccagaaataaacattctaagcccagcaagatgccctgactgctgctgctccattcttgtacattacaaagaaatgaggcaaaaattgggcaggaaattgtttgcagtaagaatgacaggacatagttatttcattttataatttattttaattttaaatggacaaataaaaattatatatatttatggtgtacaacatgatgtttgatatattttttaaaaaaacactgtacccaattctgacaaaagtgtggtgttttgaggcagcattaaattgatgcaatatgtatttgaaataggtattgatatatatcaattgtcattgaa

SEQ ID NO: 473522 - DNA, 1967 bp, Homo sapiens
ggaccgcccccgctccgctgcgtcctttgttcccgctcccctctgccttcccgggcgccccgctccggccctgcggcttccggcccgcgcggaccctgccgtgtggacgcgtgtgggctgcgcccgccccgggcgcactccgggccccaacgccaggcacaggcccgcttgtggctgggcacgctcgtgcaaagagctgccccgtgcccgcagccgcctcctgccatgtgggctgtgggcgcagctgacaggctgtgcgtgcaggagagcgagagacgtgctcctgctgctgccgggtgccagcctagcaacggctcccaggggcccagagaggtggtgctggcaggggatggcagctctgatgccaaggccagtgccaaagaggccagcccagtgccacccggagaggggactgagctggctggggccccaggccttacccggcccaccctcccaggccacagaggaggcattgatggcacaagagcaccgcagctggcgcagcatgggcactgctgggtcttggaagggggagtcgggatgagcctgcagcctgagctgctgccaaacaggcccctgaacccaaaggcgagagtgcctatggtcagcctgtgccctgggcatcctggtctccagtgctcctgggcaggcaggggtacctgagtcagtgcccacacacccatctgtgggtgttggcaggaggtcaaggacccccagtccaccctcacccccgctcagacttctgtgacccttccccgctgggcagcacctgggcctctgtgcccggcccaccgtgagggtctggccttgctcctcacccctggactcccagtgagcccctgtactcccacctctccccctgattctctgctcttctgtgccttgagccctttgagtgccccccttttttctcagccaacttatctgaccaaggctttacctccccctcaagcctccaggcaggactgtctcctccatggagcctcctaggattgctccaggccatctaggtcaccaagtatgccctgtgttttgcaggcacctccaggggagctaattctcatgctagattcagcctccccgcatgcaaagctccttaggggatggagctgagacctacattgtcctccctttctccttgtaggcactgaataaatgtcacagtggccggcagaccactctgcccgcttcccagtttccctccaattttcaggcaggttgtccccaaagtcaggctcagggacctggagctgctacctcctccctcgaggagccccccaggccggcagagggcactctaggccccatccctccaggcccagccactggagggaaggacgagactgaccctccccacccaccagcaacccccagtctccttcccagttgctcccataattaggccctgtgcagttcaagagggggtgtctgcactgcctctcctcccccagcttcatcaggccaagggtggggggtctcccctccctcaggggtgtttctggccctcccgagggcaggcagggagctggccaaacctgtggcaggggtggggattctgtccaccatcgtagggccccttgctaggaggcccacccacacgcaggcctgacccaccctgccaggctccgtctcctactccgagtcccctggcaccttgggtgacccaagggaggcccctttgtcctccttcccccacctctgtgtctttctgcccccctcaactggagccccaggatccactaactggcgttgatgaatagcagaggtcagcttgtgccaaaaagcaggcccttggcagcctctaacaaggttgagggagtcagccccttggtcccagccacaaaagccctgaggaacccatccctctcccttccatggcccccagaatgttcacttcctccagtggaggcaggtgctcaatgcgcatgtgctgacgggtgcacggacgcatagctacccttccccac

SEQ ID NO: 473523 - DNA, 865 bp, Homo sapiens
ctcctttttcctgggaagcgccagggggcagtgggaaccgccaccggggccgctgtagcgggccttaaaggatgggaaaccttgatcacagatgccccccgccggccttccttccaccagaccagacttaaaggagaagaaggaagttgtggaagaggcagaaaatggaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgagctgaggtgctcaagctgcggagggactgtttctgactttgtaggtggccactgtgtggtcctgaatcttaagaacaggaaggaaacagggctgggctcaacttcccagaggccttgggctgtggagctgggggtccctggttaaaagattatcaaggaatgggcgccccctggtggacacagaggaactgtaaagcgtgccgctgaattctgtccaggaaagacccttcagtgggccctggtccaagaactcactgggcactgggcagtgcccagggaattctaatatacaaagggtactgagtttccgagaggaaagtttagcatgcagttcgctctcaatttatttgacctggattttttcacagagcgctattaatatattgaaggacattagtgtccagtaaaagctgatcttgcacaaggaccctcaccagggctcgggaaatgtttgctgaactaagcagatgatggagaaggattcctttgagaatttgtt

SEQ ID NO: 473524 - DNA, 566 bp, Homo sapiens
aatcaatgcttacccagaaggaaaaccaatttacattgggatacctctaggtccaagatgactgctgtagcactgcccatcacgcctgcattcctgccagcaagaaagaggaatgaggaagacgtggcaaagagcagacacctgctgtctcttaaagaagattcccagaagctgcagcacacactttcacttacatcccatgggctgagccttggtctaggactatacctagctgtctctattcagtcagccaaaagggaaaggttggtcgtgacttgtcccctcaacaaggaacttcaggcactgccaactgtgttcagtaacccttctctgacaggtgaatacgaatcatcaaaagcaggtatgggaactcacaagcgattgcccatgtcaacaattcctccccaaccagccctacaaccctattgccctgtgcctctacgttctggtttctgctggtgcatgtccaccaagtcctgccatcctttcagcgtgtgaggcgtgtgagtcatttccattcacatcaaggactttattttcccacacagtctctgctgaggcaaagc

SEQ ID NO: 473525 - DNA, 1721 bp, Homo sapiens
cagttcattgtggtggaccaagatggtggttatgatttcaatcagagccggcccccgatccctcttggaccacagccagcttcctccagtgtgtcagatccacctatgggcgctccttcccctgctcctgcatttccagtgtccactcctagatgtctcctttcacttctgctacactgccagtcgacttaacagatctaactgtgtctgtggggtctcagccctgtatttaccagggcttgaaatggaaatactgaaacctagtaatgaagggcactatagaattcctggtccatcggaggccaagtgctcctggcaaaatgctcaggaagtccccttcctaccaggctacagtgcggttttcagttacagacttttgaaaattcagatttcagtagaagttggcagccacacagatgttgaagtgtgaatttgggatgtttgcaggttgtaaatatgtggaattttgatcgtgaatgggaatttaacattacaaccttacatggttggaaagattctgcaatagcaacaatttcacatttgcataaacagctttattatagttggagtaatatatagaaagaacacaaattgctctgaccagagttaaacctataaagcaatcacatttgaatgaggattttacttaaaatcatagactcatcaactttaaagtgtttttatctttcacaagagacaaatttagcctgttatgaataaaatcccttaatatctgcattttctgcctggcatatgtatattgcctcagtggaactttaaaataaaaccatacataagaaaaaattaaaaagaggcaaagaactaaagcactagacaaaaaaatctatttttttacatcaaatagtaaaataattgtcaaaagtgtttgctttaattgaattttaagcctagaatctttttcagcgcttgatttcacggtaagagtacagagagtacggaaacagctagaaccttttgaaatttaccattctcttacctttttgttgatgttagtaccatctctgtcactttgcttggtggaggtatagttttgattgtgtaattttacaggtattttattaaaatattcaggaagttaggtagctacattccaaatgcaacaaattacaacgtgttcttgataaatcagaatgctttatgacacatattttcaagcctcaggttgaaacaatttgtatgtccccatcgaaggtgtgatattcatttgaagaattatgcaagttagttcagcatttcagataaatgttggattaattatctggctcctaggaaacttcactcaggcatgtcttagttgcatactgtttgaaaataaaaagcaattgaactgagaaatacaaatatagcatttcatgatattgctatttttattgtaactctaagtcagttttagatagcaaagctccgaccttcaattgaggaagcctttatagtttttaactggttattaactccatctcttaaaaatattaatttgtaagtttgaagggaatgaaacaaaattgtctaatcacttgaaagttgtttccctacattttaaaagatatagttttagcttctcttttatgtaaattatttaaaaatgtaattttaatagggatctttggaaagaacatgaaggatatgaacagaattgttgttcaacttaatttaggaccctaatttagaacatacaccatgttctttttgcctccgaatgg

SEQ ID NO: 473526 - DNA, 674 bp, Homo sapiens
aggacactgcccagacagtcctctctccccctcctccaccggcctgcactgcggagggagcaccaccaccactcgccaaggtcttaatagactccgcgctccataaagtggacaccgagccagtgacggcggagatggcccggcgggcgcccaccggcattggctgcgctccgattacttcgttaagcagtgctgttttcaatggctgcactatgcgggtgtttgattttggagatgtaaacacagatcatggatataatgatttttttccatcctcagctgctcttatatctgtggttgacaatcacatgcagggtatgggtcatgccagtgctttggaaatctcagtagaaaggactgtaatgcttcgctacgtttttttgctgccagagctgtgggtgtggtcagcatcatctaagcccatttgttgtgctgcaaaagccagttcctggctgaactggtcaaagctccatggaaaagggaagaaggcagaatctttggagtatcaaagaggaggagacttgacttttccgagtgtcctcaacagtgtgagttcttctctgaagatgcttgcaagatcaaaggtgaagcatcagagttcgttagccaaatgggtgcagtcagttcttctaaaaatgaagggccttttgtgactaagtcgcagtcaaaatagc

SEQ ID NO: 473527 - DNA, 821 bp, Homo sapiens
attaatcttttgatcatgaatttatcaagcttctgagacagccaagtataaaggggtccctggggaacctctgaccagcctgggaactgggaggaacatgcactggggtggagcctggggcagttcacaccgtttgcagggaggaggagcctgacccctcctctcccccaggtcccgtgcgagggacatccgtaatgccatgtttgcttcagggctgatgaggagagcggcatactgcttggtggagacagtgcttgcctgttacccccggcatatatttggtcacgatgagaatgttggtagatatacggatggtaagggccattctgaagaggtctctgatggaactgaggaacaagatttggaggaaactcagaaactgagaagagtcgagtctggtgcctctctcaagaacacaggaaggggtgacagccaatgggaccatctcccgttctgcctggtgagggctcctgtgggctacctcagcccctgccttcccttctctgccttgggccacatacctggctgtccgaaaatcccagctcctggagaagagctgtcagttggagtctctctacccaaatgtgggatccggaaggactcagcctgtccagaggctgcagacttacgcgtcttcaggagacttacccccacttaaaaagaattctttcttttagcttctctttttcatataattaaaagcagataaaaacaactctttatttcattgctttttcatagctacgaggtacgcgaataattttatttttatctgcatttacaataatgatgaagatagaacaggtcagggagaatatttt

SEQ ID NO: 473528 - DNA, 741 bp, Homo sapiens
cagggctcatctttctggggaaaatggctgacaagactggggatgcccaagcaccagctcagtggagaatcagacaacaaactaaggacaagaagtcagaacttagtcaccagaactgtgctctagaacaggaatcaacaacaatgtgggatttggtggttatatatgtgtttgaggcaaaaccaagacaaactagacaccaggcatatagtagcaagccttctcccccactcctgacttctttctcagaatgtccaccttcagaaaaccacttcacaggtgcagatccccccaagtttttctgtgtttcactactcacacttcacctaagggaaaaaattaagaaaagctccccagagctgccatttttcaaaacactatgttcaagaagtgggagcggggagtgtggggaacagcagggagggatctctaggggactgaacagcaaatgttaatattcttgtgttcatgggcaccttggagggatgggtcaatctagccccgattgtggaaatctccttagacattcagctggtatggtggaagaggagggaagaaaacctgtgtattgtaagtcatattcttctatggtgtgaaggttaacgtaagttttaagaaagtttttttttttaattttattatatgatcttgctctaaagggatgtaaattcagatgctgaattgcacacatcctttctctttcatattttcaatattgaacgtaatttcaatatttaacat

SEQ ID NO: 473529 - DNA, 870 bp, Homo sapiens
agtctctggacaatgacgccacttgcagtggaaaacttcccctgtgtcctctttatccgtgtgactagactagtggtgtccttggccaatgcaggtgatactgtagccttgcaaccaggaggcatgtgtgatgaattccttgttttggagggaatcagtttctcactgggtgctactctgcctaagggcaggttcttatattctaaaatagctagctttagcaacatgcactgtctttttcccaaggcacattactccttcgcaagtgtgcccatttctggctactctgtgaccacttgcactggctttgattccctggggcagggccctggctttccctttggagccgggaatataaagacgtggggccatcgggctgaccccgagggccttctgtcaatcatggcctcgccatctctgctccctttcacaccaggcagctggacccatcgctgtcaaccagctaagtagaggaaggtaactaagcgaatgttttaagaagtaaattctgctatgctgctacaccggctgtcttaaatacaattatttagcaagaataaagtactttttaagaaaattcaaatgcaaacactagttttggaacacaaggtgctcaaagaagatttatttatcaataaaaaagactatttatgcttattaaaaaaaaaatccttgaatctttcaatattaaagaaggttttaaaggaaaacaatatgttttggaactgacatatttttcaaagaagcagtaactatttatgggccagctaaatgatgactgaaagtgtttttttcttaccagctatctattatctattagtatttggagagcgtaaacactaatgaaggacaaattttatttggagttcc

SEQ ID NO: 473530 - DNA, 1327 bp, Homo sapiens
ccacagatgtgtctggacatgcccagccccctttctccgtgtccatcacactttgtggaagcgttgccagcatgtctgacaaactgtcctataaagttgctgacatcgacctggcctcctggggacacaagggcctggatattgcggagaatgagatgctgggtctgatgagtgtgtgggagctgtacttgggctccaagccactgaagggcacccatatctctggctggccgggtaactgtcatgcatccaacattcactacttcaaagacgtgcccctcaacatgattctggatgatggtagtgacctcaccaaccacatccacaccaagtacccacagctcttactgggcatccaaggcatctctgaggagaccaccactagggtccacaacctacataagatgatggccaaggggatcctgaagagggatacggatgtgatgattgtcggcaaggtagccatggtggcaggctatggcgacatgggcaagggctgtgcccaggccctgtgggattttggggaccccttcgtcatcaccaagatcggccccatcaacctgctacagactgccatggggggctatgaggtgactgtggtagatgaggcctgtcaggagggcaacatctttgtcactgccacaggctgtgttgacatcatccttggccagcactttgagcagatgaaggatgatgctatcatctggccaggactggctgaagagcagcacggcaccatcctgctggttgagggtctgctggtaatcctgggctgttccatgggccacctcggctttgtgatgagtgactcctttaccaaccaggcgacggtgcagattgagctgtggacccacccagacaagtaccctggtgggattcacttgttgcccaagaagctggatgaggctgtggctgaatcccacctgggcaagctgaatatgaaactcacaagttgaccaagaagcaggctcagtacctggcaacttaatacctagttcacttagacaccaagtttcactttagagccgtgcttgtttcttgcattttctgtatattgatatttttttccaagaagatcatatttttaaacataggtgcttcttttctaagatctaggtgattctagattctaagattttgattctctatttttcaccttttattaatccatttggaaactattaagcactttctttgtgctgggttctggagtacaaagatgaacaagacacaattcttgccatcgcagctatcaaccaagtaagggagacagaagcctaagtggacaagtgtaattcagtgcctaggaaagggacactggatctcc

SEQ ID NO: 473531 - DNA, 1119 bp, Homo sapiens
aaccattctgctcacacccccatagaatcctttcagcagcaataactgtcactatgcttttggtatccctgacacgttggttgtgccacgtgtggccgggcattgtcgtggagaagaactgggccctttctgttgaccgatgccagctgcaggccctgcagttttcagtgcataaagctgtagcagatcataccagcggcagaccaacaaacagtgaccaagacctttttcttggtgcaactttggctttggcaagtgctttggagcttcttcccagtccaaccactgagctggtggtcgctggttgtcacataaaatccacttttcagcctggttatttcttgttccctggggaatggtggagagggtcctctcctcatcctgtggccctgcctaccggcctcactctccggaaggtgctgctccattttccacaatactcagggatgaggggaggacggaatgccgaggccttctcttcctggagttccacaggccccatgtccctctgcccttcaatgttgtctgaagatgggatgcttgggactgcagcagccaccttgtaatcatgaggagaaagccaagagctgcacagagaaacagatccaaaagcctgacattactgttctattaataaggttgattacactgattgatttcacatgttgaactagccttgtatacctgaagtaaatcttatttaatcatggtgtaaaattcattttataccttgttaggtttgacttgttgatgtttcattgaggatttttgtgtgtgtaattttatgagagatattagtcagtagttttcttttattgctgtatttttctagtttgggttatcaaggtagcagaggggagtctcattcataagagaacaaagatgctccctggaccaggtgcttgttgtggccggattacccttgctggaatctgccacctgccaggtgtctctctgtgggggaaaaagagcctcagtgttggtgtgcttcttatttttaacagggtatgcaataggtcctctcccctgtgctgcctgactcacctgtgttgtcattgagactctagttcaattatccagaggaacgagcatacctagactgccttctgttgctagttt

SEQ ID NO: 473532 - DNA, 511 bp, Homo sapiens
tttcctttcgatcaatatccagtagtgggattgctcgatcatatgaattcagcagtaaaaccttcaggtcccaagtttttctttgctgcaagatttttaattatggttcaggttttgaatttcttcatgattcaatactggacccaatgtttctcattgaccctgccccttatcaaaaatagcaataacagcaaataccagtactccagtgtaaaatcaatgcaatcacttgaaaagcaaaatcaaggacagcagcttattaaaaggaggaacagagcaatgccatttgatgctaaactacctactttcaactccaaagctcagaaaattatactacattacatagcactagtaactttaaccacagacaaactaatttacctacattttaccttcaatatagccatacggttttgttgaccttcatgaagagagaaatctgagccatattcctcatcattagtttgttataataagcatttttatctccagactcttaccaatgtgtcag

SEQ ID NO: 473533 - DNA, 503 bp, Homo sapiens
gagcacatgctgttggaaaaaatgtcctccagaccccagaatggtagatacaccaacagcttgcactgtgcacttggaaaagccacagacgcccaacaccagcccatgaaagcagccaggagggaggctgtaccctgcaaagccacaggggcagagctacccaaaactatgggaacccacatcttgcatcagtgtgacctggatgtgagatatggagttgaaggagatcattttggagctttaagatttgactgccacacaggattttggacttgtttgggtcctttagaccttttgttttggccagtttttctcatttggaatgggtgtatttatccaatgcctggcgaggattataagaaaatcaatttaaaagttaggaaaaagcctggtacataataaacattcaataactgtttacaggtattgataaatagaatgacatccaaataagagatggctttaattttctgagaatatgccttaaggcattgatagggttt

SEQ ID NO: 473534 - DNA, 944 bp, Homo sapiens
ttgaaaagggatagatcaagttgatgttttggagggctcagaagaaggcaggaaaatgtgggaaagtttggaacttcctagagacttggagggctcagaagacaggaagatgtgggaatgtttgaaacttcctagagacttattgaatgactttgaccaaaatgctgagagtgatatgtacaatgaagtccaggctgaggtggtctcagaaggagatgaaaaatttgttgggaattggaaagaaatttctaagctgcaaagcattcaaaaggtgacagagcataagagtttggaaaatttgcagcttaataatgcagtggaaaagaaaaacccattttctgaggagaaactcaagccagctgcagaaatttgcataagtaatgagaagccaaattgtaatcaccaagacaatgtctccagggaatgtcagagacctttatggcagcctcttctgttacaggcctggagacctaggagggagaaatggtttcctgagctgggtccaggcccccatgctgtgttcagcctcagaacttggtgccctgcatcccagccactccagccttggctaaaagtggccaaggtacagctcaggtcattgcttcagagggtacaagccccaagccttgacaacctccatgtagtgttgggcctgcaggtgtgcaaaagacaagaattgaggtttgggaacctccgcctaaattttaaaggatgtatggaaacacctgggtatccagacagaagtctgcagcaggggtggagccctcatgaggaacctctgccagggcagtgcagaagggaagtgtgggattaggttaattcaaatgccttgtctttgagctctgaagttctttcttctacctcttctacctatttgattctattgctgagactttccagtgcattttctgtttctctaagtgtgtccttgattaccagaattc

SEQ ID NO: 473535 - DNA, 520 bp, Homo sapiens
tgtaaggtcagttgagagaaaggaagaatagacccgaagtcagatgagaaaaagaccttcaatcctcttgaaaagtatcaaagaactgaaactcaccaaatcactgcatccagacaatgagatgccagatcctacattcatcatgattgcttcctttcccctccctactcccacttggatggacagagctgcatgtggagacctatatcatgaaattttgttccaagaactactgggggaacataccaggaaagtcgagagaatccgcagaccctttgaaggaggtggattgccgctgcaggctttatgctacagcagaggaactgtgagtctgcttgccttctcagctgagaggcttgaagcctggggcaaattctcaaccctgctcactggctgcctggaaataaacacagtgctgttgtggggacaaggtgggaatgagactggccattcaggctgtgggctgcatgggagtggagtgaggactgtgacagccggcttccttccccttccctagtga

SEQ ID NO: 473536 - DNA, 874 bp, Homo sapiens
ggcagcacccttcctctctgtgttgccaaggccttggcatctgctcatcaggccttggagtgtgacatggggctggggcttcgtgttttcactctgacaagcacagcctctgtgctcctagagctggaaggactccattgcccacagtcgagtgctggctacacgtgtgtgtctctccttcccgacttctgcctgatctgtcagcccttccaggaaggccatggcagtgtcatgactcacaggggcaggaaatacttgttcacacacccatcactcatcctctgtggatgcctgacctgctcttcttccatccttggaagtcaaggaccggataaaacacaagggagggtgagggaattggagatctgccacgctttgacagcgaagctgggttccagccaggccagtccacggggcgctgcttcattctgtcaaatgggcactgaccatccatcacatggagctggtggcaatcactacccacttcatccttgggtgaatcacttaaagcaaaagaaatacagaaccccggaatcttccatagtactataccaggtggacccctttggctaaagtagcagacagatacattttagattctactctctagatcacaagcctcctagtttcttgtttcgggagccctcgatttccatgcctttgaaggatgctggcgtttcataacagtcagacttctcgctttgtgaaatcccgtcctaatctccaggtcaataaagtgactcatctttgggcttaacgatccttttgtttagggagaaaatagtttctactgagtgataatctatttataaaacgttgcatctgattagccactattttatcttccaacaatgcttaggctttcgtgttttaa

SEQ ID NO: 473537 - DNA, 1464 bp, Homo sapiens
gataaaaccaccctcacctgggccctagatgaaccccaggtacggagccctctggcccacctcggaggggtgctgagcctctgagctgctctagttctgattccatgccctcatgaggccacccctggaggttcagggaagatgcttcctctctggagctccctcgcagctggggccagaccatagtggaagcacaggtggctgcagccaaggtgctttggtgagtcctcaggtggaaaccagcaggggctgtcacagagaaaagcaagggccagggagggtctccaggggagctggcagtggggccgagccctcagggatgctgaggacccaagcaggccaagactggcagggcgccccaccctcatgtggagagctcatctcaccagcacaggggcctaggtttagcaggggtaccaggtaccagattcagcgttacacccccagggccacgttttccatccctggcaaccacagaaggtggctttgtgcatggggaaagccctatgtggacagatcgaagatccccctgacctgccacttcctggtcataccggtgctggattcttccagtgccaggtgcacaggtgggggctttgcccgcgaatcaagtcacgtatgtgtcattgacccaaccccccgtcatcccggcattctcaggaggctggtgctgagacttgacttcatgttggacatttgcacctccctgactttccaaatggcccattcgcagttcgagcgctgacattaatccagccacatctttgttttccttcctctcagatctacagatagaacctcgtaaagcgccatgacagttggcttgcatttataagcagtaattagctatcaaatcctttgtgaatctgtttcgagaagaaaagaattcaaaaacaccaaggttccttctgggagcaggagcctttgtcttctcctctgcccccgcgttttggagagcgctcccatcccgactgtgctctgtaggaacgagttattatcaacatggcacacactgggtaggaccttcaagagcaacggacaaaaacacagtctttcagggtaacagagaggatttataggcaaaatgcagctattctcagagtcttcaataaagatatacaacctgaacaaaaggtaagtatttcactccgtctaggaaagcctgtgaaatttatttcttgcaagcttttacagtccatgaccttcccattcaatcttgaataatagcactgaattgagctgtaaaagcttccgaagtttgaagccttttgacaagttaatttagcagtatggtaaaaagtttttccccaagatagaataaagccatcatatcatgaatgtagcagtcatcccgaggaaagaaaacaccattaggattcgaaatgatatgctttatggagatagtttgtggttttgtgtaatctactatcaatatttcaggagaaagatgttccactcatcagt

SEQ ID NO: 473538 - DNA, 911 bp, Homo sapiens
agtacaggacagattccctgtgtcctgtggttggcctgggatgggaggatcccagagttactgggtggctttctctgcctttagctacaacaggaggaacatcagagcattgaccttggtgttaaactggggaggagagaataagatggagcagcccgggcagttggcccctctgaaaggcaccagcctcatcgaagttcttccagttccgaggaaagcgggagtacggagggtcaccagctccacccaggtccacggcgagttagtacagccacggaggagagagtggggaatccacagcagatcatgggctccagggctgagggacacccagcccttccgggaagctggagatgaagatgctgtgggtatcatagtgtctgccccacccatggctgtccctggccggcagaggggcagcaatgagcaggccatgctcccaggtggcttggggcagctaagatctgtggtcatgcgtgtgggtgcctgtgaagaaggggaagagggggaggaggcccagagcctcagccacaacctcaaccgtgctccccgaggtggagctgggcccagggtggtgccatgctccatagagccagtgggagccaggaacaggaaggagcttcaccctcccagagctgaagaggtgatggatgaccagctgcagagaggagctgctctgtctgctgagagctggacactcctcaggacactctggctatagagaggagctgcccactgcaggtctcctctgagctgttctattgctcaataaagctcctcttcatcctgctcatcccccgattttctgcatacctcattcttcctggaagcaggacaggagggctaaaagagacataacacagctttgttcttttggcttagaattgacttggcaatgtgggctctttttt

SEQ ID NO: 473539 - DNA, 915 bp, Homo sapiens
gctttaaaaatggaggaagccaagtctgagtggcgcgtgcaggaccgtggacaggggtggggagtgtgggagaggctgtgtttaaagggctccctcaggggcacaggttcagagaggcactcggaaagcaggtgccatcagtgcctgggaagggtgctctgcgtgtgccggcggcagatctgacgccctcctcctgggaatggcagggctcctccagcagctgaaggcacccgtcacccgggcctgtggggatgatgtgttggcctcagcaggggctctgggcagcccggccttcccttgagatatgcctgagcatgcagcagtgacggtggccccgggccctggacggcctggagacaatgtagcaaggccaggcccaggcagttttaacaattcagagattggggcagctacagattcccgcgtgtgtgccgtgacgggacagacctgcagccatcatccgagaaggtgtgtcatacaggaacttgctgttggtgtcctcgtgaaaggagtgagagcacctctcaatggagccaagggttctaatgggatggagagaagagagaagaaagggagccgactcgaaggggtgagaagcatgggagacaggaggcaggagagtggcagtctcatcaagactaggacggtgctgccagaacgtgactccacaggcccctctccgggaagatcactgggccagggccaaacacaagacactgacaagtcgagtgcccctgccccaaaggaaaccatccacaggacagtagggcacgccaggcagcagcgagagatggcaggggcgactgtctcaggggaagaaagggccggagcctagtcactgcccagccactcccaccactcgccatcgaccgagtcagtctccaaggctggcccagtctctggggagggagcagc

SEQ ID NO: 473540 - DNA, 1158 bp, Homo sapiens
gaagctcacggcaaggtgaacaccatgcgccgtgagggtggtgctgcagctgcagagagctcggagaggaggcccgggatctgcacagtggctctgctgtgcttcctgtgtctcacggaaactgctgatttaccgaacgccagagaaatgcaccacccattcctctacctgctcctcttcacaagcactggctgccatctcccgcacagcagtggctccctgcggattgcggcgaaggcgttattccaggggaataataaggaaatggagactcggaaaacaaggcactggctcgtcaagcctgcgagacaaccacattggttcctcctgaatcttgttaagaatttgcgagatcaagcagggcttcatggaggaggtgtccttgcaggggcctgtgaggataaggaggagctcaccaggcagcagcaatggaggcagagggacatcgcgggtttctgcagcagcgtggggtcttgaagctgagttcacagctttgctcaggtggaacttcccttccctgctgtccccagcgcctcgcccagcctgcgtgttccttcctgctactcctcagccaattccattttcatcccagtctgtcacttagttatctcgctctccatctcttttcacagagtttcctgagtcttgttgagaacacagaacagatgctttctaaaaattgccttttatcccacggtgagcagtgactctataccattcacattcatgaatatataaagacacagacgaatggatacaacgagctccctctctgcagctccggagctctgtgcaggttgtagaatgacttgtcctggaagacaaaccattttcccaggcatagcaggtgggctccctggctcctcgcaccatccatctggctgactgaggaccttcgctgcagctcacctgcggagcccaaaggccagtgtctggcctccaccaaaaggaccaccccagctccatgcagaatttcagcccccacccctcagtcatctcacaaggaagaacggaactcacctccagataacttcaaagttcatcactattctcttaccagaaagggtcagtcaccaggtactagaaccctgggttgctgggcccacgggctcttccagggcggccgttccctgcagccagctgtgccttcccagatgc

SEQ ID NO: 473541 - DNA, 3427 bp, Homo sapiens
gagcccacgagggtcagctcgggcactgggagacagcccaggccagacacggacaatgtggatgatgtggacgacgtggatgagggcacctgcaggcagcaaggccccgtcctgtgggaaagcaggaggcactgagtggagccaagcacaaggtccctgctctcagactctcctttcagacaaggcacgtgcaccaggcaggagcatgggggacagagaggagtccagatgccgcccctgggcttgcttcctgggaaggcagaaggggctgggagggaagctcatccccaacatccaaggaccaactcccgagctgtgtgctgtgtggggttttcctggcatggcagccacccctgctgggggaacgggcacatcctacgtcaccggattttccacagtgcttcaaaaactgcctggaattgggagtgcgggtcctcgctgggtttatgaacttggaattgcatttctgagaagcatcttaggccgataatagcactccaccatggaaacactcccaagctcactggccatggcagttttaatgctgcagtttataaaagagtttttaattatgcaatgctcccttcctgtgcggtattatgcttgagtcctaatccttcgaattaagtggctaatcgtgaaaaatgcctcttgttgttctctgtaatactttagttctgctctttacaggactttttttatttttttttaagagagaaagaggtattatataatactgatgtaatagaatgcagctggagttccagtatgcaatagagtaactatggtattcttgaaaaggctgcttctcagttaaaatcttcccattttagaaaaacaaggaggctcaaattatgctacgttgatatctgtagattgctcagtattgtccaggaccgtgggagtgcatgagcaagaatggggggggctctggttccacttccttgttttacaagtaaggaaactgaggcacagagacattccctgctcaaggttcatagctgctcagtccaggtcctcatagctgctcagtccaggtgctcatagctgctcattccaggtcctcatagctgctcagtccaggtcctcatagctgctcagtccaggtcctcatagctgctcagtcaggtgctcatagctgttcagtccaggtcctcatagccgtttagtccaggtcctcatagccgtttagtccaggtcctcacagctgtcagtccaggtgctcatagctgctcagtccaggtcctcatagctgtcagtccaggtcctcatagctgtcagtccaggtcctctgcctccagtatgcagaacgctgcacacgggaggaggaagcttccatctgcggctctcagcttcctcttcatccatgaagggagcagtcggcgagtagtgtacctttgctttgcaataaacttctttgcctactcttactttgaacttgctctcaaattctttttgtgacaaactcaagaacctgaaccaacctaccaataacacttttacaacatgaaaattcaagcacagcaactaaattaaagtagctcgatggcctgatccttggcttttcagtcacgtgaatgcttagatcttaactgatttcctcaggctatttttaacaacagtggctctgttgatatagaataaatacaagctagcatagccaatgactactcatgggagcagtaggtaatatcaaggtgtttttcctcttccccaacgctggagatatttattagaaagggaaagtgaagggagaaaggataaccacatgttcatgctaagaggacccatccatcactttaattcaagtcagaatttaaaaatatcgcactacgttcttgtttgttggatccagagatccaagttattgggcatttcaatcttgacatttgcatccagacagtttgcaaagggtaaaggtagaaaatgctgtaaacccaatcaactgctgcttgatattccaagtagggtgagtaaccttttcaaataatagaggaacttgtgagtgataagatgaactttgacctctggaatcacagattcttggtaatgcatctctttacctttgacttgccttctttataaataccttgaggtgctgggttttgataataaagaaacaagatctagtaaatcttgtagagcttacaggcaagatcccatatgtcactgtggtgctttctggctgcaaccgcagcaaccttcatgacaccctgtcatcctgcctggccacactggcctttccaattgcagaaacactcttgggggctggagtgggtgcaatcctgcatcatgaccagagctttccaagaagggatcttattccagcctgccgatgtgcatggggcagacctgcctcagtcaccctgacttcatttctaattgctttttctaatgacgtggtgctgtggctgagatgggcagcctcgccatggtgacactgcccgtgtagatgtagatgaggtcagctcatctacatctgcctctgccattccagtggcccatggagctttggttgctgggtctccagggacataaggcacagtaaccactgttcaaacaggacagtcctcagcgtaaagaggacagtagaaatgataaaaatatgtaatgtttgaaatatgtatttattaaccagcaaattgattacattacattactgaatccataaaatagctccgtgaataaataaatttcaaaaataacattcctattaaaaataatgtattttcatgttcatcaaagcaaaataatctttatattggatatctgaacactgaaaaaatagccaaacagattattcttgatatatattcatatactatatttgaatctgctacttagccatttctcttttcatgaaattcatagtttatctctcatctttttaatctcttcataaaattacaatcttctttaaatttttgctttatcattaataaatttaaaatgatagacaccttcaatggactcttctctgctgcccatcgtatgttagagaaaacattctctctaaccgtgctgaggtatcaagtaagtgcagcagaatttctgctaagtggaggataatcttaattctatttctcatatataagtgtgtaaatatttcaggccaaatgtttccatagatactatctttatgcctccattcagagtacattttttttggcaaagataggataaaacttgtcaaataaattgtgtctatttatggttcttttgaatctctcaccatatttagatcatgcaaaactgtaagacttctcaatttaattccattctggtacagagtataaatttatccaattaaaaataggtgctccctcgaaagatttttcccacaaattgagatatactaaagcaaagccatacaatttgaaaattaaagctcatacatggctagagctttcaccaagttaatgtgttc

SEQ ID NO: 473542 - DNA, 535 bp, Homo sapiens
gtaaatgaggttggaagagtggaagtcatgtccgggaaggagcacatgaagacgctgcagaatcctccgttttcatggcgagcagttctggcacagcctccccgcagtgtgacacctcccttctccgggaaggagcttctcctgcgggtggagatcagggcatgtgcccagaagaaaattgcaaccaattatgacactttaaaagctgacaaacactacaagcatcacaacatgaagaaaaatagcagcaacagtcatttaataattatcagcctgtgtggaaagacagtgttgtcctttaaaaactgggtgacagccctaccagcacagccaaacacacctattggaacggttggtaaaacagcacacgtgcaggtgaggacgctgctggggggagtgcaaaagggggatagcctcctggagagtggcttggctgtgccctaaaacgtcagccacataccactacatgactcagcagtctgggcccctgggcattttctctagataaataaaaacctgaacgtggatgtttata

SEQ ID NO: 473543 - DNA, 1068 bp, Homo sapiens
gagcaaaccccaaggtgactcctgccagctcaggttcaatcctcccatgtccgtggcttcatggtgtcctcaggacaccccatgagactcggcctgcctggtccccagcaccagctctgtggtcactccctgtggagagacggcacggccagcaggcaccaccctctgtccggcaacacaacagcaggcaaactgtgcatgtgagcaaatgtgtcccgtacccagaatgcccgccaaggtgaatacgaaacacctgcaaaaagccagcccagcggggccttcgcccctggtccaggggagcagaagggccaacctgaggaccattctcggggacctgctctgctgtggcctcctggatctggcttccagggctaggaaacctggtgaaaaatctctgtgggaggattgcggggctgatgctgggcgagtgcagggaagggaatgcagaggccggagccggctggcattacggaggccgactcttccccagccttttgattccacggccctgcagctcctttcagagaccacccccctgctctgcattctgggttctgagccaccccagtgctctgaattctgggtccagggtctcccctactctgagctcaagggagcatctcacattttcctccaaagcaacggagtgcggtccacaggctggcccgggccacagaccacctgttggggcctgccatgagttaagtttaataatgtacactgtttagaaactttgttgtagcaattcaactttgttgtaccatttctactgaattttgcaaaagtgttggtcctcagcagatcggaggaagaaactagttctttgccatgagatcttgggaagcctggtctccatcgctgacaccatcttcctctgcattgaacctgaccatgtcggatacagatgttaatgctgtcactgctctttttctttaacttgtctttatttcatttacttcctgcctgactttgaaatgaaaggggaatgagttaatgggaaggcaatttttttttgtattacatggtcttctttcttgccttgtttcaaaaacatttaatatatgtgaa

SEQ ID NO: 473544 - DNA, 2159 bp, Homo sapiens
tggcctgtccccaaggttcatcatgtgtggctgcctatggcaggattgccttcatctttaaggatgaatgatgttccattgtgtgtacacgtttgttttatccagtcatgtgttgatggacatttaggttgtttgcacatcttagctgttaaagatgttgtaggttatttaggacccggagaactgaacatagaccccatgggagttgaacagcactcttttcccacgaaggggctgccaaaagcagcttctggctggcgaagtgtggaattcaaggacttcaagttggccagtctggatctgacccagactcagcagagacaggcgtgggaagggggacgggtcatcctacatgaaaaactcagagctgggaatccaggtcagagggagccagagggcactctggaggaggaaggtgtttaaaacactgaaagtcagagaggggaagtgtgctccgtctcctggtgtggagctaatcctctttattcttccctgctcccctccctacctctctcccttccctgcctttcttttcccttcccttccctgcctttcttttgccttgccttgccttgccctgccctgccctgccttgccctgccctgccctgccctgccctgccctgccttgccctgccctgccctgccctgccttgccttgccctgccttgccttgccctgccctgccctaccctgccctgccctgccctgccctgctttgccctgccctgctctgccttgccctgccttgccctgccctgccttgccctgccctgccctgccctgcccttccctgccttgccctgcccttccctgccttgccctgccttgccctgcccttccctgccctgccctgccctgccctgccttgccctgccctgccctgccttgccctgccctgccctgccttgccctgccctgccctgccttgccttgccctgccttgccctgccctgccctgccctgctttgccctgccctgccctgccttgccctgcctttccctgccctgccctgccctgctctgcccttccctgccttgccctgcccttccctgccttgccctgcccttccctgccctgccctgcccttccctgcccttccctgcccttccctgccctgccctgccctgccctgccttgccttgccctgccttgccctgccctgccttgccctgccctgccctgccctgccctaccctgccctgccctgccctgccctgccctgctttgccctgccctgccttgccctgccttgccctgccctgccctgctctgcccttccctgccttgccctgccttgccctgccctacccttccctgccttgccctgccttgccctgccctgccctgccctgccttgccctgcccttccctgccttgccctgccttgccctgccctgccctgccctgcccttccctgccttgccctgccctgccctgccttgccctgccttgccctgcccttccctgccttgccctgccttgccctgccctgccctggggaagggcataggaagctccataggaagctaaaagccaatccattctcacagagttttagtttctagctgaggtctccactgaaaacaaccgagttcttttcaatgtgttttctttttatgccatggggagccttagatctgcttctttcaactcacagagactttctgatgaataggaccagttaatcatggtttccttatagcagcttcattgagatatgttcatatatcgtacaattcactcacgtaaagtatccaattcagtggttttagtacatttactaatgcactaatttatatatactaatatgtaatatgtattattaatatatgttatatactaatatatattattttatgttataaatagataaaaatatatactaatatatatgtacttatatatacatcaatatataatgtattattttatactaacgtatattatatatactagtatataatctatattattttatatgttataaatatataataaaatatataaatattttatgcatatattaatatataatatatactaacatgctaatttatatatacttatatataatttatatagtatataatatataaatgtatataatacataatttatatatttatatattaatagtttatatattagtatatata

SEQ ID NO: 473545 - DNA, 821 bp, Homo sapiens
aatcccttggtcaaatgcccttcggtgggtcagcacctccggcccatcatgctgtgctggtcagtccccgtgggcgtattcttacccgttcagcctggcagctcttccgggtcccacaagagtctctgagcacagcggacgccccttcttcacgagctccacaccctgttctgactccacagtctctctctgatgacagctcggagggcttccctcgggccgacaccttcctggagaccctggatggcggctgcacacttctgattgaaggctctgtgagtgtgtccccctcctcgcatgtggctactctaggggccatcccgctcatcgcttcttgcccagtgttctgtctccagttctgtctccaactctgcactggaatcctctttgaccagacctccttcctgcacatggtgcctccacccttcttgtaccactgcagaagccagcaataaacctacaggagaaaacagctcagtgttttgagctcctctagattctgatctcttagcccagctcaaattattttaaaaatagccactgacttatctttccctcaaaagagcccctctgcctaggaaaagcttaaacctcagccttttcccagattcagaaaatctctcccacccccgcccccagggacaaaatggtcagtgattgcagctcagctgggaagggctcttcctgctctggaattttaatttgtttggttcttctactttcactgctaatcaatggttttacaactataatctttataatttatcaatttatttttctagttgtgttcggagcagtgaactgttgatatttactctaaa

SEQ ID NO: 473546 - DNA, 904 bp, Homo sapiens
ggggtattttcagcaaagtacagcagtctgccgaatatttggagttcacagtaatgaagagctgaatgttaatcgccaagaagatggggaaagtgtctccagagcatgtcagagatcttcacggcatcccccctcttcacaggctgacctggctgcagccactgctgagtatccaactacagcagcagagaacaacactgagtccccagtatggcaccattccctggagggatccgccagctgcctggtggcagattgattacattggactgcttccatcattgaagggaattgttcttactggaacagatacttaccttgaatacaaatttgccatctctacacacaatgcctttgccaaaactaccgtccatgaacttacagaatgccttagcagcatcatggtgttccacctagcgttgcttctaactaaggaactcatttcacagcaaatgaaatgtggcagtgggcccattctcctggaattcactgatctcaccatgtttccccatcatcctgaagcacctgaggtgtttgctgagggcaaagagaatataaaacgggtagagaaaaagggattcctgttttccccttcatattacactgaactgaatatccagatccattctggagctgacccaaagccaccaagtggctgctctttagtcttctctaaagagaaggaaaagaagagctcagtgagtccagaatgggcccaactccacagttaatttcaatatctctcgtcccacccgacaagaaatacccacaggtgtggaggggctggcccccttcacagcctaggtattatgcacataaaaaggagtctaaaagactttaaaaagatgagtcattataaaataataagagtagatagcatattatactttttaaaattagtatt

SEQ ID NO: 473547 - DNA, 609 bp, Homo sapiens
agatcctgctatcagaggaactctaggtaggcagactgtctctgaaaggaaaacaaaatcactgagcacagctgccaggatgcaagcagaagaggaaaatgagctgaggaaaaagcaggaacaagctctcatggaaaaactcctagagcaagaagctctgatggagcagcaggatccaaaggtaagaagtgccgcactcatgagacagtctccttctcataaatcaaagaggcagcagcaagagttaattgcagaattaagaagacgacaagttaaagataacagacatgtatatgagggaaaagatggtgccattgaagatattatcacagccttaaagaagaataatatcactaaatttccaaatgttcactcgaggaaaagagtagggcagggtcacacaaattccaatgagtcaaggagccaggaagtgagtttgaagggcccattagctgacttttctacacaagctgctttgattggctgccagctggcctttgtcctgcttagacacatgctattaaaggttgctattctctcactggcactctcccctttacagatcttagaaaccaaccatacagacgagccgatgcggtgaggagaagc

SEQ ID NO: 473548 - DNA, 688 bp, Homo sapiens
gggaggcagaggatgcattgggctgcacgggatgcccaggatatcctatccacacctaacctcctctgcagataaacacaggactcacaatctccagagctatccatctggcacctttcaacaccttccaaatgtccctacacttctatttaaacaatcaaaacaccaaacactaacaataccaaatgccagcaaggatatggaacaatgggaactctcattcacagctgatgggaatgcaaaatggtacagtcactttggaagacagtttggcaatttcttaaaagctgagtcatccaattcagcggtcacactccttggtatttattcaaatgaactgaaatcttttgtctacacaaacacctgcatgcaaatgtgtatagcagctttattcataactgccaaaacttggaagcaattaagatgtcctttagtaggtaaatggataaataaataaactgtggtacatccagacaatgaaatatttattattcagtgccacaataaatgaactcttaagccaggaaaagacatgggagaaacttaaacagatattactaagtgaaagaaaccattctaaaaagtctacatcctgttcgttaccaactatataacattctggaaaaggcaaaatcatggaaatagtaaaaagattagtgattgtcaggggttgtgaggagggagggtt

SEQ ID NO: 473549 - DNA, 1279 bp, Homo sapiens
aagcatctgctcaaagctgaaggaaccccagcccaaagccacagaaagggaaaaggctttgacttctttatatagataaagccagaacagcactgggatatggcaaaagtcctaactctccaccagacattctctgatataacagtggaaggggagagggacacttcgttactgctgtgtggagatcaacagggaaatatttcagctacatttgagccttttccttttaacttactcaaagaatttaaacaagctataagtcagtatggaccaggttcgccttttgtagtgggactgttaaagaatgctgctgtttccagttggatgattcctactgactgggacgctcttactcaatcttgtctaacttctgctgatttcttacaatttaaaacttggtgggcagatgaagcttccattcaggctgctcacaatgcccaggcccaacctcaaattaatataactgcagaccaacttttgggggttggcagctgggctggtttagatgcacaactggtcatgcaggaagatgctatagaacagcttagaggagtgtgcattagagcttgggaaaaactcacttcaggtggggaacaatacccttcctttagtgctataaaacagggaccaagagaaccatacgttgattttatagctcggttacgggagtctcttaaaaagatgattgcagattcagctgctcaggatatagagttgcagttattagctttcgacaatgctaatcctgattgccaggctgctctgcaacctattagagggaaagcacatttagttgattatatcaaggcctgtgatgatatcagaggccaaaatcaacagccgatttggataccatcaagacacctgaaaccttatcatgagccagatgccaaggaagagattccgggaggatcccaaggacacctcaattgcagccatgtcaagactgacactgaggaggaccccaattgtcacgagcaacacccgctgaacacagccacctacctggggacagatcaagaagctatcacagatggtggaagaaaacctggggaaagcaggacaaccagtcaaaacgagtaatttaatggtagctatggcagcgttaagtcatctgttcctggttgggggaggtttttgattattgattcaattttcacactacttatatgtctgttcagattttctgtgtctttttatgtcttctagtctttctctgtctttctatatcttctagttttaagtgagaattagatatttattgagtcaaattgcctac

SEQ ID NO: 473550 - DNA, 486 bp, Homo sapiens
agtgagcagcctaacctgctaaaatggaggagaccttgcgtgtgtgtttagttaggcttcctagtagaaaatatgaaatctctatgcatacagctataatgaatgtagatatagtcagcatgatgaagtataagaagcatgcacttgggtcaagactgagttcagctttggctctgctttcactggttatgtggccctgtgcaaactgctggacctctatgagcctctctctccctagccctcaagcggggaagatgaggggaaacttgagagctgatgggactgctggaaaaaatcccttcacgaccaacaagtggttgcctaaacttttgattcagtgtcgctccaatgggatctggtataaaaatgagacacttttgagaaaaaataacagtttctggcgaggatgcggagaaaagggaacctttatacactgttggtggtagagtaaattccctttttatttttaagcaaaagatttcttgt

SEQ ID NO: 473551 - DNA, 767 bp, Homo sapiens
cagtctgtaagctgaggaggcagccagaccaattcccaaaacctcaaaagtagggaagccgataatgcagccttcagtctgtggccaaacgcccaagagtccctggaaaatcactggtggaccggagcgttggaggcttgctcacggcccagagctctcgggacccagagctctcaggctcggcccaatttattggcttacaagctctttgttcttagggcagatgggagggggaggaagggatgaggaaaggattaatcagagaaggagaactcgcgggtcattcaataagatgtatagcagaggagccaagaagtttgattatactcccctgcttcaagggagtgttttctccctgagaaacctgtggaatgccacggagcggatggtcatcttcagtgaagcatacagctttgggagagatgcacatggagtggtgagggaggaaggggacacctgcttagccagccagatcagccgaatcaaccttggcaatcaatggggtgacagatgttccagccagattgtcctcacaccctaaaatagatttcccaagctgcaaaagactctgagcatttcagcaattctgagaattttagcaacaggcactgcttgtttttctcttggtctggttgaatttctttaagggcaaagacttttgaatagtttgcagatttgtataatgttaaagttgggaagagtccattgtaaccatctttgctcagtgctctcattttaaggatagggctctgagagcaaggtgagtt

SEQ ID NO: 473552 - DNA, 971 bp, Homo sapiens
actgttagaaggaaaactaacaaatggaaagcaatagcatcaatgtcaacaaaaaggacaaccatgcaaaaaccccatccaaaagtcaccaacatcaaagaccaaagttatataaatccatgaagaggaggaaaaaccagcgcaaaaaggctgaaaattccaaaaaccagaatgcctcttctcctccaaaggatcataactcctcgccaccacaggaacaaaactggatggagaatgagtgtgacgaattgacagaagtgggcttcagaaggtgggtaataacaagctccttcaacctaaaggagcatgttctaacccaatccaaggaagccacgaaccttgataaaagattacaggaaatactaactagaataaccagtttagggaagaacataaattacctgatggagctgaaaaacacagcatgagaacttcatgaagcatacacaagtatcaatagccaaatcaatcaagtgggagaaaggatatcagagattgaagaccaacttaataaaataaaatgtgaagacaagattagagaaaaaaagaatgaaaaggaatgaacaaagcctccaagaaatatcaactgtgtgaaaagacgaaacctacgtttgattaatgtacctgaaagtgacagggagaatggaaacaagttggaaaacactcttcaggatattatccaggagaactttcccaacctagcaagacagaccaatattaaattcaggaaatacagagaaaaccacaaagatatgccttgagaagagtaatcccaagacacataatcgtcagattcaccaaggttgaaatgaaggaaaaaatgttaagggcagccagaaagaaaggtcaggtttcccacaaagggaagcccatcagactaacagtagatctctctgcagaaaccctccaaactaagcttcataagaggagaaataaaatgctttatagaaaagcaaatgctgagggatttc

SEQ ID NO: 473553 - DNA, 802 bp, Homo sapiens
tgacagtctcttctctctcgctcgctctctctctcgttctctttgtctctttcttttcctattagggggaaaatcaagtaactttgaaagtttatgatatgtatgatattgatctcacctataccactccagatggaaaagataaaaaggagagagaaagtgtgggttcacgggctgctaaaccctggttttctagtggacagggcaggcagtcaggaaggggagatcacaagcaggcaagaactgacaagcataaacgggaatgccacaaggacggacagaaacctaggtcagctctggttaactctgaccttggttacaagggtatcctgctgaagctagggcccttcttcagagagttacacacacacctgacccagatgtcagagaaagtggaggaggacccaagggaaggtggaatcattataggcctgctgctgcttcatgttcatgcagcagatcggcagcagcacatgtgtgtcttcttccttacgccttctacatctcagaagaatctctctcatggcccatctaacccagcatagaaggaaattctgagaaatgtagttcagcctagccaacatttcctaccattacaaggccattgttgtaggaaatatgaggaaatgggaagcatatttcttgccctgaagaactttatagtatgcttaaattaatggaaatctctatgtaaagtgttcaatacaattcttataaactgctggcttcctttctcaggtagccttgcattgtgatagatttaaacctattttaaatcttttttattaaagacatactactt

SEQ ID NO: 473554 - DNA, 464 bp, Homo sapiens
gccgttcagtatgatatgggctgtgggtttgtcacagacggctcttattattttgagtattcaccacaatggcagaggcaatgcagctggaataaggggtgaggggctccttctggtgattatgtgcatggttgtactggaggtggtgttggcttggaggcagggtgcttgtgggcacagttctagatggcttctctgtgcccagcaagcaagagtggtcactcagggtgaggtaggatcccctgttctctgtgcaatgttaacacagagtatggtgctggtggtggcagagatggctggctctgctcaccaaggcttcacctgcaatggaatttggagcggggagcagggatggagcacagacatacatatataccacacagacatacagacagcaaagcaatgtggggagttgctgtgggccaaggggaagctacagcataaggagggagcatgaaggctgg

SEQ ID NO: 473555 - DNA, 863 bp, Homo sapiens
taaaggaatcaaaggctggtgtcatggtgaatcccatcgctctccgactgaactcctactgggcttgcaaagcacagacacagaacacacttgtggcaagaatgaatcccaagggcagtgggagacagccaggccgctctcctcctcgtcggcactcagtctcaccaccgaaggctccaaatctctgggcaaagaatttgcagcagggcagcaagaaggccctgatgctggcagtcctgggaagcctgagtgtttctcacttgcctagtggcctggggacaatcactttctccttccgcaccttcagatcggggtctgaggcctcagtatcagaacgagccaggaggttaacggagcgtcgtcctgcagcgtcccgggacaccagggcccagcgcgcgctctgcttccccgcgctgccctgtgggattccgcaggtggcggccctcacaggtcgggagctgtcaggtttccagcccctccgccccgcagggctgggcctccaggcgccaggagaggcgcagcaggttccccatccccccctggcaaagcgcgttcacagcccgcctctccgtgggctgaaagaaggaggaagacagctgttttctgatcacctacgtgtgccagacactggactgagttccgttctcaatattgagaagcagtaagtagtaattgagtgttccaagaagaaatagttgagagagaagggaagttctcttttccatcaggcaaaaggcaggtcctgagattactcattagatcctcatgaagagagtgaccactcctctttcatcaaagagaatctcctcatcccagcctgtgttgcttgacaccctggtccagtccactctcactgaggctat

SEQ ID NO: 473556 - DNA, 618 bp, Homo sapiens
tagtaaagttaatcaaacaagccagagtatatttatttattatgagcctttggtgtcattcctccaacaagttccagatgctgcttgataatttcaaatggcctgtctttaaattccctaattatttaatctgctggtttaaatctgctgttgaacccatgtggttaaaaatgtcaattcagttattacatttttcagttcaggaatttcggtttggtactttaaaaataatttctatttgttcatatgctcattttgttcctatatattttttcctgatttcttttagttatttgtttttcttttgctttttgagcatatttaagacagttgttttaaagtcttttctgccttttgagatgtgtgttaggcgacacagagacaaatcacttagtcagcctttacacaaggtggaaattgcaaatttgatcagctcggctttctgtgcttcattgatggggagtggggccagcttgtcagtcccctaaaactgtgacacattgtgctagggaggagaggaaacaagggtttgaccctgtaactaggtctcatcaaagaaatagctcaagttatgtatatagtataaccttgaaattgacccaatagtcccatagacag

SEQ ID NO: 473557 - DNA, 989 bp, Homo sapiens
gcagctgaatggtgcctgcaacttctgtgaccattttgccatgttgggaccaagtgtgaatgcaaagtttgcacatagaggagaactgaccaatcggagaatggaaaacttcttgatcattgatgacagcagtcaaccagtgaagccatcaagcctggagtttttcctactgctggaattcttgtcattgcagaaaatcaatatggctctggggcgttgcgaaacaccaagagctatcgccactgtctcatgctgcacacaggtgcaccactccttggcagccaacacacacccagatgctgccttaggggagcaagggatgcagagccttttcctgaagccagacaagcccctgttgcctcaggggactttcttccatagaagacatggagcaaaactgccagttgaagaaacacaccccaaagaacaaaaattggatatgaaatgatttggctgtgatcacaatattataaaattattaactggtgagcaatacgatatgagtcacccttgagcaaagcagtcccccagaaaaagattacatgggaaaggatcatattgagctgtaatggtggggaaagctaagctattaactaaaatctgttctctacttccattataattatgttgtacctgagaaatggtaaaccagccactactttatgtctccttcccacaaaggtacagcagtgtgattcaatgctagcaataacatgagtgaagtgaaatgtaccactagaggaataatgaaatttcctgctgtgatttctacatgcttcaacctggaagaactactctggaatccatatataactacaaagggaaaaaatattggtctttaatttcttatctgtttgcctttaatcaaattatgtattgtctctccattgaattcttcatttgtaaagtggaggtaataattgtaacaattattcaaactataaatgtgaggatttggtaaaatgtgtgcgataattccaacacaatgt

SEQ ID NO: 473558 - DNA, 1503 bp, Homo sapiens
gggtgagttaaaatgcaaaactgccttcactggtttatgggtgcaagccacattggcatccatgggtggcacctgccaaggacactgggacttggggataaggatgggaaagaaaaggaggtgtgcctgctttctttccacctcacattccgagttttcgctgaaaggaggaagggaatgagggatgccaaattccctgtctttcagaatgggcaacaaacttcaccacctccagtttatactcagaaacggaccatgggaccagatagtacattagaggaccttttgaaaggggccacattggtctttcagacacaagaaagaggcagaagctttaatggccaccattcaagctcacaaactccagaattcctaaggaaagatcaaattcttcctgcaccatcccctttccaattcccgatcccgctgagagccacttccatttcccagtaaaatcctctgaatacacttcccttcagtcctttcacgtgacctgattcttcatgaacgctggacaagaacctgggtgcctagagaacatcttttctgacacctctggagggtgggaaggaagcttagcattctgcaggaatgatcatcaagtaagtgggcattctgctcaggatgttggcgaagtgggaagtattttctatttactaagtttggggaattggaaaattcacacacaggatatggcaactccatcaatctgaacattatattaatcagaagcccatctagttcataaaaaccaagatatggaaacaactaaagtttggtcaatggataaagaaataaagatattgaattatgcttatatatataagcataatttaaatgcattttatatataaacataattcagtatcttgctgaattttatacagatatagataattcagtctttaaaaagaaggagattttgccatttgtgacaacactaccaagcacaaaccaagaggacgtcaggctaagtgaaataagtcagacacaagttatcaagagtggggtggggaacacaggagaaatgagaggatgagatttttaaaatatgaagaaaataagaaaagttatttacttctttgaataatttttggagaatcctacattgttgaaaatgtatggcatgaccaaatacatcacattaatcataaaacagaaagagtttctcttttcatggtctatgtcggggaatcagtttgaaatctctttttcaaggctctatgaaatgattttgttgagaacaagggtcatggctgctgtgactaaatatcacgatttttaacaagctgcttcataatatgtttctcttccatttatttcactcatttatcccacaagcaatgcatttataaatgcaatcaatgttttttaaatgcatgaacactttcatatggatcagggagtcttcaataaatcttcattttatataacgattcatctggaatgttccagatgtggtatttataaagcattttctattccatatatcatgaactttac

SEQ ID NO: 473559 - DNA, 562 bp, Homo sapiens
gaaaaaagtggccatggtgacagaaatggaggttacgcatgaagattctgagggtacacgcaagagagtagggagcatttctgcagcgagaggtacttggccatggctacagcagacaaaggatggtcaggaatactttagccacaacgttagcacagacattagcagaatgctaaatcgtgggatccaccataaccagaagaatgctagatcagtcccacctcagcaaggactggcaaggacccccaaaacaaagaaaaaattcaaggactctgtcactccataccacaagttcacaggagcccttcatcctccaaacagtgtgatgccacactgcggacatacagatgagggcagaattgatgagactgaaaaagtgcctaaagggattatttacaatattggtttggacacagttttgaaccaaattagactaagtaaatttccatttttatcatcaaataaaggatcatgaaggaacaccacgtcagttttagacaaaatgcgttctatatcggcatacacagatccccctccatactgtgtatatgtgtttactcat

SEQ ID NO: 473560 - DNA, 735 bp, Homo sapiens
actaggcttagtgcctgggtgacaaaataatctccttttgtgtatatttccttcctctgcaatttctatgtgtaagtccaatatgttacttcctttttcttgggggtcatctccccacagcttttggtgttcaggaagtccatgtgacctagacttacaggtccatgggtgcaacctggtggtcccacctccacatcctccttccccactcatccttccccatgactgcctttctggaggcgaggttagcaaggtagttcctgcaggccccccttccctgccattctgcagtgcctgtcagctctctacaggacttccccagtctctggggaccagcctgtgctaccgtattgctgagatattaatagattccaagcattatcagcgaagcttctatcacagatttttggaaaaaattgaagagatatatgcaaaaaacaaatctcaatctttaccctacactatacataaaaattaagatgaaagacaggatagactggggaactggttgaagaagactaaggagacacagcagtggatgcaatatgagatcctggattggctcttggaacagaaaagtacattgtggggaaactggcaaaatttaaattaagtctgtagcttagttaataaatgttgatttctcggttttgataattgtactatggttatataagttgttaacattaggggaagcaggatgaagggtatatgtgaatacttggtactgtattt

SEQ ID NO: 473561 - DNA, 572 bp, Homo sapiens
atacccagggaagcagctaaaccattctttttcagcctaatggaatgaaaaacaaacattttgagccaagggcagtggagaggcactgggtggtacaggggagcctgggacatctgttcatccaggaagagatggttacgccgggccctaaaggcgtggtgggaatcagaaagttaggagagggcactccaggcggagaaaacgtcaaggacaaaggcctggatgggattcagcgggtcgcaaactttgcttctgagaattctcctagaatgcacgttaaggtgcctgggctcagacatcaggtggacattgggatatcgggccctggggtagtgatgagtgaagttcttgacaactcccccaaggctggggcgtacttcaaaggaggaaaggtgaaatgagaatttatgctgaagggttagctaagtatacatattcaacaggttatcggaggagctgtgaatattcagaagggggatgtatacatacatactaagcaaacatgcatgttacatacatcccatgttcactctgggggtggagactgaacacttaaatgcattagaatcagg

SEQ ID NO: 473562 - DNA, 2728 bp, Homo sapiens
gtttagggccatggcgcccggctccacgctgctcctccatcctctcagagaccctgtcgcagtcccactgccctcgccttctccaggcaggcactggcacaggactgtccaccacccaacaatggcctcacctacccgggatggccttacctgcctgcgatggcctcacctgcccacgacagcctcacctgcccatgaaggcctggcatcctgacggggccctgcgcatcatcctcgcactgagaggtgttgccaggacacatcccctccatttgctggataattcggcccctcaggcctgcacagctgcgggggctgcccctatctgtccagccaggccctgcccatgctccaggccatctcaaggccctggatacactggttgtcccctcccacctcgtggcattcttgggtcccaggtggacagaagagtgcagccttgctacacagacgctaagagacacacagtctcctcgtaccccaggaaccccatggtcccacactctccatcccacagccagacatcatatcaaagcctccagagcgtggggccatgtgctgccctttcccctgcctgaacactcacccttacataccctcagtcaaacccactttcctctcaaggcagcccgagcccccaggtactgagccctgccctcccgggccaggcagcgccaggctcttccaggcactcaccccatagcaagaccccagtgggccccagggctcacctgccacatctctcagaccgtgaccagaacctgcttcatggacctctacctcctgtgcccaaaaccttcctggaagacaaaagaagtgccacatgaaccctgagtatatccgagagctgatgggagggcgctgtggaccccgggctgactgcacaggacacacgagcagtcccggcaccgcactttcagaacaggcaccccgcaccaaaaccaggagaagcaacaaggccagaaacgcatactgtagggtcaggagaatccaaaatacaggccaggctttaacatgacgtccagcatgaaccatccaggcctgtgtgttcgggaaaaggtggaaagaaaagcgccgctgggaagggaaccagcagtacctgagtgacagagcaaaagctcctgcaggttcctgctcagttcagaggtctgccctctccacctacctgaggcaatgcgttcaagatcagaaaaatcacaccaacgaagttactccatttggaagctttttctgaccaacctcaccttactctgaccacaacttactccatatccaatcaggtgtgtgtgattggatgtcatgttgtgtgcacgtgtgtacatattctgtgtgtgcatttgtgtatgcgtgtttgcatgtgtgtacatattgtgtctgtatgtgcatgtgtgcatgcatgtcacgttgtgcacatgtgtgtacatattgtgtgcttgtgtatgcatttgtgtgtatgcacgccatgttgtgcgcatgtctgtacatattgtgtgcatgtgtgtatgttatgttgtgtgcctgtgtgtgcatattgtgtgcatgtgtgcatgcatgtcatgtgggcatgtgtgtacatattgtgtgcgtgtgtttgcatttgtgtgtatgcacatcatgtgtgcatgtctgtatatattgtgtgcatgtgtgtatatattgtgtgtgcatgtgtgtatgcacatcatgttgtgtgcatgtgtgtacatattgtgtgcgcgtgtatctcatgtgtgcatgtgtgtacctatgtgtgcatgtttgtgcatgtgtgtatgcatgtcatgtgtgcatgtattacatattgtgtgtcatgttgtgttcatgtgttacatattgtgtgcatgtgtgtgcatgtgtgtgcatgtcatgttgtgtgcatgtgtgtacatattatgtgcatgtgtgcctgtgttcatgtcatgtgtgcatgtgtgtacatattgtgtgcctgtgtgtgcatgtcatgtgtgcatgtgtgtacatattgtgtgtgcgtgcgtgcatgccatgttgtgtgcatgtgtgtacatattgtgtgcatgtgtgtgcatgtgtgtgtgcatgccatgttgtgtgcatgtgtgtgcatattgtgtgcatgtgtgtatgcatgtcatgttatgtgcatgtgtgtgcatattgtgtgcatgtgtgtgcaggatactgactctcagtgaggatttgaacctccagggtgcccagccagtcactagaggagacagttaataaccactgaatccttaggagatccacggggctgctgctattcagtctgcttcctgctgtgcaaaggacagacatttacagcaggcaattctgcttggactggaacacccctgacgcctccctccatgggcaccctccttgccctcctctgagctcctggactccctccagccccactctgcatggacacccaccttgctcaatgccatgtaatgtctttaggactaaattttgcaagaagtggccaggagagggaaaagatggcagatgctgactggacaaccccacttccagaatgctaacgccaaggtttacaacccaggccgaagtctggagaatttttttctgaggaaattgactagcccaaggaaaaagacctgcagattctgtcagttgggaatttcacactgcaaccattggctccccttcccagtatcctagaacaaagctcacaacgcagcaagccccacccgtgcacacaaagcctgtagtaggtgctaac

SEQ ID NO: 473563 - DNA, 1301 bp, Homo sapiens
cagctccttaggacgtgaaatggatgcttcaaaatgtgtcccagagctgtctgtggccatcgtgtgcatgtgcacctgactctataaatgctctagagtgtatctcggccattgtgggcttgtgtcctcaactgactgtgaatgttctagagtgtacctcggccattgtgtgcatgtgttcccgactcactgtgaatgttctagagtgtatcttggccattgtgtgcgtgtgttccggtctcactgtgaatgctctagagtgtacctcggccattgtgtgcgtgtgttcccgactcactgtgagtgttctagagtgtacctcggccattgtgtgcatgtgttccgaactcactgtgaatgctctagagtgtacctcggccattgtgtgcgtgtgttcccgactcactgtgagtgttctagagtgtacctcggccattgtgtgcgtgtgttccagactcactgtgaatgctctagagtgtacctcggccattttgtgcgtgtgttcccgactcactgtgagtgttctagagtgtacctcggccattgtgtgcgtgtgttcccgactcactgtgaatgctctagagtgtacctcggccattgtgtgcgtgtgttcccgactcactgtgagtgttctagagtgtacctcggccattgtgtgcgtgtgttcccgactcactgtgagtgttctagagtgtacctcggccattgtgtgcgtgtgttcccgactcactgtgagtgttctagagtgtacctcggccattgtgtgcgtgtgttcccgactcactgtgagtgttctagagtgtacctcggccattgtgtgcgtgtgttccggactcactgtgaatgctctagagtgtacctcggccattgtgtgcgtgtgttcccgactcactgtgagtgttctagagtgtacgtcggccattgtgtgcatgtgttcctgactcacttgggatgtgacgaacatctctttctacagtgcctttacgtgagtttaactcaatttttttaaaaaatttggattaaaatcttagctatgtgaaatatttagggttattctttttaatgtttttatttgttaattgacagattgcaattgtatggggttactttcttgagttttacgaagtacctatgtttattgaagttaaacatcaaacttaaaacatttagatgaaaacctttcaaaacatattttgatgtttactactttttagctagagcttactgcgggtaaaccccagtgattcttggcggtgactaagaacagctccttacacaaactgtaatacagtgttgctctt

SEQ ID NO: 473564 - DNA, 1251 bp, Homo sapiens
ccctgaaagcccagggtcccgctcacccgtgggtgctggataatgaaccccagtgacatggacccaaaagcccagagctctatcggagtcacagagtccctgcaactgggaaatcacccagcgctgactcatcacgcccaccttcacttgctgcacctccaggaagcagccgggtggcaagagaggcgagaggagccatgtgacaaggagggtgcgtgggaaagtgggcccatcctgaggattggccattataaataccgctgtaagacacagggcaggctcaccaggactgccctgctccagggagctcttggtcgagagcatgcagaaggaagggcctacaccgggcagtgtaaactcgccacccacacctggcctgtcaccactcatgtcaccggcctcccaggaacactccactcagcagtcagttctttgaagtctctagatgcttcaaggccagacacttgagggcctttttgtttgtttgtcccttatagcactaggtttcttcagaagtcgattcccacgaatttcaactagaattctcaggttctcttcaacaaactgtccttggtgctttacagaaagaacctgtgagtcagcttcccagatgagcatctcagtgacaatgatggtgtctcatggctccttcagttacgaacggcactgagctgttctggacagagagggaagagctactcttgcttgcttttggtgtctatttgcctggaatatctttttccacccctttactttaagtttatgtcagcctgatgtgtcaggaacaccaattattcttaggtttggttgtttaatataatcccaaacttcttggagactgtgttcatttaaaaaattttttgtctttgtctttgttggattgggttaatttaaatgtcttgccttcaagctctgaagttctttcttctacttgttcaattctattgccaagactttccagtgcattttgcaatcctctgtgtctttcatttccagaagttgtgattgtttttttatttatgctatctatttcactggagaatttttcattcatatcctgtatctttttttaaaaaaatttatttaagttggacttcacctttctctggtgcctccttgattggcttaatagtcgactttctgaattctttttttggtgattcagagatttcatcttggtttggatccgttgcttggtgaggtagtgtgatcttttggagctgttaaagaaccttgctttgtcatattacc

SEQ ID NO: 473565 - DNA, 605 bp, Homo sapiens
tgccccccacatgccgggtctcgtgtttgatgctggaaatgcaactatggaaaaggccaatcttgtagccaaatgcaatcaacaggccctgaaaatgcccagtgggctgggggaaatgcattcaatccagcagggagaacccaaggtgaagacagttcccagaagcagaagcaacgcagccccggcaccaaggtgtgagcccagctgtggccgagggttcctctcacctggtgtgtgcctcgtgcaagggaacctgcagagacgctgccctaagacctgccaaatggggacctggagatacatgtgggaggcagccttcaaaagggaaaccaaccgcacacccaccagcagggaacagctcagttgacttacgtagaactgagggaatggcactcgctgcaccccagaaaacgagtggaagatgaaaggattccatggaaaatgtcgacgatacatttgaagtaaaaaggcacctatattcatagcatgatctcatttttaatcagaaatatatttggagagaggacagagattaaacatagcagacagaaagtgggaagggcttattccaactactgacagtacttgactctggaaagttaaac

SEQ ID NO: 473566 - DNA, 965 bp, Homo sapiens
caaggtcatggtagccgagacatgggggaagggaccagggataggaggcccaggactccatgtggagtggcctctggggccgggcatcgccaggggcctctgtcttgcttccccaccttctgccctccagcctggggatcccggtggctgccgccacctcctgccacctctgccatcacttttcacggacccccagctccagcctttcagttcctgtgtccgtgtgggacggtgcaatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtgccatagttcctgtgtccgcgtgggacggtggaatagttcctgtgtccgcgtgggacgagatgaaaccatatcaccccaggatgaaattcaggcatagagaagcttgtcttggccacgttacccgggaggccaccaggcatgccatgaaactttgttgtcatttaaaagaatgtaaatcagagcacccctgc

SEQ ID NO: 473567 - DNA, 834 bp, Homo sapiens
gacagctcagaacccaacagcatggaacccgatggcatggaacccaactacagggaactggaacctgatggcacagaaccagaacccgacagcatggaacctgacggtggcttggaacccaatggcagcatggaacccaacagcacggaaccggaactgacagcacagaacctgatcatggaacccgaaagcacggaaccggaactgacagcacggaacctgatgtcggctcggaacccaacggcagcatggaacccaacagtacacaaccggaaccaacagtacggaaccagaactgacagcacagaacctgagggcacagaactcgacggcacagagctggaacctgacagatggaacccgacggctcagaaccctatggcacagaacctgagggcagcacggaacctggaagatgccggaggagactggagcatgaactcaggcaggagaacctacctggtcctggacaagggcgcacaaggagcccaggctaagggtgcatggtgcagcatgggccacagaaccaaaaacgtgggcaggccagtgtccatggacagggacatagatgaaaacgcgcaattgaccgggaggcagctgggagccctggtcaaaggggacaaagaaaggcaccgcagggctggaggaaccggcagtggtgctgaatgtggcactggtgtgagcagacagacctggccctcagagcctgatgaccttagagccacgacactgagggacgtggaaaaaggccgcgctgcacagatgcagaccaaagcatttcagtagtgataggtattttgttgtttcttataaaacacttcctagaatccatct

SEQ ID NO: 473568 - DNA, 551 bp, Homo sapiens
ctctgggagcacaatggaccctaattataatgacagaggagccgcaggcctggaccgggcagctgcggcctctctcagccccagtcccgccttcccgcgtggatccgggcagcctggcgtggcctccgcaacgcgcagcggggacgcggtgaccccagagctcggctgctcgcagggtccacacagcgtctcctcctgcgggctgcagacaccgcctttccctgccaggttgtgcctgtccaagcaggagctgaagggctgtgggagagggaagtttgctgaagccatgggcacatccctgctgcaggcccctcttcctgcatgcccacagtcaccctcccgggagcctttgcacccagaccccaccctgcccagagaggcctctcaggcacagggcctggcgaggggaggtccccattgcctgactctgctgccagtcattaaagtgtgaccagaaaagccattccatagtgtttactatgtggctttccacaagttatataaaatatgcattgtcatcttgtccacatgtatttttattttgaattttt

SEQ ID NO: 473569 - DNA, 1832 bp, Homo sapiens
ccttaacacttctgaaacggctggatgtctctgcatgagctgtgcttacccagttgttccatttattcttatattttacaagcatttagaggtgttaacattagctatggcaatgtaaaaccgatgtttttggaagcagtaggggcagggaatggaaaatcctctgcagctgtcaacatggggaaaactcccatgtatcaagatgtggaagattccaattcacggaggttcctcgtcagattctgtgccagacactggaggctggtatggtgggacttcatgctcctcaccttcctgtctcactacttttcttgtgactgccaattgctggccctttactctgaagtgggtgagaggaccactgcccctgctactggggaggggatgctcctcacagcacgagaagtgccaagaaggcagcagtcaaacactggaaccttggccacaccaaccacatctggggaattgcatgtgactagggcctagcccaataggaatgctcctcttctgggaacatctccccagtatcttcattttgttttcccattggctagtccagcttaaccccttagacgattctagatctccccagaaaatacctaggtgagagttatccaggcaaattctctccctcctttaaacccctaaaggctataatgtgtgtgtgtgtgtgtgtgtgtgtgcgcgtgtgcgtgtgtgtgtgtgttacagaggtctaatctgcagaagcacagcttggccttcaggaaatagatgggaaaagggaaaagggccgctttattatttcctcgtgccttcaaagcacacacaaagaaggtatcagtactttgtctaataattcctctgtaacattgagcatttaaaagttattataatacatttaaataccttgcccatacaagtgcattataaaatgtagcagtaatgaaacaattaaatgtcccaacttaacctgtcttctggtaagccatgaaataaatttctcccacgacctctatgtatatgtttaccatttgtgcaaatataccaccaaatagtgattgcagacaatttttattttgtcaacagtccactcgtgtaaaattacacacaaaaatactactataacccatgttcattgccagatccaattcaatgtaaaccaaggcccatttgttcacgcatgtgtttttattcttttgtctgttccttttctgacttacatatttataatacagaatgtgagaacagttagttctttgtgattatttagctttaagacatagaaaactgttctagaacctttaaagagaaattgcaggaatttttttaaagtcccttgaaattacaagtcaagatttttaaaattattattctttgaaactaattttctgtgtacatcaagatttatcaatagcatgtgaacaaaataggaaagtatggccacctcatgttgcttatttcttttataataactaagtcctataaattgagctcacaaaatatttatattaataaaattataatttatcatttgtaatgtttgggtttttcttgtacatttttatgtaacaagaaacaagtttttactgttaaaaatggttttaaaaaaatcggagcaagcctaagccccttcattttatgaatacaataacctgaggctcatcagggctggtgactcacacaggcgcacactcagcattgctggatgtcagctcaggatccagaatgcatttggacatttcatgctaaattaataaatgcactttaaaataggcccatattaatcccaaagtaactaaacctgtggaatttgtaaaagaagatgtgtatgaatgaggacatggcatttc

SEQ ID NO: 473570 - DNA, 669 bp, Homo sapiens
acagacttgcaaggactcgatccgtcaccacaaatgcggaagaaagaagattccaggggcactcaaagaagagcctggtacctcagtgaaaagtacagaaaagacgcagaatgcagccccgtatggaacaataggaatcagagcagcctcaacctcacgtatttctcgcagagcttgtacaaatctacgggcaatttcttgcccagttttcattctttttcccaggagcccggaccccctgagacatgccttggacttaggaaaggtgaacagctggtgaaaactcacgggcctcatgtggctaagaagcgtggcactgtggcttctcccagtccaccttcagtggagaggcttcaggaactgccctcggtggcccctcatgctgagcattccaggcacagcaagcagcctgagttgttggagcagcaagcagttatcctcctggagcccggcatggcagagtgaagcacgccttccaggagagggacccgctgacagcattccagagttttcagaacattttaccattaaagccaacagcaaaccacacagggcctttcagccacattaccaattttactcaatggtaactcaaaacttctaggttactgctcccctttctgtgggaaatcttgctaaccaagattgaaatggactcctccattgttc

SEQ ID NO: 473571 - DNA, 905 bp, Homo sapiens
ctgttcggccatcttgatgagaaaagggcactttgaggaagatctgtggaactttgaacttgagagagatgatttagggtatctggcagaagaaatttttaagtggcaaaacgttcaagaggaagcagagcataaaagtttggaaaacttgcagcctgatgatgcaatagaaaagaaaaacccgttttctgaggagaaattaaagctggctgcagaaatttgcataaataatgagaagccaaatgttcatcaccaagaaaatgggaaaaatgtctccagggcacatcagagaccttcacggcagcccctccaatcacaggtgtggaggcctaggaaggaaaaatggtttcctgagccaggtctagggccctcttgctgtgtgcagcctagggacttggtgccctgtgtctcagtctgtctagctgtggctaaaaggggccaaggtacagctcaggctgtggtttcagagggtgtaagccccaagccttggcagcttccacgtggtgttgagcctgcaggtacacaaaattcaaaaactgaggtttgggtacctccacctagatttcagatgatgtatggaaacacctggatatataagcagaagtttgctgcaggggtggggccctcatggaggacctctgctagggcagtgtggaaggggaatgtggggtcgaagcccccacagagagtccccactgaggcactgcctagtggagctgtgagaagggggccaccgtccttcagacctcagaatggtagatcaaccaacagcttgcactgtgcacctggaaaagccacactcgatgccagcccatgaaagcagtggggagggaggctgtatcctgcaaagccacagaggtagagctgcccaagactgtgagagcccacttattgcatcagtgtga

SEQ ID NO: 473572 - DNA, 2181 bp, Homo sapiens
ctgtggtctgccatgcctgacaccccccgccccaccgtgggctcccgcgctgccgaagcctccccaacgggcaccgccccctgctccgtggcgcctgctctcatcaaccgcccaaaggctgaggagtgctgggcgcatggctgggaactggcgggcagctctgccagcggcccaggcacgggaaccaccaggcgaaaccagctggcttcaaaccacaaacccacccccgctgggaggaatgaacaacttcagacgggcagagcaaacaactccagaggggccgccttaagagctgtaacacttaatgggaaggtctgcagctttactcctgaagctagcaagaccacaaacccaccagaaggaagaacctttgaacaggtccgaacatcagaaggaacaagctctggatatgctgtctttaagaactgtaacactcacggcgagggtctgcaacttcattcttgaagtcggtgagaccaagaacccaccatttccagacacggtactaatgagtgtgacgtagtatctcattgtggttgtgatttgcatttctctaataattagtgatgttgagcatcttttaatgtggtttgttggccagttttaggtcatctttggaaaattgtctattcaagctgtttgcccattttctaatcaggttgctattttgtgattgttgacacatgtgtgctttgaaatgacacaaagaacataagttaatggagaaatctggtgatctttttccccttaagtgattgatacatacgcctaaaatctgggggctgaagttagggagtatgtactagtagaaaagaataaaaggggtattttgaagttttatttaatatgggatttctcaacctcagtacaaccaacatttgaaagagaacagttctttgtggtgggggcttttctgtgtgctgagaggtgtctgtgagattacaaatggcagtccagccaccagatgccccagctctggtcattgccgcatgttctaagataggcagaattgcctgtggtggaaaaccactgactttacggttttgtgcaaggaccaggagtagttgtgtcaccaaagtcttggtcttgttattctggatgttatccagcactgtcaggcttctcctttaccacccaaacaatactgcacaatagagcgaaggtgatcttgtgtgctaaatcgccttctgaagattcgctgttggttaaatttctgggatacaaatggctttaggggaaaatgttgatattttagatgactttaaatgttatttctgctgtaaaaatcttatcaagacgttattcaaagcctacccacatgcagatacaatttttttcacaaaacaactagcttgatattattttgattctatttcacatgtgtgctgtactctaagaatataaaaataaaatatctctctctagaccatttataaataccctttaaaaaacgaacactaggtagttgctttagaattttggcatgaacacatattctttaaaaatgacaacaaaaactctcttttcaatttttctctggtgcttactttagcaaattgtctatagtttaccaaatactttttaacacaacttcttcttgtcttaattattaaagaaaatatcagataagccattgtcacttttcctactagatagtggagtgttatgtattattgtatattcttagtatatatatgtgtctatcattctttgacaggctgatttggaaatatatcatagtataaagaaaaacatgatgtttcctaaagtctttttacaaattaaggtgattacaattatattgtgcaatacattttatatattacttttaaaattttatctttttcctgtttaaaaaattatccataaacataattttaactattgcatgattttccgttttcctctgtttgctaaaccatttcttggttttgtatatatggattatttgaaattttcacccttataaacctgtttgtgcttcagttttcttgtagcacttaaggtgtccagacagatttctaaaataataaatcaaaagccatattttaaagctttttatatatattaccaaattgtttctctaataagttatacaaatttgttcaccagtagaaataaacattcccaatgtgacgtgtttccaaaacatcacaaagaggaaagctgtctttggaattc

SEQ ID NO: 473573 - DNA, 868 bp, Homo sapiens
gtgcaggtttacatatacactctcacttgtgcatgtatgctcacactcatgcacatacccacacgatacatgcagcagtgtactctcacaagactcgggcggctggaaacgtccacgggaaatgggggcgaggctgcactctacacccaaggcccacctgcaccatccagggcccagcctcggcagctccgggtgcacagcaggcagcgagtgcacagcagggagcgggagcacagcagggagcgggagcacttcagggagcgtgtgcactgcagggagcgggagcactacaaggagcagaagcccgactgggagacccgctcctcgttcccctgctctcaaccgaggcccagccgacgtccctgcggcttctgccttacatcccggccctgcttcccgctcagcggctttcaccgctgcctgcctctccctgcggcctggctgaggagcaggtgggctccgcctcccattagcagcattgcctccgtccagcacaaagaccaagacttgtctctgaaaagcgtctgcagcacgcgtgggaaccgccgctcagcagctcttcttctggcacccacagggccttctgggatttacaatgtttcaaataaagagataacatgaaaaataaaatgctgaccagtaaatgacgctatgagggcaaccactgtctatactcaaaaaacctcatgccgtttctatagtattacattttaaatgtatagacttcatttttttaaatcagttttaggtttacagaaaattgagtggagttccaatactccatccagtcccaatttctcctgttacttacttattggcttactgccctgcatttgctaaaatcagcaaacgtacacggacactcatc

SEQ ID NO: 473574 - DNA, 3313 bp, Homo sapiens
gttcatggctgtgcctacgactccacgaggccccctcacccccgacaggcttcacatttctctgtagcagcactcgccacatgcttggactggctgcctcttacttctgggcctcccatggtatagagttctcttctgctaaagaggcactggcactgacagcaagaggacctgctatgagaaccaaagggatggaagggcccggcaccactccttcccagtgcagctgtggagcagacgcagctgctgtccctttattattttcgaaataccagtatttcgactccagggggatgttcatttctatagtattttcagccccactgctggtgaatgccatgatcattgtggttatgtgggtatggaagactttgaatgtgatgactgacctgaagaatgcacaagagagaagaaaggaaaagaaaaggagaaggaaagaagactgaggggcagcagctgcttggagtttgcgtccttcccgtccacccagtgcagctcccagtgctgcagtgtgcgtggcgtgggcatccttccagctgactcatggtttgaaaaaccgttgttttatttaaatatccacagtggtagggcacacactgaagttggcttttcagccagcactgaatgtatccatcaggacatgcgtcttcaggtgcctgatctttgtagtcaggctgtgggaacggtctctgcagagcttcataactgggaatttgatttgaagaagtccatgtcatatgtgtaactagtactaattataaatataaaatacacaatataaaatatgaaactcaataataaacagtgccacctgtacatgggcaccatgccctcctcctcgtgctgtgttttctagtgcatgccacagttcgcagtagagggtgttttcaccttccaagacatggggcaaagtttggagacacctggttgtcactggagggggtggtgctcctggcttctcctgtggagcccggggtgatgcataaaatcctgtgtgcctgggtcagccgcatcacagacaatgacttgacatgaaatgtcagctgtgctggggcagagagaccttggaaggaagctcttggaaaatacgttgtatctcagtttgatgaaccaattcacaagaggctaggccctctctagcaaagttatgggctgctttactgaaaacagaatggaagccctgaagtcaacactccatggagaagcgtgtctttcctaatgtcctggtgttctgttgatttaggtgcttgggaacacaatgctcccagttctgttaggacaggcatactgttactttgcaatatccactttataaaatagctcctgcccagtggctcttggttcctgtcaaatgtggacctgtagtttaagaatgacaggtggttagagacccagatatttaaaaataggtgttcaataagggaatactgattgtgcattgtatctggatagcatgcctaattgtgcatttctgaaagttaccaattcaaaatgtaattggaacagttatctttgattagacaagcctgggaagagaatgttgaggtgcagagctcaccagccaagttcatgcccctctcgggcctttgtggctgagaagtgggacagaaagatgattaaggtaatgtgtcctccctgtagcattgtccagggccgttgtgtagatatttgacttcactgacagaaaagaaaccagggagtttgtagagactgtgcatttttagtataacattttcaccatctgatatggtttggctttgtgtccccacccaaattgcatctcaaattgtaatccccatgtgtcaagggagggacctgatgggaggtgatgggatatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtaatccaggtctcaggtagtatctttatagcagtgtgagaacagactaattaaacatctatatgttatttggacttaatatggggccgtgtgattgaatctcagtttgcctgtgataaagtagtgtaacagtattgctagctttgcatgaatttgatgctgatgacatgtcagtgtgaaaccatgacgtgtggtctttgattttcattctgcatgtgtgtgtctgtgttttggaacagttatattttggttttgtaaaaacaaccttcactttatttttaactgtgtagtaagtttatattcaatgccttaaagtgcattgttaacaattgtcttgatatgttgtcctcattttagggaaagtcatagaagccaaaatgatcagcagttgagtaatttacgaaagcacaggtgcaatcccactttaaagcactgggggttgcacagagcacactggtttcaggctccataaatgtggatgactcactggagagcttcatctgtttaagtagaacaaatgtttttactctactgataaagtacaggaaaggaggtttgggatcaaaattatttttcacattccaaacctgtgacaccttacgtttatcgattgctatgcaataaaatacatctttaataatatgtagtatttttttttgtttttttcaaaaaaatggtatttgttttgcaccttactgtaactggaaacaggagcacctggaacttagctccacctttggctggcaggtccctttgctgcagcatctggtgctgagttttaacaaacaaatgcaattgtgtcattgccagtagaagaaagtctacttgcacagataatgtatatcaaatcagaaagcaatatgcaacctgaatggctagcttctgtgagaagtaaagtggcaaggaaatgttaacatgttcttgccctttacaaaataataaatgttaaaaaaaaaaaaaaaagggctgggggtggaattcagggtaaggagcttcagtggcgcgaagttgagtgggatgcttaaagacagacgagaattgccgtcagagatataccggtcaggcccaagcatcttttccctggaaaagaacttcaggcttccttgtctggatttcagtggagcacccttcttctttcaccaagttaaccagaacatgttttcagtgcagccttcccctctttactgaagcccctcttgctggtcgactacaccagcaagtcggtcctggggaggacggggctgggctccacatgcagagttctc

SEQ ID NO: 473575 - DNA, 626 bp, Homo sapiens
ccaattttcttcaacattcacttaagatcacatttttaaaaaatgcgtccttcagaaattgttcctcgagatctgaggatgaaggacaagtttctaaaacaccttacagatgctggctacaccagcacaagaaagacaggcttcctgtccattgatagctgtccggagcacattcatgaaaagggagtatttttataccactggaagagctactccgtccacatgcccattagccgacccctgcctcccctccgctggctgctgctggaggcaggtgcagttacactgaaggacgtggtcatgtcagtgggactcaggctcctgtatgggtctctgcgtgcgcacgtcctgctttgcaaacgccacagtgatgccctgcagaaaagctgtggcagaatccccttgatagtccccagcactcttcacatcactctccccatcaccagacaaccacatcagagcctgactgacgatgagatgcaggtgaaatcgcaaaaaatatttctttagaaacataagcagaatcttaaagtatattttcatataacataatttgatattctgtattactttcactgttaaattctcagagtattatttggaacggcatgaaaaattaaaatttc

SEQ ID NO: 473576 - DNA, 1672 bp, Homo sapiens
cgtgggttaacttttggagaaattcaagccagctccagaaatttgcataaataacaaggagcagaatgttaataccccagacaatggggaaaatgtctccagggcacgtcagaggtcttcatggcagcccctcccatcacagacctggaagcctaggaagaaaaaatggtttagtgggccaggcccagggtcctcatgctgtgtgcattctactggacttggtgccctgcatatcagccactccaactattaataaaaggggccaaggtaaagctcggcccatggcttcagaggatgtaagccccaaaccttggcagcttccatgtggtgttgggcctgtgggtgcacagaagtcaaaaattgaggtttgggaaactccgcctagatttcagaggatgtatggaaatgcccagacgttcaggcagaagtttgctacagtgcctgaagctgcagatccccctggtaatattggaggatgcgagtggtatttgccccgtaagctgtgttgacggccttcttcactgactgtgtttcacttgcagcattccagggtaatgaaaatcagttgtgtgtaaacaaatcaagaaagtcaagcatgtttagggacagacttgttaatttcacaaaaccaaagctacatccaggcaaagggtataatgtggttttgtaaatttttttgtaaatttcagtttttccgctgatagtttccctccaatcattgttgattaaaagtataaaaaacacacaaaaatggtaaattgattttgcattttgcaatctgttcaatatatttatttgttctagaagctttcgtgtagatttcatagattttaacaatctaaaaattaagataatttaagacaaattacctgctttccaataacttatctttatcttcttttctttcctgtggcaatggctagaacaatattgaataggcatgaatgaaagtgctgagagtgaatattcttgcttcgatccaggtcttagagaaagagcattatatttttcaaaatcaagtatgatattgtttctgggttttttcatagacacttttcatcagagaaaggtagttccattccatacccaatttgctgatatattttatcaggaatagaacacaaatgttgtcaaatatttttctgcatctattgaaatgatcatggatttcctttttagtctgttaatacaaagaattatatttttaaatttgtgaatggtaaacaaatgttgcattcctgaaataaaccatgaaattggtaacagtgtgacatctttttatgtatggtaagtcttgatttttttaaatgtttgttaaaattttttgcatctatgttcctaagatatattgatatgtaattgtgttttcttgaaatgtcttaatctgaatttggtatcagagtgctgctggtctcatacaatgagttggaatgttatttcttcctccacaatttttgataaaaccttatatagaagtagtattttttttctttaacaattttatgtaatgtaccagggaagccgtctggagctagagttttgttgtaggaaggttttcaactaaacattcaatttctgtaatacacataggggtatgctgactatctattcctttgtgtgtgggcattgttttttatttgttcttttcccaagaatttgtctatttcatgta

SEQ ID NO: 473577 - DNA, 557 bp, Homo sapiens
accataagaaactgggaactgcaaccaccattcaatagtgtccatgaagacaaagtttttaatatattacctttcaaagttgtattttgacatagcatctatgacaagaaatgaaaaaaaaattgcattttattttcttacttttaaaagaagtagaactatgctgttacagaaaagtgaattgcttcctagctgtacgagcatacttgtgtttaggttcttttgttcatttgaagttctgcctgaagtacatcaggctgaaaacactggggccctggtcacctccgcaaagctcactcaaagggtagaagtttcacgtcagcagaagcaggcagagaagattagagaagcccacccacccctcagtgccgctcatgttacctcaaggaaaacagaagcaatcaaagcaggacattgggcagatgagataaagttcctcaagccatacacagaatcatcaacataaggctgaagccacacagcttaagaggctttaatacagcctcttaccgaacactgagcaataagctaccatgacccagcgtcttcctttttta

SEQ ID NO: 473578 - DNA, 545 bp, Homo sapiens
actttcctgcccacgttgcttagtatccatagatgatgtgtgtgggatattttttgaaggacagaaattgtctgtcaacaacagcagagcagcagctgataggcctggttgacatttgggatgaagaaatttttctagaggaaaaccttcaggcagagcaggcctccaagaggcagttatctctagcaacccatgattccaaaaatagcagcagcccctacaacagaagcagcatttgtaaaccaagagtagaggaccagggatgctgctatcatcctacaatgcacaggagagctcccacagcaaagaatcatgtggcccaaaatgtcaataatggtgtgtttgagaatccctgggagtggaagagactgacactcagaaagcaaaatcataaactaaaagtatactttcttatgggagagatgtactctgaagtgcaaaatattcatcaattgtaatactgttgcaggaattgagagtgcagggttatcagaaggagttattctagatccagtttgatttttctttttttaagtagtaccagg

SEQ ID NO: 473579 - DNA, 631 bp, Homo sapiens
tagcctgggatgggttgggctgctgggaagacctctgacatgccctggagacattttcccctttgccctcatagtaagaaaaaccgtgtgatctgccaatttatgaagccaaaatggagaattatggagaaatttccctgcagatctcttgctgctgccaaagccaacagccaagatgaggtttatagtcactcatatttttcaacgatgtgtctcacattgccaatacagaaatgcctcttctgtgaccttgaaaatggtctctttatcagtttcccacctagtaaaattacattcttttcttttacagaatgtcgaattgtagtagtttggagaaagcccgaggtgttgtggaaacaagagacccagaccctccactgcaatggtaccagaagaaattccttaatatcacattgcacagtcactagacataagggagactaaaaaattagtatttgccatttcaacaatcaaagaggggtcctgcagcaggaatgtctttgtgcacaattagatttactttgggagccaaagtgaaaaatctgctaatgaatgagcgcatcagctatggaggcgtgctaatcagacatgttatgaagagagaacctgtaggaggagtgtggttggttaa

SEQ ID NO: 473580 - DNA, 1497 bp, Homo sapiens
ccagaagaggcccttcagtattttccaaaaccatggcacccaaatcactgcctctaagagcagagctttcaatgaaaattttcaacaagtgggaccaagatcctgaaacatttcttcaaagaattataacaggaaatggaacatggatttaccagtatgatcctgaagatgaagcacaatcaaagcaatggctaccaagaggtggaagtggtccagtcaaagcaaaagtaccagtaaaagcaatggctgttgtaaaagattttggggattctcaaagcattttgtttattgactttctggagggccaaagaatgattacatctgcctattccttgaagtcaattcagggaagtccaactttaaggcaaatgcactatcaagaagaatggatgagggagcagcccatagaccagcctgaacgttgcattcctgacaagagaattggcagagtggaggctgcctggccaagcatctgtggggataatgaatggagcaattcttttggcacaaaacaaaaggctcttggggtggggaaaggcccatggcgtcagtctaggcacagctctcacaaacgaaaattctttgttatgaatcgctcctcagaaaatagctctatcctggatgccaatgtgcatgaagaaaatggcaatattcatcaacctggatccctgaataactgcatagactagagcacatctccctactcattcactttgccagttgatctggaacgaactcattctctctgtgtttgagacatatgcatttaattttttaatcatagtctgatattactctaactaatatagtatgcaacttcaaagtattctatctctatttttgtattgcactgacataagaattagccagaaaaatgttacaatattcagagtcacacaggaactttagaaatttttctcaggtatgttgtcacaactttggaataaaggtatctaagctttaattaattatttcaaagtattataaaatgaataccattaactagacaattataaattttaaaagtttacttttaacattttccaattatccaaaatggtaaaaaaaaataggtagggtaactttaatcatggtattcaattctttatgaattgtctttaaaaggttcataaaaattatccattatattcatgattttgtatctctacataattgactcatttttgaactaaattaaatcttgttatcccacacagagtcaataaaagtaacacttttatttcataattcagcacttttcaaaatacacattttaacctacaataatctaaatttaagattcagtgccatgagaggagttagaataatacataatcaagataaagtattttacaatcaagcagttctatctttatgtcttgtcttccacatttataaaccatgtgactttgaggtacttaaaatctcttggctttatttttctcatttgtaaaataggaataataattacacttccttcaaggccacaatgaacta

SEQ ID NO: 473581 - DNA, 865 bp, Homo sapiens
gttgctggcttctagaggttgctcactcatggctgcatcactctggaatctattttcatcatcacgtctcttctgattatgatgctgctcctccctcttatgaagaccgttgtgattaatgaaaggcagcggcagagggcccatcacaacaggagcatgtcctctgggaaaaactgtgagaatcatcacactgtaaatttgtcactaaaaacctcatcagcacccaatgaatataaaagagtaaaagccaacatctgcgcaatggcagataaggccctacataatcagagtagacttctgccacccagccttgcctcctctctgcctttctcatcacctgctgcagtacatttcaccccttccactccaaggtccgcagcttcactcctgaagtcagcaagaccacgaacccactggaaggaagaaactctggacacatctgaacatctgaaggaacaaactccagacacaccatctttaacagctgtaacactcaccgtgtaggacagtatttgaagaattcattcttagagtctaccctccagaagaaaaaaataaattctaggagcctaggttgaaaaggatcctgctctaagacttgataggtgtaaaatttaagtcagatttgtgggaaagcatgttacatgtattagctcagttaagaacttcattaataatgaggcttcagcttatatggatcatcattatttataaattctaaagaaaatgtttttagcagagctgattagatccagagctgattagatccagttggcttccaggaaatgtatatcagaaaaccaaatcactaattacattttaaatattcagaagtggttttttgaacaaaagtagttctaaagac

SEQ ID NO: 473582 - DNA, 774 bp, Homo sapiens
ggctgccagggctgccagcacgctttcctgggtggccagtttgtcatgggcgatagtgaaaacagtggctccccatggaatgctcatgtaaggggcagaagctgccttgccaatccctgccagggggagtgtggggctggtcacagaggccacaaccttgaccagcagggctcagaagaagaaaggaaaatgtgggaaagtttggaacttcctagagacttgaagagctcagaagacaggaagatgtgggaaagtttggaacttcctagagacttgctgaatggctttgaccaaaatgctgatagcaatatgcacaatgaagtccaggctaaggtggtctcagatggagatgaagaactttctaaagatctgtggagatttgaaattgagagagataatttagggtatctggtggaagaaatttctaagcggcaaagcattcaagaggaagcagagcataaaatttggaaaatctgcagcccgacaatgtgataggaaagaaaaacccatttttctgggggagaaaatcaagcaggctgcagacatttgcataaaggaccaccttcttttttctttccttccgaaactttgatgacacaaatgttagatcacttattacagtcccacgggtcactacgactctgcttattttcttcagtctattttctttacattgttcagataatttctattgttctatcttcaagttgaatgattcgttcttattttttgtctattgtgttgttgaacccattccctaaggcttttattttc

SEQ ID NO: 473583 - DNA, 774 bp, Homo sapiens
atctgcattggagagacgtgttgagcaggtaactgaggaggctgtgccatgatcctcttcataagaagcaatataaataggtcatgccactctctgccagcctacaaagtttccactgaaaagtcttctgccagacatattgtcactccactgaaggtggactcccttctggcccaggacaggtccaaaaatgccatcaaagagtcacatcctggaatcagggacactcaagagcctgcttattgctctgtattagttcgttttcacactgctgataaagacatacctgagactgggcaatttacaaaagaaagaggtttattggaattacagttacgcgtgcctggagaggcctcacaagcacagtggatggtgaaagtcacacctcacatggaggcagacaagagaagagagcttgtgaagggaactcctctttttaaaaccatcagatctcataagacttattcactatcacaagaacagcacaggaaagacttaccctatgattcaataaccttccaccaggtccctcccacaacatgtgggaattcaagatgagatttggttacatattttaactcatactggtcaggcaaacatacataatttttatatcatctggcatattgactcttactatagtatattgctcttggttatagctatgcttcttacctattttgtctgctattcatatagcaacactagctttattttggatagtgcttgtgtggtgctcctttgtccatcctttttctttcaaaatttctgtgt

SEQ ID NO: 473584 - DNA, 2077 bp, Homo sapiens
tggctttggtcatcaggaatagacatgctatttcctttcagctatagacaaagcctctttcagctgcccgcagcggtcgcaacaacaagcagttctacgttagcatcgcagcccgccctgcccttgcgctgcccacaaatgaccaggcaaatcccagaggttttagtgtatgaaagagcatcagatgcagattgtattttgggtaggcacacatattgcaatgaaaatccagaaattattcacactgacttcaagctctgtcatttctttataggtgttttatgcctgctcttggattttcatcttgtcattggaattgtttccttctggtgggttcttggtctcactgacttcaagaatgaagccatggaccctcgtgccatatttctttctacaccttacagtgtgcacttttatatctccctctatgggtttgttctgtccctgacagatcttgtttttgtttccttctcttcctgcaaatgtgtatttatccctcaacaaccagctctaaactcacattcccctgaaaacgttcatgaccagtgccatcactgagaattaatcatttcttcatctgtttctaattcttcatactgttcttgtaactgttcttgtcactttgaactatagtaagttatttatgagtgtgtttcccaagctagactatgtgctcctcaaagacaaggacagtggcgatgtcttaataatgtttttattcctagagctaagaacatgtttgccagatttatttccatgaactgtacagaatggaaaactacactgtctgcaaaataggatgaagacattgaggtttagaataatttctgtttaaagaaaagttagggaagaaaatgtatttttaagtgacaatgaggtcttataaaatcagagtattctttaaatagtcatgctcccaaatgctgatcaacagaactgctatctaaatatgactattcttctcaagatgttaatctggaaagagaaaatatgcaagagtgcaaatgttcacttgtctttagagaagaccctggactgtttaaaaataatttttgttctgttcataggcattcttgttgcccaattttatgtgaatatgggtgacaatttatttatattcaagcccaacttaagcttaataaggttcatgagtggagaaaaactttattttcagcttgtctaattattaaagcatacatatctgctcttaatcagcaacataacatttcagcattccaacttcctaccagaaatatactctcatatttgctgcactgagtaccagacaaagattatgtggtctgtctattaatcaaaatcagtgtttcacaatgttttaaaaatctaagctctcattaataaacattcattcccagagtctcaaaaccttttctattgagcgtaaatattttgtgcatattcctatcaattaaaaacttagctttacattccataggtattgttttataagtatatgagaatgtgctttaaattttatgaatattaaataatattttaatcctgaatatgcttcttcatgattcatgcttccctcctcagattattctacctggttgtagtggggtgggcaggcagagaggaggacaagtgagctatgtgtgcctagtcaggtgtttctatctgagagtttgaatcttgtgagcaggtgacaaaggcaatcagtctgatcagggttatttttatagaaaatctggtggacttaaggatttagcagtgttatcctctgtagtttttaggtgtccttaggtgacattctaaacagaaatagaagatttgggctgtgcctttcctgtcttggattcttgccaggccttgtgtcccagtctttctggatattatttgtgtttacagccttccaataaattccttgtctgtttaagataatgagagaaagtttctgttgttttcaactaaaatagtaaagaaatgaccaatagtaaaggaatatgatggcatgatgatatgacttgctttatatctgagattggtattataaagttataaatatcaatttaaattgtctgtaatcattattcaataaatattaaaactgcaa

SEQ ID NO: 473585 - DNA, 582 bp, Homo sapiens
ggacacatcatgatcatgtaattaaaggttaagaattgacaggtgttttatcatcatgtggatacctcatcatgacgcagacagcagagccaagagttggtctgtggcttcactcctgaagtcagcgagaccactaacctaccaggaggaacaaacaactctggacgtgccacctttaagagctctaacactcactgcaaagaatttgggggctaaataccaggcacctgtcagccagttaatagcgactagcacggccgctggactaaagacacaagtgtcaggctttctgggaaagggctctctagtaacccccgactctttggagttgggagcatggtttgcctggaacaagcttccgcttttcctgtatttctgggctgagccaaccgtcaacagaaaggaaagccattcagctccggggaggacaggcaagggtgcaggttttcgagaatgcattggtaagggccactaaatccgacattccttggtcctccttgtggtcttggaggaccactagtgtttctgctactgtgtcggtgagcacaactattccgatcagcagggtccagggactgttgc

SEQ ID NO: 473586 - DNA, 1286 bp, Homo sapiens
tttctgctgtttgataccattttacccacagtagaatttgtttcaaaatcaatcctttcaaactctatcatggctttatcagctaagtttatgttggaggaggggtcatacaagcactcttgtggcgaccagtaccacactgtaccagtaccatcactaccaacaccagtaccatccaggcactacactgggttgcacctgaagccagtgtggtactgggtcttgtccaaggcctgtggcaactactcttcactgcctggagttggggaagatgtgatgcaggcactacttggccttcatagttggtgtcacactgggtcacctgcaccccaaatgcactgtgtgattcagacaaacctccaggtctcactgaaggactgtagtccaagtagcctgactgccactcacatttattctggccccagacctctttatattcagccagtgggagagccagctaggactcaaattcctcctgctgggtgattgttttaacatgctgttgacttcagttttcctgatatccctgataaacataaaaaacaattttttgcatctatgtttatcagggatgctgggctgtaattcacttttcttgtactgtcctcatctggctttggtatcaggctcccaaaatgtttgcaaattcttagcattgtggtttcccaatgatctcattgttttattctcttgaaatattatgtaagtattcaatatgaccttggaaggaagaaaaaaatagtagtactggctaatgacttgaaccagaaaccttagactatatttagtaatacattttcctcctgatattacctataattggtctatgtcccctgcatattatctcaccaaaacccatagaagggagaaacaataaagctgaacacaataggtatatataaatttttcagtgttatttatgaaaaactgtggcttatccagagtaacacaaaaatcacagagattttttggaaactatgtttgtattagcctctgatactttaaataaagaaacattaaataaaggtgcatgtatataagtgagagtcatgaggatagaagttattattttttaaataatatttacatgtctgtatgtttctctatttaaaactttcagctatgtaaatatgatttaatgaaaaaaatgattagacattcttgaaacttctagtttaagagggaagaaaacagagataaaaaggaaaaaataaaagacgtattactgactatttcttcctttccaattctaacgaatggtatatagtcagttgtggctttacctt

SEQ ID NO: 473587 - DNA, 539 bp, Homo sapiens
tcctctagcagtccctgtatgcgccatcataatgtcatgggtgcaactggctgggaccagcagaaagtatgaagataccttgcgagaaagcagcaggcataacagcagagaaggagctgtctgcaaagaggcaggggctggaggaaagttttatagggtcctgctcctggggctacatgcagaacaagatcatttcaagcaacatctcaaatgtgatcataaacgcaatttcatttcctttaggccatctctggaaaagagtcagctgagtcatggcctgaatcctccagtggaaattaaagcagcatttacagctcctgatgttggccatcaatccttggcattccttttctttggtgtcatcacttctgtatctatttctgacattacatggcattctctctgtgtgtctctgtccatattttcctcttgttatgaggacaccagtcatattgaattggaacccattctgatgactgtatcttacttcttctgcaaacactctagtttcaaataaggccacattctaaagtactggg

SEQ ID NO: 473588 - DNA, 543 bp, Homo sapiens
cgggaacatctcctgagactgtgtgaagagatagaaaatggtagctaagactaaaatgttgctggtgcacattaaagtttttgaagcaagccgtacagctcatctggttctcactcttactttccaaagaaagatactgaggtccagagagaacaaggctaaccttccaggccagtgtcagaaaggcagaactcacttagcatattctgaaatctctcagtttgaagtaaaaagtaaacatctcgtttccattggaagcaagaaacaagttttttttcttcataatggagcattatcgcctataaagaaaaatgaagcaatgctgtttatatgtttaacgtttaaaaaaataaagactgacagtcgccagaatgatgggacaatggataaagagcagacccaaagatttccttccctcctctggactccaccctgcgagtttccccagagaggagaacacagatgtgaatcagagctggcagggtggagctctggaaagccatctcctggctctctcagagcttggatcccaagaggatgact

SEQ ID NO: 473589 - DNA, 567 bp, Homo sapiens
ggacgccgagccgcgcgggaatgagcaggaggagcgccgcccagagctccgctcggccccgagagctggccggcccgagggcgggctccgcccgggagactgaaggagcaaggggtgagctgcgtctggcgcagaccccaggggcacacgctcttcccgggctggaggagcggcctgggcacctcagccgggggagcctctggcttcgagcgagcgcgtctgtcctacccgggccggggcagctcccggaactcgccgcttcgccactgtggtgcattttcagagctgcgcctcggtgggccgagcggtcagcgctgagccgagactgcgcccctccaggcgggctgagcgccttggctgcagagggcaccagctgcggcctccatcaacgcgccgcgggcaaggccctgcgctggcggcctgggcagggcaggttgttgaccagatgtcccagactaaagccgagacaattttctgggataaaaagagagccagacccatttttcctttcgaaagcaaacctcagctcctggccaggaagcttcataaacaagcagtcttagctgt

SEQ ID NO: 473590 - DNA, 968 bp, Homo sapiens
ttgctaagattcatggaccccgtgctaggtgctggacattcagccagttttgtacctcagaaaagcaagggggagagtctcctgcctcacgcggtgtgtgggtggagggctgaatcatcaagttctttgagttccttgggaaaagataactcaaaggaatattacacaacatggagaaataggaggaaaataagcagagacacaaaaatgactcaagtgttgaaaaatatgatccacgcaactaaaaatacattgcaactgagtttgaagaggaaaagactgggtgtcaacattccagtggcccaaatggctgtgcatgaatgggctttggttcgaaggatggtgagcagatggtcaccggcctcacagagaagaaggttgtgcaacagggcctggaggccctctgaagatctgagacaaggggaagaggacaactttaccagggacaagacagcctgagcttcagcaaaacactataaaagagtatccttggttccatatgacccaggcagagggaggagtgatgggttttcaaggactgagaatgcacatatggatagaacaaatctagaaattcaagctacttctattgctaaacaagtatagagtttcatataaatataattcataaaaggtataaacggcaagagtttctacccaaagattttgtgaaacacctggcattctagctacagcagcaaattatggcatcccttagcccctcagagacctctgtcctcagcagatgtgaccgccttcttggatctcagcagtgcaagggttcagtgtgccagcatctctacatctgaggtcttgctgtcttctgcaggccttccagctgctttgagagagaagtgaccaaagtattctcacttttgaagggagtgaaataaaacctggacaaaccaggttctcaaattaaaattcatggatcttcctattttcccaagaagagcctgttttttttc

SEQ ID NO: 473591 - DNA, 972 bp, Homo sapiens
ttccactaggttatggatctccttctccctgagggaggcataagtggcagagaagctgagagatcttaagcagctaacggaaaggagtgaagctgcagaccttcacagtgagtgttacagctcttaaaggtggcgcgtctggggtagctttttcctcccagtgggttcatggtcttgctgacttcaggaatgaagccagagaaccctgtgaatgagcaattactgggtgtcttaagcggcatttcaggacgttcctgtctacataggtatcaccccttctctctgctaatacctaactacatgtttcaggtggtctctgaggcacaagattttccagagcttcctcaccgagagcattccttttctgctcttgtctgcctgcctgctctaaaaattccagaatgtgaggattttaatttgtttgaaggtcaaccagattcctctttatccctcaaggttcagcataaatgtcatgtactctggaaggtcttcttgaattccccaggccagaagaagaagaagaagaagaagaagaagaagaagaagaagaagaaggaggaggaggaggaggaggaggaggaggaagaggaggagggggaggaaggaggaggaggagaaggagaaggggaaagggaagaagaagaggaagaggaagaagaaggaggaggaggaggagaagaagaagaagaagaagaagaaggaggaggaggaggaggaggaggagaagaggaagagaagaagaaggaggaggaggagaagaagaagaagaagaagaaggaggaggaggaggaggaggagaggaagaggaagaagaagaagaggaagaagaagaagaggaagaagaagaggaagaagaagaaagaagaagaagaagaggaagaagaagaagaagaagaagaagaagaagaagaagaagaagaagaagaagaagaagaagaagaataaacaacttgggatcattcactgacactg

SEQ ID NO: 473592 - DNA, 928 bp, Homo sapiens
gcagggtttagcacaaaaggagccttaagatgtcccctacctacaaacaactggctgttcagctgcagtcgaaaatggccctcctccgacgtctccctggtgctccttggaaggttgtccacctgcagggaggtctccttgaggttcctctcagcccggacatagtgccattggttgtcattcagaagagaaggagactggactacaagctccacaggaccattcccaacatcgatggcaaaggaaacaggataggcacctggaccattcatgctcatctgatatacctgcatgaatgccgaggccctggattttctggatctattgtggcttcagctgtgtcctccaggatatctgcagacatgagtggtggtattgatggtggtggtgggcataatgttaatgctgatggtgatggtggtgctgatgggggtggtggtgatggaggtgatgatgatggtgatggtggtggtggtgatgatgatggtggtggtcgtggcaatggtggtgataatggttgtggtgatagtggtggtggtgaggggggtaatggtgatagtgatagtggcagtgctgatggtggtaatggtgatggtagtgatggcactggcagtggtggtgttgatagtggtggtggcagtggtggtgatggcgatggtgatggtaatggtgacagtgatggtgatggtggcagtgctggtgatcaccagtgccacctggcagccctgcacatccccaaatttaaaaacacttaactgagagatgactggaccccacatttacatttttctataaaacacagaataagattggtgagaatttgggtgaggaatgttaaagattttgctaaaagctttcctgcaaggctagtcttgtggataataaattccactgagacaacacatgtttggggagggcttgctgtttc

SEQ ID NO: 473593 - DNA, 661 bp, Homo sapiens
ttttctcctttgtaaagactaaaacagccagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaagagcattactgctcacagataaatcgtggagctctggcaccacccctgctcaagttgaggttctggttcatctacagtccacgttgtatgacactggttgtgtacctcaacctcaagattccgtggtttcctcatctacgagatgtgggaagcgcaggactctttcacagggagtcgtgtttaacattcgatgagcactctacaaagaacatgggacagcccacagcattggatgctcaaggggtgttgttgatagtggctcggtggccttggagaatcatcatggtcactagaaatcacttgcaagttaaatatctttatcctttttggccagtggttttagatgctcagataactcaacccatctgatcaaaagcttaaactcttagattataaagtacaagaaactgaaagaataatagagtccagctgtattgctgaatttagctttatgat

SEQ ID NO: 473594 - DNA, 1262 bp, Homo sapiens
tgctcaggaagagggtccatgaccacatgttttgtcagactgcaatccttgcccaggaaaagctctctgcccacaactaaatgagaccaggtcagaattatgggacaatggggacagtggtggccctaaggacaaacagagagaaagggggagaaatggaaaatgagttcctgcttcctattaatgttaatcttgcacagcaagttcctgagcaggtttcatttgtttgcttgtttgcagcaaagaatttgatggaccagcaacttcgactcagttataacttctctccggaagtagagttcagggttataaggtcactcaccttgggcaaagtcacagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcaggtacactcaagagcatgcacaagggagcttctgtcactagcactactttttgtgtcttcaagaagcttccagattaaagagttggctaatgtgactcagtttttactttgtataataacaggtggctaaaaattatgactgatatttcatgggtgattttatacatatttgatgtagttttatttttaatatgatgagtaattaaaactaaatgcatagttgtgtactttgcttattatgcacgtatataatgcattgtgtatgtgtgtgtgtgtgtttgtatacatagtcactactgttgaagtggatactgctccgagaattgaggtatttagagaacagggaggcagcaagctggtacctgaactaacatgataattcatgtgattaaaataaaccttttttagctttattaagaaataattgacaaataaaaattatatattttcaaagtgtaaattgtaataatctgataaacatgcgcattgtgtaattactatcacaattaaattaatcaacacatcactgcacagttaccctttgtgagtgtgtgtatgtgcatgcacatctgatgaggacacttaagattaactattttagcaaatgtcaagtaaacaatacagtatgaataactgtaatcatcatgctgtacattagttcaccaaaatttgggccaggtgtggtggcttatgcctgaaattgcc

SEQ ID NO: 473595 - DNA, 582 bp, Homo sapiens
tccccagagtgtgatgttccccctcctgtgtccatgtgttctcattgttcagttcccagctatgaaaactgccctgagagagacctgcagtcaggatagcactaggtctcacccaagactcactgtaacaactacaaaggtagcagttatgttcactcaagtccctagggctctacaatcagctggtggtgaagccagccagccttgtgtccttcttttcagggcagcaagtttcctcaggcttcagatgggtccagaggtgctgttcaggagccaggaactgaagtcaaaaaccttagaagtctattttgtgttctgttgtactaaaactgaactggtacttaaaccaaaagattccattctcccactcttctcttccctttccactggcagaggggcttcaccccatggccaccactaccacagccccatggggagtcatgccagatggtttggagatctaaatatcagtgaaggataagataataaatctcttaaatgtaaacataggagaatatcctcatggccacgggttaagggaattttcttaaagggacactaaccatgaaggagaagtgaatg

SEQ ID NO: 473596 - DNA, 724 bp, Homo sapiens
agaaaggaaaaatcaaagaaataccctgcccagagaggaggagtctagagaggcagtctgactacagcagccttgctgagctatggtggggtctgcccagttcaaacttcctggcagctttgtttacactgtgaaggagaaagaggaagaggaggagaagaagagggggaggaggagaatgaagaaggagaatggggaggaggaaggaggaggaagaaaaggaggaggagatgaagagtatggagaggaagaggaagaaggagtggagaaacaggaggaagagagaaggaggaaaaaggaggaggagaggaaaagtagaagtaaatcagagttttcttcttggtttagatctattgctggtgtgttaaagaacctggtttttcgtattaccagaattgttattctggttctttctcatttttgtaggctatgtcagagggaagatctggggctcaaggctgatgttcagattcctttgtcccgtgggatgttttcttgatgtggggtatattatttggaaagaatccaaattattatttttttgattttcagaaatacccagatacaaattgaagagcatcaaaaataatttgtgtccatatacttattttggtgtttaaaattgaactgattatggcattcaataaaaactaatgttaatataataaaaataataatattgtgcaaaagcataaaatagtctgcatttcttcatttttaaatt

SEQ ID NO: 473597 - DNA, 543 bp, Homo sapiens
tgaaagcacaagtgatgcttgtcgggacattaacaagctgctgcttgttctgtgtagcgggcattgagcctctggacagggaagagaaggcagtgcccatgacttgccatgccctgaacttagatgatctcgtttactcctcacaacaaacctcaagtaaaggacccatccccgcaccaccaccaccccaagaggatcttgggtctgaggagctgaccgatcccctcattcaatcctcacagccctaccgagaagcactctcattatccctcccgtacaggattcctgctgatgaatgggtctgtacaattatcggtgacaatatggtgcataccctgagtcctgggctgagcgtggaggcccttcccggcagggaggaaagatggctgcagctctctgttggtaggaaagacggtgagtgcggtgttctgagagccagccttgtagtcacaccgacctgggctcagatcctgcctttctaagtatagagctatgagctgcctcacagcatttctgagcctcagtttccttttctgtaaaatg

SEQ ID NO: 473598 - DNA, 600 bp, Homo sapiens
gtgatactttcttgtaacttactatgaaacgtgataggcagagtaacgccttcccaccttcaaagatgcccaccccttgggagtgtttgggctctgctatgcaggtgagcacaagacctgctggaagcccagagggtgggacgcttaccaagctgggaagaaggctacctggagaagcagatgtcaactgcagttttgaaggatggttaagatccagccaggtgactgatggcaaagacagaggacatagcatgaacaagcatgcagaggaggtggggctgaaagtgaccagccacattcagaagcctcctaggggctgccagccaccagtgttctcattagcatacaacaaaacaatagcaacagcacagtactatatatatttcccaaaatgtacaagtgtgtgcaatgagatgaagaaacaatagagcacttcccctgcaatcagaggaaattagaaagtccccaaagatcaaaaagtcaaaataattaacagattcgttaattcattcaacaaatacttaggaagtctccagcattgtcccattgtggaaaaaaacagaattgaagttcctaccctcaggaagagtatgggcttgc

SEQ ID NO: 473599 - DNA, 1405 bp, Homo sapiens
tgaaagcagctgcaggggtttaccctgcagagccacaggggtggagcagctcaaggcattgggaacccaccgcttgcatcgggtcttgctttgtcacccaggatggagtacagtggcatgatcatagctcatggcagccttgatctcttgggctcaaatggcaacacaagacttctcttccagcgccagtgtgctccttgggaagccttctccagtgccagctctagtgctggctactgtagtacatggcaggcagcagcacatggggctggcaacatgtggagttcctgtttaggaagcttcccgtggtgcccctcaggtggctacacaatgagttctgagccacattgcctccctgtgagtggtttctactggcatcctagagagtggattcccaccggacacctcagtggacttctttaccatctgggcattggcagttaccaagaatctatcaagcattgtattgggcaatttacatgcattttatcctttaatcctggcaataacctctgaatcatgcatcattatccacacttcacatatgaggaaacgaaagctcaaggagattgtgtgacttgcttagtctcatccagtttgtcttatttactattcttcaatatatttaatgcatttatccttataaatgttttatatatttgaaatttattcttatattccatgtaagtcttttgcatatttgaaagctgtttgttgctttttacaaattatgtttttaaaatggtatcttctaacttttcctgttagcatatagaaataaaattcacttttgcataacaattttattttcttgctaaattatcttattaggtttcataatttaactacagttttaacttttctatatgaacaatcaaaatgtttatgaataatgacagtttagttttcttatcttaaatttttttatcatttatttttcttgctttttgtgtaagacctcaaatgaaatattaagtcgaaatgttaatagtgggcatttttatctttttcttgcttcgaataatttaccattaaacatgatgttcactataagtatttgaaaaaatattttatgctgttaataaaattgctgtctattctaacttgctagaattagcagtcaggttgttgttgcttaactttttaaattattacgaatactactaattgtacatatttatgggattcatgtgatttttgttgcaagcatatgatgtgtgacaataaaatcaaggaattataagggctgtaaaaatgtgtgctatggtggaacttggcagggaaaaagtttccatttaaagagcttttcaaatatattttctaaagtttcaaaaaattaggtttgaaactttagtcatgaagttagcaaccatttacatagtccaacaccttttaaccgactgcc

SEQ ID NO: 473600 - DNA, 824 bp, Homo sapiens
ccacggggatcccactgccatagagcagataccaattgatatgatatagattaagccctgcctggaaccagttggcttatctagaaagcatctgagtctcattctcatcttcatctcctccccatccaccttctctttccaccccataacaatatgggggatgcgaggatgaatggaacatccgaacaagtgaagaaggaggcacaatctctcaatcagaggaactacaaatgggaagtagaatttgagctgagccttaaaaaggcgagaatgatttggatagcagaaggaagcaatgactgtaagagctgctgtagtggcacctgccacttttcctccttcactttctccatcatcattatcaacaccctcatcaccaccctcaacattactattatcaccatcatcacaaccaccaaactcacaaccatcaactccaacatcacctccatcattaccatcatcatcaccataatcaccatcatcatcaccaccatcaccaccattatcaccatcatcaccatcaataccattatcaccgtcagcaccatcatcaccatcattatcaacgccatcatcaccatcatgaccatcatcatcatcatcaccattatcgtcatcattgctatcatcatcatcttcttcatcctaaagataatcccattgctcagcaatgagtaatacctatcctttcagtttgttcctggtggcattgagtttgcattaattcattcaaaaatcctcactcacttcctaaccaataattttattcaacaaagggtgataattatttggtgtaaaaaataataatcatcatttcattt

SEQ ID NO: 473601 - DNA, 629 bp, Homo sapiens
ttaggagaaatacctaatgttatgcaagaccagggagttccaacttgcaaactgaagtttggcaaacccagtacaatttctaggatagctctaagcacagcacacctgcctgtaccttcacctgaatgcatactttgcctagtccactcactcaaactttgtagggatgacaaccaggacttggatgccttcaaatccaaaacagggctttttgcttatggaattccctacgtgcatactcatgggcattaccacataggtgcaggtggcccttgcctgagactgaaaaatcccactgatgctccctggatgggacaaacagagcacctcccatttttgctgggcaagagaggaaaggtcaactccccagttggccttgatgccactaacatggcagcggattcagggctttgcctgctctagacagggctactcttttcagaaataattttatttgaaatgtttccatttcccaataactgtgttttccatctccattctatgctttgaaatgtgtcagatatttcctgagatttaaaatgctcttactcaaggttatgtgatagtacaggataacttaaatgagagcattaccacaaaataaggtgttattgaaatcttacatctcc

SEQ ID NO: 473602 - DNA, 563 bp, Homo sapiens
aatatgaagttaataccagaaagtggaggtaactgatatgattgaactagaacagagattagtggattccaaaaactgcctcgccttcctcatcgagtatgtcaacttttctccagcagacatgaggctaaataatagtgttttccagtggtatggaaggatgggagaaatttttgaagaacacaggaaaatcattgaagagaaaatagaacaatatcaagaaggtctgaagttacggtgtgaacggtttgtggaggaattggagagttatgctaagcaatcagaagaattttattcatttggagatcttcaggatgttcagcggtacctaaaaaaggctcaaatactgaatggaaagttggatttagctgcagataagaggaagctggaggaaaaagagccataccctttgccatataagatatttacagagtttaattgtattttatatgaaaaggagaatgaaaacatatgattaactatgatgctctatcatttttcttacattgaaagatcttaatatcttattagttcaggtaattgttttataataatcacaaata

SEQ ID NO: 473603 - DNA, 685 bp, Homo sapiens
agcacatacacatacatccaagtcgcacatattcagtatcatctgtgtatagatattaacgtgctggctgatggagcagaagggttgtgggttacagggcctgactcaaaggcaatgtgggcagatgcccacaggtagccacttctgtctggctacagctgtctacactgcacctttgcaaattagaaaatggtgcctgtgggtggggtatggccagctcataggccagctcctgcatgcagagccccaggtgggcagtgtgtgcctgggtgcagggcctgctgaatggagatgcaatagggctgcatatcagccccatcggccccctggcagctcttgcgggaaggactgggaaccgctgtcagcatcaggcccagactggaatgggaaggaggggaagcaagcaggcatatccaaagccagctcctatcctcatagtctccatgaacagccatcacgcatctgggctcttgctcaccttgtccctcagcctgacaccttccttcccatcagctggcccatgcctttccagttccctggaggagcatccctccaattccttttttaaaaatccattcaccctattttttatgatgataaaacatatatataacataaaatttaccagtttcatcctttttaactgtacagctcagtggcattaatcacattcacattgttgtgc

SEQ ID NO: 473604 - DNA, 680 bp, Homo sapiens
agagcaaacagacacgggctccgtggggtccctgtggctgagaggtgggcatggcggcatgtctgggaagtccctgtggggtgtggagtcactgagaccatcaaatgggctgtatctgcctgtcccacagggaaatggtcaccaggaggtgggtgtacaaggcagatatctgggttggccgcattgaggaactgggagggggtggagccctagacaccgtgtcaagagcaataaaccctgcttctggtaggagagggtccaaattagattcaaaatgcacgcacacgcacaattataagaattctttacacagcggcaactctttggtgctctgcactgaccgtgagggccccaggggaagaagcgccacggtggagaacacagtgaacgcctgtggacccggcaccagcgaccaccacagtggcctccatggagatgttgagttgtcccgggggctaggagctcgctggctccccaagggacaaggaggcatctctgactccagctggatacctcctaagaatgtgccttaagtccttgcatttttagcaaagatatttgagacattttgggaactctccatagaagccaccagaccctccctgtgccccttcattcatccatctgtttgtccatccacccatctaacatttgttgattaagaccctgctatgcactga

SEQ ID NO: 473605 - DNA, 838 bp, Homo sapiens
gaaaagtcagcctccccggggcacgcaggactccccctcctaagcccagaccacaatcctgcccctgccactccccatccacacagagcatccttcccaggctcacccccatgggctcgctgccatcgggtcctgggccatgagccacgaggttcagagggagaggggccagcgtggcctgggcaagtacccttggtcaccaatggaccagcgcccaccactgccctcggtcaccactggacctggcatacaccactgtgtccccacagctaactgtgactacctgaggactgacaccctcgcatggagcccagccctctgcagatgcgggcgccaggtcctggatgatgggggccccactcctcgagggctaggactcagcttgcagctggtccagcagtcaggccactcaggggctgctcctagtcaaggtctccaatgccttccaacagatgatgccacacgtggccagctccaactccagctcctcgcggggagcacaggtttctgtaccacctgcagcccacagccaggtgccaccttcccctgtgccaaccagtaccccagcatggacaggaatggggcagagagtcctctggggggaacatcaaaataccctagtatgttagtgactcggccagtcagcaatgtgctgctctgagggctgttgggggatggaggaagaagttgggagcaggggatgaggaggagcctggggggacccagtgtttccacccacaccagagcccccgcagcagatgccagcccactaggacctggtgggcccagaggtgtgcagagggagcaggtggcaccatgtggccccaccacctacgtt

SEQ ID NO: 473606 - DNA, 1382 bp, Homo sapiens
tcatcagttaaggcaggaacaggccattttcatttcttttgcggtggaatgtcatcagttaaggcaggaaccggccatctggatgtattctaatttatatgtctgtcatttcagccttttcaccctgtttatgaaccattgctggggcactagtgcaattgtttggaggtgttccaaatctgctggctacaacactcttacaggaggtcctggccaaagcactgatgtggtggcagtggggtctgcacttacacaaggtgcaagtagtagcagtggcacagcagagtgcatgtggggcagtgggccagggtgtcagtggaggcagaagggggtgtccatgcatgcatactggcaaaagcagcagcactgtgaggtgtatgcatgtgtcagtgtgggtggggtattggtgttcctgcgggggcaggttgctgatggggttggggggtcagcaggatgcacatgtgctgatacaacagtggagggctgcaggcaagtgcacaccagcaaagcggtggggggaggctgcaattagtggggctgtggatcatttgtttacattaaaatttatgaatttgtcattttctaaacatcctacagtcattttgcattattcttttaccctcactggcatgtgccaacactcagcaatttatttcatttgaaaatctttataaataaaatacaacaccaatccactcaaatataaatgtgcaagagtgtatgctaacctttgtttgtttagtttagtgggtacatgattctgtttcatggagagaacagaacaatcaggatatgattcttaggacacaggacctctggaatatagcagcatgattaagagtgtgccctctggagcctgattacctaggtcttcatcctggctactgcccttaccagcaaacttgtataagttttttttctgtattttaatttcctcatgtgaaataggggcaattcaatattaatactttgatacatataaaatacttcaaatacttactagtatgcagtaaacattcaataaatgttagttcccattattaagtatgggttagaaaaataatctaggaatgaatttaaagcacatgatcagattgctggcaataaacacttcagttttccagtttcctggaacaactcatgaatacaattcacttgtgggagtatttcattcagggaaagaaatgtctttgaaaaaaatcattgaccccttgtttttcaaggccttgagtttagagacagagaaacatttaataggggcctacatcccatggcagtgtctttgttataaaaattatacggaaaaaacacaggtagcaaaaccacatattccttttcttagagacactacaaggcttagagagggatcaataatggtctgt

SEQ ID NO: 473607 - DNA, 751 bp, Homo sapiens
ggctctctgtaaaatggaccaatcagcaggatgtggcaatggggaacgctcacggactgtgcggtaatgagagatccaaacaccaagcgctccaggggctttggttttgtcacacatgccactgcagaagaggtggatgcagtcatgaatacaaggccacacaaggtggatggaagagttgtggaaccaaagagacctgtctcaagagaagattatcaaagatcagataatatttttgaactgtatggaaaaattaaagggattgaaatcattactgaccaagacagtggcaagaaaaggggctttgcgcttgtaaactttgacgaccataccgttactgggaatgaccacaactatgaagttaggaaagccctgtcaaagcaagagatagctagtgcttcatccagccaaagaggtcgaagtagttctggaaactttgatagtggtcttggagttggtttcagtgggaatgacaactttggttatggaggaaacttcagtggtcttggtggctttggtggcagctgtggtggtggtggatatggtggcagtggggttggcgataatggatttggtaatgatggaagcaattttggagatggtagaagctacaatatatttggcagttacaacaataggtcttcaaattttggacctatgaagggaggaaactttggaggcagaagttctggcctctatggtggtggaggccaatcctttgacaaaccatgaaaccaaggttgctatggcg

SEQ ID NO: 473608 - DNA, 1777 bp, Homo sapiens
gaaagcctgcagagaccaatttgaggcacatctgtaaatggataatggacatggaatcagcatggaagatcatctcccgtttcatcttgcatcatgtatgtgaagactttggagtgatagcagcaacctttcatcccaagcccattcctgggacctggaatgatgcaggctgccacactaacttcagcaccaaggccatgtgggaggagaaaggtgtgaagtacattgaggaggccatcgagaaaataagcaagcggcaccaataccacatccgtgcctatgattccaagaggggcctggaaaatgtctggttcctaactgaattccatgaaactgatggcagaagtgacccatctggagcagatgctgccataatgccagctgcagttggggaagcaccacctgggctctgtgctccatggagcaggtgggagccaaaaacaggtgaagctgtagcctcccagccacagctgaggacccaggcatccctgtgctctcgggaacctgggaagcctccccttcccccagactgcttctgctacctggcctctcctggctcctggtgcccactccgattttggagcaaagttgatgctgagcccaggcacagttgcgacctgacgatggaatatgtgcagggccttggattgaatggttctgctaaagttctctatttttggaatccactaaatgacttctatgaattttcctatcactttgcactgggttagatttttttgtatatttagtatattttttaattgatattcaaacatttgtgagtggtaaatttcattctaaattcaaattgttaagtacctaaatgtatcttggtatcgatctatttgcttttaaactttttcatttactttagaacactttaaactgtaggaggaaaaaaaagagtaatttcttctcccatcataaggttcatgactgacattccacaacaaagacagattaacgagagcataaaaatgtatttaatataagttttatgtgatatgcatgggagactccagaaacgaagatccaaagacccaggataaactgtacttttatggacagtcatgcagaaatatgattgaaaaatagatgggtacgatccagtttaggataataaaatggagaaaatgttgtgaaacccattcatttagattcttctgggtgttccctgtgacattctttccattagggtgcagggcaagatacctatcatatgaaggtcttcaggagaaaatggagggggaaattcagacagaggccttcttacattgtgatttctaaacttccttcagcttaaagtactcagtctgccaaggtgtcatattttgttctaaatgccaacaaactcttattacacatttcaggtttgaaaagacctcctgttagacttccattactctagtgtttcattctttttactctatttgcctcttctcaggagaaataacgtaatagtctagtatgtaatatatttacagaggtatctttaaagtttcatgaattaagggttaataaccaataccacagtaatgcatcacttgttatataatatttgcctgatttagtcacttaacatttaatgagtaaccactggatatgtatgctagttatgtatccaagtatatagtatggatttctggagtcacagaacagttttgaaaaataatttgcgggaaatggtgaccttttctgacattactcaaagcctatcaacaaagccatagccaaccactaggactgacagaaaaacactctcattttactgtttacc

SEQ ID NO: 473609 - DNA, 538 bp, Homo sapiens
tcatcatcagccggttttggtgtctgaggttttccagaatgtgtgccttagacataaataccagatgtggggcttgtcacttcagcatccacacccaagaactgatctctagaccacatttagaaagcactttcaaaatgcagtctcattctcttctggcctataaagtttctgctgaaaagtttgttgctggcctctggtcagctggtgtggtgcaggtgatggcagtagcagtagtggagcaacccacggggacccaagcagtacatggtagtgtatgtataggagagcctggttttattgttcttcctcagccaggtggacatgaactcagcctgaggacagggtgcaacccagccctactctctcaaaatggctccttggatcagaaagtggggagagtggaacccctcccagacaagcagtgtggggagaaagctgtggggtgtgtggtcaccccacatctcagtctcacagaagcccattgtagggctgtgagtattgtcctagatgtgtaagagagtctggttatctgttc

SEQ ID NO: 473610 - DNA, 863 bp, Homo sapiens
cccataagcagaatgacacaagcttggaagaagcaggggaccttctacaggaaaacagtgggaaattgtctagaaatagcattgagcagctatcagagaatgtgcaagaatgatctgtctcaagatgtgagggaagcagaggggataccccaggagaaagccacatttgatgtaaggcaagaaggggctaccataatggatgacacagatctaagacttctggacatcttgcagaacatcacatttatccattacatcaatgacatcatgttgaccgggctggaagaagaagaggtaggtggcatactgaaagctatgatggaagtggtgcatcccgggttgggcatgaacaggaccagaggacacaagcaagtacctgagcaggtagcccagatccctgtggcatccactactattgcattagtgattatcccttggctcatgcctaggactgtgtgtgggatctcatgcaagcagttgaggaaagaggaaaaaggctgatcttgctgaccaatgggtcaacctgttacatgggtaaaaaccaaaaatggacagccaccttattacagcctggaggtatccttgaaaaacagcagtgggagaaaattctcttaattgtaagagctttggataatacacttggccatctattttgtatgaaaaaagaaaaggtttaatacatatggcctcacaggcagcagcaaatagaaacagactggaagatcaataacgaagtctgggttgataacatgtgcatggacaaatgcgaattgtcatgaagtgtgaagatttttatagcacatgttgtacccaccagagatcaccaaaagaagaggcactaaaaaaccaaataggcaaaatga

SEQ ID NO: 473611 - DNA, 818 bp, Homo sapiens
gcaccttcttcagtgcctgctatggtggagcctcagcaatggtgggtgcccctcccccagctttgctgccaccttgcagtttgatctcaaactgctgtgctagcagtgagcgaggctccgtgggcgtgggaccctctgaaccatgcacaggatataatctcctggtgtgccatttggtaagaccattggaaaagcacagtatttgggtgggagtgacccgattttccaggtgccttttgtcacagtgttgcttggctaggaaagggaattccctgaccccttgtgcttcctatgtgaggcaatgcctcaccctgcttcggctcatgcttggtgcgctgcacccgctgtccgacaagccccaatcccagaatggtagatctattgacaggttgcattgtacaccaggaaaagccaccggcatccaacgccagcccatgaaagcagctgtgggggctgtgccctgcacaggaacggagctgcccaaggctttgggaccccacctcttgcatcagcatgccctgtatgcaagacatggagacaaaggagattattttggagctttaagatttaatggctgccctgccaaaataatcatctttgacttaatggggcctgtagcaactttgttttggccaatttctcccatttggaataagaatatttacccatacctgtacccccattgcatcttggaagtaactaacttgttttttgattttacaggatcataggtggaagggacttgccttgtctcagatgggactttggactatggacttttgaattaatgctgaaatgagttaagactggggaactgt

SEQ ID NO: 473612 - DNA, 772 bp, Homo sapiens
gttaactttgctgaaattgtttaaaccacggtgacagcagaggagcctcaccccgtagccaccatgaccccagaccacaaagagtactaccagattaccgccatccagaagaaaggggtttcttttggagccttgagctatgcagcctggtttagaggaggggtgatgccagcattcccttggcttccccagctggtgtctcagtatgtcacgtgtcccctcagtccactgtctctggacctagttcagcactgggactcacctaatagttgcagtccttttggcctagactgcctttcaagtttacttggtgatacagcgtgctgtagccctcggtgttcacataaagaaaacaaaggtaaacttaagattctgcttgtaaggtccaaactgtctacttgcgaagacaaaacgtacagagcagagaatgttttacccaaagagagcttctttgtggcaaatttctcacaatcttaaaggtccagggctacagaaattggtattttcttcaagagagagctctagtgaggggcttaggagggcagttgttgtagataggttaacttggttaatattggatcagctgcttgtgagcagtgtgaccatgcatacattcactttctttcctttatctcccatacattcagatctttatgtttagtaagcatggatttacaaacctgagaatcctctgaatctttaaacattcatatataaaatagaacttaattttcaactgctatctccccacaaactatccagaacaggtctt

SEQ ID NO: 473613 - DNA, 1902 bp, Homo sapiens
ctatcaaggctgctgaaagcaggtgagttggcagaatctgctcagtgaatgtcagtctctgagcagatgggaagaactgaggatgaatttgtccacttaaatgggaatggaagcttaagaatcaagatatttgaaggctctgtcaagggtgtggaggagaaaaagaccgagtgtctgtccttaataatcttcctctggctattgctggatgatgatgatgatgatgatgacgatgatggcaacgatgactattacagcagagtctttcatgacaggaagttcgcagcctttaagggggatgctggctctgcccagaactggcgtagctcctgcatgaactttggcttggactgctgtccctggagtcagctgtcggctgtggcgctgctccaaaccttcactctgctgggtatcttcctgatggagctccctggggccagtgcccagagggagtcctggggccactgctgcacagaatgtgagccagagtagtgggcatcactgattttcctgatccaactatggcctggaaaggctgcgggagacagaggctctccatctcagagctttgtccattgaaatgctagtgttctgatgatccagacagcatgggaagagttaggaccaactggagttttactggatgtgtcaatgaaagtaaatgtggcatgtatttagaagaagtgtgcacgcatgtgtgagcgtgtgtgcctgtgtctgtgtgtagatctgtgcaagtatgggtctgtatgaaaacacccccaaagattagtattttaatatgtaaatctggaagaaaacactgagctacagctttagttgaaatattttcttaactactgtactgtaatgaggaaagtacttgacaaaagaataaaacatgaagtccagtttccttttgacaggtccatcgccgcaccccaaagtctgcttcccatcctgtctcactgccctgggcacccacgttcacacgtgctgagccacaggcagatggggcgtggctggctcctcggggcccgcgcaggcccagggggcagcagctgtgcctttgctccgctccacttagctctacaattaggagaactgctctccgtgacttttaaactttgagggtgaagggcatgatgccaattttcggggtgtgggcatttctgtgaatgagcaggagacagttggggagctataaacgtgcatattacgaagcagcatggagcagccgggtctcaaaggctgatgtttttctcatatcccacggttttatggctccatacctttaaatattcatttccattgctctacacgaggacataaagtcagactgtgctctcacaagtcctggtaggtgcccatctctgcagtccttacagtggcttccttaggagagctgggcagagtcttatcatcccccaactctgcagaaagagggacaactccaagccgaaagagctggcctggcagcccctcggagggtgacacaatcgagtcagcctgccagtgtcctctgctaagggtcacctctacatactcttctccttattcttctgctatcagacctggttaatgcattctatgtatacgtctgtgggtaactcataagggaagaattagacacccctctatgtttacaaacccagttcttgccacagcttctgaaatatcctggatgttcaactactatttgttgaactaatgaatgattctcctttttggtgacttatatgttcttcagtgactggagctttcacatatacacaatatcaggttgtgaataaaatatgcaatgggaagacacaggaagctacactgtcaggtgaagttaccaagttatttgttcacttcttcactcacttccagtccccagagcctggctttcttcctcgacatgaggcctgcagcttagag

SEQ ID NO: 473614 - DNA, 802 bp, Homo sapiens
gtctagaagaactgtaacactcactgtgagggtccgtggctttattcttgaagtcacttgccattagagttatgttccatctgaagctctctgagatcatttccggaggaaagaaatgcacaaggggccgccgtgttgaaatctacacagtgagaaggtggttgtctgcaagccagaaaaagcgccctcaccagaacccaaccatgctggcaccctgggctcagtcttcaagcttccagaacagagagactagtcacagctccagggttctgcaggccatagcatcagcactaccccaggccacacagctggctgtgatgattgatgtaggagtcccctgtgagtctagcagtccagagagaaaaccaggcagatgggaagacatcattaatcattgtaacattttctgtactaacaagattttaaactggaagttttcaccacaaacactgaatccaaaggaaggtcatcaaaagacaagggctatagaacacaagaggaaattggcagaggttcaattaaagaggacattgggtcctgtggaaggatgtagggactcacccacaggacttagtgaaaatgacaacagcaacattttaaaacctgcgcagcagcaagcaaataaggaggacaaccacagttgcacatttccaaaagtggcagctaagaagagaaacagaacttgaaaatggtgactaatatctcttaatgaagtaaagcagtctaaggtttacttaaggacctgagagaataccatcttctttttcattttcttaatgtgggatataggaaatgctgccag

SEQ ID NO: 473615 - DNA, 631 bp, Homo sapiens
gagagtgagcgagggctgccagcacactgtcacctctcacttatcatatgtacttaccataaatggagctagcagtactagaagttgctgtggaaaagaaaaaggaacctgaatctctgaatctgaatctgacaaagtttctggaacctaagcagcagtttcaaggaagtgaaaggtttaaagacttatacaatgcagggatgaaatcagaagaatctagttgtgaaaaattctacaaggccaatggcctagtttcttcaacaaataaattaaaggaagtggaatactacaaagggccattaagtcttttgtttcattgttatgagctccccacagtgagtgaccaatccttctgtttgcctaggagagccccagattatctgtttattcggaataattactactgtagcccctgtcactctcaaaagtgtcctgatttgtatgattattgtacacagtcacactacccatcagcctgtatcactgtgcaaacacacagccaaactatcttacatccaactgtgtatattgaatttgtgtaaagattatgagagagtaacaatcctaattagtgtgtcctagtttcccactgtgttagacagtttgggttaccataacaaagtaccacaga

SEQ ID NO: 473616 - DNA, 1344 bp, Homo sapiens
ttttggaagactggatattgttccagtggggtgtgagatcctctggccttaagtcgctcctctttgctcctctttgtctcccaagccaggcttatccgcaggtttcaaagtggggaacctgaacttgtgatgagcgagctcatggcaggcatgcaggcaccctgggctcctttgcacacactccctcgcttgggcctgcggtggctccaggaagcaggtgctcttgtcatccccaatttgtagatgaggaaaccacaggtcagagaggttaaacaattgctcaagtcacacagctgagtcccctgtgaggtgaggggagtgcagaggattcgcgtggcctgggacttgccatggcgtgtgggaataggcagtggtcagctggggacactgaccacactagcagagctgctgccagtggcccccaaggcgggggtgagttccccaagaagaccctgcgattcattcagctgtttttcattgacaccatcatcatcatcgtcatcactgttaatacaaatgctgggagcagcccacatagccgcctgcaagaggcctgtgtacccaccctgggcatacctcctccagagccagaggggtgcctggtgtgggtcagtgctccccaccagaccagtgcctccgacccaagtcagtgcctcccacccaggccagtgccccccacccaagtcaatgcctcccacctaggccagtgtccccaacccagtcagtgcccccaacctgggtcagtaccctctacccaggccagccccatcccaccaggccagtgtcccccaccctggtcagtgccttccactgggccaatgccccccattctgcccatgccccccaactgggtcagtgctcctcaccaggacagtgcccccgacctgggccagttcgccccacccaggccaataccctccacatgggtcagtgcccacaaccatgtcaatgctccccacccagatgtgtgttccccccccaccaccagactagtgcccctcaaccaggccagtgccccaggcagccttgggtttgcgcctcagctggtgacagctgaggctgccctgcaggaggatgagccccggggtcctcagggagtgccagctgaaaggggtgtcagtcaaatgctcctcggagcacacccgttccgtgctccctctggccaggccttccctggctcctgtgggtccagaagagatgcagtctgccagatgcagaccccaggaagtgtcagcagtggggccgggatgaggggtggatagaggggtgccacgtgtgtgtttgcattccaccctgcgatgttgttctgacccctgtgtgtccctgcctccaacccctgcgcat

SEQ ID NO: 473617 - DNA, 4061 bp, Homo sapiens
gctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccgcggccgcgggcagcaccgccggcagtctgcgggagctggcgaccagcaggaccgcgccggcggcaaaggtgagtatctgtctcggcggaagtggccacggcacgtgggagtgtgtgggtgggtgcttgggcgtggggggcagtgatgaggtgcggaggagaccacgggtggtcctgcgttggcccactccgctgttgctcttcctccaacttcgcttgcttggtggcggcatccggcccctgggcagctcgccgcttgttcacgtgtgtcccatcctcctgtggagtgggcacgccttcctgtcccgtcgctcacccccgattccttggccggacttgttaccctgcctcttaaacttagcatcgcccttgcgtctccctagaaacggggaccttcttcctctgggtccccagacactccctctgcacaccctgggcctgcctagagaaaagttagcccttaacgtttctgacagggctctgatggctgctctgggaagcccgcgggcctcctgcctgcggtgtggctaaggaggggagggcagaaggcagagtgggactggggtttggaggaatgcttctagtagtctggaaggagttaatctggaggccccaggagccttttgacccagcccttttggacttggcagtgtctaaccagaagccaaggtcttctcctgggctcccaggcagggttgcattcccacgggggtcatttatatttattattattatttttggtacagccgcattttagggccttcgctgcttctgttttagacgaaagatcttctctggatggcttcaatgatttggttttaaaagcttcttacagcttcttattacacacccttgccaccttgtgaacagttaccaggagagagggcatgggatgctggtttaaatgagaaaagaaaggacccgggttttgttaatttctttaaatggagaaaagcacttaaatgttaaaaaaaatacattatctattggaataatcatttgctttagaaacacaactttattcctctacttttgaccatttaaggagttggtgatgcctagtccttccactatgtgtaatcctgaaatgctgggaacattctagcacctggattaggcagtactgcaaatctctaaggttaaggttaggaacttaaacccttggatgttgagcttgagttaaatgccatactttgctgcaatgggtttttttttctatggatcaggaagaatggggacagtcaaggatagtcactgggggtcacttggggggcactgctgaaggggaatttttttctttggttttaattgtgattaaatccagctaaatgcttgcgttagaaattttcaaacttttccttcctggccttgctgtttttgatgtaaggtatttataattaaatatctttatttgcagaataagtgggttaccttcttctgttctgataaattatgtgatattcggagccccgcttctagtaaaacgctgggacattctgatgaccatctgtttacagatgtcctctcagtttatcttgggggactttgtgtttgaccaggaggttaggaggtaacctctgacatgtgacaggctgaagctttgatgccactccgggaattctgtggcatttgtagtaccttttagaacttgtcaaaggggttgaagcttggaactttttagtagtgacatttagtattagcaggaaattgatgttttactcaccatatgttgagacccttggttgactttctttatgggtgcatagtcatgttcatgactttttgtgtttttgggatgtttctggatgttgtttaatagacgagcacttatttaactaataagcaggagtcccgcatggtgtattcacactacactagcactatactaccatgctgggataatagcattaggtccagcacatgcttcgggagtgggaaggattgtaatagcatatcaggcattgagcaaccctatacagttggttgacaaagatttcggctgaaaattacttttggtactttactgtccattggaattgcttgactcctgccaggaaagttgaatgctggatgttgttgcatgttgtttaatagaggggcacttatttaactaatatgccatgatagcaggtaaccataaatattacagtcccatcattttccaattagaagctccttacatcttcttttgggccaattagggtatgtatactttttaggtatataggtaagtattggcatagcttgtttactttattaattttgttacggttcaatattttgacagctttatttaaaaaaaagttttaatttctgtttggttttactggcaggacacaaaacagtgttttcctgaactctttacctgttgtttttcatcggttttggtgatcaccagagtacttggagtcccctgacgtggttagcagaacctctcagctctgctctcacctgagccatttgagataaagcgcttttgtggagtcagttaacgatgctgcccctggaaataatatacccagtgacgagtacccatagcctaagatcaggagttggtctttttatttgcctgttggcaaatactatatgtgtgttgcttcttaaagtgtgttcatatgtgttacttcttgaagtgacctttaaacagtcctgttttaatggtactgtctaacccttgcagttgctaatgtatgctaaatttctcaggctaacttgtttgtttattgttttgttttcactattttgcaagaaaatccctttaacatcccaagctagcatcaatcaaattgtttcagtgcagtgggagtcttgctaaaagagttttgtggttccacattgagtaattcaaaacatgctttttaatgtaagtgatttaataaggacttgaatatcagacaattccaattttgttttgaaaattttttaaatccttgacttatatttgagcctatacagaacatcttctgcagttcatgtagactcggctaggcactattataggtaaacaagactggcttgggctttctggatggagctgacagtagaggtagtgagtggttgcaagctgtctgcccagctctcagaagaacgagtgatgttaataattaattcagtccacacatatgtactgactgcccaccctgttgcaaatactgtgttaagcactggaatatacattgttcacaaaaccagaagtgatccaggcctttctgcaactgaccattcagaggacactgtaaacaaatagccaataggtatctcttgacatgtggtaataagagacatgaagacaaggggccacagcctgatgatggcaggggacgtggagtcatgggtgatgtctgtggatttaattatgcagcttattttatttatcaaaatgtatccacatctttactcttttatggataagccactggattccttaactctttataatcatatcccaaatctgcgtaacttaaaaattgcatcctattttctcttcccaagcacagccaaaggtaattaaaaccagatgtgtttgcatgagaaaatgc

SEQ ID NO: 473618 - DNA, 555 bp, Homo sapiens
ggtagggatgctctgcctggtgggtgcgggacaccacggctgggagcagccccttggcaaggtcctgtccaactgccccgcacagggtgtcagtgcactgcggagatgcaggtggtggggttcaggacacagtcacgttgaacctgctcagaagttccctgagagcagaatcgcatcggcgtttgtgcaggacatcaggtggtttgacactttgtctcacaacacacaaatgctcagcattgtgttccggttgtctccaggattcagtagtcacgagctgtgcagttcacatctctggggagagacaaggaagctcgtgacactagaacgaggtctggtaggtttgcctctggaattccgagtgacctgggacaagtcattctgtccagtgagaagacaagtatttctacaaggagctcgctgacccccacccccacccctaccaggaagccccacaaggcatcattatgaccccaccttacagctcaggcacagggaaattccaaaccacccagaggcagttaggcttaggtccagtcccagggcccctgttaa

SEQ ID NO: 473619 - DNA, 1838 bp, Homo sapiens
cagcactgctcttacaccagagtcactcagctctggaagcctctttgcatccccatggcagcagctccgcatgtcctgcacagggagtgctccacgcctgcacaggagctgcatcaacaggagggaacgtccctgcacagggagtgctccacacctgcatgggagctgcatcaacaggagggaacgtccctgcacagggagtgctccacgcctgcatgggagctgcatcaacaggagggaacgtccctgcacagggagtgctccacgcctgcatgggagctgcatcaacaggagggaatgtcctcacgcaaggagtgctcgacacctgtgtgggggctgcatcaaaaggaggaaacattccccacatagggagtgctccacgcctgcacaggagctgcatcaacaggagggaacatccctgcacagggagtgctccacacctgcatgggagctgcatcaacaggagggaacgtccctgcacagggagtgctccacacctgcatgggagctgcatcaacaggagggaacgtccctgcacagggagtgctccacacctgcatgggagctgcatcaacaggagggaacgtccctgcacagggagtgctccacgcctgcatgggagctgcatcaacaggagggaacgtccctgcacagggagtgctccacgcctgcatgggagctgcatcaacaggagggaatgtcctcatgcaaggaaaatggaaatctctcagtggttcctttgtgggagagcatgctgaagggacttgagggtggcctggagaaccaggccctgctctttgctgtgttcccaggtctatacatggtgaccatcccgggaaacctcaccatgaccatggtcatcatcctggacacgcacctgcacttcccagtgaacttcttcctcaggagcctcccccttcctggaccttggccatgcctccatcaccccaatgccctggttaacttctcttcctcgtccaaggtcgtcacctttgcaggctgtgctgcccggttctttttctccttgctgtctaccactgagactttcctgctggccgtgatggcctatgactgcttcgtggccatctgtagtctggtgtggtgcccagtgaccacgtgcctctcgatctgcatcatcctgggaccaggcacctactgcagggtctgcctcagctccatcgtgcagaccggcctcatgttccagctcccttctgcagggaccaaccacattgaccactctgtgacatgccccagctgctccggctggcctccagggactatggagtccatggagcagggcaaggtggtgtctgtcttctacagcctggtcatcccgatgcttggccccttcatctacagcctacgaaacaaggacatgaaggaggccctgcggaggctgggccagagacaagcactcatgggaaggatgctcatcttccacagcatcctcaaataggtctgtttaaaatagtaacttacctctcgctttccctccatgctgccccccacccccaaggttctcccaacaagcccccgggtgccatctggaaaccacctggctgaatacacacctccccctcctccccactctccttctccttcccctcctccttctcctctcttcctcctcccatcctcctctcctctcctcctctcctctcctcctcccctcctcctctcttcctcctcccatcctcctctcctctcctcctcccctcctcctctcttctcctcctcaccttcctcaggctccaggccaggctgtggctctgctgcatgccgctgtgccccactgaccacctctagatgtacttcttggctcacctggcaaggaagac

SEQ ID NO: 473620 - DNA, 884 bp, Homo sapiens
ccaggagatgctgtcctggactgtgttgattgcccttcagccatgaggtggtgcttgcaaaagagcagcagtgggatttcagtagcccctgtgcgtttcggggcacgggagcggtcctcaggccacggggttgacattccagggggagcgctgctgtctctgcagcacagaaaagtttgtgcagggcgtggggagtggcaggcggtggctagccccacagttcccacgcacttggagagtcggatccactcccacacaaccgccgccttcaagccacgcccctccctgtctgctgcaaaggtgggcgtccagcccctgcacccgcgggccctgcgcccgaggctcctgcaccggccgtccctgcaccctggcccctgcatccaaggctcccgcacccggggcttttgcacctggggctcctgcatccgcggcacctgcacccaaggctcctgcaccggggttcctgcacccggggcccctgaacccgagactcctgcacccgcagctcctgcaccaggggcccctgcacccgggacgcctgcacccacggcccctgcaccaaaagctcctgcacccgggacccctgcaccaaaggctcccgaaccttgaaacctgctttttactctctcccacctggggttatgtcgtgaaacgcccccattgggagcttctttgaacctgagaccacgcctgaagttcttggctgtccgcagggtcccctgtgaggaacagtagggaacgactgatcttggtctgcctgggctctgggagtgcaggagaggtcttcccaacgcagctcctgcttttatatcccaccaccctccccaagtcagttcctgctccgggtggggttagggccttccttcttgtcctcctggactttc

SEQ ID NO: 473621 - DNA, 2006 bp, Homo sapiens
aggagcctggtgttcaccaaaggggagacttgagacaaaaagaggacagagccccaagagctcacatgtatggtgggtaacatcagagccccgagagctcccaggtgtggcgggcagatcaggacccgagagctcccaggcatggtgggcagatcaggacccccagagctcccaggcgtggcaggcagatcagagccccgagagcttcctgcatggcaggcggatcaggacccccagagctaacaggtgtggcgggcagatcaggacccgagagctcccaggcgtggcgggcaggtcaggacccgagagctcccaggcgtggcaggcagatcaggacccgagggctcacaggtgtggcaggcagcatggactcgtctggcaattaaggtgggggtagagtgggttgagcaggagagggcatcgggcttgggtttggcttgctcccagtgaagcctggtggtgccttggccacatgcatgcctgttcatccacagctcttcatccacggcccttcatccacggcttttcattcacaacttttcttcaacagctcttcccccacggctcatccacggctcttcacccatggcccttcatccacggctcttcacccatggcccttcatccacggctcttcacccacggcccttcatccacggctcttcacccatgtcccttcacccacggctcttcacccatgtcccttcatccacggctcttcacccacagtccttcatccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcctccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcacccacggcccttcctccatgcctcttcacccacggcccttcctccatgcctcttcacccacggcccttcgtccatgcctcttcacccacggcccttcgtccatgcctcttcacccacggcccttcgtccatgcctcttcacccacggcccttcctccatgcctcttcacccacggcccttcgtccatgcctcttcacccacggcccttcctccatgcctcttcacccacggcccttcgtccatgcctcttcacccacggcccttcgtccatgcctcttcacccacggcccttcgtccatgcctcttcacccacggcccttcgtccatgcctcttcatccacgtctcttcacccacggcccttcatccatgcctcttcatccaagtctcttcatctacgcctcttcagccacagctcttgcctggctgctgctggacacccacgttgttgcacagaagcaccactgtccactgactgtccacctccagctcatgtcctttccagaaatgaacaacaaatacatagcaccaagagtatcaccggcaatacccaagaactcaaatatgaggaggaaaaagatcgtgcaaccacagaaaagtgaaaaaaactccaagccgacagtaagagaattggacttccatattcacgacatccctctccccaaaactgcccagcacaaaggacacggaaaatgtccccctgactcacagtttctacgctggaaaaaccaaagaagatgtcaaatcagtgtggcagttcagcagcaccatgctgtaggaggtttgttccacaccttccctgggcacaaactgtgagccagccttcccacactaccaggatattccctctggggcctccctcatttgggatggttggcactctgactgtttact

SEQ ID NO: 473622 - DNA, 1496 bp, Homo sapiens
cctgtccctgggcaattcccttctagaagtttgtttttcagcctgcaactcttccatgaactcgacttgtctagccaaccccctacacgtcaccatgaggctctccactcccaagcacagaggcatgagtggggagaatgtcaccaaggtcagcaccttcatcctggtgggcctccccacggccccagggctgcagtacctgctcttcctcctcttcctgctcacctacctctttgtcctggtggagaacctggccatcatcctcatcgtctggagcagcacctccctccacaggcccatgtactactttctgagctccatgtctttcctggagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgaccgctacgtggccatctgccacccgctgcgctaccacgtccttgtgaccccggggctgtgcctccagctggtgggcttctcctttgtgagtggcttcaccatctccatgatcaaggtctgttttatctccagcgtcacgttctgtggctccaacgtcttgaaccacttcttctgtgacatttcccccatcctcaagctggcctgcacggacttctccactgcagagctggtggatttcatcctggccttcatcatcctggtgtttccgctcctggccaccatactgtcatattggcacatcaccctggctgtcctgcgcatcccctcggccaccggctgctggagagccttctctacctgcgcctctcacctcaccgtggtcaccgtcttctatacagccttgcttttcatgtatgtccggccccaagccattgattcccagagctccaacaagctcatctctgccgtgtacactgttgtcacgccaataattaaccctttgatttactgcctgaggaacaaggaatttaaggacgccttgaaaaaggccttgggcttgggtcaaacttcacactaagacaactaaatgtcctagagtaaaatctgtagtgatgaaacaacattgtatgtggcactttgtgctctttaaattaatttttaagttaaatttaacaaacctacagaactaagtgaaatttaacaaacctacacaactgtgcacaagtaacaagccttcgtctgcatatgttttcacaaaaggactgtgctcatggaaccagctcccagatcaagaactagaagctgccttcacgccctctcccagtcattaacccttctccacaaaaagcactgtcctgacttccaaaaccagatgctagcattggtgtttctgaggggcttacacataaagtatgtgccctgttatgttcagcttctttcattcaccgtgttgcttgagtgaatccttgatgtttttgcatgtaacaataattcatgcattctcattgcta

SEQ ID NO: 473623 - DNA, 1518 bp, Homo sapiens
acaggtggtgaatcctagaacagacaggagaacccggctgcacagcaggaggtgagcggcgggcaggcgagcatgaccgtccgagctccgcctcctgtcagagcagcagcggcattagattctcagaggagcgcgaaccctgttgagaactgcgcagcctcggaccctgggcaaggtcgtgccggccgccccgtgcaggccccttccttgccggtcatggccgggccttgccctatttgccacccctgtgcaatgggtcagcagggactgaccctgtgggaacagcctccgtcccaggaggtcactgagcagggggccctgctgaccacggtggccccgagtgcctcagtgcactgtggcctctgcttgcgtccttcttcggagacgtacaccctcagccccagtgtgttcctcagctgctgcagaggccgccccaggggctctagaattgtgggggaaggggtcagcccaggggcaactgaggcccatggggactgggcctgcctctggccacacagctggggcaccctcatcggcttcctgcagcctgtagccaccaggcaaggcatggaggccgccactgcccaggagctgagtgagccgccctgctttgtgccctgtgcccagccctgtgctggggaggccctgcaggcccgagtgggctgtgctcacactgggggctgtagctgagaccatgcctggctcccgctgcatggaaaagcagagcatttgttttgctctttgcttaaaaagagggccaggcacgttgtgggtgatggatgaacctttcagagtcacccaataaatgaatcaacagatgcaggaaaatggtcagctcaccttgagggacatgtgggatgagggcatgtgtgtgtatgtgcatgtgtgtgtgcatgcatatgcatgtatgtgtgtgtgcatatgtgtgcctgtatatatgtgtatatgtgtgtatgtgtatgcatgtatatgtgtgcatgtgtatgcatgcatgtgtgtgcatgtgtatgtaagtatatgtgtgtgcatgtgtatgtgtgtatgtgtgtgtgcatgtgtatgtgtgtgcatgtgtgtgcatgtgtatgtgtgtgcatctgtatgcatgcatgtgtgtgcatgtgtgtgtatgtgtatgtgtgtgcatctgtatgcatgcatgtgtatgcatgtatgtgtgtgcatgtgtgtagatgtgtgtgcctgtgtgtgttcatgtgcatgtgtgtatatgtgtgcttgtgtatgcatgaacgtgtgtttatgtgtgcatatatatgcatgtgcatgtgtgtgtgcatatgtgtgtatatgtgtgtgcatttgtatgcatgtatatatgcatgtgtgtgtttgcatgtgtatatgttttatgtgcatgtatgcatgcatatgtgcacgtgtgtgctaatgtgcacacacgtgcacaaatgtgtaggtgtgcacatgtgtatgtgtgtgtggttgtgtatgtgtgtatgcatgtgtgtgtgcgcatgcaggcacatcaatgtgtag

SEQ ID NO: 473624 - DNA, 567 bp, Homo sapiens
tgcaacagaggcatttttttctcataatgtggaaaagtcacccaaaaaggagctctttggaatacctatgcaagatggaagaattcttcaatcccaggctcttccaagccacaggaaacaaagactggctcctgttacctgaggctgcagagcttgggaagccatccattcagatgtcccactacccaccggtgcacaggaacaaaattcttgtccttcaggattctggcttcccttatgtctgcataaatgtggctgcctttgatgacatagtaaggtcccaaggcacggagcacggcacatcacagggaggagccaccggagcccatattaatccaggaggaatgtggtcatctctcagcttctctcctttccagcaagcagtcctttctgaacatctgcaaggaggcaacatcaaaccacaagcacttccaggaagacacagtccatggcagggtacaggaaggctctggggatgatgataatcagagcagcatacaagaacattgtagttactctttcattagtggacattttagaggcttgcccttcactgtccttggttgg

SEQ ID NO: 473625 - DNA, 895 bp, Homo sapiens
ctcacattctgttctccaggaaccgcttttgcaattcagttttcctatctgcaaaatgataggaataaagccattagaaatcaggtcctggccaagcagccctgcccactgtcggcttccctggggttcctgcatgttcttgcagatcaggcccatcatttatctcccgtgctcgtgtgattatcgggtggtgggcatccctacatcaggtggtgggcatccctacagcaggtggtgggcatccctacagcaggtggtgggcatccctacagcaggtggtgggcatccctataccaggtggtgggcatccctacagcaggtgttgggcatcaccccattcccaagtcacaatggtcgaattaggcattacaggaacaattccttttgcttcttctccacttccataattcatagcgatggcctaatttcagtttcaacacacaagccacacttcatatctcacgttaaactcttgtatgaatgttgcagaatatttgcagtaacgctaatgtcctccccacagtgaaagctgttacaagatctctcgctcgagctgctaccgcctgcacctctcaggttggtctgatgtcagcacagggcttggctgaaaccaccccagagccagcagcaggaatccagcagtatcaccgcccctaggcctccccctcactcatggccagattcaaagcccattaccaactagtaatatacctagagccaattcctaacccgtgaatcctcaccttcaccttcccattccccatactcacctcagtcttgcccttctgtgaactacagttttccaagcttgcctccacctgaactccaaacccaattaatttccagccctatcttccatggctttctgaccccacaaatccaaatgagtccacct

SEQ ID NO: 473626 - DNA, 655 bp, Homo sapiens
tggatttgggtatatggtttcaagccaatggtctttggaagcttgtaacgtctatgcttgatttctcaggaaaaatgatttcagaccattcaagtcattgccccttcctcaactatccggatagccaaagctgcagctgcagtcagctgagtggggttacttcccatgagagcctgcattgccaggggaacagctgcttctccatgtgcctggtgtccctggggctgctccagccccctggccagggcctctcctggaatgtcttgccctgtgtgtcaggtgccctgctccctatgatgagagccctacccctgataccactgacctgtgaaaggcaggaacctgctgagctttttctactcccttccctgctgctcaagggtcgagccccaccctttgtcctctctctagcagtggttgggttcaggcccacctgttgcgaatttcttgattctgatttgtatcggagctctcaccggatcttcaaaggatgggtgatatggtttggctgtgtccgcatccaaacctcatcttgaattgtagttcccataatcctcacatgttgtgggaggaaccaggtggagataattgaatcatgggggcagtttcccctatcctgttctcgtgatagtaagttagttctcacgagagctga

SEQ ID NO: 473627 - DNA, 1108 bp, Homo sapiens
gcctaaaatctatagagagttaaagcataaaccatctacagctcccagggtgagtgacgcagaagatgggtgatttctgcattttcaactgaggtaccgggttgatctcactggggatcatcggacagtgggggcaggacagtgggtgcagcccaccgagtgtgagccgaagcagggcaggcatcgcctcacccaggaagtgcaagggcacagcagtctgagatcagactgcaaggcagcagtgagaatgggggaggggcgcctgccattgccgaggcttgagtgggtaaacaaagtggccaggaagctcgaactgggtggaacccaccacagctcaaggaggcctgcctgcctctgtaggctccacctctgggggcagggcacagataaacaaaaggcagcagtaacctctgcagacttaaatgtccctgtctgacagctttgaagagagtagtgtttctcccagcacacagcttgagatctgagaatgggcagactgcctcctcaagtgggtccctgatccccaagtagcctaactgggaagcaccccccaggtaggggcagactgacacttcacatggccgggtactcctctgagacaaaacttccagaggaacaatcaggcagcagcatttgcagttcaccaatatccgctgttctggagccactgctgctgatacccaggaaaacagggtctggagtggacctccagcaaactccaacagacctgcagctgagggtcctgactgttagaaggaaaactaacaaagaaaaaggacatccataccaaaaacccatctgtacatcaccatcatcaaagaccaaagacgaatggctaactagaataaccagtgtagagaagtctttaaaggacctgatggagctgaaaaccatggcacgagaactacgtgacgaatgcacaagcctcagtagccgattcgatcaaccggaagaaagggtatcagtgattgaagatcaaatgaatgaaacgaagcgagaagagaagtttagagaaaaaagagtaaaaagaaatgaacaaagcctccaagaaatatgggactatgtgaaaagaccaaatctacatctgattgatgtaccttaaagtgac

SEQ ID NO: 473628 - DNA, 766 bp, Homo sapiens
gccattcatggccacagtaaaatctatgacagtcagagttgagcaaaatccaaaaatatgtgcaagaccttcctggagagaactacaaacatgttattgaaaggcccgaaggaagaatttgaggaggagaagcaccagtgtttcggacaggagtatttggataacagtaaattctccaacatcttagcattcaatggattttgggttaaccggcactgtgagaagaggaaggagcagagtcgtcaatgcaggtcagtgcccgtcacgtcagtaacatgctcaaaagacagatttatgtcacggataaatgcaaatatacgggatgacacgaaaaatggcaatgcgactgcagtgacctcagagaagatggtagctgtggagacgacgggaaatagcatgggtgcagttggtgctcttaaagaagactgaagaaataaagaaaatcaaagagctgagaacacaaagcgtctttaaaaaaatgaaacatttgtacctgtttatcttctgttccaagaaaaaaagtgataaagatcgatatcgtaaaataccttgacttgtaaccagacctcaaggacaaaggcatcttttggtagctcgaggaaaagaaaatctataaaggcaggagagtgacttcaagtctttaaaaaatgtttagctctttcacccaattgtcaatcagaaaatctttgaatccacctgtgacctgtaagcaccccaagttggagatgtcccacctctttaggcagaagcaatttacaccttccac

SEQ ID NO: 473629 - DNA, 545 bp, Homo sapiens
acagcagacatgggaccatcatctggattcctagacgtgcaactgcaagctgtgcacccaggctcacctgcagagcttgctaaagctctggaatgtacctccaccaggggacgtaacagagggtctgggtgtggtcaatatgccataaacatttgtggaatgaatacagcacaggaggaggaaagcgtaacatactcggatgtctgccaacctccaggcgtggcccagctggatgccaatattcaattcaccctttgctcctcctgtgctgaatggccagacgcttgggtcctcattgtggtttgctgtggcctcaacattcctctggccttctcccaggaggaggtggcatctccagaaattcatgaggggcagctcaagtccctggcactggccccgcagaggttctgctcctgtcagctgaggttctcagaacccacttgtctgtgtctccagatttgggggccgtgctttgcctggtgactcagttctccgacgggtgaagaagagttgttgattttcagtttgttcatccttttccttcc

SEQ ID NO: 473630 - DNA, 571 bp, Homo sapiens
ttaagtttaatttgtcaatcttttatgaatcatgcttttggtgtcatgtctaagaacttttcgcctaaccccaggccgtacgaattttcccctgtgtttttgtctaaggtatcatgggcgtttgcagctcccagtgccccgtgctgctcctgtcttcttggtctgctcctcctgtcatacctttctccgtctctcacggtatcgtgggcatttgcagctcccagtgccccgtgctgctcccgtcttcttggtctgctcctcctgtcatacctttctccgtctctcacagtatcgtgggcatttgcagctcccagtgccccgtgctgttcccgtcttcttggtctgctcctcctgtcatacctttctccatctctcacggtatcgtgggcatttgcagctcccagggccccgtgctgttcccgtcttcttggtccgctcttcctgtgagtctcagggcatgtcttagtgctcacgctgtcctggtccatcggggggtcccgtgagcttgtccgtgtgggaaggtcgggactgtgatgttgacgggatgccttgtgagttgggggaggtgctg

SEQ ID NO: 473631 - DNA, 542 bp, Homo sapiens
acaaccacgacctaggaaggcaagatgccagagacgcctggaccctacgctaggctcagaaatgttccaacacaccatccaagcatgaagcagaagacacccataattgagtttgctgccaccaaccccaacagcaagaattccagtcctgctgctgcaaaaataatgtctcaggcaaaaacggcctttaaacttgatggaaaaataagaactttttccgacaaacaaaaactgagggatttcattaacaccagacctgtcctacaagaaatgctaaagggatatcttaacctaaaagaaaaaaagttagcgagcaagaagaaatcatctgaaggtacagaactcactagcaatagcacatggaaaaacattgaatatcataatatgctttgttccgttgctggtgaggagctgcgttcctttggaggaggagaggagctctgatttttagagtttccagtttttctgctctgttttttccccatatttgtggttttatctacctttggtctttgatgatggtgacgtacagatgggttttt

SEQ ID NO: 473632 - DNA, 937 bp, Homo sapiens
tgcttcaaagtgttctcttgtcaaaatggctttgtcaaaataccatttacctatcagtcctgtcctcttgctctcttcctgggacggcatgagcttcaccactcgctccaccttcaccaactactggtctctgggctctgtccaggtgcccagctacggcgcccggccggtcagcagtgcagccagtgtctgtgcaggcactgggggctctggttcctggatctccatgtcccgctccaccagcttctggggcggcgtgggatccgggggcctggccatgggaatggccaggggtctggcaggaatgggagacatccagaacgagaaggataccatgcaaagcctgaacgaccacctggcctcctacctggacagagtgaggagcctggagaccgagaacaggaagctggagagcaaaatccgggagcacctggagaagaagggaccccaggtcagagactggagtcattacttcaagaccatcgaggacctgaggtctcagatcttcgcaaatgctgtggacaatgccagcatcattctgcagatcgacaatgcccatcttgctgctgatgacttcagagtcaagtatgagacagagctggccatgtgccagtctgtggagagtgacatccatgggctccacaaggtcactgatgaccaatgtcactcggctgcagctggagacagagatcgaggctctcaaggcagagctgctctttataaagaagaaccacaaagaggaagtaaaaggcctacaagcccagattgccagctctggcttgaccgtggaggtagatgcccccaaatctcaggatcatttcagacatccaggtccaatgtgatgagctggcttggaagaaccgagaggagcttgacaagtactggtctcagcagattgaggagagaccacagtggtcaccatgcagtccactgaggt

SEQ ID NO: 473633 - DNA, 2007 bp, Homo sapiens
cgatggtcaagacaagaaccgtggagtcagaatgcctgcatgcagatctcatcaccatggatccaggaaagacctagaaagagaaggcctggctacatcactggagattctctacagatgcaagtttcccccacctcagtctgcctgccctgcagcagccatttcaaagtatgggataaaatggtttgatttccttcaaggaaaactcaaatggaaagatggacagcctgcttatggagcagttctacctatgagtgagactttctctgcactgtactggctgtgtcagagaagcacgacgtatgtgcctgcattgtcttcactgggcaagtcatttcagttgcaggaagccatgcacctgcacttctttgccttgaaaataactaatctgcggagagtgatcagtcagccttgtcagagctcagtcgtttggctttatgctcatggccgcacctgacccttgggcactgtgggtgtataaatagcctcagaaatggtgctgctctcaagccctgtcttgcaggactttacctgtaaaggaaagctttaccttttcatgacaggacttgagagcttatttcaataaaagaagagggagagaaaaccatcctacatcccctgaacatggaaacatttcaaccctgatgaccactggttcccacagtgggataccatgtgtaaaatgatttaaagaatgcatgttagtttagaatctaaatttcaaaggatttaagtttctacttcagtaataattattactatttatagggattaactcttccacacatttctaagtgaaataaaagttagctctaaagaagtactacaagttggaagagacattttacctttacgttatcacatcatcaaagcaatgtggctttcattttataaatcttattaagtttgcttgccttttcatattagcatttattacgatgctggataatgttacttggcgaaacttgtactttctgtctgccaaaatctacattacaagatctacataagcaccattgtacgtagtgttttcacactcccaagaaatattaatgtttgggacttgagaataagaagctggaattcctgagaattctagggaatccctgaaattgtaagttagtctttattttttagtaatattttatataaatattttaaattaattataagtgatcatactaataaatagtaaatcatttttaatagtgctatgataaaactttcagaaactttctgcaaacaaaatatatgatagcaaatgcatggtttattatgattatgaagtgatgtattgctgacaagatgaaatattttcataactgcaagagtgatctctttttgatagaaccattccataatagaaaacattaagagaactttaacacaaaatatacgccaaataaaaattatttaaaagtggaaagatattatcaaaatattaaatatctaaaagttgccattcttaaaaataacattttaaaacactcaaaacatcagttgccatgtgcaatagttttgatccatgttttgtaacaaatacctaagatgcacacagtttttttctatttcatgtcgagttggtcgaattataaatgtgcctccaaaagcaccctcaatttgattattagggggcatgttgcttgtctcctattttaacagtgaaaatagtttgtctactggtcctcattttggttttgccttcgaaagccatcttacttttgctaatctgaatttcatatcaatttctgatttcatgtagaagtattccacattgatgtcttatctttgcatttctcctattaaagtattcacaaagaactgtagcctctagtaaatattcaaacattggaaaatgctaaggaatatcttggggtattattccaataatgtaacacttggatctcccagcatttttaacagaactacacagaatcatgtcagtgttgccaagttaaggatttattttgcttccaaaatttgttatttcttagaacaccagtcatc

SEQ ID NO: 473634 - DNA, 518 bp, Homo sapiens
tcgggaaagggagtcgaggaaagttgtgagaaagctcgataaccatgggcagagaagagagcattcttcccaaacatgctgttcaggcagagtcccatggaactcatgctaagtctgtcacaaaaacaggagcagtgttaacacagggggatattgaccagaaatggctgcttcttgtaatcagcttggtcactgccgtcatctttcactgccatgagcctgctctgaggtgttttgtcctaaggagaccaactaccttctgtcctgttcttgccaacccatcccactttccagctgccaatggagaagaagcatggctgatcctcctctcttcccatgtggaaggtgctgctgagggcagacctcccttgggaaaaggcaggcttttatctgctgagctcaaggttaagcctgctacgaaatctcaagggcaaataatcacttggggattatagaactcagtaacaggaaatctgagtgtcggctttcagggattcgtgtttctttaggggagaagg

SEQ ID NO: 473635 - DNA, 587 bp, Homo sapiens
ctacaagtgacatgtgcagagtgacagcgagagccctgatcacagttcctgtttctgtccagggctgcttgtaccacaacaggccatcagatggacgctgtccacagtctattacggcaagggggcaggaggcctggtgggagccggtaaatgactctgccctctgggagggataccggggtggttggggaacgcatctgctgtgcgccacaccctcgtctccaggccctgcgtgctcagtgggctctcagttgccagtcctgagtcaaccttcaggcttggtcctgtggcggcattgcttgtggactactgagctgccgcacgtgtcacagccagacacgcacggggtcattccaccacccagggctggcccccaccctccatgctctgctccattgtctgggcaatggaaggcgatgatgctgatggaaagctaggtaatggtgtgaacatcactttcacaatgatcaaaaaaaatgacctatattcagcatggaggaaatgtctttcaattcctaatgatcacctttttatttacacgtgctcatttataagccgtcagccaacatagatcactttatgcttcc

SEQ ID NO: 473636 - DNA, 801 bp, Homo sapiens
aggccagaggtaaatctatgcccctgtgagtgcacatagaggaaaactggaaccaaccagaggaggaatgccaaagaggctgaatcccaacactgatccttgcatgccagagagaagggcaagacactgggtttgcgaaaaaatacgtgctgaaaatgcatacttggaattctatgaggatatctgtgaatcacaagtttcactaaaacacttagtcctacaaatcatgtcttcagggcattcattccccctgccctggtcgtggatggaagggtctacccaggcattgagcaatgggatgcttctggctgacactgctcagggggaccttcagctgcctgaagggagcctcctcacctcagagcccacccaggtctatccaagaccaacatcatttgtccaagcttccataccaagcaggcagaacccggattcgaactctgacccatctgactccaaaccagtgacccagttgcttattgtgggacctagtttacactgttatctaaacagtgaaagtgctgaggaagacacagagaagggaaaaccctactgttcatagctttttctggtgacatttacttgttttaccttttgataaaatcatttgtcttttttctggatcgtgtttgcaaataaatccttcaatgaaaaaatcctttcatcatttcacattcccagatcctgaaggcacctgcattccagctcttcagggaggcaggggaggaccctggggaggaccctggggaggaccctgcacattcctgccagctgtatgggcccctccccaaatgttcagcc

SEQ ID NO: 473637 - DNA, 787 bp, Homo sapiens
gataaaacaactctctctctctctctgtttggatggttttaatagcctacaaatatcttctgcttttggcacatcattgcccctttgtcttcagctctctggtggccttccagaatatagggcaattgccaaataatctgaaatctgcagattttgggaactacaaaacaggatggtactgtttggtgctgggtataagaaaatcaataaggcctaaacatagctcagcaaatgaagcagaagtttgcatgattgttcatccaccaggggaggcggctgtgatgaagtctgtggggcctggggaggaggagagaatcaagccctcaatagtgagtaggtgtcagccaggtagacagataagagagcccattccagtaggagggccagaatggcgagtgcctagaggagggccagatgactcatctgtgagacgggaacaggtcgtgtgcagggagcaccatcacaaatgtgaggtgaggtgccagcatcttcccggcattattgctgcgttagtcagtccctgctatattgggagagtgactgtttcgcattggctgcatgaagtggctgatctcatccgtgagtggcaccacctacagccgcgtcagactctggggcctcgacacttagggagactgactcgcagttccgtccgcacacgctgcggctctgaattcacaccagggtagacagtgtgggcttggcgatgtgctgtgctagggaagaggctcctgaaacacatactgactcaatcacaactctttagactctccctctatattctctc

SEQ ID NO: 473638 - DNA, 565 bp, Homo sapiens
ggcctgtctggcattggtctccaggaagcaaattcctgtgtcttgtggagtgcctggcacacaatagatgctcaatatgggtttgtgggatagaatcgtgtttcaaaaacagcaccgaagcactctgcactgtgaagaggtaatgcagaaaccaacaagtatcctgaaggggatgcatgaggagccaaatggggaagcggtaattcgggtcaagaaagtcttcatagtgattttactccaaagccaaatcttgaaagatgaagttgggctcaccagaggatccaaagaagaagagaatgagaggcaagaaggaaaggtatttgcagcagaagaattagaaagcaagtgctcaccaacatctgtgcgccctctcttcctgggtccacagctagaaaacattcctagtactcttgcagcaaatgactgggttttggccagtgcagttgtaggcagaagtgatgaatgccattttcaagtgttacttgaactggatttagcagatccaaggaagagttctgggggccccagaggcttgtggagctccagctctagataaaagggtccc

SEQ ID NO: 473639 - DNA, 610 bp, Homo sapiens
aacattctgctctcccacagcttctgatcgaattctaggctcccaacagaagaggagagctaactggaatttgtgtaaggactgagaaagcaatggtggtcaaggctcggagggcccctgcactgtggaaacgagcagaagctggtggggagaaggcatacgtctgggggctgagagcctccagttctcctctggtcccacagtgtcagagccgggcctgggctggaggactctcctggaggcctcagcatcctcacaggtcaaatcttcagcccccggtgcttccctcctggcagatgagaagcacccgggcctctggtctttgtgccagtgacacccgaggagtccccccatggcctggcccctccctacaagggcaccaggaaagtggagcctctgggcagggtcttccctctggggtcaatgccaggctaactcaggactgtcccatagtctcagactatgctggagtggggagtgtgataggccattcttattccatacgtgacttatcactgaggaacatctgccgagggctggcaataaggtcactcccagcatctcccggctccttaactacgtctcccttcattccacactcccattgatt

SEQ ID NO: 473640 - DNA, 539 bp, Homo sapiens
tttctctaaaggaacagaaagcatgttgagtatggaaaggcccacatggatcccacagaattccagaatcctcagccctcatttcctggattccaaagacccaccaacccaatcacccaaatttttctccgcagctttgcacgtgcagctcagatcatcaaaattcttgagttagacctagaaatctgttgcgttatgcgccttgatctaaatgtgactgggacttggaaaccttgttatactgaaaagtctggctatacagatatttggctgatgtattcagtgattctcattcctagagcaggaaagggaatgaagtataaaagtttcagattgtttggtgagccggatcagatcacaaagttggtcatgagtccaggatgggggcactggcagctcctaggaagctgctgtaacacctgtttactgctcatccagcaagcaaacaagcttcgagaactcttagagctccctgggtggatttggtccctgaggctgactgtgtttctcatggacgtgggactcaggactggatgatc

SEQ ID NO: 473641 - DNA, 511 bp, Homo sapiens
gtgccaattctgcctctggatatgttaaagcagtcaattaatgaattcactcaagctcaagctaagattggcaaagtgggagctattctgatctgtgaacgtgctcttgactgtctgctgctccggacctgtgttgatttcatgagacagccacagaactggtctgctgaagacagccctgtggcccagcagcaggctgcatcttgcacctcaatgccacttacctggtccctgtatgctggcaccagcaccacttcccaagtaagcaactacaaccaccacagccacaccatggccacgccacggaatctctgtggtctctgccccactgaggacttacagcccatggcatatttgtctggtggtgagttccaagtctgtacccaaggtgcatgggaggtcgtcaaagccaagtacctgacatctgaaatttcggtgatgggaggaaatttctaagatcctccaggacatcatttttataagacaaaaggaccctgagcatcaaaaggag

SEQ ID NO: 473642 - DNA, 839 bp, Homo sapiens
tccgttcatcatccagcccaaagtcctgtccctgagaaatacaggattggggatggcccctggtgaggaccaagctctgtccttctggattccttctggcctggttgcctccatagttgatatagttatgtgtctccacccaaatctcatcttgaattataatccccgtaatctctatgtatcaaaggagagaccaggtggaggggcactttccccttctctcagcacttctccttcctgccaccttgtgaagaaggtgtcttgctccccctttgcattctgccatgattgtaagtttcctgaggtctccccccgacgtgaagaactggacctttctctcaaccagcaggcatacaagcccacccgtcccttgggacaggggtccccaacccctgggccatggattggtagtggtggattggtagcagtacatggcctgctagcaactgggcctcacggcaggagatgcaatgtctattgaaaatttgatgtctgtctctccagttcatgttttcacacttcgccacatccttttggttgtcataaataagatgaattctttgcttagttttagattttgcatacatggaatcgtactctatgaacatctctcttgctcctaatttaaatacaaatgcttctaaaattttgccattacatataacattttctttgtattttgagtagttacattttatcacacttgtattcctagattgctatcaatggttctttaaacaagaacattttttcaaatgttttttcttctaccaagatagtcatattgcttttatcacttcatctataatatgattataatatgccctggaagttattct

SEQ ID NO: 473643 - DNA, 619 bp, Homo sapiens
cacaccagggagatgggaaaacttgatcctcatctcagaattctgccaactatagttgatgttttcttcatgctacttcctagctttgtgaacttggccaaaaggacccttctcaatatccctgccttctgccacatattcataaacataaagcagggtcttgcagacatcgatagtagcatctgctccagtgaaggcaacagaggagtgaaatggactctgttctatggactcagagtgacacttccatctctcattgatgactgttctgtgtttcaggcagaagggcagtttccagggggaatcgtggggcgacaagtagccagtggagaagctgccaagagggtcatcggaaccttctgccagcagctgaagcacaggcagcatggcagctaacgttgaatgagaagcaagtaggctttaagaaatcaagttctccatgtaggtggggaattttgttatttcactgaaccatcttaacttttccatataaataagaaatttaaaagttaatgaaaatgactgtcgggcaggagtgtgtgatgtattcttggactgcctttgtggtttttgtgtggacaagatgttttcaagccgattttgaatataaaaagggggt

SEQ ID NO: 473644 - DNA, 658 bp, Homo sapiens
ctctctctctctttctcatttctgaaggggggatgagggaagtaggcctgcatgactccagaggcagggcacagtgtctgtttcaatgctggctagcttttggctccttcattctgggctctgaggggcaaaatcccttaagatgccccttgctgtaaacctctcaaaaagaaaatctcatcaccagtcaaaagtaatgggtccaaggggtgttgtgattcccctaaattctcaggtcagcagcattctcatttctgactttttcacttcggtcagctggaatcacactctacggcctcctattgacacaagagacatggagatggaaattatgacttttatcctggtggttaacatgaaaaggcaatgcagacgtcaggatgatgaccaagaacaagcggaagtcaacaagaaccaagggccctgtcagaaggaggcatgcagaacagaagccctcatgggccctgggcttgggccacacaatggccgaggagatgcaaatgtaagtcagctgggaatttctgggaaagtttgcttttctgcaaaagacggctacctcttttttgggtaacttttatattctttcttcctggaatgagggctgaggttggagacagagcatggcttttctgatcaagaagcaatcagacaggcaaaa

SEQ ID NO: 473645 - DNA, 577 bp, Homo sapiens
tggctcattaaggatgcccaagtggggtgaagagtgtctgcaagtttctgtatgggggcatctgcgtgtgggcatctgcgagtgtgtatctgcatgtgggtatctgcatgtgtgtatctgcatgtgggtatctgcacgtgggtatccgtgtgtgggcatctgcatgtgggcatctgtattctgcatgtgggtatctgcatctggagagtctttgagtgaaataaaaagtagaggacgcatggagtgtggacagctccaagcacgtccctgttgtgacatgacatgcatgctaggcacaggcaggagcaagaaatgtgtcagggacgcgggagacgcagattctgaaggatctcagggccctggaaaagagcatgtcgtttcagcaagtctcgacgcaccactgctgcgattgagcagtgatcagaattgcattttagatcagccactgaggtgaagttgacactcaatgttgctgttgggtgaggatggaggcttattctctccacttggcctctgctgataccaccctggctggaaggatgagaggcacattattgctcctccttatgcagcctct

SEQ ID NO: 473646 - DNA, 582 bp, Homo sapiens
cgctgtccctggctgacatggctttaaaagagtttcagaagttgaaattcagtgagatcgtaaatacaccaggtagacagttgaatctgaagataaaaatcaagttctggtgtgatcccgatgaagacagccagcagagaagagcagggcctggaagaacgacagaggtattgaacaggagcatgctgggctgcagctcagaatggggaccatccttgctgcttcttagtcatctgctgcagggatacacaggggtcttactcttcagccggtgttgggccattacttttcatcatgatttttggcagaaccaaattgggttgacaatactgctggccttccctctaaggccccaagagggagctcctgaatcgtatttgcatatgggaaagctgaagtggctggcattgtgcaactggactgagggactcggttgtagtaagtaaaagcagattgtaatacacagcgtcggctcatcactattgtgctacttgaaatgtacttacaagtagccctttaaagagattatgaagaaataactgtgctactcaccttttctttcaagagaagccaaagggaatg

SEQ ID NO: 473647 - DNA, 484 bp, Homo sapiens
cccacacagaacaaacgtttgaagcagaagtttgcttggtaaacatggaatcggaacatgggaattgggccactgggatattcaattgcgtgggccacggaggagaaagtactgggctctcgggacttctctcccagggccctagaggatgtggctggcattccccctagggacagcaccctgcgctgcccagatgcctgtcccctccttgatggggaacacggagctttcctgggctgctggcctaccaatgccaagaggctggcccacagcccctccagacacagccaagagccttgcctggagcccagtgtcagctgcagggcctgggacatttccgaggaatcagaggcaaggatgccagagctacgaggagccttagattcagaaacaaggctcagagaaggcagcacctcagataactggctcagagaaggtggcccctcaaacgctgcacagccagccccaggctgatcccatgcca

SEQ ID NO: 473648 - DNA, 689 bp, Homo sapiens
tggatggatggatgaatgggtggatggatgggtgggtgggtggatggatggatgggtggatggatgggtgggtgggtggatggatggatggatggatggatggatggatggatagacagatggatggatgctgcatcatacccccacctctcataaccaacaacggccatggttgtcacccacagtatctccttctcagaagagctcgccaaccccccaaggcctggaaagagccccagcagctggcagcaagtatcccaggcacagggcgaaggctctgcctgtttcctgtctggacctcacaatgccctggcatggcagggcgtccccccgggagctggtgctgagagggtggcggaggaggagaccccacctcgggggaccagggatcaggagagtcagcagggccttcagaagtcccctgattcaggcttctcacttctaagtggggacatggagccctacagaggggcaaattttctgtgggttataaataagcagttcttagcggaaggtcccccacactggacctgggaggcccacaccactttacccttgacccaggcacactgatgtcggcaataaaggatgtgacatgccagaaggagctgaggttcctggtgacagctgttgccaagacacaacaaatattgaaattaggcaaattaacaaccttacaatggcctctg

SEQ ID NO: 473649 - DNA, 632 bp, Homo sapiens
ttatttttaagcaagggctctgccttcccagcgtgtcttaaatttctccaggggttgtatgctccctgcccctactaatttagtaaatggctttgtcacgggtgtgttattgtttgcttttctttatggcatccctcatgtctgggctaagcagtcatttgttgagcatttacatgcattgcccccatttaattctcgtagagcgtgggaagtagttttctattcctacttaacagaagaggaaatgttacaggaggtatttcaagacttactccaggtgcattttcttcctcctttgcaaatggccaatcgccctgagttttccatgaaagaaagggccacggacagtaatggtgcagctctcagactctggaccccaactattagagttgggcccaaatcccagctctgcagctcactgtccgcatgctactcagacatccccgcatctgacccagcagaccgctcctgctcctgctcctgcaagtgtctcccctggctcctgtgaggcccactggcctggtgtccgctctttctgaggctgtgacattggagctgtctctttggctcttctccgtccacactctgtccctggagagctgcaccccagcaacattcccgtctctcccttc

SEQ ID NO: 473650 - DNA, 982 bp, Homo sapiens
tgcctgtaatcccagcactttgcgggggtgagaagcaacgtgtcaggagtatcagagagtggccctgtacctacctgtatcaagagtgcgcactgctggccgtgagtgattccgtggcacgcagtgcatgggaggtccagccttgtttaaacggccgtggtcagaccagaaccgagattgtcatgcaagctggttccattagcagatccaaggtgccacagaactggaatggcggtaggattagccaatcctcagctggaaccaaaataggggacggagcccaaataaaaaaggcttggtttcctgagggcccggagccccccgagagaaccactctaacattgaagtgcgagagtggatacaccgggagctgtaaggggagctgggagcagggcccacccctgtcctcctgtgagctgcagctgatgaagccatgtagcgtgaaggggccactgcaagggtccccagcagccatagagctcacagaagacaatgtacggagaggtcccacagcagcacccctggccagtccccagccctggactcaagactcgcaagcatcaaagttgcagacaggaagcttctggcagactgtccaccctgcagggagcctcagaggttcatttctttgcaaggcaaagaaggaagaacgtggctctaagcctgctctgcacctttcattctcccccatcatccaccgatacatttataagggataaaaaaggctaaactgctacatcgccgctctgagcctcaatgttctcatctgaagaatgggaattattctaccacattcaaaggttgccataagtatgaaataggagagtagatggcagatagtcagtattcagtggatgcagctattattgcctggctccatgccagacacaagttaggtcaactggggtgggtgactaggggaaggcagacatggaaatgtattagatgcactcctgcccttgggaagctctcctagcctatc

SEQ ID NO: 473651 - DNA, 615 bp, Homo sapiens
ttggaggtgggaccatgagcctcttgaggccacactccctgatcctggttctgaaactcagagatgcagctgaccagactgatgtggccagcctcactctgaaggatcctgcagcagacaaattgctggaatgtgttcagacggaatccagctgctacaacccagacatcagaccatgctgcactgactccgtggcaccaggtcctggaacctggacgccgacacggtccaggaccctctactctcatttgaaatccatgacactaagccttgctgctgccccacaaaggaattctccacagtccctgctgctttgggtcattcactccagattcaaaatcctggctgtggtgtctggccaggtccgagtcacgtgccacgccaaggttcaagataagctagggggacacagcggttgctgtgaggattaaatgagatgctttgtgtaaagccctgtgcagcgtgtgacccacagtgcaacagtgacccgtgacgcagtagggagggctgttttccatgcccagtgaggcctgctcagctcccattaggcctttatggatggcctgcctcccagctggtacctggtcccgtcacagtcccaggactctagacctc

SEQ ID NO: 473652 - DNA, 3445 bp, Homo sapiens
cacctgaagctcctctaagcctctatgtcctgccgtggagctccttgcccccattctaccttgggggtgtgtggggtggagagaagatgctgaagctggatgctaacttcccatgcgactgggatgggggcatctgatcagggctggagactccctgcctggactctaaaccaaacccaggacagggaagaatgattctggtggtcacttcagcatcagcagccttcagtttcgagggagagcagcagcagcagtgccagctgttgtgcccagtgttcagagctggtgcatctcagagccccttcttcagcagcattctggctgctgcctacagcatgtgctgttcagatatcagggaggacctccaagggggcccactcaagtggagatcagggagtttggagttacacctgtgggttcccacgggcttcctggtgttggagtcccagccagactccctggatctgtccgtggaggctgggagtcacttggatgtgtttcagtttgtaggtttaggaggtaagaaatatgggggaggaaaaattgtgcagaccagtgagaatgtgccctggccctatgccttcctgtggactggcggctgggaaatgctgggctagaggatccctaacattccatgaagctaatgttccagccttcctgttttgccttttccagaatgttatatagttgcagtcatatagcatgtagccttttcagactggcttctttcacttaataatatgcatttaagttttcctcacatcttttcatggcttgatagctcatttctttttagcagtgaaaaaatattccattgtctggatgtaccacggtcgtttatacattcacctgctgaaggacatcctgttgcttccaggtttgggctattattaataaatctgctataaacttctgtgtgcaggttttggtatgaccatgatttcaattattttgggtagataccaaggattgcaactgctggatcatctggtacatggagtgtgcttagttttctaagaaactgccaaactgtcttccaaagtggctatcctattttgcatacccatgagcaatgaatgagagggttcctactgctccacatcctcaccagctttcggtattatcagtgttctggattttggccattaaataagtgtgtagtggtgtttcattttaatttgcttttctctaatgacatatgtagtggagcatcctttcatatgtttatttgccatctgtatatcttctttgatgagatgtctgttgaggtcttttgaccgttttaaaattaggttgtttgttttcttattgttgaattttaaggcttctttgtatattttgtacaaaacagtcctcttgcaaatattctatcccaggctgaggcttatcttctcattttattgacagtgtctttcatagagcaaaggtttgaattttaatgaaatccaccttatcaattatttctctcatgacttgtgcctttggtgttgtatccaaaaagtcattaccatactcaaggttatttagattttctcctatgttattttctaggagtttatagtttgcattttacatttaggtctgggatccattttgagttcgtttgtgaagggtgtaaggtccgtgtccagattcacttttttctgcatgtggatgtccagttgttccagcacccttcattgaaaagactgcctttgttccattgtattgactttgctcctttgtcagagatgttgacgatgtttatgagggtctatttctgggccctctattctgttccatagatctgtttgtttattctttcaccaataacacgctattttgattatttcagctttatagtaagcctggaagccaagtagtgttagtcctatgactttgttcttctctttaaatactgtgttaactattctgggtttttttttttttcctctccacataacttcagaatcagtttgctgatactcagaaaataactgtcttggattttgattgggattgtattaaacccataataaggctgggaagaagtgacatcttgacaatattgagtcttcccatccatgaactcttttaataatgatgtctcctcattatcttccttggcattctgggaaaacttctcaagcatccttcacatccttgatcctctgcaatgtcaaattcccctttccatttctaatgaagattaaattctgtgatggcatttctaatttccttactctctttatccatcaccaaactcctcttttctcttaaattcttagtcttctcctttttcatttcagtctgatatttcatcatgtcctcttttatctcctttttcatatagttcacattttttgaattatttgagaatataaaacatttacttcccaatatttcttctgtttcctgttcttaatatttgacaaaagtgtaattgtcatatgcatcttaattgtggtgctttattttgcagaatctctttgatccatgctagattcttaggcttcctcctgaggacaaatcaataagacctggtgtctacccaaccagggcaaccagtgagtggattgtctttaattcccaccacatcttgattgctctacacattctgctgcaagatcttcagaggtgactggtgataatttacgcaatcagttcaaagtgggaagggaggcagagcgatgagcatgctagcagggaagtcgtgtgtctgggatactggcttggtgtttggggaagctattttctacttccattttcccatttgatctggccttcatactaggtataaaccatagcctgctaagcctccttccatggatcagatccttgccctctgctatggtttgaatgtgtcctccacaaaattcacggtgaaatttaatctccctggtggtattctttttggaaagtgatgaagtcacaatggcttcaccctcatgaatggaccagagggaactaacttaacaccttttgcctttctgccatcccaccatgtgagaacacagcctttgtcccctctggaggacatagcaaaaaggcagcatcttagaagcagaaagactggggcctcatcagacactgaacctgccagtgttctgatcatggactgctcagcctccagaactgtgaggaaataaatttctgtccttaataaattactcagtctcaggcattttgttatagcaccccaaaccaactaagttatccactctaccaggagcaaactctacttccctggaggctttctgtgcactatcgctgccactcaaaacctggagcctcacagagcctcttacacatgctgctgctctgtgacagggaaggagttcatgtggtttgttcctcatttgctccagctcaccctcctctctcaccctcatccctcgagttagggcacggtggtagggtctgcaggctctcctcaactcacttctcttgaagggtgctgctcctc

SEQ ID NO: 473653 - DNA, 1033 bp, Homo sapiens
ctgtactaaaagatggggttggtgaccgtcatgatgatggtgataaagctgaaggaaaagttgctggcagcttcttcccttctgccttctggagaggtcagggatgcctggcggacggccgtggctgccccttcaaaggtgcttccaggatgcagacctggaaaggagcttaggaatatgatgactgtctatctgaatatggataaaatgagagaaggttttgggaacatcagagtggccccaaagaagggaatccctgaacccaaaccagctgcccagctactgctggtagcccaggttctgaggctgaggaatggggaagccccatccccactcttcagcacccagttgattggaagagggaggaagctggcagctggggaaaggtcttgggccaaacatttttccactggtgaatcagaggacagcagtaacaggagccaggctggcctgaccccagccacctctgtgagtcatagctgaggtccctgtgctaatcttaacccctcagagaggacttgttgggacttgccaccaaatcttgaccaccaaaatagtcttggagctgacgtggccctggaaagccctggcccatcacagaaggggtcagagaatggagccagggtagagagggctggtctgggagttaggctgtgccccagctctcccgtgaccttgagcaactcacagtgaagtgttagcaagatgggctcccaggtcccttccagacattctcccagaccagagccaaactgggtctgagaaggaaggaaccaggacctgaggcagcagaaggttttcaggccaggtctggccctgccctcatcacagttgctcaccaaggtcctcgccttttacagtgcacagctagtgacagcaaccttggttctggggccagctgcatccaaaatttgttctgggatttttgacaagttgcttcacaaatctcctttctacagggaaggcagtacagctagtggtttaaggcactggactttgaagtcagactaacccaggtgagaatcacttagtc

SEQ ID NO: 473654 - DNA, 4901 bp, Homo sapiens
tggtggtaataatggtgatagtactggtggctgatgataatggtagtggtcatgatggtgatggtggtggtgatgatgatgatgatgatggaaatagtgatgataatattggtggtgatggtggtggaaatggcaatggtaatggcgatgatggtggtaatggtggtggtgatgatggtgatgatcctgctggtggtggtagtgttgatggcaataatagtggtcatggtagtggtgatgatgtggttagagaagtcctgcttcagggagatactgggcactcatcagagattgagctactactgtgtttcccttttggattttatccttatgctgtgattcccttggcaggaaacctggaaggaagggagatgacaccaaggagtcaacttgagaccaagaccatcagctatcaaaagacatcttttggggcctccacccatcccatgaccaatcacactgtgaggttgtccatatgtcctgccagctgccgccaggaccagtgccttagcaacaggagcttttgcacgctgggagagggaactctggcaccttcccaagggtttgccggaagggagctggaggggcagcaggatggagaggaagagggcgcattacaggcaaactggagacaatccgggaaactcccagaaaccccagcaaagactgcagagagagcctggggatccacagaggcctacatgacctcaaggcccagagtcactggcttccagaaggcagggaagttgatgacatgcatctctgtacctctgtgtccttaccggtaactaaagcagaggcctgggggcctggtggggaaagtggcccagatcagacctctaggggatccagagaaggcagaagaccttagaggattcagagcctaggctgggaaagtagtctcttgctgggaagacctgcaaagggatggccatttgcaaccctcttgagcaagatggtggaaggtggacttgtaaactgctagcatggggcttccctgagttctcttcactcattgctacctagaagaccttgacttcacctagggtgcagagtcttgaggttttaagactgaatgcgaccttacccaaccttgctctgccctttgccagaacactacatgtggtacttgactctggaaagacaacaaacgtgagattcccttcccagtcctgcatccctaactcctttcgcctggcttatctcctcctaggaggcctgggcggcagccttccccaggaatgtaagagcttcctctttgctcttccagccaagtccctttcccccttcacttagctaaaataagattggactttctcaaaatgtttactaggaaactaagaaataaacaaaacaaaaccaaaggcaagtgatggaggttgatgaactattacaggattgtagaatctaacagcaatcttcggtcaaagaacccaactcaaatctctcgggattttttttagaagtgcttcttatttcttctttcttattttattatactagtcctcattctcattatgttttgctaatccttttgagcacatgctatgtgccaagcattttgcaacatgatcatttatcgttttatcaggcaaggcattgtgtacatatatcattgtatcatgctcagacgggttaaataattcatccacagctgttcccctggaaagtggcagggctagatgttgaaaccaggctctctgaccttaaaacttatgtattgatcaccctccaccctgcctctctttgactgtgtgtccacacccctccttgtaactcaaggcatctaatgtgaagtgccctgccagggacacatgtgaacctttggacccattcctgctccaggtgaaattcatgcagaagctcctgacactggttatgaatagtttgcaacttcaagaaaacaaataaatgcgattgtcttacatttcctttaccttttcttcttatggacttcaggtgcagagttacagtgtctgctccatgattcatcatcattagttcacatgtggatttcctttatttcttatatatgtatttgtttatttttaagaaaataaacacccacagaccaccacccatctcaagaaacagaacattacagacaatttacaactacctattttcctccccaatcctgttgcctggccccatctccttatcattctcttgcttttttaaaaaaaaactcatttaaacttatatatgtatatatgtattttaaaacataattctttagttttatttgttttcaaacttgtgggattagagctgagggccagaaccttctgaagtttctttttttcattctaaataatgtttcatccaaaatgtatggattcatccatgtaagtagtacatggatgtatactttttttcttttccttgttcttataactacaaatagacatataagtttaacaagatttttcaccacctttgaatctaaaatatcttgcagtagctctagaatttagctcttttcttaaaagatacttcaaaaagtatcttcagtgtgcgtcttttgcagctggtcatctgagcccatgtataactgggaatatttttattatgtcattcaaatgacaatttgggtatatacaaaagtcttaattcaaaggttttccttcaatatttaaaaaatattaatccattgtcttttttactctgctgctgctattcagaagtctgatgtcaatacagctcttgcacctttgtagttgttcagtcctttctctaaagaagcttttaaaatgttctcttctttcatattcttatattttactgtagtgtattcaggagtgagattttccttctttctcctgtttgcactttattgcactttattgatccatttaatctcatattatttattttttaattctggcaaacatttctctattattttatcaaatactttctatatatttttatcttcttaattcttatgcttttatcttcttctgggactcttattatctggatgttaacacttgcatactctatcttctttaactttttttgtgtatgttctattcctttatcctttcctatcaccttctggaaagcttcctcaatctgatcttccaattcattaatttgttctccggctgtattcatactattatttatttgtgtatcatgttctttatttcaactattatatttctcttatgtaataattctaccgggtacttttaaaatttttaaaattgtcatttcatagtattacatatatggtgctccatttctgtaaatgtgtttagcttattttaaattttcaatccagttttctaatattcctacttcagaagtaatgcggttttactcttgaggtggtggcattccctcagggttatttgggcacgtattctccaagggtctcagttactgtcttaaaatacatagtagagaagggaaggccacactgtagtcatggggccaagacattgagacacttgtttaccatcatacttcaaagcaactcctcaggccaaaggttggtggaaagaacaatctctctggatagaaaccactagcctagggtgagagaggaagaagatagaatatgcagctgagcttgtcccaacctgtcttccccaactacctcctccagaggagtaggtgcattgcccagacaatacccctacagatacctgctcaaactgcacggccactgtctccaaaatctgccgtaagaggtacacaatgcttgccctaatgtaatgtagggaaaaggcaagatcagatcttaaaccacttttctctcatttaacctctcattgtcactatcaatcacctttcattcaggtttttaccaaaataccagttcaaagtacctttcagtttccctggatatttctatttttttttctttgctggcgtgtgtgtgtttgtgtgtgtgtgtgtgtgtgtgtgcacgcgtgtgtgtggtgctggtgatggttgtggttttgtttcctggattctgcattctcctttataggttcccctttatagaggctgattcttggagagggagccattgtgctgtgactatttgcacctaggtgggaaccagataccctcatcttaaccatttctatgtctatgttcctacaatcctttcatctggacattcccaggaaacagattatctccggttcctttttgatttttaaatgacattctacaacccatctaaaaaactgaaacatacttaatacagaatgctctaaaagtacacaaacacacaaagcaaaagccatctacaattttactactgtgagatttctcctatgaattcaatgtgaatagatcctgtcagaaccttcaagagggttgtaattgtgtacatgccagccaggtgtctcagattcctatttcctcacacccactactaatactgtatgtattattgatttattaaaagtttgccaagctggtggtggaaaaatgtgtaatttcttattgctataacttgtagtcccaggtctaaagaatagttgggcactgttccatatgtgtactggatgtttgcccttctgtgaaatgctcattcttaccctttgcccagtttgctttgagttgtttgattttttttcttattgatttgtagggcttctttatatattacaaatattgactcttgctatatgtgtttcatatattttcttctctatggaaaaatgatttttatttaattgtgttaatgttgtctttgaaaataaagatgtttacacttttcatgtggttgaatctttcaatatttttcctttaagacatctgagtttcatgtgttgcctagcaaggtctttcccaccccataattagaaaaaaaatgtcaaaggataaaataaatatttctccagagcaaatatgcaaatggccaatacttatatgaaaagatgctcaacatcatt

SEQ ID NO: 473655 - DNA, 1495 bp, Homo sapiens
gtatatatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcgtatccacctacatatatgcgtatgtatacgcatatccacattcatacatgcacacacatatgtatacatatatacacatatacatacacacatgtgtatatatgcatatatacacacatatgtatacgtatatatgcagtgtatgtgtttaagggaagaagtagtatatgtgtatatatatgaacttttgtttctgtggttaaagatattgtccatctctcatgtttcccccttgatccatctgctcctctttctccttctggaatggcaatgaagttgtttttaaatacgggctttattattattcaggtgtggcgaggccaacagatcaggacacaaccaccattgaaaagatggtttattactcacagtcccaagaggagaaggcataatatgccatgggtggtcagcaaggccccagattttgaagccccagaaatacagaaaataaaaaggcatgatgaatacagaagtagaggtattccagaaggaggcattgttatcataggagatgacagctgcatgcatgttactgcccctgtagaccttccagtgggacaaggtgtggaggtggaagacagtgatattgatgatcctgaccctgtggaggcctaggctaatgtgtgtgtttatgtcttagtttttagcaaaaaggtttaaaaagtaaagaaaaaattttaaaataggaaaaagcttatagaataaggaaataaataattttcgtaaagctgtacaatgtgtttgtgttttaagctgaatgtgtaaagtcaaaaagttaaaaaattaaaaagcttataaagtaaaaacaattacagtaatttaaagtaatttaagatacaaatctttagacatcttatttcacttctcttggttatgtatgtaggagtgggatggctgagtcatgcagtaggtatatgtttaacttttgaacaaactcacaaatagttttccaaagtagctgtcccattttacatcccttccagcaatctatgagagtactagttgttccacctatttgcaatacttggtattgtaaatctttttagatgagggctgaggtcatgtgggttataacagcaacattaaagggacagagtt

SEQ ID NO: 473656 - DNA, 754 bp, Homo sapiens
ccaccgctgtctctgctcacccaccctctgtcccgcttctccctgacctgacccaggggcagccttgctgtgggagctatttccaaggacaaccctggcagccccaggccctgtcctggacccgggatgcctgtgcacctccaccccagactgagacagaggaaccctctacacctgcaggagacagaagcttctagaatccacgtgggaggaaactgaaggactggaccacataggtcagtggctgatggtcttgaccatgcagagaagccaagatcgtatccatccacatcggaagaaaagcattcataatttgccctgggcacccagtaatgattctggacacacctcacctctctctggggatcggccttctgcccgaggagttttcgcacacaatggttggcaggctttggcatttattttcatcactgttttgaaggtgaatggcatttgtcacattctttcctggctgactttgatgtggggtgaattcccactccctaatgacaggaagtcctggaatcctagaataaacattaagccagagtctgatcagcttcttgaggtcaagccctttgtgggaaaggctgagaacaggctcttaaattgtaaagaaaaggttccaggccaccccaagggtcagctgccaaactaggcccggaaggaggagctactgcccaccagataactgcatttcacattagtcagactcccataagcctggctaagaaatgtaagaaacaaagttcat

SEQ ID NO: 473657 - DNA, 627 bp, Homo sapiens
ccctgtccatgaaggcagctgtgcagatgctggctcccactgaggaccaaactcgaggccacagcatggttctgcagtgggaggcctgtggagatgctcaagggtttcagggaaaccaggacttgaagtggctgtgtcaccctgtgcttcaaaccttggatggctcctcttggacctggataaagctgagaatctgcgcagaggtgagagctgcctgtttggcaaattcctggatttcaggggaagaaataggaactcctgcccagggagaaggaggaggcatggacactgaagaacagtctcgaggacaactgcacagccaggtctggagagcggccgtgggagaagccttgagtgggttgagtgcccagcagctccgtggaggctatcacaagaatatcagagaagcgaggtgggtaggaggcgttctggacagggaagcagccagcagaatgggatgaacttacattcaggggccaggaacataaggtttcactgtgaccacgtcgctataactgacaaaatgcaaataagctccactcccactgatgtagacaacgccctggagtagaattaaaaaaagaaaacgttgtgccaacctattttgattgtgtacttctgcaataa

SEQ ID NO: 473658 - DNA, 4955 bp, Homo sapiens
cccaagttctgattcctaggccaaccagctgtggccagagggacagggtcccagaccacaactcccagcacttgcttgcaaggctgctttcctgagaagcggtggtgggaatggcaggcgtgtggagtcccacagaccagcacttctggcacccagcccatgagaacagaattcctgcccctgataatggcacagctggctgttatcaggggcaagaagtgcagttgggccagtggaaaaagagcaaattggcagctgatactgcccagtggactggaagacaagagacaggcccaacacttggatggactggagtttctgaaagggccaaaggcagaatccagacctggaagcacgatggggcctcatatgagactggttcaaaggcaagccctagtctctggatctggagcatttccacactgacttgccagtgtacaattgcacagttctctccagacctgctgggtatgactcgaggcttaccaataggattttcagaatatcgattgattaccctggggcaatggctggtggaagtcttttaatttgtcttgcccactgtctgctgactcttctgatcctttggtttttaaattttataggagtagcttgcagcgttcctgcctctctggcctatccagtcccattctcctgtcaccatctctgtgggctcccttccccagcaagcttctccttagaggagtccagacctactacctcatctcctctcctcccatcctcaccgcagcattttgcaatccaccctctgcctctgttgctccaagggtaagagatacaagtttcctgcaactttctttcaaatgttacaggaaattttatatatatatatatatatatgtatgtatatgtgtatatatatgtatatgtgtgtatatatgtatatgtatatatatgtataggtatatatatgtgtatatatgtatatatgtgtatatatgtatatatgtgtatatattatatatgtgtatgtgtgtatatatgtgtgtatatatatgtgtgtgtatatatgtgtgtatatatatgtgtgtgtgtatatatatatgtatatgcatctgtgggtatataataaaacaattgtcaaatgtccacaattagtgggtctttgttaaggctatgatggaattgattatactattcttatacttttttggtaaatttaaaatcttttcaaaaaaggaaagagttaaaaatgaaaatgcatatatgtaatcaaaagctaagatttctgtttacatatgtttcgaggaaggaatccaacttagccattatttagtgaacacttattttccaattctatgaaatatctccataatcaataataaaatctcgcacatatttggatctgctcctgccttcctagtctgtctcatgaatccatctgtctgtttttcttcaccagtaaatacactgtaattgttgtagcctttagttatgtttaatatctagtagggcaagcccatccaccttgctcttcaacattttcctccccatgcttctattcttccagagaaacttacaataattttgtcagatttccttaagagaaaaaaactcactgaaattttgattgatatttagtcacttattgattaactgggaaaattaaaatcttataatttttgttgattcttcctagaaaaaaaatgcttgtttctccttttgttcaagtctcattttgggttcttctgtaaagtcttttcattttctttacataaatcttgcgcattccttgctaagttaattcccatgaattttgttgctgtagtaaatgcaatatatttccgtgatatgttctaatggcttgttcattatcataggaaggatattggtttttataactatatttctgtattttgtgactgctaccccactaaactcatttgttagctatacgacattttcagttgattttttgagatgttcaaattacaaaaccatatcccctgaaaatgatggtgataatatttccttcttgggaatatttatgacccttattttatcttcttgtttatttccattgctagaactttcagaacattaataagtaatagtgaagatagaggcatccttgtcttgttcctgaacttaatttggatgccaatgatttttcacagttaatgataatgttgctttagtttgagagagatttcctttatcatgttaaaagagcgttctttaattcttttattcacaaaaacatcaccaggaatgaattgcaatgtcttgaaatttttctaaaactctgatttactaagctctgattctgtgcccagctctgtgccaagaattttaaatttaccatttaatgtaacctgcacatgaccctgactattaaaaattacgtttcaaattatacagtagaagaactgaccaaggacccagagttgggaagtgaaaaagacaggatttgaactcaggctttcgaaattcaagctcttgacactctatggcaatgataatgtggtttttttttttgccttaatctattaaaaaaattgatcacattaagaaatttcctagtattgaacaacatttgcattgctagaatcagctctgcttatacatagtgtattattagtgtattattattttaaacacatggcttcattcacttttataatatttcgagtctgtatttgcgaaattagcctgcagtttctcttttgcccatctggctggctggctttagtgtccaggcaatgccagcttagctaaatgacttgggaagctgcctgtctttttccatgcactaatcctatttaaacagcccaaagatgatctgttccttgaagttttgaaagaacttgcccctccaacagtctgggtttaaaactttttttttttttttttttttttacaactttttcagcttcatcttgaatgacccaagagctacttagaaggatagtttttaattccccaagtggcctgatgtttctgttctttgcttaccctttgcttcttaatgtctagttttcttgaattctgtccccaggcaaccacttaaaacttagattgtttacatcttattacctatttagaatgtttaaaaatcctaagaaggtctacgtgatttgatttttctagttcttcttttaagacaccttgacctgtcaaatacagagatccataagtttaaaatccccactatggattcatggatttttttttatataatagcttttgctttctattttttaacgagatgttacttggttcataaaagtttatgatgtatctttattgtggattgtcattttgatcaatataaaatagcactctcttatttgcatttctcatgcactactaatatgtatttctgctctctttttgtttgcattttgagtataatattttcccacttctctgttttgcatgtttccactgtatgtttctgaaagagtatatactttgatttttttacataatctaaaaattttcatctattcacagtagaatctcatatgttgatatttgtggtgaaacttgtatgtttagcattgtttctgtaatattattttgtactttgtttttatatttccttcctgtttctttttctgaatttacttaattgcttaaatattttggtgtatttttctatagtaatttgaaagttatgtatacctgtagaataaaacaaaatatttaaagcaaaaaaaattctaccaattttaataattaaataatatctataactgtactgaagtaagatgagaaatttaggacatttttctttctttctttctttctttgcctatcttttcctcaccttaaagttttgtcagaataattatttattttggatttatgttcttttccttcaagaattattttgaatgtttgcatttggctttgtatccatattccaaatgatgatttagacattaactattccttcctggctgagttactcatggctgtttcttttgtatcacttctttcattctctggttcttgattttgactcatttctcggttgattggtggatcttttggggtaatgtttttaaagcagaattacatgagttcctacatgtctgaaaatgcctctttcttgacctatatatgagcgacatcatagctatgtatagaattttttcacaattgttgtcactcgaaattcagcagacattgcttcattgttttctgaaatttaaagttgcacaagtgaagtctgggatgacctgatttttctctctctctgtttctttcctacctagatactgaaaattgttttcctttatccttaagccttgatgagtccttttatattaatgttgccccttacatctgatggctgacatcttccttcacatcagagaaattttcttctattatttatttgagtatgggtatagtaaattataattaaatgaaaatttaaaatagagactttaatgagtctataaaagctccattgactcaaaataagctccctaaataaatgttgaatgaatgaataagcaaagaatggatgagtgaatcttttttctccattttctttgttctcttcttcttcctaacatggcttttatgtcttcccccatctccattagaattttcttctgatatctcttagaaattttcaagctactttccttatttcatttgattttatgttattcatggcttacactttttaaattttacagtagtgatttttcatattttaaccttttcctttacaaaaaaattttgcagttgagatttgtttcttctcatgggtgcaatgaatcttgtaaaaactctaacaagaggtatcacattgtatttccttttgttctgttttctctggtttcttgcagtaactcttttccaaagggaacgcatctgtttagtttccctggatttgtccttgcaaagccagcctctaagatgtccctgcaaattcccacctcctgccattcctgcccttctgtgttgccctctct

SEQ ID NO: 473659 - DNA, 622 bp, Homo sapiens
caccctccactcctctctctcctcctcctggcacaccccctctgtctgagagcctgagcctgccacacatgctcatttctccagtttgagcccgcacttgccctgactcttctctatgttctctccctcctcccagcctcccaggcactgtccccagcctgccaggcactgtccccagcctgccactgccaaggagcccccaggagcaccctcagccccagggccacctgcaggccagaacaggggctgcaggaagctgcacttcttccggctttctcagggcccaaggaggggcctgctctgtccccttgttcagctccttctctgccagccctacaggaaggaaaggaggccacgcctcacagcttgtgccccaatctggagcttctgcacccgtgccccaggtccatggggccccacccttacttgtcttcactctgagcctggagaggcccaggacttccagaaagctgcaggccaggaccctcagcagctcctccccattctgggagaaagccccaagacagcctctgagacgactctgactttctagctgtggaacgttgggcaagtcacttagcactcagagcctcagtttcctcacatgcaaaaagggataatc

SEQ ID NO: 473660 - DNA, 1012 bp, Homo sapiens
actgctcagaaaacaaaagattctcttcaaaatattactgctcattgacaatacatctagtcactcaagagctctgatggggatatacaaggagatgaatattgctttcattactgctaacacaacatccattctactgcccatggatcaaggagtatttttgactttcaagtcttatttaagaaatatatttcataaggcattagttgccacagatactgattcctctgatggatctgggcaaagtcaattgaaaaccttctggaaaaaatgtatcattttagatggcattaagaacatttgtgattcatggaaggaaggagacattgccacagccaccccatccttcagcaaccaccaccctgatccatcagcagtcataagcattgaggcaaaaccctccaccagcaaaaagatgatgacttgttgaaggctcagatgattgttagtatttttttagcaatgacatattttctacttaagtacattttttagacataatgctattacacacttaatagacttcaatgtattgtaaacataacttttatatgcactgggaaatcaaaatttttgtgactcacttcatgttgatattcgggattgactgaacctgcaatgcctctgaggtctgcctgtaccggcattcacgtgcacttgggcttgctgttgggctgccagccaatatcaaccaagctcttctccacttccagttggttctctctgtccttatcatgtagaacagtgctaaacacagaagatgctagtccttaattaaatgagtaaggaaatgaattaaatctggagcttttcatctcactgctttctgtagcagtgccaccatgtgttgtagagctcccacaattatttattgaaagtctccattttaccactggcaaaatactagtatcaatttacctgtctcataaggctgtttgaatgttcatcaattttttctccacatcatgaaaatgtttcatttgccactcgtattaatctgttctcacactgc

SEQ ID NO: 473661 - DNA, 618 bp, Homo sapiens
gtgctggcacagcaggctggcctgcctaggggggctctggacaccagctgccctcccttctgcctgctgcgcccccaggcagaacatccagaagaagccctcaaaccagctagtgtagatggacattgataaaggagactgggctaccaaacagaagtcagcattcggaagataccagccagccagagaagatgccaccggaagcagaaccacatgggcctctgtgggtcctggaaatggggtgctgtttgtacaaggcccttggaggcagcccctctgtgagtcactgttactgctcctgataaaccaattgactcaaatctgtcctgtggctctcagttccatgaccctggctcagagcctggcacgacctccatggcccacagaacccaagtgtatccttcctagaacagtgagggtagcacctccatgtgaccatgtgatcactggccactccctacatgcactgatcatgtccatcactacaagggccacacctgagaggatccaggaccactgcttgatgctaagcagatgctgttgacaaatgacccaataaggacacaatggcaagggtggaacggggggaagctggaaagatggccccatagagccaac

SEQ ID NO: 473662 - DNA, 736 bp, Homo sapiens
ttcactgactccatacccaggacccacagccagccgtggtcgggtgatgccctccacattccaatacctggaagcagcaattcctgtgagcactgtgccttttatggaccaatttatctgccagtccagcctccaagaggagctggggccaagttggagacctgcttatgcttgtcagcctctgtggccagatgacaagagagcagcccacagctgggagaggactgggaagtccccgtgtgcagagcctccctggagttccattcttggcctctttgcacctgcgcacagtccctggtggtgctgcaccctcacaagggctccacgcctatttctagctcctgccttctctgcagagttccaggcctgtgtttggctctatctacttggaagactcacaggttcttcaaaaccaaccaacgtgaagccagtttgtcctgacttttaccccaaacctgatgactgcttcatcccctgtcttgagaagtctccactgcccacccattgtctaaaccagagcccctgttcccacagcattaaagtggagatgacagagtccctcctggagagccggtctagccattcagtgagtcagcagcacagctcctccagcacgcagagaacagcggtccatggagggagggcgtgagcctggggttttactgaggaaggatagtgggtttttcagtccctgaagctgctgctctgcccactcaggaaggtgaggaaggcagac

SEQ ID NO: 473663 - DNA, 1131 bp, Homo sapiens
ccgctcgccatcggcctgcaggctcacgcttggtcctgtatgcagctaagccatcaaccagggaactgtcctctgcctgagggtccaggaagaagcacggtgcctcagcagcagcagagccggaccccagggttccaacgagaaacctcatctgggcagtcagccgtgactgctgattccaccaggcctggaggggcggtccttgagcgtggaactcttgttatccaatggcaccagcgactcatcgtgacatcagggactccaaccgagaaaggctttagaggctgcccttgcaatggctcccccgcatctcctcctctgtgctcccttttcctgctcacatgccaggaattgactgagggactccgtggcgcttcggggccagctcacaacacccacggggcagctgcagactggggagacctccctcacgggatctaatcttctcgcagttcctgggactcacgggtatggggaaggaggggacaggggctgccctccagttctgacctgagaacctgggaagcctttgggaccctcccaggcagcccctctataggcccctcctgtatctgtggggagaagagggcagcagtgtcccctaggagaggagcggaggcagcctgggaaccaggccaccatggaaccacccctagctggccatcagggagaggactgcctggctcagcctgcaccgtggggggcagctggggctgcctggcagccttgcagggtccgaagtgcctcttgggatgggacgtggtatcgcgttagcaggtttgacctgggttccctgtgtgtggaggggcacgggcttgtcagaagcagcaaggtgcttgtgtgaaggactgtgcaggtgtcacctccaactcaggcctctgctagggacgttccagcctctctctccctgtgtcctacgtgcctgagtgccacagagtcaccctgggagtaggctctgtcctctacgtttctctttggccacaggaatgtcggggaggatgtcttcgtgtggttatcaccagcggcccctgaccgctggttagaagggacacttttctggtgctcgtaggcacgcggttcctaacagcggggaagccttctgcaaaatgcacctcattgtgcagacatcac

SEQ ID NO: 473664 - DNA, 3218 bp, Homo sapiens
cactcagtgggtcccgagctcttctcgcatccaagaagaatgagctcttctccgaagttaagccatctctcctccaaagtccagccatcccactgaagtcaagtcgcctctctccagtcaagccacttctctcacctctaccaactgagtctggggtctttataggcacaggatgagggtgtggggcaggccacaggagatagtgggcgaacacggatataagttcttactttgggcagcgggtttcaggcttttcggcttgaagagccatcagtctccccaggtctttgcagacctgccaacttctctagaaggagcagcctcactgtctgatcccagcatcctgcccagctcctgcccagctcagcaaaggtttatggattcctgtggtgtgcaaggcaccgttagaccctggtaccacaatgaactaggtggtgagagctcacctgtcaacgaacatttcatttcaccttttcgaacacaaagtgacaacgtggttcgagttaaaatcatttattctctttttcaaacaaaagatctgagtgtgggggagatgaggtcagaggctgccgggagtgccttgtccctcagtctgcacagagtcactgtcccagagatgcacacttcctgcctgtgctctctcgtccttgacaggagctgagtgaggctctggggagtcccccactgcgggatgtgcagctttgcaaatctgcagggctcttttattcctgcccccaccccaaccaagaacacaagcctaccaaaagcaaacccatagtttcttatgcaactaagtgcttatatttaccatgtgggaatgcaaccatcctaccaatcttagctgctccatggtcgtgactggagtatagaatcaaggcactttttgcaagagtggcaaatactagggcattgtatagagaagtagtactggttgcaaataaaatgataataaccaatttttactattgggatggaagtttatttcctccatataaactgagttgcaattccacttgagtgaattcttttgatgaagtctttaccaaacatgggctctttaccacccccagtgaatgcaggtgccgttcagaggtgagaaaaaatcaccatctgatgtgggggaaagagcacggggtcagatgagctggcccagcccaggctgaatgctgtgacagtctctccatgtgacctcatgactttcccacttgctgggctccctccacgggcagaaccctgtgcccaaggtgcccaggctcacaggaacccaccctcatcctcaccctgcttcccagggcagctccccctgctaactctggtgatgtgcaacttccatgcaaggtttcatttgaaagaactgattttacattatttcagaagggcctctcatatatataaggtccttctcagctctgacaagataggatatattcacaccaactttttttcaggctggctgcagacagccccaaatgcttcattccagccgcccctgccccacctagacttgtcttcccacctaagttatccacaccatactctttattttcctgacccttccatgtgtgcccttgctgccctgccctctcgctcatgggcccgcctttatggccccaccaaggccattttcctaaaaagcaggcaaatcacactattgcactgttcagccatcagatgcctcctgccctgccctctgcctgaagagcagagttagggcaccttcacctggcatccaaggcctccacaggtctccccaaactgtctttgcagcctcactgccactgaagttctgtgcttctgtttaccaactcgctgtctcttcccatgctggcatagccttgcccacacccttctctccataggaaaggcctttcaaaatcctactgtagcccacccaaagcccacgataatatcctacccagcacagagatgagtgacctctgcttctgtgttccctcccacaacttgaacttctcttgatcactcaggtttttgttttgcttcgttttgctttctttacagtataatgtaacatctggtttcgtggaaaaacaatgaatttgggagcccatcagccctgaattcaaacccagtccctcttgcatgtagcacagctggcctgtcagccacagggaagcaggcgccatgcctctctcatcacagatccatacccagcattcagctgtgcttctcactgttccaagtgatttatgggaattgttttgtcccgtgcacacagcaaccatcacagagctatgcgaccagtgcaaacatgacacgcaaattcaggaagctttccatatttttaaaacagaactgttcaaacatcttgtcttgtttgttttactttatttttatatgttttcagttcatcatctatgtctgctcttaagtcctttccccacctccagagagccacttcctgtgcatggcgtctgtctttaaatatgcctgtgtgcatgaagaatgtgcagaacgtagccagtctaacaggtgtgaggtgatatttcattgtggttataatttcactacactgtgtatgttcaaaggagattaaatcaatataccaatgatgtatctacactcccgtgtttactacagaattatttacagtaggcaaaatatggaaacaatctaaatgtccatcaactaataaatggataaagaaaatgtggcatatatacatatatatgtatatatataaatactttatatatgtgtatatataaatactttatatatgtgtatatgtaaatactttatatatgtgtatatgtaaatactttatatatgtgtacatgtaaatactttatatatgtgtatatgtaaatactttatatatgtgtatatgtaaatactttatatatgtgtatatgtaaatactttatatatgtgtatatgtaaatactttatatatgtgtatatgtaaatactttatatatgtgtatatgtaaatactttagtgtatatatactttatatatgtgtatatatactttatatatgtgtatatatactttatatatgtgtatatatactttatatatgtgtatatatactttatatatgtgtatatatactttatatatgtgtatacataaatattttatatatgtgtatacataaatactttatatatgtatatataaatcctttatatatgtgtatatataaacactttatatatgtgtatatataaatactttgtatatatatatataa

SEQ ID NO: 473665 - DNA, 777 bp, Homo sapiens
tttgctcagccaaccccaaccctctctggtgtcattgtcctgtgcttctgacaaaggccaaggggtttggaagccagtctgtggccccaagtaccagttcagttctcccagccagcttttgaagtagaaagacggatttattataacggcggctagcagggcatgtcgcatttatggcagaagtgcaagaagccaagccaaaccacatgggtgcaagtgaggactgtgttagcatcttgtttgctaactttccggggccaagaaagcaagtcatgtgacaaacctctaaatcaacccaaaatagattgtcctccacatatcgcaccgggaggcaccaaggaatcacatggaactagttctagctgtatgatctattacagagagggtgaaggcagagcacccagtggtgacccagccaacagtctgactcttcctgctctgcagacctcaatcctcctccatgtgagtcagcccaagggctggcttggaatagaggctgacaagaagcccagttggagccataaatccaaactgaactctccaatataaatttatttctcagacaacaaacaacagatgaacaaaatctcttgttggctttaaaactcaatctctacagctcctgtgtcttatttcttagtacgtcttaattcatagaagatttagggcttatgaatgattagccccctaagaaccagcaagcccccttcgttctttctttttcccatttttaaataaaatttcattaaatacagtttcattaaagtataacaccca

SEQ ID NO: 473666 - DNA, 467 bp, Homo sapiens
acagcacaaagccatgagggatcctgcccccatggcccaatcatctcctactatgtcccaaccccaacattgggtattacattttgacatgagattcaggtgggggcaaatatccagacagtatcataaacctttccagttttgtcttttcataataccctcccactctcacccccacttccactttatggaaaaatttatagtctataaatgttccagctgtctctttgatcagttgcaaatattaattgactgggtccctcaacactatttctatttcctcaaattcctattcattcttcagcaaactctttacttaaatttatccttcaccatatgctcttcaagtactccagaaaatacaatattgcaactgaattcccttgaaaagaaacagaaccagtagaggagagagggagagaaggagagagagaggcttattaaaaggaattggcttatgtaattac

SEQ ID NO: 473667 - DNA, 732 bp, Homo sapiens
aacatactctgaatgaatagacttttcttgttttcatttggttggtcttcatttatttccacaagacttaaaaggctaaaatcaaggtgtcagcaaagctggatggagattatgggaaaagtaaatctgcttctgaagttactcagatttttggcagaattcagttgctttagtttgtacgatgaagatccctatttcctcaacttgtggcttccttcatcttcaagccaaaaatggtggttatttttcaggcttcaaatctctgattttctattttgtcctgtcttcttagaaagtcttgaaatcagcaactgtacacattctaagagagaaaaaaggactggaagaaaatttgctaccatattagaaagaagaatgaaggaaagcccgaaagaggtaacggctgtggctgcaatgtttaaagaaaaactagagtacaaaaatgaacaggcacagacggagaagcgaagccgatagagtgactcataatcaaagtccaaatagcttttgggtcacaagaaccaattgtccctataggacaattattatttagttataagatgaaggaagtcaagcactgatcaaactactcttgataagttttgcaaataaataaaccacatgaattttcaatgtttctaatgttttaaactatcatgtttaataaatattagttttatcatttttaatttccctatacatttatgtcagagtaatttttttaatgttttg

SEQ ID NO: 473668 - DNA, 1030 bp, Homo sapiens
ttcaggtgtactctgggtggaggctgttgctgatttgcacttgccaacagcagtggcagtgttgtggagtacactgttgtcagttgtgttggagtgccagcacagggctgctggcttctatgcaagtgtgcgcagcagtggcagcatggcatgaggtgggtggaagagggcctgccatccgtgcatgtgtttgcaccagtggcagtagcagcacaggagcagagctggcaggcagagtgctggctggtgccctctgtacatgtgtttatttaggtagcagtggccatgcagggcagggtggcaaggatgctcgtctttgtgggaactgctctggggatgccaggactcttgcaagtttatatgatcatcctggactaaatgcctatgaacaatacaggaagaggcaattaattggacaaaacataatgaatttagcagatggaggcagagtgggaagctatttgacatcatttggtactatgaatgccaaaagagcaataattatttatgttaatagtttaatggcaaaaaatacaaaataaatgaataaaaagttttttcttatataagtatagaaatagctaaataaaaatgaaaaaaattgattttcctggttaatcgcatcaagtttttacctccttctgattatacagatagagcatttattttattatgcagaatggattttaaaggggtttaaaaaagaaactaccgttcaaggttttatgacttgggaaatgcatgatatcactaaggcaacaaaggttacacaaatagtataaaatgtcattttttatgaagtctgcaggcttcattaaaaataactaaatatcacctcttttatgaaatatttaaatttacattataaatatatttttagaaattcttcataaggttatctccaatttatgctgttctccaaatgtatatttttatttatttatatatattatcaattatactaaaagaatgatcttttccaggaatgtgatttatgggcatgttcaattatgctttacattttcacctt

SEQ ID NO: 473669 - DNA, 735 bp, Homo sapiens
cacagcagtccccagagtgtgatgtttcccttcctgtgtccatgtgttctcattgttcaattcccacctatgattgagaacatgcggtgtttggttttttcttttcagctctatcagattagtttagttctttctttaaaagggtgttttgcctttcagcttttatattgttttactggattccttaaattccttggattggattttgacattctcctgaatctcagtggtcttctttcctgtccagattctgaattctatgtctgtcatttcagccatttaagtctgcttaagagccatggctggggagctagcatggccatttgcagagcttcttggagtgtgtcagtcttcttgatggtctggtgtcttggtgaaaagctcatcctggctgcagctagtcagccatcttggctcccttctccaaaaaatattttttataaacagtataaactaagtgtacagtatttgtaaagtctacggtagtgtatattaatgtcctaggcctttatgtttattcaccattcactgacttacccagagcaacttccagtcccacgagcttcattcgtgactgcgctgcaaatctttaagttcacttatctgcaatgtctaatttgcaattactgtcttttagtgtatttttaaactcaaactttagtttccctacaaaagttgaatatgcacattaaagaaaatcatctatgtctctatttatatacttgatatttttat

SEQ ID NO: 473670 - DNA, 1047 bp, Homo sapiens
ataactttcctgaggcctctacagccatgcagaactaatccgacctgtgataggacacctaagaaagggtgagagacctgagatagggatgggatgaaggacctgaaattcctcctccccttcaggactaagcaggagaaaatccaacgtccgcctccagagtggcccccaaagtggcattttcatgatagacttgttattaccaagggtctgctgcagtttgctggaagtccactccagaccttgttcacctgggtatcacaagtggaggctgcagaacagcaaagattactgcctgctccttcctctggaagattcaacccagaagggcactggcctgatgccagctggagctctcgtgaatggggtgtttgtcgacccctattgggaggtctttcccagtcaggaagcccgggtggatcagctactgtcttcagagccggcaggcaggaacttttaagtccgctgaagctgcacccacagctgccccttctcccaggtgctctgttccagggatatgggagtttcatccataagcccatgactggggctgctgcctttttttcagagatgtcctgcccaggccctggtggtgtaggcacacgagggaatcccccaaaaccaaagccttctgctttggtctggctggaggctgcagaccagagctgttcctattcagtcatcttgccagatccctatcttccacctaataaatttaaatcatatgtcaacttgtcttaccagagattacagtttgagattctccttggttttgatgataataaaagtgagatggagagagactagaactacttggggaaaagtttaaatgtctaatgggagattatttttggtaagagattaattatactgtaaaataattacttagtaataaaaggaagaaaagaaggcacattagtaatggccttcattatcttattctgtactctggcctcaatctttttgtctcttgattagctttgatgttcactcttacattcatttaattcaaaatttatgaactagtaccttttctctttcatttta

SEQ ID NO: 473671 - DNA, 603 bp, Homo sapiens
gacaaaattcaacagcacttcatgctaaaaactctcaataaattagggattgatgggatgtatctgaaaatagtaagagctatctatgacaaacccacaaccaatatcatactgaatgggaaaaaaactggtagtgttccctttgaaaactggcacaagacaggctctcccagagtagctgcggtaagtggaatagtgcatattgaaaatctggacacatgttacacatttctcaataccacccgactgagggaacaaggaattattataggatttgtctgccagggtggatatttcaaacaccctaatgacactggcagcaagtcactctaccacgggaaatctgatggtgagaacttcatcctgagcatgcaggtcctggaatcttgtccatggagaataccagacccaacacaaacagtgcctagtttttcactgcattgccaagactgagtggttggatagcaatcatgtggtctttggcaaggtctcctttaaaatcagtatattaattttggttaatgaagatttaatgttatctactttctgttattctaataacagcaaaatataccctgccatgaaatgtttttttctatttgc

SEQ ID NO: 473672 - DNA, 712 bp, Homo sapiens
tgcactctttttcagtaaggatgaggtatgagcgggaaataactctggcaccattctggcttttgagccaatacatgcaaacagataagctgtatattacctgtggccattgcgctacttctttagttcctagtctttctaccatgtctgaacttctgcttcagagaacagtatttgtagccttagaagataccagtctttctcttccttccatgtgtttagacattgctctcgtctttcagcgcccgtacatactgtgtgccccacgagaacagactatccccaggcttttaggcagtagttccagagcatcagtcagggggcagatacttctctcatctgctctggaggttgatgaagaaatctatgtcagcggttactatggtgttatctcacctgccctgacaacctctgacaatcctgtcctcacctctatgttgcagaaatcagcattccctgtttacagcagaactacataaaacgatagcaatttccttgtgcacatcaattttctttgtggatgggcagcctgttgcaataatgaggtctgtcagctctttgcaaaagaactggaaagtggccttactcgtgtggaaatcgaatagcaacttgtcactctcccttggcagcatagccccagactgtcaatgtggtgtcctgtgtcacattgtggcagtgggctaggtccctgcctgaagagatgctgctgatt

SEQ ID NO: 473673 - DNA, 622 bp, Homo sapiens
cgcatagccatgattcatgggtccaggaatcaaggggaggaagtggaagtggcaccactcaccatcaaccctactaatccactaagaaaatttttgctacctgttcctgcaacattgcattctgctggcctagaggtattagttccagagggaggaacactgccaccaggagacacaacaacgaatccattaaactggaagttaagattgccacctggacactttgggctcctcctacatttaagacaaaagactaagaagggagttacagtgttggatggggtgattgacccagactatcaagatgaaatcagtctattactccataacagagatctggctgtagttccctttcagccaagtgccaaaagtctgagctgtcttacccaaagacattttggatcactcttgggatctcttctgcaggttccttaacgagactcagcaatttatattacctcacttgcaaagactaatgtcagaagagaaatcttaatgtttcatatctcctgtaaaatattggaaaatcacagttctcttaggaagaaaaaagaagtttcaataaggttaacatctacaatatatgatggcatatgaggaacacatactttttattataagt

SEQ ID NO: 473674 - DNA, 1340 bp, Homo sapiens
gaggcctggatagcgaaaggagttaatcatcaaagctctgaggggagagcatttcatgctgaggaaacaatgattgcaaaggccttgatttcatttgtgtttcctggagaaatccagcagtggatgcagggcagactggaaggagatcaagatggagagcaaagcaagggccaggccatgcaagaccttgccagccatgttgaagattttgatcttcattctaaaagcactgggaagccagtgacagaggaagatggggaaccttggggaatgatgcctatggccatcttccattgcagctgccccacacgcaaaaccacctgggtttcacacagggtggagctctgtcttttcctaatctctagacagatctccctgccaattcaaatgcctgagagggtcgttggatctcttatagctagaatcccagaggtccacagcgagagtggcctgccctgccatcacttcacacacccctttcctagaagcagttcagggccaggaactagttccggcactcagcaaccccatgcagggttccaggcttcctccttcttcagctttggcatctgcatcacctcttctcaactcgtggtgttttctctctaaagatctgtttgaaatatgttggtttccttgatattttggtgtctcttggcggtgttgcttcctggatgcttctagtcagccatcttgtctccctcttgagaagtttctctcaaaatggtaacacagaaagacatagtcagtttcctgctccgtgaatgagaatatccagtgaacattttatcataaaccgtaagagtcaatgcccaaagcacatctctctcttaagagaaaagtcatagacaaatcactggacaaatttgaaattttaaaggtaacaattttacaatataatttttgtttctttttcctttagtccaaaatccaaactggtttttgttttcagttcattatctccaatcaacttaaaggcaaatgtctcagcatcaactttggaattaaacagagcctttcttcaaatgatgttctgggtgtatgatttttaaactctaatctatgcctcctcttctcttgtacttgcatgaatcctttccccaagaaaatcaacagataataaaagtgtatgactataggtctgaagagctgagtctttgaaatagtttatactcgtttcatctctgttagaggtgagtgattattaatattctgtgtcaacttgaccggcctaaaggatgcccagagagctgataaaacattatttctcagtatgtttgcgagagtgtttccaaaacaagtagcatttgaattagtggaacgaatgtagaagatattcc

SEQ ID NO: 473675 - DNA, 722 bp, Homo sapiens
tactgttcatggaagtccctaccgagaaagggagaaacaaagagtttcaaagtatgtttcaggctgaaaacaaaaaagaaaacaaacaaacaaaaaagcttgaaaatgcattttgaggctgtgatcttccgttacaagactgtggtctgaagaccagtgggggttcctgacttttgtaagaactgcaatgagccaaccaacgactgccaaacctacctgaaaaccaattagaaactctccctgcttcccaaaatgccacctttagtgggtccggaattggttctttccagtgggttcatggtcttggctgacttcaataatgaagccactgacccccgcacccttgggatgatgcagcaagaaacccctcaccagatggggtgcctcagccatggacttcccagcctccagactatcagccaaataaatgtcatgctgatgcaagaagtgggctcccatggtgttgggcagctctacccctgtggcttttcaggatacagccttcctcctgactgctttcatggtctggcaatcagtgtctgtggcttttccctgtgcatggggaaagctgttggtggatctaccatcctggggaaacttataatcatggtgaaaggtgaagcaaacatgtctttcttcatatggcggcagcaaggaaaagtgctgagcaaaagagggaaaagctctgtataaaatcatcaggtcttgtgagaactcattca

SEQ ID NO: 473676 - DNA, 1417 bp, Homo sapiens
ggtgtatctggaacccaaaaagttatatttggcttgacctactttggtgtctagggcgtatgcgtataggtttgtatgcacaggagaacctggcttccctgtcccgcgttggctggtcagtggcttcagccttgccagcccaaattcaggccaagcacggattgcagctcggcattagtctctcaaaattatatgttgaccctggaatcagggaggcagtgccgtggctgcagccatgtctctactcctggtatcggggctctcaaaatggttctcagctgaagctgctccaggcttggctgcctgtgggattctgtcttcaccagaaacttcaaattgatgtaaatgaattgctgtatggagtatggaggttgtctttccataacaatgtctgtttgtttctgagttttaggtatttcctttacattgtgtctcagaaagggcatctcttgttcttttaccaactgcattctgctattactttctaattcatgctcattagctcattcagggtgggggtgagagtaatactcttcaagttttctacttcccagggtagaaaccatcaacataaaatattgtgaacagtgagattatgtcttaaagtgagctttccttttgttaatcaaaatgctagggaaatatgttatgataataatattataatatttgataatatttaataatatattacatactattaataatatttatttaataataatattaaaattgcagatatttattaggcttttatcaagtgttaggcattttgaccaagaatatatggttaattgttatcacacccagacttgtaagacaaatggaaagttcatgtgaaaaacaagacaatggacaatggctccttggctaaaaaggctccgcaccccctttagataagcatcactctgagtatcacataaaaccttaacatttattattttaaataccttggtgtggtacttgtttctttcaaaactaaagtgaaaactgcattagctaagaaaagaaatgcagtattcacggacctgacaacttaagtgcatttgcaccttacttcttaagatgttgtttaaaagagctcttcaatccttctttggaaagaaatacctcctttcatttttttccttgatgatttattagagtaactcaaatttagctcagtccctaatagattaataattctatattagtttttgggtaaataataattgtacgtatttattgggtacatgtgacatttttaaacatgcatataatgtgcagtaatcaaatgaaggtatttaggacctccatcacctcaagcatttacttctttgtgttgagaacattccagacctcctcccctagctatttttaaaaacagaataaattactgttaatgatactcattcaatttgcaagtgaacactagaaa

SEQ ID NO: 473677 - DNA, 1822 bp, Homo sapiens
gaagccttcaggtcttgacggggcgataaggagcctgcctttctaaggctctgctcccctagtttctttccctctcccatattcctcaagggctgcctcagaccttgcatccagggccctagagcaaggcgctttccagtccgagctccagggcagccactgtggtgaggggtgtccgcagacgctgatctggacgctgagccacgctaactgaagatgagagtcacgtgttcatgccaggccaacctggaactctatcaacattcggtccacagggagcttgatggcttttcccttccacaagacattgtgccgacccatcatgttgatgatgacatgctgattgaacctgaggaatgtgtcttcaccccaatgatctctttatcccactcagaattcaagatgtacactagttggacagtggttatccaggccaggctgcataacgccagcactggactcgctccttcttgtctcaagctctcatatcctgttctgggtcatcaaactctacagccctctccacccacgtcccctaaggattttatacagcaacttttgatgaccagctcagtggttggatcaagaagaagctccaaagcgattcttaaagccaaacttgcaccaaaaaaggtcattgtcactgtttggtggtctgatgccggtctgatccactacaactttctgaaccccagcaaaactattatatctgagaagtaggctcagcaaatagatgagatatactgaaaactgcaatgcctacagccagcattgatcaacagaaagggcccaattcttctccacaacaatgctcaactgcagatggcacaaccaatgctttgaaggctacagagttttgtctcatccaccatattcaacggacctcttgccaactatcacttcttcaagcatcttgacaacttcttgcagggaaaaggcttccacaatcagcaggatgcagaaagtgcattccaaacatttgttcagtcctgaagaatgatttttacactacaggaataaagaaacttatctgtcattggcaaaaatgtgttgattgtaatagttcctattttgattaatgaaggtatgtttgagcctagttataaggatttaaaatttatgatccaaaactgcaatcacttttgcaccaacttaatgcataagtaaatagagtatgaatgtataaaaggcagcataaatgtatttttgcttctaactcattgtgttctcctattattaagagacattaaagataaaggttcagtggtagaaattcaggtattattaatagatttaaaagaaagctgcataaagcagtaattatatatctgtggtgatgggcatacaatgtatacaatgacataataataacagcaatgtcttcacaaaggaaggaaatgaatgcagcactatatagggataaggttttgtgtacaattgaaattaacggcattaattcaaactaaattgttacaaattaaattgctaattgtaatctccaggacaacactatgaaggtaactaaaaatatagtacaaacaatgaaaaagaaattaaaatgatatctacacctcaacagttatataaatatctattttcctaacttacgtagttttttgtgtcccgaagcttatacggatatctatacctccaacttatatagatatttacaccctaacttatgtagctatttacacctctaacttatatagatatccacaaccctaaacttatataaatatttacactcctaaacttgtctaaatagcaaatgcctaatttaaatatatatcaacactcttaaacttatgtaggtatcagc

SEQ ID NO: 473678 - DNA, 1135 bp, Homo sapiens
aggagaaatacctaattaattcctcctttgttctctctattgctctgacatggtaagacctgcttgctttccctttgctttctgccatgattgcaagtttaccgaggctccccgcgatacttcccgtacagcctgcagagccgatgtgtctagaaatgtcatccaggacgtggaccctggaatgggtgcagtgggactctgcctggtacccattgtactgataccctcatgtactatacctgagtattatccaagttgcaaagcaaagtcttctttactcgcccctctccccaaccagaaggaggaaatctcttctggagctgtgagctgtacaccctggggttgggcatctcttctgtattttgaccctagtacaacacagcacacccttcttctagtatatgcaagagacctggatctgcacaactctcttaccctgagtcaggctaccaggtactgccccaaaatggattgtcccctgaggagacgatttggatcttctgcttgatcaagtctgctgttgaacacttttagtgatttttatagatatcttcttttggtgcgtacttaattccacttgcaaaatatttctccataatatcccctttgtctaaaaagtatttctctttccatgtaattatttatttatgtatttatttatttatttttgtgatttaagctctgtcttgcttgtcaccttttgtgtaaagatatctttgtccacaccatcctacatgtctttttctcctcttttactaatagcacattattatttacaattttagtactttaacatgcaaacactgtcccatttcaaatgacttactcatgtatttgtgtaaccaaggaagtcagctttgaaaagtgtcagatttgactcctcaccacaggactcacttagaactggaacatattttgagaatatatatcaagataattcaactgaacagactctgatagaattagcatgctatttgtcctattgcctttggtgagcaggaacaaggggctgggagacaagacatatttctgtatccttgaatattactgaagatatacattggatattgaaatgaggctatctacattagtatacttacattgggatatttcacacattatataatgatgcagg

SEQ ID NO: 473679 - DNA, 649 bp, Homo sapiens
ttctatatatttacttgcagtggtttttagcaattgggaaacacatgtgtaactgttacaactatgacatagtcaccattgtctttaccatcaccatcatcaccaccattagcagcaccagcagtatcactatcatcaccaccattttaagcatcattatcattgaatttgttgatttcattctactggccatgacttgtggcctaagggctgttcagtcatcatgtggcgaatgctgctgggcctgggacacaccctttagggcagtgggctcctctctggcccagagcacgtccagaaatgccatccagaagccaaggcctagaatcagggaccccaagagtctatttggtgctgacacccatgaagcagagctggcacctatggtgccagacaaagtcccctttacttttgcctctgcttttctcaagaagaaggagtttctccctgaagccaccacagctgagaatggcaatgtctcatgagaatgtgttatgtctcacctgaagccagcaagtctgcccttccctcaattcctaaacacgtaacttcttaattataggttctatatatgtggcttcatttaaatctcacaaccacatagagttgataacatgatctgtaaattacacataagaaaatgaaatac

SEQ ID NO: 473680 - DNA, 667 bp, Homo sapiens
tttccactttgacagttcacaatgtgtccggagtttcttccttctggtgggttcgtggtctcgctgacttcaggaatgaagccgcagaccctcactgtgagtgttacagctcataaagagggctttctgtatcctgggttcttgccttggtgtactggaagaattgaatcacacgtgggcttggagaatgaatgcaagattttattgagtggcggtagctcaggggaagtcagaagggatggaatggggagatgttcccctggagtcaggccactcaccggccagggctgtcctccaactccccagccaaattctgcattgttctactttgcctgtgggtggcctggcagtgtgtcagtgcctgtcagtgtgttcctctccatgtccagtcacccaggtattcctccgctgatgtgctcttcttgacgtccagctgcctgtgtgctcctctgctgatgtgctccagccacctgtgtgtctgcctgctagagtcttggggggcttttatagaggataataataattttcattatcaccaaattaacaatcttgtcatgattatgcataatcatctatatgaataacaattttaaaagataaatattggttagactatcagtctttcagcaagctttcatagagtggagaaaaaataaaatcacacaga

SEQ ID NO: 473681 - DNA, 2095 bp, Homo sapiens
gacagacatgcacagtgcacacttggacatacgccctcgacagacacccatagtgcacctcccggacatacaccctccacagacacccacagtgtaccccctggacatacgccctcgacagacatgcacagtgcacccccagacatacaacctcgacagacatgacatgcacagtacacccccggacatacaccctcgaaagacatgcacagtgcacccccagacatacaacctcgacagacatgacatgcacagtgcacccccggtcatacaccctcgacagacatgcacagtgcaccccccggaaatacaccctcgagagacatgcacagtgcacccccggacatacgccctcgacagacatgcacagtgcacctcctggacatacatcctcgacagacatgcacagtgcatccctggacatacgccctcgacagacatgcacaatgcaccccccggacatccgccctctacagacatgcacagtgcacccctggacataacaccctcgagagacacgcaccgtgcacccccagacatacaacctcgacagacatgacatgcacagtgcacccctggacatacaccctcgacagacatgcacagtgcaccccccggaaatacaccctcgagagacatgcacagtgcacccccggacatacaccctcgacagacatgcacagtgcacctcctggacatacatcctcgacagacatgcacagtgcatcccccagacatatgccctcgacagacatgcacagtgcaccccccgcacatacaccctcgacagacatgcacagtgcaccccccggaaatacaccctcgacagacatgcacagtgcatcccccacacatacgccctccagagacatgcacggtacaccccccggacatacacccttgacagacatgcatagtgcgcacccatacatacatcctcgacagacatgcacagtgcacaacccagacatacgccctcgagagacatgcacagtgcaccccccgcacatacgccctcgacagacatgcacagtgcattcctggacatacgccctcaacagacacgcacagtgcacctcccggacatacatccttgacagacatgcacagtgcaccccccggacatacaccctcgacagacatgcacagtgcacctcctggacatacaccctcgacagacatgcacagtgcacctcctggacatacaccctcgacagacatgcacagtgcacaccccatgcatacatcctcaacagacatggacaatgcatcccccagacatacgccctccacagacatgcacagtgcaccccccgcacatacaccctcgacagacatcctcagtgtacctcccagacatacgccctcctttgcagctgagagttcttggatgttctggatacaagtcctttgttggatttgtgatttgaaactgtttttttttcaagtctgtagcttgtcttttcatctgcttaacagagactttcatagacaaaaaacgtttttgatttctataaagtccagataaccaaattttcccttgtggctcctgcctttggatgctgtgtcgaactgatccttgaccacatagatttctgtcatgttttcttttggaaaggttttctagttttatgtgtaaatctaccatactgtttccgttaatttttgtgtgaagagtatgaggattttcatttcacaaaggtcactccagtgtgcagggatggattggaagaggctgtgcctggaggtggacgaaccagtaagtgggtgacagagggagcaggctcagtggctgagatgaagaattcaggttcacagggcacccagcagcaggctgaccctgtgcaatgtgacatatttgtgtgcatgtgtgtgcacatatgtgcacatatgcgtgcatgaatatatatgtataattgtatatattgtagtcacatatttaaacttattaaaattattaaaacccccttcaccccaactgctgagattgttttaaatctttaaagggaaatactttagtgttcagaaacacttaacttgaattaacacacacattatttttaaaaagacaaattactaattattttgaatgcac

SEQ ID NO: 473682 - DNA, 917 bp, Homo sapiens
agcatcccatctgcaggactagcttccctgggctgccgtaataggccaccacagactgagggcgaggggctcctcccacaactcagtcagcgccggcctcctgagtcaagtggggccagattcctccagggcgtccgctggacatgctcaatgcacacagaggtctcatcatccctgggaggagcctgggctggcgtccatctgtccccatgggctggtgcccactcacagatggatgtaaagccagctccggtacccagatccccatgactcatatgggcgtccacaccccacagccggtctccctgtcaggccctgctgagctagcaaggaagtccagcactttggagggtcgcagaggacaaatctttgtcttcagaaagtttatcagggaaaacactgcatttgggaatagaggtgggacccagggaggagacagaagaggaggccacgtgaagatggaggcagagattggagctgtagggctacagccaaggcattcctggggtccccaggagctggaagaggcaggaggtggattaggcagctcaggctgttgtaacaaaatgctgccgactgggcagcttcaacaacagacatatatttcccaccatccaggagcctgggaagtccaaggtcaaggtgctgtcagggatgttttccagtgaagcctacttcctggcttggagatggtaccttccttctatgtgctcacacggtttgtatgtgcctggagacagacagctctagtgtccctccctctccttgtaaggtcacagtcctattggattaggaccccacccttatgacttcacttaacttaattacctccatgaagggcccacctccaaatagtgtcacgtgggggtggggcttcgacctagaaattttgggtagacacaatttagtccatttcc

SEQ ID NO: 473683 - DNA, 877 bp, Homo sapiens
gcaagaaagtgtccttcgagtcacatttagccagggcgccttttgcagcctcctccagcctggcacagacacagatggccacatggcggccacagctggtggagagcggagctgccggcctactagtgggagctggctgcccactcctcttcttgggagtgcttggctatctcctctggctgccgatgcagcctgggagggacctgagcgtctttgaagacagtcaggagcaggcagtggcaggggtggagaaggatgagcctaggagtctaacccagtgccacctgctgagccacccccaggagttctcagtccaggaacaggatgctcagttccctggatctctcctctcatggcagggtgtggagacctctcagagcagtccttgcaccagctcagggaacctgccttccaccactcgcgacaacccccaagcagcaaaccctctcacagccacttccacaagctcatggcaggtctttctcaaggtggcctctggttgtggggaggcccccacggcccctccgaggtggagcacggagctcgccagcgtcttgggaagctgccgcaggcgcttcttccttctcggcaggaagatggcgcccggctctgcagtggccctgcctcccctcgccgttagatgtctctgcaatcagtcgaagccgtagcctgtcaccggagtggggggctgctgcttttctcctcagaaagagaacaccgttgccacccaaagcaaattaaaattaagtgcaaagctatttccgggtcagttaagcacagcaggtcactagctttctccattgctctcagagcacaaagcaaacatctctcagcttgcatgttctgggaccctttgaattgctcgctgaagatgaaa

SEQ ID NO: 473684 - DNA, 569 bp, Homo sapiens
ctcctgactgtcttcttaggaaagcccactcctcccctcctcagcttcacaatattcaacattttgaggtggaaaagtcacggcattctcacacacgcctaggaaaagtgtgaaatggtcctgttgatctggacggcgatttgtcaatgtgcacccagagacttacaagtggttagtagtcaaatcggtccacgcggcgggaactgctggtgtgtgagagcaaccttggagtaccctactccacttctaaccaggtcaggtctgggagcagttggtggcagtgccagccaaaaggagcatatgcaaaatgaattaggagctcccactagtaggccggcagctccgctctccaccagctgtggccgccatgtggccatctgtgtctgtgccaggctggaggaggctgcaaaaggcgccctggctaaatgtgactcgaaggacactttcttgcggaatgaccttagattctccttccacatcaagtttcttccatatgacccccgcagacttgtgcatgcactcacacgtccatgcccacacacacacgcattctgtcttcgaggctaata

SEQ ID NO: 473685 - DNA, 668 bp, Homo sapiens
aaggaaggaggagggtatctgaaaccagcatccagacatgcagtaccattttgcatctcaccatggtactgggggcagaagtgatttttatcacaacccaagtcgaaacacatgctcctaaatatttatttaatgctgtcaacactggagccatcagaaataccatttgcggtatacaaaatgttctcatgcatatcacctcatttgattttgggaggcagagggctgatcatgtttctgttttacaaatgagaacattaatgccaaaagagcttcgtgccccttctagaattccctataagatcagaggagggttctatgacagatcccctctggctcaccgagccctcttccccagctcctctgaaaaggttatgtctaggattcctaaggtaagtgttagtaatgaagtgtatgacttagcccattgtatcatgggtgactcagctgcagcagtgcctgacatcaccaaccctagtcagcaagaggtcatttcctgcatgtcagctgaaacactcattcctaatgaggtaatgacgtgacacctactgttcgcagaactgcatgtctctggactacgtggccgaagtcactatctatggactccttttattggggtagaaattattcttcagggcaccagcatgatgaagtacagagagcttggc

SEQ ID NO: 473686 - DNA, 797 bp, Homo sapiens
tgtttcaaaggcaggcactaggccatgactgagaccttcatggcagcccctcccaccacaggcccaaggcccaggaggaaaaagtggtttcatgggctgggcccagggtcctcatgctgtgtgcagcctagggacttggtgccctgcatcccagccactacagccacggctgaaaggggccaaggtagaactcgagccttggcttcagagggtggaagccccaaggcttggcatcttccacgtggtattgagcttgccagtacacagaagtcaagaattgaggtttggaaatctctgcctatatttcagaagatgtatggaaatgcctggaagtccaggcaaaagtttgctgcaggagtggggcccccatggagaacctctgctagggcagtgcagaaaggatatgtggggttggagcccccacacagagtccctactggggtactgcctagtagagctgtgagaagagggccaccatcctccagaccccagaacagtagatccaccaacagcttgcaccacgtgcctggaaaagctgcaggcactcaacaccagacagtgaaagcagccgtgagtatcctgcaaagccacaggggcagagctgcccaagaccatggcaaccaaccttttgcatccacatgacttggatgtgagacatggagtcaaaggagatcattttggagctttaaaatttgactgcccccctgcgttttggacttgcaaggaccctgtaaccccctttgtcttggccaatttatcccatttggaacggctgtgtttacacaatacctgtaccc

SEQ ID NO: 473687 - DNA, 720 bp, Homo sapiens
agcagcaacgagctggaaaggacgggaactgacaccatgggttcagccaggcctgtctgccacctcccacgggctctcccacccccacccccatgctcaggttcagccaggcctgtatactcatcctggcacatctccacctccaaaccccagcacaggtcaaactccaaagcacctccatccactctgggttccctttatcacatcacaaacaatcaccctgtacaaaatgtgcccaactcaagcacaggggagagtcacatgtcctcttcaaggcagactgtgtcctgtgtatttccaattgttcactgatgatccccattccccagctcagtgataagcacttcataaaagaatcacccaaggtgatagctgaaattcagatttctaggctccacctccattgtcctgtatcatcatatccccagaacacactcaaggacaattctcaaatccaagtactgcttcaagttcacctaattactacagcatcagagcgacacgcgttccagaataagaggctgtccgtggatttgcttcagcgctccatggcttggcagacttcctctttgccagggccgttgtatacgtagctaagtctgagtaaaaagacagttccacgattcaggtacaagaaacataacaccaaactagactgtaaaaaatgacaagtgctgaaatttgtttttataccacattttccttatctattcatccatc

SEQ ID NO: 473688 - DNA, 1354 bp, Homo sapiens
tgacgtcttgcctctgcctaacaccatgcggctgtctcctacgaccacccgggacattctggccacagtgtggagcatggatggagggtgtcaaggccccagtttatccattcacctgctgaaggacatcttggttgtttctagttttggcagttatgaatacggctgctataaacatcagtgtgcagatttttgtgtagataagttttcaattcatttgggtaaataccaaggaatacgaatgctggatcatatgctaaagttttcaagttcatctatgttgacacatgtatcagtacttcattcctttttatggccaaataatattctattgtgtggatattccatattttttattcatttgtcaaatgatgacgttttggactgtgtacacttgttaacgtttatgaacaatgccactataaacatttgtgttgaactttacgtataagcatatgttttcgtttctcttaggtatatctctaggaacagaattgctggatcataaggtgactctatgttgaatcatttgaggcactgcccgactgcttttcaaagcagctggaccatttccaccagtagtgtgtgagaattctgacttctcatgtattatacttaccagcacttgctattagtcagctttttaattccagacatcctattggatggcagtggtatcgcattacactttgattggatttaatttaatctgatgactaaaaagttcaacatctttacatgtgtatattggccacttatataccttcttggcagaaatgtatattataatcttctgtcaactttttagctgggttatttatcttcttattattgagttgcaagtattctttatatattctcatacctgtgccttatctaatatatgatcagtaaaagctttctctcatcctgtggattgtcttttctctttctttttttttttttttttttttacttggaggaataaaatatattttaaatgttatgaaaatattgtaatattgtaaaattattttcttattattatactttaagttttagggtacatgtgcagtctctttcttaatggcattctttaaagtgtggattttaattttgataaagtccaatgtatctatattttcttttgtttgtgattttaatgtcatatgtaagaattatttgccaaatacagttacagagatttattcctatgtttttgcctaataattttatattattgcatttagacctctgatccatactgagttaatttttgtttatggtgtaagttaagtgtccagtctcattcttttgcatgtggctgtccagttgtcccagcctcagttgttgaaaggactattctttcccaatc

SEQ ID NO: 473689 - DNA, 701 bp, Homo sapiens
cttttctaagatctgaaaaataagtctgaatttgacacacatctgatacaaagggtttggggcaagggtttgagcagagatggacccgatgcagagacaggagcctcagccttggaatggtaagggcgttcattcagccagcaaggagcttggaaacgaactcatcccagagtcctcagaaatgaatgcagccctttcattcaatcttgccatttgccctttgatggcaaatgctcagaagacaatgaccctgcaagctcctacaaggtcagagggtttgttgagccttaaagagccccagtacaatatccccttttgcctggaacagttcctccctttctggcatcagcttctatcaatgtacggcaccacacaggctgctcgctttgagccccagattgtggtccagaaatatcattcctcaggaaaacaaattagaacttctcaggaaactggagcagaagggtacaaaatgagcccgggacatcgtgacataccaaatggaaagaaagctatcaaagactactggcgtcatcttgaagacacaaggttcaccctgaagaggccccaccacccaaagatggaacagcttgagcttcaattaggaagataatgataatgcatagaaacctaatgaatatgtttaaatccacctcattagaaaactttttaaaaaattaaacggtcacctttgaaggatg

SEQ ID NO: 473690 - DNA, 1110 bp, Homo sapiens
gaaatatgatgcagcgattaaaaataagatatatgacttatatgctaagcagaaaagcaggtttcaatcacattgtgattgcacaaaaatgcaaacatatctgtgagagtgtgctaattaatgcatcagcaagcttgggagagaaatatcgaagatacaggtggaaacaggcttccaagaacttgaaggccccaattattagccatgtatgtgttaattactttgaattaatgaagatgaaatacgatcaagaatgcacttccttagccacggcagcctcattcaagcagcttgtgactttcatgtgggacagcacagaacaggcaacttcatcccagaaagctccatcgggcatttcaggctctcatttccataaccaagtcacattttattttaattattagaaagctttttcttaaaaacatcagggaactataaattagtgaagtgtttactagattaaaacctcagatgtacaattaaaggacaacataacctcctcattctgactagactctcccatcacagagtgctggcttctcatccttcttgctgcccagagtcagatgtgggggcccatgaagtccaagaaagctcacttctcagagccactccagaggagcccagaattcctccaaattagaagaggccaaatttaattaggtgtgaaatatgaagagacctcaaacaatgtaacatgtctcatgaaaggaaatgtgtccatctttgaaacctagaccaaaaaataacaaaaaatgtgtgtgtgcaaagtaataatatatatttatagtttagtaatatatgtgtatatatattttaaataactttaaaacttcagtacttacaattataaggacaataaattcttccttctgttcatgtgtgacaggaatactgtatatattaaaaagtcatccggaagttaaaaaatcaatgtatttaaaaatttttgaaataggttgtataagatgcattattttacatttgatttgatgacatgatttttgtttgaaagtatgcaatacaattcagtagtttctgatgtttgtattaaatgtttcataattttgaaatgaaagaatggaatgctaagaaacatttcattaaaaa

SEQ ID NO: 473691 - DNA, 2869 bp, Homo sapiens
gattgctcacacctgtcgtatttaaataaaagaacacttttgtgacacccgatcctcctgcggccttcagcaagagtcctgtgtgctgtgagacctttcctcactcatcataaggttgcgacctggctgacgctcctagaatgaaacgcagcctctctgggtagcacgctgtgggggctcgggaatcgataccccaaaatgtggggctttgacgtgttgaactgaagaaacagcctctccaggtctctctgatcaccctcctcatgtcccatctgaatcccctgcgtcccaaagcacagggtgaagctgctctctgagtctgaacccaccaaagaaggaaacggtcacccctgtctcttccctgagtttttctcagctggattcctgtcacagaaagaaagaccaaagtctcaatccacctggacagacatgtgtcataagccattgtctgctctgtgggcccaacagacattgcctcagatcactgtatattctccaagcccattgaatttcctaaagggcatttactacccgctaaactcatccacacgccccatctccctttcccctaaaagggcgggtgtatcagcgtctgtcccatcacatgcatcctgcaactcaaagaacaccacagccaaggcgtgtaccttggggtatcatgctctgagccccaacatctgcaaaggtaggtgtcattatctccttagtgcaccacaggaaaccagctgagaaagccaaatgctttgtcccaagtcaccgggcaggtgtgtggcagtgcagagagcccagtctgagccccctgcaccctgagagctgcccccagatgaagagcccaggggagcatctgagctccctccaatgcaccacttccttccgtgagacatcggcccatgcgcgtgaaggggacaggaggcaggcggtcctgtgggtgactcatgggaagaacagcactgtgaccgcagcaagcttgcagctctcaaaaaaataaagaacaaaggaaagaaaattaaaagttagggctgaagggggagctggaactaacatcagaggctttaagtgtctgccactgggctagaaggtgaggtggcccctccctgtgtgacatggagcccaggacaggctctccctgtgtgggaactcgtgcagagcctgcggtccccattcacggccccgcaggagctcaccaggagagactgcagcagctcatcagagtctgcgctctcctcctggggcaggtggggctccagttcccgcaccccttctcctcaggtggagcctaaatagagcagtcagatatcaatcagtttccacagctgcggccttgtaaactagacttgcaagaaacaggttaacatgagaaaaacagaagtttattcacacgtgcctctcacagagggagcagcatgaaataggagcatgtcagcggtgctggcagatcagtcacccaaactcaagccctcctggaaggggaagcaggcccaggctgtggaaccgcggagagccggatttgaatctaggcaccgccatttaccagctgcgccaccttggaaggctggtcaactttctctgggtttccatttacgtcgtgtgccaaacacaggtcattagacacgcacaaggatcatcgaagagattgccaaataagctccctacgctctactcacaccagctgctcacacggggacagccgtgtgcaagatactaaagggggcgcttagaagaggagctcaaaggtggcctggcgtcaggggctggagggcctttgacagaggccgggactgaggctacagcatcatcggagcgctggccttggaaagagtgagtggttgcggattggacgggcttctggagcagtgagacagaggaactctcctgtaagtgaaaggaaaggggtccctggggcactggccggtctgagactcaacccatccccctggggcacagctgacccagagatgcctacctggtcgggggccgggacccctctgggccatcccccatgtgctcggctgttctgagagccagtccaggggacaaggtggcagccagggcaggagggcagaagggcaggatggagtgtggggagggtcagcagcccatgaggcagggtggacacccaagtctctccctgccgtccctcctcagcgagctgcctgggctcaggccactgcgggctaagcccctggcccctgcctgacccagaccctgcctgatctgagcggggggtccatcccagagtgtccagagctcagcagggggactgggggagaggccccgaagagaggcgctgcctggctgctgcacagcgggacggtctgggtggtggaggtagggagctagagaaggaataagctcagtggttaggtgcaccccaaatggctaaaatacgacaaacagaagtgggacagagcctcagcaaaggctgggtatccccttccctccagcagcctgtggtctctgcctgcacctgctcctctgggagcagcccacctgaccttgaacaccctgtgggaagagctgacttccagacaggctggaggcgcattccctgtggctgctgtaacaaagagctgcaaactacagccttcaactacagggttcagaagcctgcagtccaaggtagggcttgggcgtgccctgctccctctgcaggctggggagaatgcttcctccaggacctcttcagcggccttgtggctggggatcccacagacccctggccaggcctctgcctcggcctctcatggccttggcctctgcatctctgccttccgtcttttcaaaaggactctagtcactgggttcaggtcccggggttctctggtacgagttcatcttgactacatctgcagcagccccgtgttccagc

SEQ ID NO: 473692 - DNA, 1685 bp, Homo sapiens
gctgagcagctcacagccactgtgccgtggtggtgcctgggtcttacatcggtccccagctgccatgggctgtgaaaggccaaggaccccagaaaaccacaggcgccctgtcagcacactgcctggcagagacgaggctccagggattctgtcgggttcggccttcctcgggacccgcgcgtcaggtgcccgcccgtcatgctcgcccacggcggttttccttgtcttcctgctccagtttttccttccctcacgtttcccattcgtgcgcggagtgctgagcacagacctgtcccggggcaaggggcagggatggtctgcgtttgggggccctccggctgcaggtgtccgcagagactcagtgtggcctgtgtgggtgctgcctggggagctggccccgggacggggcgggccctggcagccgcactctggtgccctggtggtgacggtgatctcaggatgtccacagacctgattctcaggcgtgcgttctgaggagtcctcctttctgtggagttatgaagacctgtgaacgctggcatgctgcttctttgctcattttggcctcctgaagaagtagtcactgaaaatgtgtgctggttgcaggggacacctgagtgggcaggaggggtctcccagcagagcaccccagggagaagactgactttgtgtttgacttaagaggaaaaaacccacttttcaaaatgagaaatttcgtattcaggaaaaattagaaagaatgagttatatcaaaaggtataaattgttgaagtatggtaaatggaaagaaatagaaacactgggtattctgtacaatcaacgacacccgaggaaagatggtctcttatttaatgcttcaggactgatggagaaagttgtgtgacattctttttgtgtttcctttgtggtcttgaaggatatctttgtatctgataatatactctgtgtcaaagtatatgatgatgcccctgccaaatttatacacgagttaaaagatttgagggaaggtattcacctatttatgtatgtgctatcattaaagttatccttttgatttttgcttttttccatatattttggaagtgaaaatggccgagtcaggccaggccagcactgcccttctcacgcggtgtcaaggacctcagtgagcacctctaggcctccctcgcccttatccagtcactagggtggacatctgtgcctagtgttcagttgtatttattgaatcatttgataattttatgtattgttcatacaatgtaggaagtctagtgagtgagctatctattgatatctgaatttgaaatgactaggaaaaaaatttgggcaaaaatctggatctaagaaaataaattattcatttgtattaaataaatgtaatcactgagatttttttaaagctgatatatatttgactgcttatattcttttctacacattttaagaaatatttttcaaaattggtttgttataaaatctctttcaacagatttttgcataacaaccggattacacatttagttccagggacatttaatcacttggaatctatgaagagattgcttccaaatatactttttgcttatactgagctatttcttataattaaggcattttaggactggtggagaaagttgtgacattcattttgtgttttccttcatggtcttgaaaccgttagtttc

SEQ ID NO: 473693 - DNA, 705 bp, Homo sapiens
agcgttggggtaaaggttgcagcttttcttggctgcccgaagtgtgtgtgatgcagcatggccccaggggaggtccttgctgcccgaggactggccaagccatgcaaaggtcagggctgccaggaaggaggagaccctggaagtaatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcagccgcatcaagtccagctgtggcctctcatccatctgggccccatcaggttgcaaactctgctctgatccacctgtgttatccatggccattgctcagaagaggagctgggcccttgaagaacagcggattgaggcattgggtgtacccaccatggctctgggaaatgatacagatcagttcatgcctctggacgggtctgcctgtcgtcctgtgcagaagccggtagagtcggagcccttacccagggaggctgcaggtgtaacttcctctctgaaaccttctggctgcctttagcttcagccacaaatcatgccagggttgctgcttccctggtattttgtatttcaggccattatggttataaaaccttttgtttggcaatgtaagtggttttggtgtttcttgttt

SEQ ID NO: 473694 - DNA, 2683 bp, Homo sapiens
ggttacttggttggttgtttgcttggttgggagactggatttattatgtcagacctgctcactcacactggagggtctacggaacatactcctcacaacgatcatgagaaagaatattgtgagaggagcccagtatcctggaagagctttgagcttgtgctctcattagggggagagaggaaggtagaaggacaagagttgaaaaaaccaactgtggggtattatgctcactacctgggtgatgggatcactcataccccagacctcagcatcacacatcgtacccatgtaagaaacctgtacatgtacctcctgaatccaaactgctccaccatttgcaccagcaattccaagactgggcatctacccaaaggaaaagaagtcattctaccaaaaagacacatgcatgtggggtaccggataaagcaaaagtggttcttctacagcatcgaatactacacagccatgaaaaagaataaaatcatgtcctttgcggccacatggatgtagctggaggacattatgcttaatgaattaacacaagaacagaaaatcaaataccacatgttcttgtctggataaagcaattgtggcccttctacaccatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttagtgaatcaatatgaggaacagaaaatcaaataccacatgttctgcactagataaagcaaatgtggtccttctgcatcatggaatactacacagccatgaacaagaataaaatcatgccctttgcagcaacgtggatgaagctgaagggcattatgcttagtgaattaatgccagaaacagaaaatcaaataccacatgttctcaattagataaagtaaatgtggtccttccgcatcatggaatactacacagccatgaacaagaataaaatcatgccctttgcagtcacatggatgaagctgaagggcactatgcttagtgaattaacgccaggaacagaaaataaaataccacatgtttttgcttataggtgggagctaaacattgcctgcacctggacacaatgaaggggcaccacagaccctcaggactaatagagtaggaagcaggggcgggggtacaagggttgaaaaactaccctgagattctttgaatttcaggcagaaggcagcaactggagagatctttggtgtgtgaacttttatgtttgtgtgtctacatgattatgtgagtctttttgtgactgtgtttccatgagtgtgtgactgtatttgtgtgtttgtgtgtgcttgtgtgattctgagtgtgtctatgagtgtgtatgacatatgtgagtgtctgtgtgggtgagtagccatccacgtgtttatatgagagtgttttcatgattctgtttatgagtgactttgtatgtatacgtgtttgtgtgctttgtgagaatgtcaatgtgcatgtgcacccacgtgtgcaaaaaacccacacatttttgtaattgtgtttgtgtgtgtgtccctgcatttgtgtgagtgtgcatgtcttcgtgtgtccatgtgtttctatgagtgtgttttgtgattctgtctgtctttgtgttgatgtgtgtttgtgtaagtgtgtggttgcatttgtgtcagtgattctggagcaggtgagctgatcacaagtctgagccgagaatccatggagctcttttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcccaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttattaatataaacatgatttttatagttcatataaatagttatatatagtgtatatgtaaaatatacttttatttgtgatacataattttatagattaaattttatatactaagcaaagttatatgtgatatatacatgccatataacatcatttatataatatatctttatgtaaataagtatataataaaattgatcttatatttgttaatacataattatgtatatatactatgtaaaaataaaattatatattgtatgtgcataatatttctataaatacacgcttatgtgtgtatttatacatgaatgcctgtgtttgtgtgagtacttcagtgagtgcgtgaatgtgtgtgtgtgcatgtgtgccagtgtttgtgtgagtgtaagagtgttgtacatttatacacacacattttgtcttctggttaataacaagatctatctttgatttaggatatgaagaattc

SEQ ID NO: 473695 - DNA, 635 bp, Homo sapiens
tgctctccgatgccgtagccactcgccatgagtgaccatggagcacttggaaagtgctaccaggtgcaacaggaagtgagcaaagtcaggcatctgagaagcaagtcacaagaaatggttgtcatggcaccagtgaagtctgagggctggagtgacatcttggggtatctgggacctgactcctgcaccccagtgccaggccctctggatcctaggggcttctgcaatatcttcagagacagagatgttgccccagatggctgggagctggcctggctctatcagtcaggccttagtgttgctacaagctggcctggcaccgacagccaggccatgatgttctcatgtgaaacacaatttcaccagtatcaacatcagacaaggccactccgtgaccatgatgaagacaaaaccaagactataatcgcacagacaaaacatattgtccacatcacaaaaattgcccaacatcattaatgagtaactgccccttctttaccaatggtagctttaggttcactccattcttcttactttctaggctagcagtgcctctggtagccactgtgcctaaatcataggtagaaaggaggaaaaaaggaaacagataacgagagagagaaatcaatggttgt

SEQ ID NO: 473696 - DNA, 1075 bp, Homo sapiens
aggagccattgaaggattttcagtagaagagagacacctgttccaatttgtgttttggaaaaaattctgcagacaatgtgggggtgtctaagagagaggaaaactggggtgggaatgatagaagggcatttcagagatcttcacagcagcccctcccatcacaggctcagagacctaggagagaaaaatggttttgtggaccaggctcagggccctgttgctctgtgcagtcctggaacacagcacccttatcccagctgctccagctccagcagtggaggccaaggtacagcttgggccattgcttcagagggtgaacctctgacaagatttcagaggatgtatggaaatgcctggatgtccaggcagaagtctgctgcaggggtggagcccttacgaagaacctctactcgggaagtgtggaaggaaaatgtggggtcagagcccctacacagagtccccactgcagcactacctagtagagctgtgaggagagggccaccatccttcagaccccagaatggtaggtctactggcagcttgcaccaggcacctggaaaagccacaggcactacatgctggtttataaaagcagctgcaggggctgtactctgcagagccacaggggtggagctgcccaaagccttgggtgcctaccctttgcaacaatatgacttgaatgtgagacatgaagtcaaaggagattttggagtgttgatatttaatggctgccctggaaagaccaattgtcctcacccaacccaggacatccacccaggaggagttatgctgctggttcttaccagaactctccaggattcaaatccaaacaaggaagacaacaggaacaccagggagatgagaaacaaggtgagtgagacatacatcacccatccttgcagcaatgggtttgctacctgggtggtggctaccaggatccagacccagaacccaaatatctggaagataaaagcataaaagaaggagcttcattagccagtatagagcatgtttccctttgcagggcatctcttttctgtctctagttaaaagctcaggtgaagttaggagggaa

SEQ ID NO: 473697 - DNA, 670 bp, Homo sapiens
agggctcccacagtgtgcgctgccaacctgctgcccgtgcagaaactctaggatcctgagaagagtttggcaggtcaatggagggtggaaaggatgagaggaactggggagagagacagagaagagggaaggaaaaggaagggagaaaagaggacattgtgtatctgagaacaggaaaggagcaagtggaatggaagaaggagagggaaggcagcagcttcaccctcgctagaacttttccttgctcatttcaattttcaagattttcccaagcttctaaacctacaaaatctaagcgacacacatttactggagaaatcacaaacagatcccagccctcctgtggacctctctgcatctgtgccctggatacctctttctcctttgtttctgtggatgaaacatctgtgttcctagctgaggatgatacctctacctgtcttcacccacccttctcacctactcaggaacattgctccagcaatttctcttctctcctcttcagcaccagcttttccctttctaccaaatcattcttatcagcacttaaaaatgctgtcgtttctctccatttaaaataaaccctcacctgtgtatcatgtagaactatcaataagaaaaatattaaaaaataagaaaataaagaaaaaagataaaatatatcctctgt

SEQ ID NO: 473698 - DNA, 1269 bp, Homo sapiens
agtgccacagtcttttcagagtgcctacggggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcggggcagaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcggcatgtatcagtaggccattcctttttatttttggatagtattccgctgtacggatatatcacattttatttatctattcacaggttgaggaacattgaggtcctttgcactttttggttatatgatgatcaacaatgctgctatgaatatttgcctgtaagtctttgtgtggacaccggttttgatttttctcagacagacctctacaagtggaaatgctgagccatatgataaatttctgtttattttttaaaaactgccaaactgttttcaagagtgtgcagcatttaacacttgcaccaacagtgtatgaagccttcttttctgtcacattctcaccaacttttgttattgtctgttttttaaattattaaaatcattatagtgtatatggaatggtgcctattgtgaatttaatttgatttttgttaatgactaataatgttgagcaccttttcatgtgattactgtctgttcatatatcttcttccataacatctatactaaaatattttgttcatttttaaattgggttgtcttatgacttatatattctggaaatatggcgtgtatcagataaatggtttataaataatttctctggtctgtggtttgtcttttcattttcttaatggtatcctttgaaatgcaaatgttttgaacattaatgaaacctaatatattagcattttctttcataagttgagcttttgatgttgtaactaagaaatatttggtgaacccagaaatggaaaagttttaacctaaagtttttataatttcagattttaggaatgggcagaagctggaaacattcccctt

SEQ ID NO: 473699 - DNA, 1105 bp, Homo sapiens
gcctctggctcgcctcctgcagcccctcatctccttctcttcatggaaatccatccttaagacagtcacctctcaatgctcgtctaccatgccaccagcccccaaggctttctcagccctcctccttttcctacgcatcaggctcgtggatttactccaacacaagattggcagattgacttcactcatatgccccatatctgtaaatttaaatatctcctggtttggattgacaccttcactggtcaaatcctccaagctgtctctcaagctcttgatattcagtggaaacttcataccccctaccatcctcagtcttcaggaaaggtagaaaggagtaatggtcttttaaaaacacacctcaccaagctcagcttccaacttaaaagggactggacagtatttctaccacttgcccttctcagaagtagagcctgccttcaagatgctacagggtacagtccatttaaacttttatatggacttactttcttgcttggccccaaccttgttccagacaccagccctctggacaactatcttccagtcctccagcaggctagacaggaaattcgcccgactgctaatcttctctttcctactccagattcccagccatatgaagacaccctagctgaacgatcagttcttgttaagggtctgagccctcaaactctacagcctcgatggactggaccctatctagtcatctatagcaccccaactgctgtccatctgcaggaccctccccattgggttcaccattccggaataaagctgtgtccatcggacagcaagcctgatctctcctcttcctcctggaagttgcaagtactctccactacttcccttaaactcactcacatttctgaaaacagtaataacccttatgaacctaatatgttccttcattctattaggtctattcatccttactctactttttgcaacagggctttacacagtcacccccactacttggactgtgccccaaaacttgtcatccctactatcttctgtctagtcatactcctattcaccattctcaactactcataaatgccctgctcttgtttatactgccggtttacactgtttctccaaa

SEQ ID NO: 473700 - DNA, 592 bp, Homo sapiens
ggccgggcaggggaggaagttatgtttttaaagagctcatttttagaaatacttgctggcagcacttgcagctacagtgtttacctcaaaaagaagaaggtgagaatgtggtcaacattccacaatgatactgtgattgaagtagacaacagaaatggagagaaaactaagaagtcatatgccactgtggactatagtcatccttgctctgatgatgtcatacctcttcacctgtatggaagacctttccccaagagatatcaccaacatcaggggagcgaaatccaactggtcactgcaaagtttgctgcttgtgcaaagacgagcctagcaagacaatctgaagagaaacgtgatatttttgtgtggaatgtgatattccgctttatgttgttctgtgctttgaaatttaccacacaaaaaattattaaatactgattatcatatacatttctgttatattaggattagagacaagttctgtttagaaataattccaagaacggattttatattttatttcacattgaaaatcagtcagatttgcttcagcctcaaagagtgtgtttatgtaaaattatatgaatgctgg

SEQ ID NO: 473701 - DNA, 620 bp, Homo sapiens
atagcattaggagatatacctaatgctaaatgacgagttaatgggtgcagcacaccagcatggcacatgtatatatattgaaatttgctatttcgtgcgcgctgtgttccctaccgccgcttgctcctgctcaggtggggtgagcctcctcccagccaattactggaaatttctgccaaggggcatcttggagcctctctcacccccgttctcaccaaatacaggcacttcctctgagaggacggcagagggcgcagatttagcttctgtcctgcgaatgaagcacgcagtacaaggttccaaactgcaagatgagataggcggtcagcacaagatacaggtcatgaagaccttgccgataaaacagtttgcagaaaagaagctggctaaatcctaccaaaaccaagatagccacaagagtgacctctggtcgtcctcactgctacactcccgccagtgccatgacagtttacagatgccatggcaacatcaggaactcccttgaatcctttgatgtgtcccctttaaactcctccccctcctgcctctgtccacccccaccagacatttctctttcccagcccttggctccctcagccatttcagtccccctgccccaa

SEQ ID NO: 473702 - DNA, 1894 bp, Homo sapiens
tgtgcatccttacctagaactcggactctctggggacctgggaacacgctttcagccagtgccacagtgatttgggtggggacttcctgcaccaagtgttacttggggccgtgaaaatttggttctccctctacagatttctgcatgaatccccagacagtgctgctcctgcgggtcatcgccgccttctgtttcctgggcatcctgtgtagtctctccgctttccttctggatgtctttgggccgaagcatcctgctctgaagatcactcgtcgctatgccttcgcccatatcctaacggttctgcagtgtgccaccgtcattggcttttcttattgggcttctgaactcatcttggcccagcagcagcagcataagaagtaccatggatcccaggtctatgtcaccttcgccgttagcttctacctggtggcaggagctggtggagcctcaatcctggccacggcagccaacctcctgcgccactaccccacagaggaagaggagcaggcgctggagctgctctcagagatggaagagaacgagccctacccggcggaatatgaggtcatcaaccagttccagccaccccctgcttacacaccctaatgccagccctgggctctcttcctcggcagcccctccctcaactctgcagctcctctcgcacccagaggagctcctttccccagcaggcctcactggtaggatcctgaccatcttctccaaaccttccccaggagagactctgcctttagggtcatccaagtatccctgctctcagaaccggaggtccactggttttctataatgtactctttccctcctgccacatcctgcccccttcacattcacgagtcattaccagccagggaaggtcatccaagtttcctccagcatgggcgatatctttgggaccgagactttccttggagagctgctgagagcggacagtcccaaaaacaagtgtcaaagggcccaagggaaaggggactgtgccctggaggctcacttcacagggatcagtgtttgctccacagctgtagctctgggctgacgccccccagaccccttccttctcggagtgacccgcccccaggccacctgctccggggagttctgtgcactttactctttggacttctcctcacgtgtgccctggttttatggggagagggaatcgctgttgggaaggcagagcagttgcaaccctctctgcccttgcttcatgtggctggagcccaggcaaggagagcaggagccagcgtgagactgaggccccctggtgcctatcaaggaccagagtgaaggggactacatctcccagcccttcaccttttaaatatgagtggttttaaaaggaaaaaaatgaaaccaggcaacagcaacaatattctgtttttaaaatagggacaagactgttgtcactttttagacatgtatcccattccttttggctctgcaatatttggggctgtagctccttccaagcccatggtagtccctccccgagtctctcccagtagaatgcagcctcccttccctggccccttccctctcagtgacggtgactccctggggccttctcctgagtgggacagcaacacagtgggtggtaaggggcttcataagatgtacaagatgagggagaggcccctccagccaaccctgtgtctaaagagtcaggctatggctgctgcacctgtgcatttatcatcagcaaggggcaagagtacaaagacatattccttctggctcccactgtgcaactgcagccccatctcttcctggtgggcagggtccactactcctgccaggatggtggctcctgcttcttgcctactggttccttggtgtacttttgctgtatcccttcatggaaacatttccttat

SEQ ID NO: 473703 - DNA, 1241 bp, Homo sapiens
ggagaggattaccccatactagggatccttctataagcatttctaatggagggtcctgccttgcggatctttggcttcaatatccgcttggcatcttgggctaatgcctggccaaatagatgggggctacccctgaatgcttgggtagcccctgcttttgctagaatgtctctccctaacaagggagtggggcgttcaggcataattagaaaagcatgtgaaaagagtaaagttccccagtcacaacttagtggctgggagaagtatctagtgactggttgtcctaggacccctcagatagtgacagatctggaggacaggacaggagatggtcaagcataccccgggctctgtgagggtgatggcatgggctggcacttgccccgggcaccctcagtcctgctgcttggatcatctgacccagttccaattgttaaagtactgggtcatcagttctaaggccctggccaaggagccaaggcttagagattgcattgcagagggatatgttttgaaaatattttctccagttccaggcttgccttttcattgtcttacttgtgtctgaagaatacaaatatttgattttgatgatgttcagtgcatcaaaaaaaaaattttaatggtttgtgtcctatctaagaaatctttgcttatccaaacataacagaggtctatgttttcctttagaaatgttatggttttcatttttacacttatatcaatgatacatattgagctaatttttatatatgatatcagaaaatttagattatagtccccttgttactatttcaatctatgttttttgttgttgtttttgttgcaagtacttggaatccactcaaagtagtttaagcataaatatggaatcgaatttgaaagatccaggagtgtctcaagaagctcagaattcacaggcaggaaaggcacttgcgcatcataaggtggtagaaaaaggaactgaaaaggcattgggagctgtggccatgagagtgcactgctcacatctctgaatgcaggggagcgtaacatggccccctgctgctgggctatgaaattctgccactgcatttgcactgagaccacccttcttgtgagctgctcccacccggtgactgagtgcaggcctgccatactaaggcaggcccatttctgggatatggggactcctctgacaggtggctttggcacaagcacacctcatcagctcttgcagagctttcttagaactacactac

SEQ ID NO: 473704 - DNA, 1937 bp, Homo sapiens
aacaacagacctgctttcaccccagcagggctgggtctgtgcccagggacctcctctgagaggacagcctgagagggcagggacttggctacctcgtctgtacctgtgctcctcgccctctggcagagcctggcccggagcagctgcccagtaaatatttgttggagaagttctcttcaaagtgggtgggcagaactccttgccccagttgtcctctgactcctgctcagaggcctgatggaaggagggtggactctgccctgtgtcctgcctgctctcaccccatgctttcatgggctccaggactctcccatggagagcttcagcaggccctctccagtgtggagctagtaggggaaggttctcaggcagctgtgtcaaatgtgccacatgtgagcctatgcccttcttgctgtgcccattccagacatcagtaatgggccccagagctctctccatgactagagacgaagttgcagggagtcccaggtggaaaacaattgctggtgtgaaagatgaaactgtttgtccctcagatctgtggagaaccccagccttgtccttgatgggtgcaggggaaagggctgcccaccctggtgtgaggggtgtcatccagggcagtaaagagggccatctccggagacctctaggattcctgtgctgctgctgcagctgttaccccctggatctggtaagggcacgggtcttctggagccctgctgcacacccagcacccttgtgtcctgagaatgtcttagaaacccagtcagtggagggcgggagacaggaccccgttgagtgcaggcaaaaggaaccaggtttccaagagcctgcttggaggaagagaacaacgtggtgctttgaatttgatttctagcccttctgttctgcaaatgaagaaatctggcccaggtggtttagggatgtatcccaggtcctgtgtctgatgatgcttggagccactctagagcccaggaacactgggaactcatctagcttcgtagcaaccctacaaggttagagccacagttatctattttatcaatgagagaatcagggcacagagagagagccctgaaggcttggtggcagcctctgaggttgatgggatctttaggcagaaggtggctgccacctagctatcaacccagaaagaggcctggcaatggtgggagcctcagaagtgagccccatccctcatctagaagctgcaggtcttggggctaatcagggctcactgccacactgggactacagagagcccaggtccaggcctggcctgctctgcccagcagccgccagtcctggaccccctctcctgcagggcctttctgttttctctgagggaatttggggcaactataagtaaagccaataggaacgttcatacatatgtcttttggtgcacagaagctttcatttcttttgggtaaatatctagaagtggagttactaggtcatacgataagcaaatatttagctttcgtggatattcaatcttccaaagtgagcctaccaatgaacacttccaccgccagtgtttgagagttccggttgctccacatcctcgccagcatttggtgttattggtcttcttgcttttggtcattctggttcatccacgttgcagcaggtatcagtacttcattcctttttgcaatgaaatgtggatagaccacattttgtttatctgttcagcagcgagtgtgaagtagtatctcattgtgattttaatttgcatttccctaacaaacagtgatgttaaacatcttttcatgtgctgtttggccattcatatattgtctttggagaaatgcctattcaggtcctttgcccagtttttcagttgggttctttgtctttttgttattgagttgaaagagttctttatgtattctggatactagatccttatcaggtgtgtaagtatttgattt

SEQ ID NO: 473705 - DNA, 759 bp, Homo sapiens
acttctgcagacttaaaacgtccctgtctgacagctcggaagagagcagtggttctcccagcatggcgttcgagctctgagaacagacagactacctcctcaagtgggtccctgaccgctgtgtagcctgactgggagacacctcccagtaggagccaacagacacctcacacaggcaggtgccgctctgggatgatgcttccagaggaaggatcaggcagcaatatttgctgttctacagcctccccttgtgatacccaggcaaacagcatcaacatcaacaaaaaggacatccacaccaaaaccccatctgtaggtcaccaacatcaaagaccaaaggtagataaaacaacaaacatggagagaaaccagagcaggaaagctgaaaattccaaaaatcagagcgcctcttctccaaaggatcgcagctgctcaccagcaacggaacaaaactggacagagaatgactttaatgagttgacagaagtaggcttcagaaagtcagtagtaacaaacttctctgagctaaagaatattctaacccattgcaaggaagctaaaaaccttgaaaaaagattagacaaatggctaactagaataaacagtgtagagaagatcttaaatgacttgatggagctgaaaagcagggcacgagaacttcatgacgcatgcacaagcttcagtagccgattcgatcaagtggaagaaagggtatcagtgattgaagatgagttgaatgaaatgaagtgagaagagttt

SEQ ID NO: 473706 - DNA, 901 bp, Homo sapiens
ctggcctggaatgcaccaactgggcagccctccaagcccagccaccgcccctaggccttcatgcccctccacctctagctctgggggccccaggagtcaatgcccacttcagctccagccaacatggcctgggatctggtctgatctaggctctgacctcagctctgcccctagctggctgcgtggccttggaaagctcacttctcctctctgcctcaggcaagccctgctcctcagcctcactcaggactgcggaaaaatgcatgttcttgggcccttgctcaatgaggaagcccagggaatcctgtgggtgttggcaggtcctgtgggagatggtgtggtgacagcacttggccataccttacaggactccaaagggggaaacaagctctcagcgagtgcacagtatgggaataggctcctgctgcaccacactgtccctgctctcttcaacccaggtgggatccctggcccagacaggaaaaaggacatccaagcagatgacacggacccggaatgtgggagcaccaggggtttgctctgggccaaacacccctggacacccctgctcctctgcccccacccactctttacttcttctttccctcccaataccacaagtccccacgccatggcagagacaggagcctgcgtggccagcaagcccagcgaagggggctcaggtgtcatctccacccccagcagaggagggagaacacccccagccagctttgcagctcccccatttctccctctcccgctgctgctactggttcaaaagataaaataaaaaccctctgcatcaacaaataaaataaaatcacaataaaaaatttatattcctgggatgtaggtctttccaaacaggagcagctgctgccagagctgagtttggcagaag

SEQ ID NO: 473707 - DNA, 716 bp, Homo sapiens
cgggcctgtgccaggtctggctggaaaagcccaggcagacggttgcatggcctgcagagcccagaggcccccactgtgctggaggagtgccaaagagcacatggttcacctctctgttccagaccacaatactgactctaccaaggaagttcagaggaacagcgtgaactggggataccatcgagggctccagacaccaaacctgcaacaggaggtagatgtacaacctgcattgacagacacagggccgtcagctctgagggcaaatgccccttgcatggcttgtcaagaaataaaattttctcccacctcagaactaggggatctttatgtcttcacaagagcctgtgaccagacctacacactttcaggggcagacactgtggttgcaagcaaagagaaacactttggctatggagctctaggttcgagggctgggctttatgatcagacctgggttagaatccggactctcacaccttctagatatgtgacctttgtcagtgacagcatctctgctacagactctaaagcggttgtgcataatgggtcagggagatgacaagacacgatgttcagtgcagaacctgaatatttattcatttaggtatacagtttgctgatgatgttctgtgtgtggactcccatcttcagagaagccagctgtgatttcaactatacatatttgtgtgtgaatatataaatgtatgtatata

SEQ ID NO: 473708 - DNA, 546 bp, Homo sapiens
tcctgcccacgagcttcccggagtttaatgcaactctcaccactgtgcttatacatgtgtgaaattctgggctcagcactcccgagaaaccttcttagatcacccccttccaccaagtcccctttctttcctatgggtttctgtgcaggcacgtcattctttggtaacatcctgcctggcatgaccatcatcctgattcataagaatgcccagcgcaaggagactgctcaatacatgttagttgtccccttctcctgctcctctttgtatcatcatcatcatcatcatcatcatcatcattatcatcatcgtcatcatcaccacccgcatttagagctgtccaggaatggagccaactcttcacaaagcagtagacttcatgtttctagaagaacactcaacccaaatggtactggggacatagcagaagtgtctgctttggcgagctttcttgaagtataattttatgcaataactttcatccattttaaatatactgtttgaatttcatataaatagaatctaacagtatacagttttttatgt

SEQ ID NO: 473709 - DNA, 521 bp, Homo sapiens
cctggaagaaacctgacagagaggatgggaaggggagaaacagaagagtgtgacgaggtgggtgtccaagggcagtgggacaggctgtccgggtgggagagtggacttgaggaagtagctgcaggcccagactacttcagccacaccctgatcccctgggaccctcagggcacagaaggcagtgctggctccaacctcagtccaaggagctgtggaagcctcagaggcccttggcagagggaaggaggaaggggaaaagagcaggaaggagcaagagagaaagcagggcagactcaccccttttatcagaaacctgctccttcaataactaactcccatgataacatcattaatccattaatgaggacaggcccaataacccttaaatatccatcctcttaacactgttgcattggagattaagttaccaacatttgaactctgggggacacattcagaccatagcagtcagttataaaagtgtgatttatgttttttcctagtttcataagcataagatg

SEQ ID NO: 473710 - DNA, 1351 bp, Homo sapiens
caataacagcacagtgtgaacatacgtgatgtgtccaagacacacagagccatggaatctcacaggtatctcagaattcctcctcctgggactctcagaggatccagaactgcagcccgtcctccctgggctgtccctgtccatgtacctggtcacggtgctgaggaacctgctcatcatcctggctgtcagctctgactcccacctccacacccccatgtgcttcttcctctccaacctgtgctgggctgacatcggtttcacctcggccatggttcccaagatgattgtggacatgcagtcgcatagcagagtcatctcttatgcgggctgcctgacacagatgtctttctttgtcctttttgcatgtatagaagacatgctcctgacagtgatggcctatgaccgatttgtggccatctgtcaccccctgcactacccagtcatcatgaatcctcaccttggtgtcttcttagttttggtgtcctttttcctcagcctgttggattcccagctgcacagttggattgtgttacaattcaccttcttcaagaatgtggaaatctccaattttgtctgtgacccatctcaacttctcaaccttgcctgttctgacagtgtcatcaatagcatattcatatatttagatagtattatgtttggttttcttcccatttcagggatccttttgtcttacgctaacaatgtcccctccattctaagaatttcatcatcagataggaagtctaaagccttctccacctgtggctctcacctggcagttgtttgcttattttatggaacaggcattggcgtgtacctgacttcagctgtgtcaccaccccccaggaatggtgtggtggcatcagtgatgtacgctgtggtcacccccatgctgaaccctttcatctacagcctgagaaatagggacattcaaagtgccctgtggaggctgcgcagcagaacagtcgaatctcatgatctgttatctcaagatctgctccatcctttttcttgtgtgggtgagaaaggtcaaccacattaaatctctacatctgcaaatcctgccccttagtcacattattgttgttgcttgatggcttttattcatttccacatttcctatgtgaatattcctttcttcattttgcctttaactggaatggtacatctccaacattaccctatgagaaagtggtgtagcctttgatcaaaatttaaatcagctaaccaagaaaccattgctttctaaacaactacggtaatttaatcgaaaattatatttgggtatatttactgttctaggcaccatcaactttaaaatatgatgtttaatacattatccttataa

SEQ ID NO: 473711 - DNA, 572 bp, Homo sapiens
caaagaaaggaagactttgctggacaatgctgccaggacatgcaaatgtcacctgcatatgtcactgctctcagcttagtgacacatgctgtctgactcccacattacatttgtccagtttttcagaaaaaagctacaaaagaagcttattagaggggaatattccctgtgagaagcccgacttcaacaccaatgtggcactcaaaaagctggctttcctagccagacagaccagacctcagaatatcaacagctcagacaatatctgtgtgctccacgaggagactaaggagctcttcttaggagcaactgcatctgcaggaactggaaagagaagcaaaagagcttttccaacaactacaagacagtcaagtgagaatgacccaacatttagaaaggatgaaagacatgtacagagagctgtgggagacgtgccacatgcctgacgtggagctgctccaggtgaggagggagggtccatccccaaagaaaggaagcctttgctggacaatgctgccaggacatgcaaatgtcaccttcatatgtcactgctctaagctaagtgacacatg

SEQ ID NO: 473712 - DNA, 632 bp, Homo sapiens
tggtgatgttgaagacggtgatagtgatggtgattatggtgatgttgatgatggtggtgatggtgatgataatgttgaagatgatgatggtgatgatgtttggtaatggtcatggtgatgttaaagatggtgatggtgatgacgatggtgatgttgaagatggtgatgttgatgttggtgatgttgatgatgatgatggtgatggtgatgttgaagatgctgatggtgatattgaagacagtgatggtgatgttaatgatggtgatgttgaagatggtgatgttgatgttggagatgctgatggtgatgttgaagaggatgatggtgatgatgatggtgatgttgaagatggtgatggtgatgttgaagatggtgatgttgatgttggtgatgttgatgatgatgatggtgatgaggatgatggtgatgttaatggtggtgatgttgaagatggtgatgttgatgttggagatgctgatgttggagatgctgatgttggagatgctgatggtaatgttgaagaggatgatggtgatagtgacgttgatgatagtgatgttgaagatggtgatggtgatgttgaggaagatagccaaccttaattgaaatagtaagaaaattatttttaaaga

SEQ ID NO: 473713 - DNA, 1686 bp, Homo sapiens
tgaacaggtttgttgaccaaggtatcgttcccgtgccacagtgatccagtggtgtcacatcactatggcaattgctgcccagggcaggaatgcagagcagctgggttctacgctgtgcctgtgtcccgtacacgcaggtgacagacccttaggtaagttagcagctctacttgcctggcctgcaaggcagtgcggagctgggagtgtagccacggtggcctcttactcctgtgctgcttgcgggcagctggggctgaggccacctcccggagcattttcaggccctgagaggacacagaggcctgaaaccttttcctgcgtggcctgcagcagtttagacctgtgtcaagatctgtcagaactgggatgtcttacaactggtgtaggggaaggcagtcacaggtacaggctgagtgccatggctggaggccagatgggaacatcaccatgctggtgggtaccagcaagaagagatgaggatagcaaagaatcaggcaggatccctacaattctgaagatgcccggtggacagatggaggctgaggacccgaggcctcccccgacgggagggagcatagatgacatgcctcctctgggtgaaggggagactctaactttgaccaaatttaccatgaatccattaggcaagctctgatctgactatgtttctatgaattgaaaaacattttcctttagaggacagaaggaagatttgagtttctattgagacagatactcagttcagttgcagaaaagtaaagagagttacagtttctgaaaacctgagtgtggagtaagaaatattaagaaatatcatacccatttcaacaccaattcaatactgaattttaaacagatatttggagtagaagagacacagccaaatgcttgaatttcatttgaaaacctttaagatacatgattagcatagcctcacaattgtaatctgtgtgaggctgaatttatctcattttcctttgaaccctaaatttaaaaaatttatttattggttaaaatgcctattaatggttgctgtccctaagtggtttcaaaactcccagtgggaaggacaacagccctctcagaggcagagtggcctctctctgtgagaaatattcacctacaggtatgcttttctggcttgctttatcgctggctttgcaacttggagatgtaacgtagcttgaaatcaaccgtatgtgtattgtatttatatacatgtgtagatacagggaggataaagtcacataaaatgtcttctttgacctcaaagggcttaaagtttattgttttgcaaatagcgtatcgatattttgctcaacacatttatgtcattagagtaaaattaaagcaaaatgataaaaagatcattgaatattatgtacaacatgatattttaaaatatgtatacactgtggaatggttaactcaagctattagcatgcgttacctcacatacttaccattttgtggtgagaacacttaaaatgcactctctgcattttcaagaatataatacattgttatgaactacagttaccatgttgcacaatagatctcttgaacatattcctcctatctaactgaaattttgcatcctctgaccaacagctctcccctacatcccagttgcaagacattccagttctgccagctcttgacacaggtctaaactgctgcgggcca

SEQ ID NO: 473714 - DNA, 586 bp, Homo sapiens
atttcatgcggtaaaaagtgttctgatgtcagagtctgagaaagccttctgctctcctcagcaggtaggggaagtaatgaagaccaagcagttccattgcaagagttgctggcatctaggttggtgcataatgagactagggttgtggctttggtccccaaccactacctcctggttcttcacccaccaccctggctgcccctcttacaaaggaaacatcttttgtaagcatctttctgtctttccccttcatgttactggaactctcctacagcctgctctggggaccaattttatgctgagggcaggagctgctggctctgacgcggctggggcgcaaaccctgcggcccgtgcacacggggccggacccgtcgccagcgccagtgcgccggccaggggcaatgtctgtgttactcttgctgtgtctcacagaaggtattcctgacttctggagccacctgctgccctagtcgctgacatcccaggggactatttcacctcttgtattagtccattttcacactgctgataaagacgtacttgagactgggtaatttataaagaaaaaaaggtttgacggactc

SEQ ID NO: 473715 - DNA, 596 bp, Homo sapiens
tgaagccgtggaccttcatggtgagtgttacagctcttaaagatggtttgtctgtaatttgttccttcagatgttcggatgtgtccggagtttcttccttccagaaccagccatctggatgtgtacgtgcaggtcacaggggatatgaaggcttagcttgggctcagaggcctgacactgatgacatgtgcccactgtggtcaggccacagcttggttttatacattttagggagacacgagacatcattcaatatgtgtaagaagtacattggttctctccagaaagaaggggaaatattatgtgaaacaggggagaaaatgaagacagacgaaagaagaacaaggaagtcctcagaggaggaggtctacaccagtctcaaacagctgccccagcatcacctggagggcttcttagaacagtctgcaggtccatccccagaggaagtctggggtgagtccaatgataatttacattattaacaaattccaaaacctttgctgaagctattgttcccggaaccaggcatgggaacaggttggagttaagaatacatgaaactgcagaggtgttcatgaggtctttctctcttgtct

SEQ ID NO: 473716 - DNA, 1134 bp, Homo sapiens
atactacctgatggtcatcaccaagcactcagtatgccagacactttctacaccttcactcatttaggactccccccagcttttgtgaggcaggcgttgtcattcccattgccagatgtagaaaatgaagctcaaagagataaaataccaaagttcacagctgagggctatcacattacaacagaagagtcagaaccctcccagaggaggatgcaggaagaagactgggatggaatcaggcggctctcacatgccctggctctaggctctctttcttcctcaaatctggagggaaatgtcagagcccatgagcccatagtgccttgtgtttacttccctttagagcagggctttggccccaatccttccaaggttgaattgtcccaggaacaaagatcctggcttcctgtagcagcatccttgaccttccctagctgcctgaaaagcacatgcaaaggagcccgagcaaagcgaccacatttcccattcccacgcccttattctctgggggttagaaacattcccttcactcctcccatcctgcagtgtaagaccacaggcagcaggagtgtggtgcatcaacccacagggcagcaaggatggacagaggttctggggctgtgattgtctcatgagctgccctggcttgacagatgggacactggcaaatgaagcctccctgctccttgcttggatacccacacactgagccctgggtcccctgcccactccttctctcaacagctgtgccatacattggcagcttcggagatgatgcagagccttcagtgtgagtgaatactgggaatcatttctatgaatggggtatattatgcagtggtccccacatttatttgaagatagaatcttggttttgtttttggctttgtatgtgtgtgtttgtttttggagggacaatatgtgaacttgtgagactagaataggctggaacacactctggaaaatgctgacttattaaaaaaaatagaggcatgtctggaatttaaagaattttggatatctcttcatcaaatatttgctaagtacttaaatcactgagaaatggcatgaggccccacacaagggagctctaaaatccagtgccccttcagagcagcaatgctcctaattgcc

SEQ ID NO: 473717 - DNA, 637 bp, Homo sapiens
gacagccacagaggttcctggctgcatcgcttcctctggcacaccttcatccatttcctcacagccactttcgtcacttacgtcatgagttcacctgcactaagttcccctggctgcatacccagaatctctccagtggtagcagggtcaacattcccaggggtggaatctgaggagaccaagtacagatcaggactttcatccctgacaggtgataaggaagtccccacaccctgtggtagcagtggagaccacatagggaacccagacttggactcacatccagaaaaacaaagcctccctacccttccctgctggtggggtatcagaggaggcctaccagagagtcagaacttctgcccgtgcccagtggaaacaacgccacctcccacccccatggtgtcaatggaggccacaaaggaagcaaagacagagtccctgggagccctgtgggaaggagacaccacttcgctgtgggaagtctcaccatcgctgtcgtgccaggagccgttggagtgtccccttctctaaagccatgtcaagcacagtaagaataaatagaggggaagtggaaccgtgagaacatgctcttaaaccctattttacagtattcctttgttaaatgaaatgaaagcaa

SEQ ID NO: 473718 - DNA, 767 bp, Homo sapiens
ggaaacgggagagcagtcattcactacccatctcctcagcagcaaatgacaagcatgagtcctttgccacagactgatcagaggcccctgaacctatctctgcggcagctgtggaggtccttggaccctcccctgcttcatccggggctcgtcattgccagggtcaagtcaaccatttcacctttgaaaaattctgccctctttgctgcgactgactatggtgggactgggctgtcagatattgaacaaaattcctatgatcaaggcatattacgcatgtgtgggtgtgtttggctgtgtggaaaaatctgctccgtgcctctcccctggtttctggaggatgagtggtcttttgtgttctttggcttgaagaagcatcaccctgatctctacctttatcttcacttggcgttctccctgtggaagtcactctggcttaagtcactacctgctgctttccagaaagccaaagaagcaacctatctaggactctttctcaaacagccaagatgccagtcttcctgctgtgaactctttgtccctctcagcagcccccactgaggagacaatcactgacccacagatgagcaataagctcatctgtgagtaaagaggtcagtaggatgagctgaaaatgccacacctggggggtgggaaatgagttcaaatgaggcagaaaataaatggaagagtcaacatagccttccagaaaactcagaaaacttgaagcctcaggttcatttttccgacctgcccatgatgtttct

SEQ ID NO: 473719 - DNA, 626 bp, Homo sapiens
ttttcagcttgccagcagttggttggttggtcttcatgagggatggtgctttataggggactcactgttggtttctgttgccaggactttggtcattctgcagtggcaggtctagaggtgttggtcactggatgtagatgtaaggccttctccattgcggggtgtggcataatacctaaaatgaagcctccactgttacgtgctgccttgacagctggtaaaattgggagagctgcaagtggcctaattccaacttcccatcctcattcaactcccatggataaggtccgccaaccaaactcccagccttatcaaaggccccagacacagttcctgctggtcctgagcaccaggtctcagttccctgccagcccatggaatatgtcaaacatgacaatcacatctttgtgtgggagccaggggtcacctcactgtcttgacactgcacagcctctggtggttcactctgttcccaaatgcaaattctgtgtagccctgcatggcgtgcagtgtctcctcccccaagctccattctagttgttttcaatggagagttgctctaatacaagttaaacttttggagccagagtagaaatctagctcatgcagcatttcttgaatattta

SEQ ID NO: 473720 - DNA, 458 bp, Homo sapiens
tcctatcccagccttccagtcactcaagtagtttgaggctgccatgagctatgattgtgctgcagcaaaccaaaaaccccaagccaaaaaaatttccaggttatatttcatccaagttgtgggaaataaatgcgaaacagttcatctagtattcatctacacttgtatcttcactttctgtactgctgttgattatatacttggtgagaaatacagttacaaggtcaaagatcaggaagaagacgtccctcatgtggtcaggctaggggagtgggacttctcacgccgcagttcaggactccaagataaagtctgctccatcaccccttcctcatgtcatgccctcctccccgggcctgcagttacttcagatggaatgcagaatagaggtgcgtttggagaattgcagttcactagcatgggggcacagggctgtgaggggctgactcagtgatggt

SEQ ID NO: 473721 - DNA, 1099 bp, Homo sapiens
ggaaaaaaggaagataaccataaggtttgactgcctgcagggttgggcagaatagagccatagttttcttctcacagaaagcctatacatggatgtgtgaataggagaaatatcgctgaattcttttcccagcatggagtaatcctggggaagctgataatgagacagccaaatggctaggcagataaaaaggggtccccagagagtctcccacctgccccacagtttacatcagatacttttgtgcagattagggaacctgcccagggcttttctgggcatgcccatagtgcactggagcccaacgtgtgcactgggggaactgggtggagccatggggaatgcctgccttatgcaggggaggagcctgccctcttcagctcctgtggtgacctgggaatcaatctgcgaggtggagggctgtaaattctgctactcacctttctatgtgtctgcgagtctaatctttcctggtcaagagagatatcaccgtggtaagcaatgcaggtttgatagcaacaccagctcagacggtaattccacaggacgtaccggtacctcagtcacatctttgtcatgttcgaagctgctaggaaaggctagcagaagactcaccagaaaggttctgaagatacaaacaaagagcctgaaatgttggaaactttagggtcaagcattggtattagagccttggaaagagaatagagttgtcagtcaatttacattacactggaaactataataaattgggcaaatgcaatgcaaagaaaactgctgacagcagatatgttcctaaaatgtatgtagaatgatgtagttgttaatttaattagttgcttaaagccagacaatttctttccaaaaattctggcctgtcaaaagttaacgatcatctttcttaatctagcaaattaaatatgacactgaatgactttaaataacactgacacttccataggaatgttgatatgaagcatggtatttaattttttatgtaaaatatgaatgcacagaaagacatgaatgatgcatagtatgaaaacatgattcaaaaataaaaatatgactggtgaaataaaaactttagagaaatgtcact

SEQ ID NO: 473722 - DNA, 791 bp, Homo sapiens
agaaggaatttcacaagggtacatgtgcataatgtgcaggttagttacatacgtatacatgtgccatgctggtgcgctgcacccactaactcgtcatctagcattagactgggcagccgggcagaggtgccccccacctcccggacggggcagctggccaggtgggggctgccccccactcccggatggcagctgccgggcggagatgctcctcacttcccggaccgggcggctgctgggcggaggggctcctcacttcccagagggggccgccggtcagagacgctcctcacctcccaacctcccagacggggtggcggcggggcagagacactcctcagttcccagacggggtcgcggccgggcagaggcgctcttcacatctcagacggggcggcggggcagaggccctccccacatcccagaccatgggcagccgggcagagacgctccttacttcctagacggggtggcagccgggcagaggctgcaatctcggcactttgggaggccaaggcaggcggctgggaggtgcagcgatgcagctgaagacaagtgcagaatacgtcaagcaggacaaagtaattggggatgaatagtcccgtgtgattaattacattgttaaagcaagcctgaaatcaccagtaaaattatctaaacctacggttttatttctgaataagcttttttttttttaaatcaaattcctaaatgaatacaggactcttctgattttctctttcatattgtgctctggtatagggtttatttaaattatatttttatagaaa

SEQ ID NO: 473723 - DNA, 696 bp, Homo sapiens
tacacaaattctctctcatcaccatatggccactgctggaggatgggggggattggccttggcaattcaaaactgtcttttttaccctttcgtgtattttctattaatctctcttccatttggtcatcctgtgaatctgaagcctcctttctttctctaactttatttcaattcaggggtacatgtgcagatttgttaacgggtatatcacatgatgctgagatccggagtacaaacgattccatcacccagaaaataatgaagattaaatataaaaacactctcttgatcagcatcctagcagcagtgaacagaaacttggatgtggaaggtttccaaaataacccatacatcttcctcctttgccttacggtgcttcctcctcattcaaagtgtgaatctcatgggaactctgaaataaacattctgaatgctgagctgtgtctcagggtctccctggaggacccacacagcttcaatataaagcacattgcatgtgtattggtgattccattacattagcatacttcaaaagatatataacagaaatcaaagaagtaaactggtcttcacactaataaccttataggttgtggacatataaagataaaatttccacgaaatcaaatgtgaggctctacaaaactattaagaaaataaattatttaaggtttttcttccttacagtgtttcaaa

SEQ ID NO: 473724 - DNA, 628 bp, Homo sapiens
gggtttgccaccgctgcccacaggctcaccatggcctgagtaaatgctcgcactgctcatacatccatttttaaaaattgggataagtatggatggggaggctggaaaaagggcatccttccccatgcggtccccagagccaccctctccaagcaggacttggggaacatccttctccatctgggacctgaaggatgtccttctccacccaggacttgggaggtgtcttatccacccaggacttgagggggatcctattccattcaggagtgggggaaattcttcttcatctggacttggggggcatccttctccatttaggacttggggggcatctttcttcatccaggactggggggactggggggcatccttctccatccagtattgggggtcatcctcctccatccaggacctgaggggtgtccttttctgcgcttccttggatggcaggctttcctatgcagtcattcagaaagtcaggctgacacatgttgtcgtcttgaactctggaatctcatctctattctaggtgaatcccttcatgtttatagtgatttaccattaaatcactgtgcatacatgcttatgattattaggttttctaagcaaatcgactcattagcat

SEQ ID NO: 473725 - DNA, 563 bp, Homo sapiens
aaactgggctgttcgtaacagtggatcaaggtggacctctccgtcaagatggctcctgttcttgccacagtgcgtgcgggcatgggtgctacagaatcactgcccgttagaacccagggatcaccgggattctctaagcttgattgctgtttgagatgtgagaacactcaggctcagaggggcatggcctcttcagaccctcaggctgggtctgacatccccaccagcaaagagcctctgtgtccagcctgcagatctttggcccaagcaaatgttgccatcatgggaataactcccggatttccaaaggctctatcagtcactgcgtgggagccaattctgcccggagatgctgcctccaggaggcaagttattacaacgcaagccagatatgaatatttaacctatctgatgctaaatgatttaacaggtgcctctgcagtgtctgaggaaatgtgttccttcagggcctaataaaaataggcattgtttccacgttagtgtgtaagaatagaaataaagacttctattcaaactaggttagtgtcatttgcatcagggat

SEQ ID NO: 473726 - DNA, 518 bp, Homo sapiens
ttcgcgtaagttcctctgaggatctacaacccgcatttttttatttatctctgtgaaggatgctgcagaatccgcaatgagacatgaaggttctgctgaaagttggttctctcaggcccctggagagctggacacagcagcattccgagaagtgcagggactgaggcagggccctcaaggatgtcctgggaggaccaggagggaagagaaaggaaggaccaccagtgggagtgggcagacgacaagggaaaggagacatacggggaagaaggagaaggcaaaggaggcacagaaagaaaatcttaaacccagatcagtactgtggtctccaagcaacaccacaggccttaccacctggacccttagagataaagttcctctgagtctccatccatctccagccatcacagggcccagagcccttcatgaggccagcgcgagacaggtcatccatcattcctggccaatgtatgggtgtgcagatgctccggtgtgaaaggacctggctaccttccttc

SEQ ID NO: 473727 - DNA, 557 bp, Homo sapiens
gcttcagtttagtcccctgtaaaatgggagtagtaacagcacctgcctcacagagacgccctccgtcagtgcctgtgggagacctggggcactttctctccaagcagaggcacagattgtgcaaatgcattgggtctcaggggcagacacatgtgctagaagtacaggagcaacgcagggcctgggaaagcagaatatgggaacaaatcagttacatttttggggggattctacctattccaagggcggtacagtattctttacattatttaaacttgacaatgatttataaaataaacattattatccttattatcaaggtgaaggaaatggagaaagaacctgcaactgtagcccatctggattccaagctttgcagaatggattctgtgaatgttaggtatctaatggctttccctcagtttcttcgtttgtcaagcgaccttaaaaataatttcccagcctgttctacaggacgtgtttaaaagtgtctggcaagtggttaaaataaatccgtaaactcttctctgcatatttttctctgtatttggagagct

SEQ ID NO: 473728 - DNA, 678 bp, Homo sapiens
gtttacaacagcaaacgccaggaggcccggcctcacttccactgtcatccagtggccaacaccagccaggacggccggaaactcagtctcgtgtccaggtctaatgagcagtgaggtgtctctgccacagtctgcaaactcccctgtcctctgtactccgtgagaatgggaagaaaagtgcagccctctcctccagtctccgtagcatctcaggctctaaggcaaagcgccaaaagccatgaaaagcagtgtgctacagaaacaatgactggtgtgggaatattttttttaaatatccaggcattgtcaatgctgcaactggaagcccagagagacataaagctgtcccggttcaaaaccaagagggatgaggccaagagcagaggcgaagcaggagcgcggatgcagagacaacagggagcaggaacacccacgtggtgtctggtagaccagggctttgaggaagatggacatgagaaggaaaactctaaacagagagatgcatgctatcatccagctgggggcaaacggcaatgtggaaaccaaggagggagtgacaggaggtgttatgtggtgaaaggaccccatgaccgggttgctggggccagtccagagcagtgaggacaaggatgaactggtgtggagtagcatgatcagttgtattactctgtaagggac

SEQ ID NO: 473729 - DNA, 491 bp, Homo sapiens
ctctactgctggcattagcaatttgaaatacagatcagtaatgccattattttacatcaaattctttcttctgaggagacaagaattgagattgctgcagacccatacggatttaccaccagtaataatttcttctgtcaaaaataagcggagctccttagcaggcattgaagaatgtagaactcgagagttgtcttggttgctctcaaaaggaatcctggaagaagaactggatgcatcttggtcctctgtgagaaacataaataaagggttcaacttcatggaccgagcacttgcacatcctctgagaattcaccgcattcctccctgcatgcttcctttcttggcaaatgcgtttccctgggaccttttagtacatttcttaagtcctggagttaggctttacccaataatgtttggacaagcagtcagaaagagccaccactaggcagggttttctctataaagtcaacttcctgctggaataactt

SEQ ID NO: 473730 - DNA, 550 bp, Homo sapiens
cgtatgactttggacaagcaaacaggaatggtaagagaatttttcaaggaagcaaaaacgcagagaaaactgagattactactactactagctggctatgtgcccggccctgagcaagagctcatcacacaaaacacttgcttcttcaaaagacagctagaggctgactactatcgttacccgcaacacctgctacagataggaagagaaagagggaaagaggctctcctggaggtgttaccttcactgcctgtggctggggtagcggtgacacaagcactcccttggctgtcccagctgtcccataatcactgcactctctctcccccaagcttacagattctctctccacacaatgtggctgctgccaggaaatgggcaagggctggtgtggacaattcaagactttcttaccctcctcagtgtctctttcctttatatgatgttaagaacaggtatatcatcctgtaacactccgaacacgattgtacgttacactgggcatttcgatgctatgatttcagtgtcgtggtcatattactccatttcc

SEQ ID NO: 473731 - DNA, 821 bp, Homo sapiens
cgtgctaacgtccacttacgtggccacaaccttcacccatgcaacgcagttgctttggctttgaaaatgggatgacggcagtctggcaggtgagaactcttctcattgtctaccaggtaaagcaaaattataaaattgaacttgtattgcctgatgtgaccatttcaaggtcgttagagggattaagtgacaacaataaatacaaaatgaacatgaaaactgctaggtgcatgaaacggctgggtgtgtgggctttcagatggcatttttggtgctacctctaccagaaagcaaatccagaaatgcagcaaggatcagatcttccaggccatgtaatgacattggctttagctgtggctgctgtcctgagagaagcctgtaagcaggaagtgggcacagtagactgggaagatatggctagtgaccacaaggaaaaccaggagtgtggggtgttcagaaagacaggggaagaaagcgtctcagacaggagcaaacaacagactgtgttgaatgctgctgggagatcaaataagataaagatgggaaaatggccaccagatttagcaataaagaggacattgatgacttcaagaaaaaccacttccttggagtggtgagaacagaagcctgatttcagagatgtaagatggaatggaatgagaggcagtgcacacagagatgtaaacagaatgtgaggattttggtgttaaaagtgaaggaagaaatgaagcggtagctggaagggatgtggagtcaagagaacatagagagtgaaaaatatccattgattactgaaaatgaaaacattgaaaccaaaataa

SEQ ID NO: 473732 - DNA, 623 bp, Homo sapiens
gaggcttggctccgctgagcagctttgacacgctagccctgtcgggcagggggtgtgacatgatctctgaccacaagccaggctttagctgctttagctttttaagtatcatctcatttcatcctcagaacaactttatgaataagaaaacctcacaggcccagacgtcaggggctggggcattagaaatgtggaagggaaggtgccccagggggccggaccttacaacagctggcttccacctggccttcttgtctgatgcctgttggctatggggcactcttaactacaatgctcatgctctgggtagctggatgttcgttgaagaaaggcagggctttgcacatccgctagagagagaaaaagaagaagaagacgtccttcagttcacgtgttctcaacactacattgttgctaggagtggagagaaaaatttctgggcaattttgaaaaatatgtctcccctgccaaaacattatattgtggatattctggggttcctccttcattcctcttctttctccacaacactcttcctggtggtcgtcattcactttgatgacttcagttcctacccatgagtcacccacccaacctcttctaagtctttgcctcttacatcc

SEQ ID NO: 473733 - DNA, 529 bp, Homo sapiens
ttgtcatttgtttgaagatgccagatgtgccatcactttcctaatgccaaatttgtggaaaggagatggaaaagggtagatccactgacagcttgtatagtgtgcctggaaaagtctcagacactcatgggctggaaaagccagcccatgaaagcagccaggagggaggctgtaccctgcaaagccacaggggtagagttgcccaagaccataggaacctacctcttgcatcagcatgacctggatgtgagacatggagtcaaaggagatcattttggaactttaagatttgacttccctgctggatttcagacctgcatgggtcctgtagcccctttgttttggccgatgtctcccatttggaatgactatatttatccaatgcctatactctcgttgtatctaggaaatgttgttttgttctttaaactcctacttttctagtagttgtgcacattcttcattgttgaaatcaaacagcctttaaatttaatacattctcttttaattaactcaaacacatgcttgt

SEQ ID NO: 473734 - DNA, 804 bp, Homo sapiens
actgtggacctgtctttggaaatacttatcatgcagggatttcttaggcaggaacataaccaatcctgcctccaagaagcagatccctcaccatcctccagcatggggctgccggccatccagcaccaagctcaccaagtagcagaaaagcccagtgcttccggcttccctttctggatgcagccttggacactgtcttcattttccaggtggtatttccagggccaaagagaattttctgacactcattgtaagtcacacataaaatccctgctttcatcccaaagcacaggcgctgcgttgcggagcctggtcctttcctttgcgcagctgacaggaggctgccacatggcggcggctgcagaagactgtggtgagccagtcagtgatgtgccaatgcagaatgggagcattcatacatcaaacctgagcgggaaagaggtggagtgccgatcatcaggatatggtaagctgtccaggcccagagggaagtgcttctgaacattccttccggaaaaatccgccagcgagagctaaaacgcagacagagctttctaactgttcatttcattattatttatcatagtgaaaaaatgaacattaccccaatgttatagtagtagaacatttgaataaattataatttcaacatatgatggatattatacaattattaaaaaacgggcttagtgagctatgagtttttaaaggattctctatttactcatccagaaagttttctcatttttccacccatatttgcattacttagcacatgtgcacaattccattttcacaattgct

SEQ ID NO: 473735 - DNA, 928 bp, Homo sapiens
ttttttttcaaacccagctcctgctcagtgaaataggtctggctctcaagactgcaggaaccggaggctgcaaattgacatggtgcagggacagccagtaacctagctggcctgatgtggacaaaggagggacaggaagttgtccctacagtcacaggagctcaaaaagatgggctcctcgtccctggcttctccaatcttacgactccctgtagcaacaagtgcttccactctccccaggctggggatggatccctggagggactcatgctggtattaaatcctccaccctgtgtcacccccaccccccactctagcctggaccagtcacatggaaccacccaaggactgggaaggataatcgcttcatgggaccagaaggtcccagaaggcaaagagaacaggatctggatgagcattagaaggctgtcctataattctttttcagaatgcaggcttctccctcattcctcctccctttttctcgcctatgttccctccctacgtcctgtgccctctgttctcacttccctgcagttgctgccctatatcctccaaagcagaggctgaccaaggatgatgttgccacaactatctgaattaccttgagaaagagagttgatgatgaggctttgacagaaaagtgattgacaaactgattccatagctcttgtgttttaagtgttttaacatttattacaagatatttaaattcatatcacatttgcaaactgattaaaaaaaaaactccaaagcaaatcaaaagaaatttcatatgtggtggatttttaatacagtattttaagacaagtgaaacaaggttccacaagtcacatgtgtttaccagtgccccacatttgtgttcccatcagcctttcccacactcaatcaattcacccttgaatagctgtactcgatgctagggagc

SEQ ID NO: 473736 - DNA, 570 bp, Homo sapiens
ccaccaccactgccgcagccatctcatctatccttttgtccatgggtctgtctcccccaattcaaagtctgggtgggagtgtctgtttggctgcactgggtcaaatgttcttgccctgtcaggcccctctgctgcaggtctgctggagtttgctggaggtccactgcagaccttctttgcctggatatcaccagtggaggctgcagaacagaaaagattgctgcctgttccttcctctggatgcttcgtcccagaggggcactggccagatgccagctggagctctcctgtatgaggtgtctgtcgacccctgctgggaggtgtctccctgtcaggacgcacggggagccggcaggcaggaacgtttacgtctgctgaagctgcaccctcagctgccccttcccccaggtgctctgtccctgggagatgggagttttatctataatcccctgtctgcctttctttcagagatgacttgcccagagaggaggaatctagagaggcagtctggctacagcggctttgtggagctgcagtgggctcacccagtttgaatttcccagaggcttc

SEQ ID NO: 473737 - DNA, 3758 bp, Homo sapiens
ggagattccctaatcacctcctctctcctgcagctgcaaagctggcttggctggctggctgacttggctggcttgtgtggctggctgggctggctgcggtggctgggttggctggctggctgggctggctgggctggctgggctggctggctggcttggctggctgggctggctggctggcttgaatggcttggctggcttggctggcctggctggctggctggcttggctggcttggcaggctggctggtttagctgtcttgggtggctgggtggctggctggcttggctggctgggctggctggctggcctggctggctggctggcttggctggcttggcaggctggctggtttagttggcttggttggctggctggcttggctggcttgactggctggctggcttggctggcttggctggctggctgagttggctggcttggctggcttgggtggcttggctggctggctggcttcattggcttggatggctggctggcttggatggctgcctggcttggctagcttggctggctgactggcttggctgccttggctggcttggctggctaggcgggcttggctggcttggctggctggcttggctggcttggctagctggcttggctagctggcttggctggcttggcttgctggctgtcttggctggcttggcaggctgacttggctggctttgctggctggctggctttgcaggcttggctggcttggctggcttggctggcttgcttggccggcttgcctggctgggtggcttggctggcttggctggctggctggctgggtgtcttgggtggcttggctggctgggtggcttggctggtttggctggctggcttggctggctggcttgctggcttgcttggctggcttggctggctggctggctggcttggctgtctgggctggctggctctcttggatggcttggctgactgggtggctggcttggctgtctgtgctggctggctggcttggatggcttggctgactgggtggctggctggcctggctggctgggtggctggctggctggcttggctggtttggctggctggctggcttggctcgtttggctggctggctggcttggctggcttggctggcttgactggcttggctggctggatggcttggctggcatgcctgtcttggctgccgggcgggcttgactgggttggctggcttggctgcctggctggcttggctggcttggctagctggctggctggctggcgggcctggctggctaggtggcttggctggcttggctgtctgggtggcttggctggttttgctggctgggaggcttggctggcttggctggctggctggttgactgacttggctggcttggctggcttggctggctggcttggatggccaggtggcttgtctggcttggctggccggctggcttagccggctggatggcttggctggcatgcctggcttggctggctggctggttttgctggcttggctgcctggctggcttggctggcctgcctggctttgcttgctgcctggcttggctggcttggctgcctggctggcttggctggcatgcctgtcttggctggctggcgggcttgactggcttggctggcttggctgcctggctggcttggctggcttggctagctggctggctggctggcgggcctggctggctaggtggcttggctggcttggctggctgggtggcttggctggcttcgctggctgggaggcttggctggcttggctgtctgggaggcttggctggctgggtggctggctggcttggctggcttggctggcttggctggcttgggtggctggctgcctggctggctgattggcttggctggcttggctggcttggtggcttggctggcttggctggcttggctggcttggctgtctgggctggctgactggcttggctggcttggatggtcgggtgacttggctggcttgagtggctgagtggattgcctagcttggctggccggctggcttggcaggctggctggcttggctggcttggctcgctggctggctggctggcgggcctggctggctaggtggcttggctggcttggctggctgggtggcttggctggttttgctggctgtgaggcttggctgttttggctggctggctggctgactgacttggctggcttggctggcttggctggtttggctggctggcttggatggccgggtggcttgtctggcttggctggccagctggcttagtcggctggatggcttggctggcatgcctggcttggctggctggctggtttttctggcttggctgcctagctggcttggctggcctgcctggctttgcttgctgcctggcttggctggcttggctgcctggctggcttggctggcatgcctgtcttggctggctggcgggcttgactggcttggctggcttggctgcctggctggcttggctggcttggccagctggctggctggctggcgggcctggctggctaggtggcttggctggcttggctggctgggaggcttggctggcttggctggctgggaggcttggctggcttggctggctgggtggcttggctggcttggctggctgggaggcttggctggcttggctggctgggtggcttggctggcttggctggctgggtggctggctggcttggctggcttggctggcttggctggctggcttggctggcttggctgcctggctggcttggctgcctggctggcttggctagcatgcctgtcttggctggttggcgggcttggctggcttggctggattggctggcttggctgtctgggctggctgactggcttggctggcttggatggtcgggtgacttggctggctggctggcttggctggcttggctggctgactggcttggctggtttggctggcttggctggctggctagctggctcacttggctggcttggctgggtgggtggcttagctggcttggctgactggcttggctggcttggacattaaatataataatatatttggtacattaaatataaattgtatacgttaaatagaaacatcttttatacatcaaacataaacattttatacattaaatgtaaacatatcttatatgttaaatataaacttcttttatacattaaatataagaatacatttggtatatttaatgtatacagtacattaaatatagacattttagacattaaatataagcatatattcagcacattaaatgtaaacatattttatacattaaatataaatactgtgtatgttaaatataaatatgtattttctatattaaatgtaaatatgtatcctgtacattaaatataaacatattttctatattaaatataaacatgtattttgcatagtaaatatatctatacattttctatattaaatatcaacatgtattatgtatattaaacaaagacatatatttcccatattaaatataaacatatatttttatatgttaaatataaatatatatttcctgtattaaatatacacatatatattaaatataaatatatttttctatatgaaatgtaaacatattttaaacattaaatataaatattcgtcttagatatggcccgtgttggaatgtgtagtagattgagtatataatgtctactcaatataaaatttatatttatatatgcagtaatgattcaagttgattgtagttaagaaaaacaagctccaaattc

SEQ ID NO: 473738 - DNA, 1780 bp, Homo sapiens
tctcctgccccactaaccttaatgacagctttctctggacaagggactgatttcagtaactttctcctgataagagaccatcctccatggactggttctggccagttttggaggctgtgcctgtacagaggggagactggatttattatgtcagacctgctcactcacactggagggtctacggaacatactcctcacaacgatcatgagaaagaatattgtgagaggagcccagtatcctggaagagctttgagcttgtgctctcatacacattatatacctcaggaatgtacaatgctcagcgcctgggtgacgggattattcataccccaaacctcagcatcgtacaatatccccaggacacaaagctgcccgtggatcccctgaatctataataataataattaataataataataataataaataaaaagtgactttgtcattcgcagggaaatgtgaatgacattcactctgcctctcaggcccttggattcccaaagtttgttttcgtcacgcccaggggacactcagaatgtctgtaagatactagctattaaaaaataaatatatatatatactgcaacagctgattagtctggaagagtttggtcagaagacagtgtattaagaagactgtgagtccccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatatatatatatagagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatatatgtgtatatgtgtatataaatattatatatatatatatagtaaccgctgatttgtgtggaagactttggtcagaagacagactattaagaagacagtgggtcctcacaggaaaataagaatatacatcatgtttatattatatataacataaacaactaattacatctgtatatacagcataaacataaagtacaaaaatatttgtatataatcgtatgaaatataaatataccagtgtaagatattagctattaaaatatacatgtgtgtatgtgtatatgtgtacatataatatatatacatatataacatatataatatataagatatagcataataatataatatattatatataatatgtaatatgtaacatatattatataattaatatataatatataatatattctatgctatataatatataatatattctatgcaataaaatatatagcatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaatatatatatatatata

SEQ ID NO: 473739 - DNA, 1371 bp, Homo sapiens
agccagcagagagagaggaatggctgcctgttttctcccccaatccaaggcactaggttttggctaggttgcaggttccaagctgctctcctgctgtgtcggtgccagaccacggggaggtccaggggttgcaggggagggctgtgcatctgcaatgactctcaggggactcccggtggtggcaattggtgaatctgcacgacctgatctgggtcttgcaccctgggtgcagcatgacaggggtgggcaggggctggctctgggccagaggaccctttctgatggacttcagctgttggccttccaggggagactgatcaacctcacaagagtcatacggaagacctgcaggtgggagtaccaggttgaaaccaaggacacattcctggaggagctgctgtttgagccagctctgagaacaggtggggacaggactggagaggaggagggggtcccctatgagcaaagactggccaccaccccatctaacacccccacagggcccctgtggcatccctgtccagtccctgtcaccacccagtttttccctctggacccaggaattcaaagtaagcaaggaggtccactgctccagttgactgcaaataattacaaccttgagcccaagcagcactttgggtcctggtttgggaccacgaagcggctcggtagccagaaggggttgtccagccagcacctgggctttggcactcctcaagaaggtggaggaagtttcaggcacctggctcctcaggtgtctgccatccaggtgctcttcaggcctgcccagaagagctctcttgatccagctagaactggccagaactgactcactcaggaatgtgtagactttgacatcaggggctgctttaatttgcacaatttccaaatacctcttttttcttctttttctgatgagtcatctccctagacttgcattttaaagagatagatagttatcagattccagagaagacatggtagaacatttatatgtcaaagacacagagctgagactttagttttagataccataatttgcctaaaccaaaaaggaaggtgtaggtaaagttctagtcaagacaggatggccaggaaaaacaccttaaaccaagggacagcttgctttgctgatttaagccaatggcttctttatcataagacttcccagtgatttagtcctccctctcttccagtgcacagagacatacccctccttacaaataaaaatgttctttatagatgtaaatttattttacaaaaatgtttcaaaataaccagatgaaaatcatccttatgccagaaagacttgtttttttttttttcattactagaaatgaaacagtaagtatttgctgtattgacatactt

SEQ ID NO: 473740 - DNA, 1813 bp, Homo sapiens
gagggtttctgctgactgtggatggcttttgcatcactataaagttgaaaactgttaagtggaactgcgaagaagcgatgctgtcctcagtcatcaagcgttcactaggcgcttggtgtgtgccaggccccgatgtgggtcttgggcatgttccagttctcacgtcctcagggctccttggtgagtcgagggtgaggaggacacagaggcacaggaggccatggggcaggtctgggtgcactcaggctccagagctcagccctccctgctgagtcagggcgagcaggatacacgcctgctcctggaactcagtgggatggccaagctggaagcagagctcattcctgagcagggcacccgggcctcgctacggtgctgggcaggcttctggtgtggagggtgggctcagatcctgctgtccctgtggctgtgggaggcttttctaggcaccctcctgactgctaacaccaggagggcctatgatatgggaccgctgccccatgacgtgtgccaggtttctgcacgcgactgctgggaaaggctggccctgggctgggtggacccgcactgcctgctggcccctgcacccagatggtgcagcccacacccctctgatgtccacccatgctcggctctgggacttccctccttccaccgtgtctgaccctggttgcccttgttctgccactggcttgtagcagcccttcctgaagccacgtcctccagggagatttgattatgtcctggtgttgcaacctcgctaatgcaatcaggaagttttctcaagacttcagctgctttgttggcagccaggcctgactctcagcagctctgcaggctggaagggcccaagagacccctcacccacctggtgtctccagcagtggggagggctccggggcatagcctattgctgctctgctctcctcctttctttgggctaagatcatctccagaaatattaattttttagacagtgtgattatagttatttaatactcatacttatcaaaatattgtatgttaaaaccaataaccatctgaacttatttgaatatagtttttcctattctgttcttagaaatttcagtcattaacaatctttacacttagaaagtgttttaattttactttgatgacaggaatagtgttcttctcaatgaaatatataatagcagcttataagtgataactgttttcattctgtttttaagagaaaatactttggtcttttttaccatagtttagtgtgtgatgtcataaaaatgggctgtagccatttaaattcttgttcaagtgcagaaactaagagactgcagtttctattaagccatgtcaactcctattaggagacctttagtggttccagttccagggccttcttgaagaaattgtgatacttgtgtaagtatatctagagttttctttccagcattggctaagtcacatagctgagaaatatgatacatggagaaggttgctgactggatgaacttttctacattgaatactttaaatctggattctagaataaaatatattgatgcatatttgagttgtcaactgtttatgtcttgttcttttcagcttcaacattgctttatggcatgtgtggtcgtttttcactccattgttgttgtttacccagtttatgggggttataatgtttatcacactccttggatgatttccgaaggtaagatatctggaatggtttttctaaaaatgaactcatttgaaaaatgtcttttatgacaattttcagtggatggagctgtaacagactatttgtgaattattttcagtcatgttt

SEQ ID NO: 473741 - DNA, 532 bp, Homo sapiens
gcacgtgtatatcatgtaatgacacctcatggcccagattacctttctacagggagaaaggaagggccaagaaaatttgaagaaggatcttgtgaggaggatcaaaatgttggagtatgctcttgaacaggaaagtattattgtgaacgaagtgaaaggagtagttgatagaacaagtattgtggaaacagaaaagagaactggaaggagatccaaaagtaaaaccgaattattaatgttacagaagaattacctacctagcagtggatttatcaaagcatccctgtctgggaagacctgggcttcccagacaggcctgaggatcatcacacggtgttcagcacataccaccaggggcaggtgcaccctggcttctgaagtagcacctgagaatcccctgtgtctaatacctgcttcatgaataacattccataggcttcggaaagactgtggtttaggctctaatttattcaacttgaataatttctccttgaaatactgagaatagcttctcttttgctgtacaaattcc

SEQ ID NO: 473742 - DNA, 1570 bp, Homo sapiens
tttttataggctggtcacacccggagcaggagtcagtcccagtcaggacacagcacagacatgagggcccccactcagctcctggggctcctggtgctctggctgccaggtgccagatgtgacatccagatgacccagtctccatcctccctgtctgcatctgtaggagacagagtcaccatcacttgccgggcgagtcagggcattagcaataatttaaattggtatcagcagaaaccagggaaaactcctaagctcctgatctatgctgcatccagtctgcaaagtgggattccctctcggttcagtgacagtggatctggggcagattacactctcaccatccgcagcctgcagcctgaagattttgcaaattattactgtcaacagagtgacagtacccctcccacagcaggaaaaggcatcaaatatccacaagactcttttgaaattatatattctgcagtgggataattatgttacctaaccagaatagtaatgacacatgcatttaaagctgataaaaatgaaagtcttgtcaaaaggaagtgacagcccaacttgtcaggccaaacatgctttggcatagaactttatatgctctttaaaatgattttaataaaaataataagctaatcaatgcaatcaaactttgaagatggataaagttcagtaacttaataatatggtagaaaacagacatttatatgttagctgtggtgatataaaccagtttcactttatagaggacaactggtaatatctgtcaagtttataaatgcatataccctttaactcagcaattttagaatgttatccttgaaatatatatttgtacatacatgaaattatataatacattactgataaaacacagacaagaatatgtatacaacccaaatgaccacctaaaggagactggttaaataaatgagtataattgaaagaaaattaggacctgaactaagacctttgagaaaagagtaaaagactatgagaataatgtcaatcttttacctttttttctctagaaaactaagacattagaaacaaaaagtcttaaaacacattcctacataaaaaaaagaattccttctgtaaaacgacctcagtcgaaaacataataattggtataaattcttactcttttaaaataaagattaaattccagctaaaaattctccagatatggcagtatattgctctttgaattgaactgaggaaaggcgagggtgagagacataaaagatgaaaacagtgaaaggaagaaataaagggaagggaaaaagtaaaaagaaaaagaggaaaatagaagtatggagtcttatacaggccttcaagctgacagatgagtacatactagctttttgattctcttccaaattccttatttatgactatacttttggcagtctcctgataaaatgaaatctaccaatgtatttcagttcaatcacgtgtttgggaaatacctacttcccatcaggtctaaactgctgtaaaggagaatataggaaaaacaaataaaaccaagtttctacccacaatgtacttccaatctagttagggt

SEQ ID NO: 473743 - DNA, 4672 bp, Homo sapiens
cttggctggctggctggcttggttggctggctggcttggctgtcttggctggcttggctgcctggctggcttggctggattggctggcttggctggctgggtggcttggcaggctggctggtttagctgtcttgggtggctgggtggctggttggcttggctgtctgggctggctggctggcttggctggcttggctggctgactggcttgactggcttggctggcttggctggccggctgggttggctggctggctggctgggtggtttggctggctggctggctggcttggctggcttggctggcttggctggcttagctggctggctggcttggctggcttggctggctggctggcttggctggcttgactggctggctggcttggctggcttggctggctggctgagttggctgtcttggctggcttgggtgtcttggctggctggctggcttcattggcttcatggctggctggcttggatggctgcctggcttggctagcttggctggctgactggcttggctcccttggctggcttggctagctggcttggcttgctggcttggccggcttggcttcctggctgtcttggctggcttggcaggctgacttggctggctttgctggctggctggctttgcaggcttggctggctggctggctggctttcttggctggcttggctggctggctggcttggctgtctgggctggctggctggcttggctggcttggctggctggctggctggctggctggcttggctagcttggctggctggctggctctgctggccggcttggatggcttggctggcttggctggcttcgctggctgcctggctttgctggcttggctggctggttggtttggctgccttggctggatgactggcatggctggcatggctggctggctggcttggccggcttggctgacttggctggttgggtggcttggctggcttggctgggtgtcttggctggttggctggctggctgtcttggctcgttggctggctgtcttggctggttggctggcttggctggcttgtctggctggctgtcttggctggcttggctggctttgctggcctggtggtttggctggccggctgggttggccggcttggctggctgggtggtttggctggctggctggctgggagtcttggctggcttggctggctggctggctggctggctggctgccttggctggcttgtctggcttggctggctgggtggcaggctggcatggctggttgggtggctggctggcttggctggctgggtggctgggtggctggctggctggctggcttggctggcttggctggctgggtggcttggttggtgtggctggctggcttggctggctggcttgctggcttgcttggctggcttggctggctggctggcttggctgtctgggctggctggctggcttggctggcttggctggctgactggcttgactggcttggctgacttggctggcttggctggctgactggcttggctggcttggctggcttggctggctggctggattggctggcttggctggctggctggctggctgacttggctggcttgtgtggctggctgggctggctgcggtggctggattggctggctggctgggctggctgtgctggctgcctggcttggctggctgggctggctggctggctcgaatggcttggctggcttggctggcctggctggctggctggcttggctggcttggcaaactggctggtttatctgtcttggctggctgggtgactggttggcttgagctgtctgggcttgctggctggcttggctggcttgcctggctgactggcttaactggcttggctggcctggctggcttggctggctgactggcatagctggcatggctggctggctggcttggccggcttggctgcttggctggttgggcggcttggctggcttggctggctgtcttggctggttggctggctggctgtcttggctcgctggcatggctggcatggctggctggctggcttggccggcttggctgacttggctggttgggtggcttggctggcttggctgggtgtcttggctggttggctggcttggctggctagctggctagctggcttggctgacttggctggctagttggcttggctggcttggctggcttggctggctggctggctttgcttgctggctggctggcttggctcgctggctggcttggctggctggctggctggctgtcttggctggcttggttgcctggctggctgagtggctttgctggctggctggctggctggcttggctggcttggctggctagctggctagctggcttggctgacttggctggctagttggcttggctggcttggctggcttggctggctggctggctggctggcttggctggcttggcaggctggctggttgggtggcttagcttgctggctggctggctgggcttggctggctgggtggcttggctggcatgcctggctgggtggcttgggtggcttggctggctggctggctggctggctgtcttggctggttgggtggcttggcggacgccttgcttgtctggctggatggcttggctggcatggattgcttggctggctggctggcttggcttgcgtggctggctggatggcttggctggcttggctggctggctggcttggctggtggggtggcttggcggacgcctcgcttggctggctggatggcttggctggtgtggattgcttggctggctggctggcttggcttgcgtggctggctggatggcttggctgtcttggctgtcttggctggctggatggcttggctggctgtgtggcttggctgtcttggctggctgggtggcttggctggctgtgtggcttggctggcttggctggctgggcggcttggctggctggctgctggctggcttggatggcttggctggcttggctggcttgggtggctggctgcctagctggctgattggcttggctggcttggctggctgggtggcttggctggtttggctggctggctggctgggtggcttggctagctggctggcttggctggcttggttggctggctctcttgtttggttggctggcttggctgccttggctggctggctgacttggctgtctgggctggttgggtagctggctggcctggctggctgggtggctggctggcttggctggcttgtctgtcttggctggctgggtggcaggctggtctggctggctggatggctggctggcttggctgggtggccggcttggctggcttggctgactggcttggctggtttggccagctttgctggctggcttgggtctcttggctggctttgctgggtggctggcttggctgggtgactggctggcttggctggctggctggttttggctggctgactggctgggctggctgggctcgctgtctggcttggccggctcggctggctggctggctggctgggctggcttggttggcttggctggttaactggctggcttggctggcttggcttggctcgcttggcctgctggcttggctgccttgtctggctggctggcttggtttgcttggctgcctggctggcttggctggcttggctgccttggctggcttggctggctggctggcttggctgacttggctgtttgggttggctggctggctggggctcctgggctggctggctggcttggctggctggcttgcttggctggcttggctggctggcaggcttggctggcttggctggctggctgtcttggctggcttggctggctgactggcttggctggtttggctggcttggctggctggctagctggctcacttggctggcttggctgggtgggtggcttagctggcttggctgactggcttggctggcttggacattaaatataataatatatttggtacattaaatataaattgtatacgttaaatataaacatcttttatacatcaaacataaacattttatacattaaatgtaagcatatcttatatgttaaatataaacttttatacattaaatataagaatacatttggtacatataatgtatacagtacattaaatatagacattttagacattaaatataagcatatattcagcacattaaatgtaaacatattttatacattaaatataaatactgtgtatgttaaatataaatatgtattttctatattaaatataaatatgtatcctgtacattaaatataaacatattttctatattaaatataaacatgtattttgcatagtaaatataactatgcattttctatattaaatatcaacatgtattatgtatattaaacaaagacatatatttcccatattaaatataaacatatatttttatatgttaaatataaatatatatttcctgtattaaatatccacatatatattaaatataaatatatttttctatatgaaatgtaaacatattttaaacattaaatataaatattcgtcttagatatggcccttgttggaatgtgtagtagattgagtatataatgtctactcaatataaaatttatacttatatatgcagtaatgattcaagttgattgtagttaagaaaaacaagctccaaattc

SEQ ID NO: 473744 - DNA, 2303 bp, Homo sapiens
ctggactgggatctttaagtaaaatgaggataattgaatcctggggtggcagggaacatgggctgtccttaatcaccaaagatgagataaagcaaatgtggtctttctgcatcatggaatactacacagccacgaaaaagaataatgtcatgtcctttgcagccacatggacacagctgaaggacattatgcttagtgaattaatgccaggaacagaaaatgaaatactacatgttctcaactggataaagcaaatgtggcccttctacaccacggaatactacacagtgatgaaaaaaataaaatcatgtctttgcagccacatggatgcagccagagggcattatgcttatgattctggagcaggtgagctgatcacaagtctgagccgagaatctatggagctcatttacaacagaagccgggaccctgtgcaaatccttctgaaatatccccggtttacagagctcctaggggtggggaagaaaaattccctgacttttcggcctcagggaaagagagagacaccccgctggccgtacacctctgctgtttctcagaaaacaggtggggtatcactctttcccaaatgacggtgattttaagaacggttcaccttttgaagagacgtttctgccctggcgatccatacatattgaacccaaatgaatattttttaattaaaaatttttatataaatatacattgtgcatactttatattaatatattgatataaatatattttattaatataaacatgatttttatagttcatataaataaagttatatatagtgtatatgtaaaatatacttttatttgtgatacataattttatagattaaattttatatactaagcaaagttatatgtgatatatacatgccatataacatcatttatataatatatctttatgtaaataagtatataataaaattgatcttatatttgttaatacataattatgtatatatactatgtaaaaataaaattatatattgtatgtgcataattatatttctataaatacacgcttatgtgtgtatttatacatgaatgcctgtgtttgttgtaagatactagctattaaaaaataaatatatatatatactgcaacagctgatttgtctggaagagtttggtcagaagacagtgtattaagaagactgtgagtccccagaggaatataagaatatacatcatgttgatatattatatataacataaatagctaactacatctgtgtatatagtataaacaaaagtacaaaaatatttgtatataactatatgtaatataaatatatcagtgtaagatattagctattaaaatatatatatatatagagagagagagagagagagcaaccggtgatttgtctggaatattctagtcagaagacagtgtattaagaagacagtgagtccccaggagaatacaagaatgtgcatcatgttaatatattatatataacataaatacctaacaacatctgtatatatagtataaacttaaagtacaaaaatattagtatattactatatgtaatataaatatatcagtgtaagatattagctattaaaatatacatatgtgtgtatgtatgtgtatatgtgtatataaatattatatatatatatagtaaccgctgatttgtgtggaagactttggtcagaagacagtgtattaagaagacagtgggtcctcacaggaaaataagaatatacatcatgtttatattatatataacataaacaactaattacatctgtatatacaacataaacataaagtacaaaaatattgtatataatcgtatgtaatataaatataccagtgtaagatattagctattaaaatatacatgtgtgtatgtatgtgtatatgtgtacatataatatatatacatatataacatatataatatataagatatagcataataatataatatattatatataatatgtaatatgtaacatatataattaatatataatatataatatattctatgctatataatatataatatattctatgtaataaaatatatagcctatatatatatatagcaacagctgatttgtctggaagaatttggtcagaagacagtgtattaagaagacagtgagtccccagagaaatataagaatatacatcatgtttatattatatataacataaatagctaactacatctgtatatatagcataaacataaagcacaaaattatttatatataatataaatatatcagtgtaagatattagctattaaaaaatatatatatata

SEQ ID NO: 473745 - DNA, 888 bp, Homo sapiens
agccagcagagagagaggaatggctgcctgttttctcccccaatccaaggcactaggttttggctaggttgcaggttgcaagctgctctcctgctgtgtcggtgccagaccacggggaggtccaggggttgcaggggagggctgtgcatctgcaatgactctcagggggctcccggtggtggcaattggtgaatctgcacgacctgatctgggtcttgcaccctgggtgcagcaagacaggggtgggcaggggctggctctgggccagaggaccctttctgatggacttcagctgttggccttccaggggagactgatcaacctcacaagagtcatacggaagacctgcaggtgggagtaccaggttgaaaccaagaacacattcctggaggagctgctgtttgagccagctctgagaacaggaggggacaggactggagaggaggagggggtcccctatgagcaaagactggccaccaccccatctaacacccccacagggcccctgtggcatccctgtccattccctgtcaccacccagtttttccctctggacccaggaattcaaagtaagcaaggaggtccactgctccagttgactgcaaataattccaaccttgagcccaagcagcactttgggtcctggtttgggaccacgaagcggctcggcagccagaaggggttgtccagccagcacctgggctttggcgctcaagaaggtggaggaagtttcaggcacctggctcctcaggtgtctgccatccaggtgctcttcaggcctgcccagaagagctctcttgatccagctagaactggccagaactgactcactcaggaatgtgtagactttgacatcaggggctgctttaatttgcacaatttccaaat

SEQ ID NO: 473746 - DNA, 550 bp, Homo sapiens
tgaaatgtgaatgaacttgaaattggaaaatctgggcagtgaaaagcacacagctctacgattcaggagatggtcgcatgaccttgaagctggaaagcatttttgtgatggctgggctgcagggccattaagaaaatacctttgcacaccaacaaaaaagactaaagccttaattgctgatccaaaaggcaacaggaaaggatgcaccactgcatatatgacctcagggggaaccaaagagcagcatgagcagggggccatggtcatgggcattgactgggtgcttgctgcatgcaaaggctctgtgttaagcaccttgggaacactaactcatttactgtcccaacaaatccaggatgtagcaggcttcatgaacatcaacactcatttgaggttactgagagcatttgcctggccttaacattgtcatcccaaagctgtttgccaattcattcccatcttcacagccctgtctttctccagtaggcttggtctgtggttctaatgaacacaggaggcttggttcattcggatgcaggaagtgaggagg

SEQ ID NO: 473747 - DNA, 1363 bp, Homo sapiens
ccacttctggctgcctaagcagatggcagaagaaggaaacaagctagccagccagccaagccagccaaaccagccaagccagtcagccagccaagccagccaagcctgccagccagccaagccagccaagcctgccagccagccaaaccagccaagcaagcctagccagccaagccagccagccagcccaggagccccagccagccagccaacccaaacagccaagccagccaagccagccaaggcagccaagccagccaagccagccaggcagccaagcaaaccaagccagccagccagacaaggcagccaagccagcaggccaagcgagccaagccaagccagccaagccagccagttagccagccaagccagccaagccagccagccagccaagccagcccagccagccagccagccagccgagccggccaagccagacagcgagcccagccagcccagccagtcagccagccaaaccagccagccagccaagccagccagccacccagccaagccagccacccagcaaagccagccaagagacccaagccagccagcaaagctggccaaaccagccaagccagtcagccaagccagccaagccggccacccaaccaagccagccaagccagccaaccagccagacagcccagccagacagccagcccaggcagccaagagacccaagccagccagcgaagctggccaacccagccaagccagtcagccaagccagccaagccggccacccagccaagccagccaagccagccaaccagccaggcagccagcccaggcagccaaaccagacaagccagccagccaagccagccagccagccaagccagccaagccggctagccagcccagacagccaagccagccaagctagccaagcctcccagccagccaagccagccaagccacccagccagccaagccagccaagccaatcagccagccaggcagccagccacccaagccagccaaggcagccaagccatccaagccagccagccagccagccagccaagccagccaagcctcccagccagccaagccagccaagccacccagccagccaagccagccaagccacctagccagccaggcccgccagccagccagccagctagccaagccagccaagccagccaggcagccaagccagccaagccagccaagcaggcaggcagccagccaagacaggcatgccagccaagccaggcaggcaagccagccaagccagccagcaagcaaagccaggcaggccagccaagccagccagcaagcaaagccaggcaggccagccaagccagccagacagccaagccagcaaaaccagccagccagccaagcc

SEQ ID NO: 473748 - DNA, 846 bp, Homo sapiens
gtgtatatcatgtaatgacacctcatgggagtagttctcatgcacgactacccatggccagaccaaggtagtgcagcctatgcacaaacctcctcctgcttttccagaggactggatttctgggaaatggctaccgaacaggctgccaggatccatatatccagattcagagagatacatctctggattcaaatgcactttttctttgtgcataattttagcagtcattgttactatgccttggggattctagacattatacttcagctgactctctatggccctttctccccttcactgctctatctgaacctggggaggcagctcaggctgcaaatgaggcagacctcatggcctggaattagcatcccctaggacggttgtcaatcagtgatgacaagggaggtgtacacatcccccagctccctcacctctcaggtggaataacagagacatttttcctgtgtttctatgtgggcttgagctctcgtcatcctcagaggtggctccttctgaggcacttttcactttccctttccctcctcccctcccttgctcacttgcttgtttcccgcactttgtaaatatactgcctgcatgcgaatctttggcatccttctcactgaggggacccaacctaatgcattggaaaaatcctcattcttggagggcatcgttggtttgaattattgccacttctcatgttttaatgcctagggaaattccaaaaatttaggaaatctttaaattccctttgccaatctttcttagatttgattttagcagagattcattttctctaggtcacaaaatcacagaagccttccacaaatggctacacaacat

SEQ ID NO: 473749 - DNA, 3786 bp, Homo sapiens
ctggctggtcctgacctggaatacttgagatcaaatgtactcaacaaaggggcctctaaaggtgacatttctgggtgttgatggctggtggctgaaaaagcttgggtctcttggctggctttgctgggtggctggcttggctgggtggctggctggcttggctggcttggctggcttggctggctgggtggcaggctggcctggctggctggatggctggctggcttggctggctggatggctggctgggtggctggctgtcctggctggctgggtggctggctggcttggctgtctggctggcttgctggctgtctgggctggctgggtggcttggctggcttggctggctggctggcttggctggcttggctggctggctggcttggctgtctgggctggctggcttggctgtctgggctggctggctggcttggctggcttggctggccgggtgacttggctggcttgagtgggtgagcggattggctagcttggctggccagctggcttggcaggctggatggcttggctggcttggctggcaggctggtttggctggcttggctgtcttggctggctgggtggcttggctgggtcggtggcttggctggcttggctgcctggccggcttggctgccttggctgtctgtccggcttggttggctggcaggctggccggcttgactggctggctggttggctggcttggctagctgaatgtcttggctggttggctggcttggctgggttggctggctggcttggctggccgggtggcttggctggcttggctagctgactggcttgactggttggctggcttggctggcttggctggctggcttggctggccgggtggcttggctggcttggctagccggctggcttagctggctggatggcttggctggcatgcctggcttggctggctggctggcttggctggcttggctgcctggctggcttggctggcatgcctggctttgcttgctggctggcttggctgcctggctggcttggctggcatgcctttcttggctggctggaggtcttggctggcttggctggcttggctgcctggctggcttagctggcttgactgggtggcttggccatcttggctggctgagtggcttggccggcttggctggctggctggcttggctggctgagtggcttgcgcagcttggctggctgggtggcttggctggcttggctggcttggctggctgggtggcttgactggcttggctggctgggttgtttgcctggcttggctggctgggtggcttggcaggcttggctggctggctggctggctggcttcgctggctgggtgtcgtggctagcttggctggctgggtgtcttggctggcttgggttgctgggtctcttggcaggcttggctggctgggtggcttggcttgcttggctggctcggtgtcttcgctggcttggctggctggctggcttggctggcttggctgcctggctggcttggctggcatgcctggctttgcttgctggctggtttggctgccttgctggcttggctggcatgcctttcttggctggctggaggtcttggctggcttggctgcctggctggcttggctggcttgactgcgtggcttggccatcttggcttggctggctgggtggcttggccatcttggctggctgagtggcttggccggcttggctggctggctggcttggctggcttgactggctggcaggcttggctggcttttctggctgactggcttggctggcttggctggcttggctggctgggttggctggcttggctggtttggctggctggctggcttgactggcttggctggctggctgtctggcttccatggcttgcttggctggctggcttggccggcttggctggctggctgtcttggctggcttggctggctgggttggctggcttggctggctcgctggcttgtctggcttgactggcttgggctgtcttggctggctggctggcttggctggcttggctggctggcttgtctggtttggctgcctgggctggctgtctggcagggctgtctggctggttcgctggcttggctggcttggctgggtggccggcttggctggcttggctgactggcttggctgggttggccagcttcgctggctggcttgggtctcttggctgcctgggctggctgtctggctgggctgtctggctggtttgctggcttgtctggcttggatgggtggccggcttggctggcttggctgactggcttggctggtttggccagctttgctggctggcttggggctcttggttggctttgctgggtggctggcttggctgggtggctggctggcttggctggctggctggtttggctggctgactggctgggctggctggctggcttggctggcttggctggctggctggcttggctggcatgcctggctttgcttgctggctggcttagctggctggatggcttggctggcatgcctggcttggctggctggctggcttggctggcttggctgcctggctggcttggctggcatgcctggctttccttgctggctggcttggctggcttggctccctggctggcttggctggcatgcctttcttggctggttggcgggcttggctggcttggctggcttggctgcctggctggcttagctggcttgactgggtggcttggctggcttggctggctgagtggcttggccggcttggctggctggctggtttggctggctgagtggcttggccggcttggctggctgggtggtttggctggcttggctggctgggtggcttgactggcttggctggctgggttgtttgcctggcttggctggctgggtggcttggcaggcttggctggctggctggctggctggcttcgctggctgggtgtcttggctagcttggctggctgggtgtcttggctggcttgggttgctgggtctcttggcaggcttggctggctgggtggcttggcttgcttggctggctgggtgtcttcgctggcttggctggctggctggcttggctggcttgactggctggcaggcttggctggcttttctggctgactggcttggctggcttggctggcttggctggctgggttggctggcttggctggtttggctggctggctggcttgactggcttggctggctggctgtctggcttccatggcttgcttggctggctggcttggccggcttggctggctggctgtcttggctggcttggctggctgggttggctggcttggctggctcgctggcttgcctggcttgactggcttggctgtcttggctggctggctggcttggctggcttggctggctggcttgtctggtttggctgcctgggctggctgtctggcagggctgtctggctggttggctggcttgtctggcttggctgggtggccggcttggctggcttggctgactggcttggctggtttggccagctttgctggctggcttgggtctcttggcttggctggcttttctggctgactggcttggctggcttggctggcttggctggctgggttggctggcttggctggctggctgtctggcttccatggcttgcttggctggctggcttggccggcttggctggctggctgtcttggctggcttggctggctgggttggctggcttggctggctcgctggcttgcctggcttgactggcttggctgtcttggctggctggctggcttggctggcttggctggctggctt

SEQ ID NO: 473750 - DNA, 682 bp, Homo sapiens
agcctatccgatggcgaggagagatttctgctctgtaggatctgcctcgccctggacctctggggacaatggacccacttaattgtgccatacttttgggaaacccctttgggtcccctcccattgtatgcgagctctgttttcacttattaaatcttgcagctgcacacttttctggtccgtgtttgttcctgctcgagctgagctttcactcactgtccaccactgctgtttgccgccgtcgcatacccgccattgacttccacccctccggatctggcagggtgtctgctgcatttctgatccagcgaggcacccattgccgcttcctggcaaatgggggcaatgagcgaacatccttctgctgtgttcccaaaatccatctacaaaaagagagagaggaaagagagaaagaaaagagggaaaaagggaaaagagagaggggaaagagagagagaaaaagagagagaggaaagaaagaggaaaagagggagtcaaagaaagaggagagagaggggagagagaggggaaagagagagagaggaaagagagagaggggaaagagaaaggcagagacagaaagagagagataaaagtagtaaagaaaaaaacagtgcaccctattcctttaaaagccagggtaaatttaaaacctacaattgataattgaacatcttctctg

SEQ ID NO: 473751 - DNA, 4385 bp, Homo sapiens
agcctcacatgaagtctcacctgagggggagcctcaccaagtgtgatgttcctgtcatccagctatcgagaccccttgggtcattggcagcaacagcaagaggcagctctgcagaagctgtgcagccagcagcagcagcagcacacacacaagcagccctggtggcccaggctgcgggaccccaggccagccccctccactccttcacccttagtatcacacaccgttggagaagtgggcccacgtcaggccctgcggaaggctgcctggcccccaaaaggatcctggaatatcaggtccaaaaaccacctgtggagaactgctaagctaaatgacttgcccaagctcctagactgggaagtgatggagtcagaactcaaacatgggactcctagcttcgaaccgtgtgatttttccacaaaacctgttggggtcctcaataaatcacatatctcttcctgtgagtgtgtggtggtaaagaacacttaataagttgagaaataaaactaaagttcaaatactatttttattactgatagaaccaagttagtgatattgcattaggtctgttaaccaagtgggcatgtgggcttgataattccaaaccccatcagccatgcagcccagcctggaaagaggtcctggggcagagggaggagcattcccccagagaggcagagcagaataggggctctctgtggctgctgcctcctaggagataggaagacggaattaggcatggccagttattcctaaatcagttaagtctctccaccttcataatacaggggagaaagctcagccatagaacaggattctcagatgcttactgcactcatgtttcatatttgaaatgttttccctccatctcacatttgtatcctcatcctgcccagccaaatggtctcagtagccaatttccagtcatttcttggatgtgctcagcatctctcctcttgcctttgcaactttctacaaaataggttaaatgcactcagatgcttttttagacaaagcatattgggagtatagaaataaccccacccttattaagaaacagtggggaggtggggaagagaagaagtctagtatctgattgagcctctgaggggccatattgtgatggggacttcacagctcaaggcgcaggtgttcacagatgtccagagcagggcacccagaagtgaccagcctctggaaaactgggtccccactggtcctgttcatgtccttgtaatgtatcaatcaatcgtcaatgaaggatgcccctttaaaatgaccagatatttatgtctgccctccaagaagggccattcctgggtacctggaaaagcaaacacattgttagatggctaaacagagttaaggacccaggagtgagacaagcctgatcccctgcagaacagtgatgaaatatctgtgctgccagatgtacacagccttcctcccctggccagccctccacaagcacaatgggctctgctttcgaagactccatagtgaccagctgtcagctcctttcatccatctgcttgtgcttgtcatgacatcaccttcttcattttaacacatcgccctttcatggcagtccactgtgtccgggtttacacatcattttatgttgattgcatttctcgaatggctgcttccaggtggctcactcccagtcactcccacagcagaatttactcctgcgaagatttccttttagacagttaatccctatcaggagtgtggattcccattaggcctgatcaaagcgcttccagaagactgccctgcccttaaagcaccacatgtgttggtttatttaactaatagctgctgcccttaatgttgccaggagcccatgggggcttacattaaatattctttaagccagaaacaatagaaagtgtatatggggcttaagcagagccatcctttgagtttaagagtttgggattttgaaactgaaacctttccctccatctccttacaaagactttttttttaaagtaagcaaacaattaaatgttgttaataggcatttaagagctaatctttagaagaaacaaagccttaaagataaccctaggtctttccattcaagtgtgaactcccccttaaaaccctatatttaagaagtttcatttggagattatctatttgttcactgtagcttggtctcttaattgtttataagagctctcactactaaagcccattcctaaggaaagtggtctatgaaggagccagtttgcttaaaaaccaggctcttaacttaattgagtacttggtttaaaagagttgactccatgcatttgggtaaatttacatgttgtaagatgcctggacacctttttgtgtccaatcagcttccaggatccatagatcactgttttcatttgaacacattgcacttttgcgtcatgtcatatttctcaggtttacagataactttgtgttggttgcattttagaacagcttgtcccctgggaatggagggaagcaccttaattcagcactgaatctgaaattctggggccaagatatgaacatccatgttttcaccgaaagctttttcagtgattctgatgtatgtgaaaactagtgtttcagaacttaccagacaacttctgtcacttctggtttgttccatcctgctctaagatgtgtcttaggtttgcaggactcaccagactcttaaaagatttccatcagaaaggcagtggcaaccttgagcttccagcacaatggaaaatgcctagcagtttgtacaagtctgcgtgcttcctcctgccctgctccctggaacttgggctttcttcaggggttcccccaaccctgaaagtggatctgaaggtgctgaattcaacctgagggcaatgtgtgtatgttgtagagaagaggataaagaagcgagtgtttggtttactggcgctggcatacacacattaatttagggtcttcatctgctttggtagacaaatcacaaacatttccatgaataacagcgtctgttatgcaaattggtttccgtctgctggtctgttgagaataatcttccataattacaacagctatttacttacgggcaaatcagctttctcaccaccttctccattcgagagaggcctccaactgctgctggagcccatgtgattgagggctgatggactctgatgttgtgagcctgttgtttgagtttgtgggtcccaggacagaaggatccacagtaccgccagtcaacgagtggggattaggctccctcaggcttctctgcactaagatgtccaggacatagtcgtcacaagttttatagcgagttgaggaaacaaggcatgtggaactaatggaagagaattaagccctgaaatgtgtggttctgcttagaatggatgcagtaagcatttagcaaagaagatattagtgtgagctgaagaattaatactgacacggcttatggagagaaacttgccctgggcttatgaagaggggaaggattcctggagaagtctcagatggcaaggacttccaggcccagagcagaggctggaggaaggaattcatggaacatgacctgagtgcagaggaggtaggcttcccaacctggaagtaactgacgtgcattgaacaactaccctctgacctgtgccatggcaggttcacttagttatctgctaacaatagtgacataggtaggggagctgaggcagggaaaattaaagtatattgcttaaggtagcaaaattgggaagattgagagtcagtgttggagatggaggcactatcagaagacatgaaagttctagaaatctggggggaatcattgggatatgactctgatggatcttgatctatagtaaaatgacaatgttgggaggataaatcatattggggtgcagtggggtagggggctgggttgttgtgcttacttttctgtatttttaaatcttccctccccaacatgttttttttccacagtgattttgtaaactgaacccagtaagaatatttcccagtaggacagggcagcatttactctcctgttttacaggtaaggggaacgacattaagaaaaattgtttcgccagccatttttatcttttttactagttagtcccagggtgctgactctcttgggatgtggtctgttactcataattaataataatgttgataacataggaaacatgggagattcattccatactttctctactatccatagtacctgataggacacagttcttgtctccaaacagctttcattcaaagatggaagaattcaaagtttttattgggcaggggctttgggggatgctgcatcacaagctgaaaagcccccttcattttcctggcttccacctgggtgagaaagggtcagaaatctaaaagactga

SEQ ID NO: 473752 - DNA, 486 bp, Homo sapiens
taccctgacaagctgcaagggtggagctccccaagaccatgggaacccacctcttgcatcagcatgacctggatgtgagacatgaagtcaaagaaaatcattttggagctttaagatttgactgtcctgctggattctggacttgcatggggcctggagatgggagttttatctataagcccctgactggggctgctgcctttctctcagagatgccctgcccagagaggaggaatctagagaggcagtctggctacagcagctttgccgagctgcggtgggctccccccagttcaaacttcccagcagactgctgtgcttgtagggagaatttcaaaccagtagatcttatcctgctgggctccatgggcatgggatctgctgagatataccacttggctccctggcttcagccccctttccagaggaatgaacagttctgtcttgctggcattccaggcaccactggggtataaagaaaaaaaa

SEQ ID NO: 473753 - DNA, 702 bp, Homo sapiens
aggaaaaccagagacctttgttcacttgtttatctgctgaccttccctccactattatctcaaactccgtgctgggagaaccactactctcttcaaagctgtgagacagggacgtttaagtctgcagaagtttctgctgccttttgttcagctatgccctgcccccagaggtggagtctacagaggcaggcaggcctctttgagctgtggtgggctccacccaattcgagcttcctggccactttgtttacctactcaagcttcagcaatggcggacgcccctcccccagcctcactgccaccttgcagttcaatctcagactgctgtcctagcagtgagcgaggctccgtgggtgtgggaccctctgagccatgtgcaggatataatctcctggtgtgccatttgctaagactgtttgaaaagcacagtattagggtgggagtgttccgattttccagctatttgaaagaatgtgggtactgcaatttaagctgtatctgctttaaggggaaccccaagcaccatagtgctgtggttctcacagactcacagatgtaccatcttcatggtcttggacaaggtctggaagaattctctggattacaaggtggaggggcctcaccccatggccactgctacctcaggcccacaaagagtactgccagaccaccattgatgtttcctaaggcctgagggctctt

SEQ ID NO: 473754 - DNA, 579 bp, Homo sapiens
ggacccaggattacagaaattggctccgatgattatggaggctaagaagtcccacagtctgccatccacgagttgggagaccgcggaaagcagtggtgtaattcagtccaagtccaaaggcctgagaaccaagggacctggtgttggcagtgtcaatctggcctccaaggccctttctggctattatcccctgggacttgatgattcagtactgccacagatcctggatttgttggctaagcacacccatggagagaggcatgggagaatggaaagaggagtacccggccgtgtgaggtgtcagtctgcccctactgggctgtgcctcccaattaggctgctcgggggtcacaggtcagggacccacttgaggaggcagtctgccggttctcagatctccagctgcatgctgggagaaccactgctctctttaaagctgtctgacagggacatgaataggcttcttcaagatcagaattgttaaagtagtgtagcaaaaggaaagatatttcagagaatgtcctaatagctcagatgaggatgccatcatttaaatatgaccagactctacatgtatta

SEQ ID NO: 473755 - DNA, 656 bp, Homo sapiens
aaaatctcatcaattaggtgaggtgacgccccaccctgcttcagcttgccctctgtgggctgcccccactgtccaaccagtcccaatgagatgaaccagatacctcatttggaaatgcagaaatcacctgtcttctgcctggctgcagaaatttgcataagtaacaaggagctgaatgttaatcaccaagacaatggggaaaatgtctccagggcatttcagagacctttgtggcagcccctcccatcacaggcccagaggcctaggagaaaaaatggtttcatgggccaagggcccttctgctttgtgcagcctagggacttagtgccctgtgacccagctgctccagctgtggctaaaaggggccaaggtgcagctcaggctgtggcttcagacggtggaagccccacacgttggcatcttctaagtggtgttgagcctgcaggtacacagaagtcaagaattgaggtttgggaacctgcacctagatttcagaggatgtatgtaaatgcctggatgtctaggccaaagtgtgctgcagggcagaatcctcatggagaacatctgccagggcagtgtggaagggaaatatggggtgggagcacccacacagagtccccactggggcactttcaagtggaactctgagaagaggg

SEQ ID NO: 473756 - DNA, 614 bp, Homo sapiens
tccacagcttcattcttgaagtcaacttccagtgcctgacaccgtaagatgaatccatatgttgatctatctcttgccttctctcagtcccaggtctacctttcgctcctggaagcctcctgcgttccttttcctgtgaccctctccaacttcaaaacactgaagtgtagaggtcttgttcttcaaacatctctgtcttatctttctgccttctctgccatgagccagagaaaactctctgcttttgcatgcttatgtggctctagtaggactaaagactgcaccctgcctttcacatgcaagtacaagcagcacacatccttcctgagcattactgccggagggtccacgggggaccaggccctcttcaatagacactacattggctatactctggaatccaattcagcccttcatgggggttgcaagggtgggcgtacaaacatgggctaaaacagttggtcttcagatttccaggccagtatatttttaaaacatcatgtggatcagtaggttgtttgtgctttttagccttttagttctttcttttttctctaataagctacaattgagctggggtatgattgctttttttaatcattctgtgtttctat

SEQ ID NO: 473757 - DNA, 794 bp, Homo sapiens
gcgttcgggctgatgtgcctcccgtggcttctgagaaagcagagagaacatagccatgatccggcagagtgtccgctgtgctcctgattcagcgaggagcccattgccactcccaatcaggctaaaggcttgtaattgttcctgcatggctaagtgcccagagcagtttgagcctgcgagagggctgtccctaactctgctccactacagaggctcccgcatcaaactctctgggctctacaccaattgtcttgctgcctctctcacttctctaagccaccctccttgccaacttgagtgtccctgtggtggtcaagaggtttctcatgcccatctgcctgaggccagtggcaagagcaggttgcttcttgctagtccaactcaccggtttccctggagccatcgaagtggaaagcaggggttcccagaacttgtagtaatccttggatttccagaagaatgtgtctttcatatcactatggttactgcatgccttactgacataggcaaagaaatctgcagccagcttaactcataaactggtcttgctaggctttggtaacagttttgggttgctcccttgttaacttcacctcaacttagcttcaagaggtgcttgctcctggaccaccctttatcttgtcttctgctttccttgtgtatactccagactgactgttaatacacttaaagaagaaaattgaaaatagaatttagagtcttttctcaagaaagtagccagatttaacataattttcttgctgtaaaattaaatttttgagtgtaagagtctg

SEQ ID NO: 473758 - DNA, 1611 bp, Homo sapiens
tcatcagttcattttaacgaatatttgtttaagatctactattcccccgactctgctagaccatgataaaatggcgacaaaaacacacaagctcttgactctcagagttcacagtctgatgggaaaagatcacatcaatgaaggaaagattatacctggcatcatcaccaccaccacccctgcaggggacagatcacactcaatgactgctctgtgcagtacagcgatgcctccccccacctgcactcaggacaagttggaaatgccatccctgtacccctgctccccagggcctctgctggctcagatacctggtttctcaggtaaggaaaccaagcacagcaaggaagcagaggtgcagctatttagccaagtgcatcacaagcaaaagattcctgtgtgtgaaaggaaaaagaatgaagatagatatgcattattcatgctgatgattaaaaaggaagagattcccatggggcctgctgttagcatctcaactggacctgggttgggttcagcatgacattagtttttgggttatctatttttttaaaattttttttccaaagaaccaatattttgattagttcttctgttatttttattatttcttattgtgcattagcttattttcttttacaagcttttgaattgaatatagttttttattcattatatgagtgaaatttattattaatataagtataaaaagatatgaaattttatctgataattgattcaattgcatcctataaatattaacatgttatgcttttattttcatgtttttaattgaagatatgttctgtattttctctattacccaagactgctttgatagaggggtagttttgtcttgtgatttattttgttatttttttcagtttgttttatgtctagtatattatgttttaaaaatattttatgtgtacttaaaaagaagaggtgttttctatcaaagagtgtacatttggtgtatgtccatagaaactgtgtatttttgttgcaatgtttaatgagactgttaaaaatggaaattataaaataaagtactattacatataattcacctcagaaaaagtaaaattcatgttccaacatcagaaaatctattggcatcatattaaaagagtaaaaaggaaaaatcatatcttctcaatggacacaggaaaaagtattcaataaaatgcaacagtcatttataataaaattctaagtaaactaagaatggcaaagaagttttttcacctaataaaggacatcaaaaggctttacttgatatttgtataacagcgaaacttcaaaacgttcccattaagattaggaaataaagatgccccctactctttctattctgtattccattttagaatcaatattacaccaattattctagccaatgccataagtcaaaagaaaggaaaataaagatgtccaaatttaaaaattaggacaaaaatatcaatttgtataactttatgattattactataacaaattcaagagaatatacaaactgttgacattaatatttagcaagattgctacaaaccattaatatccttatatattaatactaataaaatataaccaattacatgtaattcataataa

SEQ ID NO: 473759 - DNA, 474 bp, Homo sapiens
cgcatagtgtgcctgtgttttctcattatggtatatttggctgtgatattcttgcttccgggccagcttaatttgctcaatgcatctcacactctcatttttcttcttgatccccttacttatagtcaatatcatatcattcaggtgttgctttataattgtcttatgtgtgtcaagtttctggaggcaaatgcttccactggtcaatttccaagcctgggtcagttctggctcaacttcagcctgctgacgacattaaccacaaaaaggaaagaaataatggcattcacagcaacctggatggaactggagactattatgctaaatgaagtaactcaagaatggaaaaccaaacatcatgtgttcttactcataagtgggagcaaagcgatgaggatgcaaaagcataagaatgatacgatggactttgaagacttcggagggaagggggggtgaaggataaatgatacaaat

SEQ ID NO: 473760 - DNA, 577 bp, Homo sapiens
gcgcactctccacccagccctgagtctaatgtcttctgccagcatctatgaaattcagcaccaacaagggtttctggccttgctggggatagaaatcacctccaatgaggaggatcagagaagtcctccgagggaggcagcttttgatctgaaccttaaatatgaggaagattttcaccagcaagtgtggggagaagaggatggaggaatacttggcgagaggagggtgagcaaatgcctggaggcaaaagaacaacaacaaaacaaaaccataagaataatcagaagtgttagtcctgccaggtttccctcctgtggtttcccagagaaaggtctgcagcactggcacagcccttgccttagtgctctatgtgataatcaatgtttttcacaaggaatcagagaaaaccgccagacactggatatggctgttccaaatgaccaatattggaagggttaaacatctcaacacaaaggccatcatagttgacaccaagatccccctttcaggactgaaggactgagttgtccctccctccctgttttagtccattttcaagctgctgataaagacata

SEQ ID NO: 473761 - DNA, 2177 bp, Homo sapiens
gaagttaaaaccaggtactcttgctctatgtcctggaaggctgacctctatggactgcctcaattgggctcccctggattccttcctggtggtcagtgggctagctgtggcagcatccagtcattgaaggccagaagtcctgtgggaagcctttccctgctgctaagccaggcccacaactctctaattgcctcatcagttttaggagtgaaaaaggggcaccctatgccatgcaagtccacatgtggaagcaccaggcttgcaaaacataggcaaggacaaataaaggaatacaagctggccaccccagccagccccagcaacacgctcaggtcctcttccacactgtggaagctttgtcctttccctcttcacaataaatcttgctgctgcccactctttagttccgtgccacctttaaaagctgtaacattcaccacgaaggtccgtggcttcgttcttcaagtcagcgagaccacaaacccactggaagaaaccaactccagacacactaagacattcaaaatgctgttaggttgtgaaggggcagattttgttcagaactaggcctgacctctaggagttttgggcagggagagctgagcttattataaggagaagcttttctatcagaagtactaagtaaagtagtgagccctctgttacttgcagtattcaagcaaaggccaaatactcacctgtgagaatgttgtgggtgagattcagctggattacactgtgtacccgaatcttgggtgaggtttcccagagaattagcactcaaacgagcaggaattttcctgtatttgaatttctacaccggaaatacaatgaatctcggtttggggaagacaggtaaacttgaaaatactttaagtcatgctacagtgaatgcattgtagattcaaataatagaatcaataaaagatgaggcaaagaaattaataaaattttaatagtggtttctctgtgtctgacctcacaattcaaaatatcggtgttgttataaataaataattttaaaataattttaaaatcatgcaatatagcaatacagtaagagattacggcagcggttcttatttaggggtgattttgccccatcaccagtggacatttggaaacttttggagacactttttattgtcatgactgagggagtgctcccggcatccagtaggtggaggccatggatgctgctaaacatcttacaatgcacaggacggcccccacgacaaggaattatccagtccaaatatagtgctgcattgagaagccttgttctgtggagatcatgaatgtaactataagagtaataaaaattgcttcaaccacatcacatggattgagaaaatgctatacttcaaataaccgttaagggagtgaagatgatgtgttttgaagggatgtgctttgaagggctgtgttttgtgttgtgtgactcgaaatatagctctggtgacagcagacattctgttgtcagcagtgtgtatgaagagtttcaagaaagctatttcataagatgcgagggagaaaaagccacatttctaaatcaacatgttactgtatataataagtgacattaaatggttatatataactaatttaatgaaataaatcatatagctatttagcaattttatctgctttaaaagttgacatatggaagtgagtcagacacaggttttttaattttctcatagggaaaatggctgcatgccttacattcagggtagccttgaatttggacatgtacagaacatcgatttcagagtcctaagttctgtgttggttatggcataatttttttggttatgatataaaattacttcaatcttatgagcctggaaacaacttcaaaaggcaatcaagtctttcctgcttttatttgctttaaaaagattacatactgtaaaattcagcacattgtatgaactttgacaagtggatagtcgtgtaaccaccaccacaatcgagatgcaaaataatactaccaatccagcaaactccctcatgctgtccctttgtcatcaacctctttcctctgtgttcctatttttatatttattcttacacattttacaagtagaatatttattttcaaaataaacttttctgcagagacccagcatctaaataagacccatgcagagcttctttggacaaagcaaagcatt

SEQ ID NO: 473762 - DNA, 740 bp, Homo sapiens
aaccagacaggtccttaggaaactcctccagcaagcactgaccccttcacagccagtcctgccacatgctgatcaactatgcctattgctgctcactctgcaccttcctgggtcctgtggttcagggcctcagctcctgtggttcaaccagacactccggagttccgctgtctacatttatgctcgtccatatcacctgaccacctgcctgttggatcctatggtcccctgccctcttccctcgggtccccaggccctctgctcaattcatcaggttctgattctcaaaaggaggttccactcactttgacaattcatttggctgtttgcctggctctgaccctcacagtgtctcctgaaataatcttaaatttcctgctggcccctgcacagctgtgggtgggaagtgttcctgctcacccctcgcccacacttccctcacatcaggcctgcactgccgcatcccccattgggcttccctgccggctgagaagcatcagacaatttgagtgcagcagcaaaacagaatggtgtaggctaaatctcagaggtgggttttgcttattttatgaaagccagagagctctcggttaagaacatctgtgcaaataggatttaacttctcccctcactctggcttatattcgtatctgtcttgtttctggaaggtgtggctcctttttaaaaaccactatttcccagtgattccaagtgacatgctgaaatgaaagccctaataa

SEQ ID NO: 473763 - DNA, 767 bp, Homo sapiens
gcgttcctacttctccacatcctctccagcatctgttgtttcctgtctttttaattattgccattctaactggtgttgatttcagactgctgcgctagcagtaagcaaggctccatgggcatgggatccaccaaaccagatgcaagatataatctcctggtgtgccatttgctaagaccattggaaaagcacagtatttgggtgggagtgtcccatgtttccagataccttctgtcacagcttccctttgctaggaaagggaaatccccagaccccttgcccttcctggtggaggaagcactgaattcactcgcaactcaggaaagtttacatgacttcccaaaattcaacttccctgctgagtcactgcctctacagaaggctacaacccacatcagacaactcattcagccaactcacacttgtacttcctgtgtgctccccagcccacacctcctcaacacacacctggtcatcactccctccccttgctctcattcaagtccaggtgtggtcaagctcctgctgttaagagccacaggtaccgcaccatacctgatggtttttcctaaactctgtcctcacctttgtaaagaattcctttattaagctctgtccagttacccagctctgaatgggccatgagacaggattccgaccgatacaccgactaaactcaccattggcagtaaagttgtttttgtatttctttacttgcaggcagatttttaagaggaattggtgtagcggtttcctagcttgtgatg

SEQ ID NO: 473764 - DNA, 724 bp, Homo sapiens
tggggcaagtatgaagtctaggtctgcaagggctggtttggatttgggtccacagcaaagtgaactgatgatctgtggccccctctcccagccctgcggaaccctcattcttcctcctatcagtaatggcaactctgcctttccagtgcacagaccaaaacacggagtcatctttgactccctcttccttgtctcacaccccacatccagcccatcaagaattcctgttgagtctgtcttaaaagtagaccgggaatccactccttttgcatcacttccactgctcaccagtctggttcaagccactcttgtctctcatctggagagttgccatcacctcctaagtgactgctcttcttctgctcttgctgtcttagatgttgatattcacatctggcctcagatattcatgcggtcaactaattccctcaagaatgttgaaaaatatgaagaagaaaaattactactcttttataacaatattgtcatgttttataaactaacgtcagttaagagaaatgaacatagatcttatacagatgcacaaattccaacggaaatggtttaaaatatcttgtgattttatctttgcttgagtgcctatctgaccttcctaactagattttcatttttgaggccaagaacactgtcctgttcttggtgtttccatccttggggagcattgtgcacacagcatgtttatagtgaacattgacttgaaatg

SEQ ID NO: 473765 - DNA, 963 bp, Homo sapiens
tccagcagggaagagaggcactgtgagtcactcagggaagaagagaaagacaagaccaggatgcatgtggagtgtgctatcaccttagggaaacgggactcagatttatgcgagcttcggataagtttaatgaaatatctcagaactgtccacacaaggaaagataagaaacagtatctaatggctcccactccagatgagtccactggtgggccaggacagctctcagagacacacagacactgggccacagaggactgggtcaaagcaaaatgcacctctcagagcctgcaccactgcgtgcgagacagctgttttaggtttattgagtctccacttcgggtcaccacctcattggcacagatggaacagcaactctccctgagggacatgggccccacttctgggagaggagaggcgtgcttgttgtcctacaggatccaggagggggaagctgcagctctcggtgacaacgtgatggtcacggctgatgtggaggtgggagagctgcccacgcctaaactcacggactccacattctgtgaagagtccactgctaacaaactagtgtgtcatgctaaggacaagggccgcctccctttaggtgacgcttgggaagccgccaatgaaaagtgcccaggtggggcaatgcttgcctgccttaacatctcttcagcactcacctggcagcccctccagcagttacctgccagtggcagggatggcatttatattctggtgttgggaatggcccgccatatggcatcctgcatgcacgctgggaagaagcagtctcctgaggaggtgtaaacacacaatcttacaccgaatgtgtcaatacttctattactctttcatgtttgtctcattgccaaaggcttactttgatcttaaaacatacattttttcttacaaaaaaatgttaagacacaacctagttcatcctcttctatatcacaatgc

SEQ ID NO: 473766 - DNA, 1012 bp, Homo sapiens
gggagggtcagcatcagctggttggttgatgtcagtggtggagtcttttgaaagggctgctttctattcggtgttagggagaaagcctaattatgtactggaaaacaatgctgtttacccagggaacactcaacaaagccagggaacactcaacaaagagcagctgttggtgccactcagcctgaatgcaggcatcttgataacaatagatggcaaagctaaagttcacaaaggctgtgtctttaaagcagcggtgtctttactgcagtgtgagttttcacggcggtggacggactccttgctggacgtcagccctgcccctggcatgcgtagccccgagcctgggctcctgccccacagagacaggcagtggaatgacagcggcaccaccagggctcaggactctgagagacccctgcgtccagatcccgactcccctgcttcagaggacgaacatggctccaactttcttgcaactgagaaaatgttagccaattgcctaacacacagaggtgaacttcaaaagacgctgtaccgcccagatgcactggcccgcagaggagcaaaggcggctccctggagggagagaggatggtccatgtcctgggggctccaggcatccccctcccttctaaggggacatagaacatctgaggaaagttgataactttctcaagaatcagctcatttcagcacaaatcttgatgcattactttctgttaaactgatttctgcctcatatttattatatttgtcttttctactttcttcagtagtttaatttgttcatcttccaacaatttcttttgaaatcctagctcattcatgtattctgacgaatgtaaagtgccatatgttgaagattcatacatattactcctaaccaccttttataagcttagactcatatatctcagtgtaaactggctatttacactaatggctacaacatctcataagagacacccaaatggaaagtcatcaggtttactgaaaatggacttttcttccc

SEQ ID NO: 473767 - DNA, 825 bp, Homo sapiens
tcaggactccgatgaaaatgacatgaagtctatttcctccctcacagttattagcctttgttgttgctcctccaaaaggttgacatttggggtatctccacccttaccctgtgatgacaatagctttgatgaggatctcttccactctttatgtgaccaaatccagctgttaaacttcactaatgccagcttattgcttattgtcttctacgttattctgggcatgaattttgctacaaattacttcattcaagttatgcctcttttgatggattcctttctgtggtcagtgtttaatgtttgttctgacatcagaaggactccatctagctgtgttattttccagtacctaggcaaactaactgtcctgaagtctagccgtatctctagtagatccatgagtctcttcacaattgacttttcaccacaatctctctttttcttaaggaaacacttaggcttgaacttctctatgctctgtttcaagagaagacagttactttgggaaaggattaggagctatctactctttagcttgcttccccacctccccccaacctccaagtaagaactcagaaggtggaattaaggacaacagcaagcttatgtctagcgatcccagctctaacacatgagagtttaatggaaggagcagcagtagcatggacgtgttagttggcctcttccagcatagacctacaggattgtaagtttcctgaagcctcctcagaagctgctgtcttttctgtacagccttcagaactgtaagccaattaaacctgctttatttagaaattactcagactcaggtatttttatattagt

SEQ ID NO: 473768 - DNA, 656 bp, Homo sapiens
cacccatgaatgaacaaggacagcttagaggttagaacgaagatggaaaatggcaaatccacaattaacctttccccacaaataactaaaaaaagtggacaaaatagaggagacacaatttacagacattggcaacaagcagtccagaacttgcctccctctgttctttcctcctctctattcccaaggagaaaacacttaagaatgcccggacttactgctttagtacaattttcagacggtggtgcagggaagaacataattagaacttggccaccttacaaaggaattggctttctgaatatttcatatatccgtctgcttcatccctgtttacctgtggaatcacaggctttgatctcctgcttgggacattgtgagaactctcttcctggactttcttcttctgtctatcccactctggttccctctccacactgtagcaaaaccacctgagtaatttgcaaaggaaatttgaataaagcataactttatcttatgttaagtgacacaaaacactaggacactgaattgagtccattgaaaatcggcttcaataatttacagcctgcaaagcttcaaactcttcatctattttgttttaagtttggatttgtcacactctgacattttcatatgtttccaaaatgtcacca

SEQ ID NO: 473769 - DNA, 471 bp, Homo sapiens
ggaggccagttccgatgacccatgcttactgcagatagtgagtttcctccagccctgggcagtccagatgctatctgggagctaaggcccagagtcagaaatcttaggaatctatcttgtgcttattgtactgtggctgagctggcagctgagccacaagaaaaagtccttcttaccctaccatcccctttccagaagcagaggaatctctcctcttggcctccactgctccaggcttatggcagtgggctcttctctggcccagggccacactggtattctttaccatcatcagctaaccttgccttagaaatgaggaaagctgtggcccagagaggcaaggatatgagatcttctatccaacagtctgtgaggagtggaatccttctgaaaatgacacaggtgagcctggatgcagattctttcatcccacttgagtctggagacaactgcagccctggatgacagctt

SEQ ID NO: 473770 - DNA, 633 bp, Homo sapiens
cctggaggcagaggtgaggactgggtgatgggtgtgatgtgggagctgacccaaggagcagcactgaagatcagcaaggcgagccactctgactggcaggcaggtggccccttccctctgtccatagcaggcctgagagtcacactgtggaggagaggggcgacctgcctgccctcttcatcgccagtaccaccactgcttctctctttagccaagtttctccccgtgccctgccttgtggagatcttccaatgcgtcctaagtctcttccccaagaagacgatgttggctgctagctgccaagaggtgggggctgggagctgggggctgggggaggacctgcaccccaagccccctcctctggccacagcctttgagctgaaggagagtggtgatgcagcgggaggcacttttgcggggctctgcagtggaaaggctgacctcacagagggtgaccagcagccgcacaggcgggacagtcgccctcagcgttcattctccgtgttcttggccccctgactcagccctcccttggtttatgctggtgcctgacaactagtaggtgcccagcacaaagttgtgaacagactaaatggatgggtgctattttatatttaatggtttagaaatgct

SEQ ID NO: 473771 - DNA, 841 bp, Homo sapiens
gttcacccagcaccccatcccccgccatctgactctcctcccatgaccctctcctgaggagccaccgcacacgcacacgtttgagcttttcctccctggtggcagtggtgaaggcctgtaatgcgtcctcctccgtctctctgcgtccctggagtgaagggcagctctgggcagcaggaaggactgagacgcatggccccactgatgcccaagccagagacgcgggaatcctctcgagctgatggctgctgccacccgtgcacctgtgcttggcccagttgccaagatgcctgtgccatgggacacccctactcaccctgccctgtgcttcgtccacagggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcagccgtttcttcatctgtacaataagaatggtggtatagtgcctgctctgtggattatgattaagtgatcctagaacagtgcctggcccatagtaattgctcaatacacatcagcaattatcactcaatacacgtgagcaattatcttctctgcctttgctggctccaccctcctcttcccgctactgacttcac

SEQ ID NO: 473772 - DNA, 1281 bp, Homo sapiens
cacaattctggaacgtgctggcagccctcacagccctcgctcgctctcggcgcctcctctgcctgggctcccactttggcagcacttgaggagcacttcagcccgccgctgcactgtgggagccccttcgtgggctggccgaggcctaagccggctccctcagcttgcggggaggtgtggagggagaggcgctagcgggaaccagggctgcccgtggagcttgcgggccagctagagttctgggtgggcgtgggcttggcggcccgcactcccgagctgccggcaggccggccctgctggccctgggcaatgaggggcttagcacctgggccagaggctgcagagggtgtgctgggtaccccagcagtgccggcccaccagcgctgcactcgatttctcgcccggccttagctgcctccctggggggcagggctcgggacctgcagtccaccatgcctgagcctccccctcctctgtggactcctgtgtggccccagcctccccgacgagcgcagccccctgctccacggcacccagtcccatccaccacccaagggctaaggagtgcgggtgcacagcgcaggactggcaggcagctccacctgccgccccgctgcaggatccactgggtgaagccagctgggtttctgactctggtggggacttggagaacctttatggtttgtgaatgcaccaatcgacactctgtatctagctactctggtggggacttggagaacctttgtgtccacactctgtatctagctaatctagtggggacgtggagaacttttgggtctagctcagggattgtaaatgcaccaatcagcgccctgtcaaaacagaccactcggctctctgtaaaatggaccaatcagcaggatgtgggtggggccagataggacaataaaagcagggtgcctgagccagcagtggcaacccgctcaggtcttcttccacactgtgagagctttgtttttttgcacttttcaataaatcttgctgctgctcagactttgggtccacgctacctttatgagctgtaacattcaccacgaaggtctgcagcttcactcccgaagccagcgagaccacgaacccaccgggaggaacgaacaactccagacgtgctgcctgaagagctgtaacactcactgcgaaggtttgcagcttcactcgtgagccagcgagaccaccaacccaccagaaggaagaaactctgaacgcatccgaacatcagaaggaacaaactccggacatgctgcctttaagaactgtaac

SEQ ID NO: 473773 - DNA, 612 bp, Homo sapiens
tttcttctttaggtcagttttagatgcatggcaaaattgagcagaaggcacagagacttcccatatactctctgccccatacaccgacagcctccatgcttatcaacatccctcaccagagtggtacatgctgttacaggttccaggccctggatgctgggtggaaagctgacgcgaccccatgccctacggagcttatattctcagggtgtgggcaggataaacgaataagcaaagaagagagtttgaaagatagtgctaagaaggaaataacacacagagaggtgagcttgtctggggctggtggcaccaagcaaggcagtggaggctgtggctggtgtaacatgattctcatccatgcacagatccagaacaggagcccgaaggaggtcagaggtagcagggagcccagtcagctacgtgccttccttccacactgcctccacagctgggccaagctgtttgtttggattgtagagtgattttttattttctgctaacaccgcaaagcagcacatttgtgcatgtttatgtgtgaaatggtatgcatttaaaatgaaacaaacttttatataaatgtacaaagttacagaactgtatttctaagctttc

SEQ ID NO: 473774 - DNA, 987 bp, Homo sapiens
aaacatacaattaccataaggtccagcaattccactcctaggctgaaatgcagagctggtgccagcaagggtggagctctatgacaacctctatgatagggctactcaaagtctggtccacggactagctactcgacacagtcaatgagcagggctgaccccatcggctcctggggcagcaaatcagcacatttcactccctggctgcagttatcagttcaaggctgggctcaggactcttcaatccaagaggagcctgggcaggactttggaggaaaagggcagaccgaggctgtcagcggcggaaacttccgttttaacatgatgttacaccctctcctaaggcctgaggaactggagcccaagcagccttcacagatggcctccccaggtggtcagaccagaccttccctgaagagagagacctctggagctccccctaagcccagctctgcctgctctgcggactcccctatagcagtagaatgctgtgtgaaggatcagagggagccttctaaagaggccactgtagcagcggaggccaagtggaaagtatgccgggagccaggatcccccagcccaagtgctgacaccgccactaatgggctctccactcggtgccttaacttctacatctgtgaaatggggtggcccagtgacctctgaggttcctcctcaccctccctctctgagacttcagaagctactccaagctgaacacggctgggcctgaggtgccgatactctggactgctctggcaggcctgcccatgctccttggagaggagaaggaggcccaggaacacctttgatcttgaggtgggacccaggagccaagtcagtgcacaggcagggccctgagagatccacgatgggtcaggtacttttctagaacattccatacatcatcttgtactatgttcacagcagccctgtcagtcaggcatcctttgccccattctgcagagggacaactgaagcctgagc

SEQ ID NO: 473775 - DNA, 929 bp, Homo sapiens
ggcgtttatgctgagctggtgctgccaggagcgagcgggctttccctgcgctacttgctaagagcagtgtggctccttctcccgtgtccccagcgccgtcaagccccagagtgaagctgtggctccttctcccgtgtccccagcgccgtcaagccccagagtgaagctgtggctccttctcccgtgtccccagcgccgtcaagccccagagtgaagctgtggctccttctcccgtgtccccagcgccgtcaagccccagagtgaagctgtggctccttctcccgtgtccccagcgccgtcaagccccagagtgaagctgtggctccttctcccgtgtccccagcgccgtcaagccccagagtgaagctcctttcagagcagcagcatttgtgtaatgaaggcaaaataaaccttcctgagggaggaaaactcctatgcaagaggaggcaggggcagccaagtcacaggcccagatccttgctgccagttcctgtcttgctgttgcaccaggctcctctgtcagcccctccagatggtgtgctctgctggctccactgcagtcctcagctccttctgctggaccggggcttcccttaggaaaaagctacttggtcactgtccggaggaggcacggcagggccagcttggagctgcagtgcaacctggcagccctgttgccaggctggggcctgcaggctctcaatcttcatgttatttatggactggaaggaccaacccaggtctgtaaggaaggtgagagtctggctgttgagtcagtctcatttccttgggctgttgttcgctggatcccagctagcaagtctctttatctttttgggtaacaattctgtcatatacgtttcttcagattttcaaagtaatacatgctcattttaggtaactagaatgcacaaaataaaaaatatgag

SEQ ID NO: 473776 - DNA, 549 bp, Homo sapiens
gacaatcctaactgccctcttgagcaggtgttgctgtccctgatgtatccagtccatattcagttttccctaaatgtcccaagagtgtcttttatggctgtttttgttgtgttgtgttttgccacacacagattgccatgttctgcccctccatgtcagagcaagacaggtgggctggagcaattaggagaaagtccaaagccctttgcacagccaccaaggccctgtatacacgtcctcccccctgcgcccttgactcgggcccactgggccttctgcaagcacctgtgttgtgctgtggtgcttcctccagccaggccctgcacctgctctctccctggcacaccctttgcctcactatctttgcacagccaactcatagtctattgccctttgtgctccccagaagccattcagatcttagttcagactgggtcaagtccaatcttccaactcccatagcaccagctgccccagaggcccttaccacgatttgaatgtttgtgcactatttgttgaatgtctgttctccttacagaacttgtggct

SEQ ID NO: 473777 - DNA, 757 bp, Homo sapiens
ttggtgttttttcagggtcaggtagatgagggaggaagggtcaccagaagtggcacaggcttctgctgcctacctctccagcatcctggattcatgggcctcatctgactgcttcccatccttctttggaaaaaagacagagaaaccagcagcagtgttcccagacagttctgggatacatgtgcagaatgtgcaggtttgttacatagaaaactgtgataaaatagaaaaattcattgaaagaacaaaactaccaaaacttgactcaagaaacaatggaacatctataacaaataatgagattgaattagtaatcaaaaatgttcccccaaagaaaagctcaggaccagatggtttcactagtgaattctaccaaccatttaaaggaaaactaacacttatctttcacaaagtcttaaaaaaaaatagaagaaaagggaatacttctcaactcattataaaacaagatgaagataacatacccaaaaaaaccatctcttatatagaccaaaaatcccctataaaatgctagcaaatcattccagcaatatgaaaagaaatttatacgttgggaccaactgggatttatcccaggaatgcaagtttctatggttaacagaattggctggatgttacttttatttttataataaatttggtgctttattttgctcatcatattggttcggtaattagcatatgtcaaggcaaaaaaatcccactagatgacaatggcattcctgcattgttttaatcc

SEQ ID NO: 473778 - DNA, 566 bp, Homo sapiens
ctctcttctctcatgcagctggctgtctttggaaagagggatccaacctgtctttgctgggcagccaggccaccaaggttactaactctccttcagtcttgggagtccaaccacctggaagtggctttttcttctgaatgccctgtaagatgtctcactggcactaattgtactgtggtaaatattaacacatttttatccactcaccctcctaacaagtttaccgaagtgttaaccagctcagtgccctcttggtacccaggttcttgtccaacatccaggaaaactgggtcacacacagacttgaaagatggtgaatgcgggggtttactgagtggtggagatggctttcagtgggatagatggggagctgcaaaggggatggagcgggaaggtgaccttaccctggagtatggccatccaccagcaaatctcccttccaaccatccccagctgaactcttcttgacgttcagatgcttctcttttctccttctctgctcttttggcactcttctgcttttctgttcatctgttcatggagactggggtttggaatttatatgc

SEQ ID NO: 473779 - DNA, 1075 bp, Homo sapiens
ggcgctgagtaaaataaggctgaaacctactgggctgcattactagacagttaaggcattctaagtcgcaggatgagacagaaggtcggcacaagggtacatgtgcacaacgtgcagatctataaggtcagcccccgtggagcagagagtctggtacagatagtagaggaggatctggaaggactgaggaaaggcagaatgaagaaggtgaccaagagcctgcaagccactgcagcatggtgctcacaggacagggccctgcatgggcttttctggccaccagcttgcccaagagctgatggccaggtggctttggcctggtacctccccatcccctcagtcagcctgaggttttctgctgtgctgcagctggaaggcagagctatgaacataaaggcaggactggcagatgtgcttctgactgggaatctgttgagaaaaaagcatttttctatgtgtggggaggatgccagggattcacccaaagggccctcccagtttggtcctttcagtccactgccccaaccttcttggcactgaagtcacttttttccgtccacgacatcatcagagacctatgcccctttcctcttctcaaggcagaattaactgttcctgtgtctctgatgcctttgctttaggtgtattctcatgtgagggcacttttcacatttgcaatacatctggatgttaatgggtctgctttctcccttacagagttgcacatttcgtgcacacgcaattatgcttgtaccttcattaagggcttggttcatttttgtattcccatctgtagtgcctgggacctgattggcagtgttttgtactttacaaatctttttaacatactttgtctcattcttcacaacgggtccatgaaataggaagttatcaactgagtcattttcaggatcttcattaatagcatggattaatgcactgtgtggaaataaatgttatctccagggcatactgaatagaataagattttctttaaaaattaccttttgcttagtgtgcatgttgttctgtgtgttttaggtattttatctcatttaattctggaataatccaa

SEQ ID NO: 473780 - DNA, 630 bp, Homo sapiens
tgcctccagcaggtaaacccatacttctgaaggggctcgcactgctctctactgtgatggttgatgagaagcaaagctgcccttgggtgctgccgcttggaatcccaactgcatgctcctttcttgccaagctctctctgctcactgatgtgactttcacaggaaatgctcgttggagcattctgtgttttgaattttgggatttggatgatcaactggagcagatagctgtatgtggaggaggtcgttgttttctgtatgagagcaggatgaggaaatgccagcctgggtccaggagcatgaatatgcaggtgtctggagccatgggcaggttgtcagatgtatggtcgccagatttattaccaagggacatggatgaagctggaaaccatcattctcagcaaactaacacaggaacagaaaaccaaacactgcatgttctcatttataagtgggagttgaactatgagaacacatggacacaaggaggggaacatcacacactggggcttgtcagtgggtgaaggggtaggggagggatagcattaggagaaatgcctaatgtagatgacgggttgatgggtgcagcaattaccatggcatgtgtatacctgtgtaacaaacctgcac

SEQ ID NO: 473781 - DNA, 756 bp, Homo sapiens
ttgcccaggtcacctaactggtcctggcacccagatagctccttcccacccaaatctgccaggcctcgggggcagtggcagctgacaggcctctgagtcaggatgggtgaggaggaggagctgaagggccggccaaggaggaggagggcccggctggcctatctgcagagagagcccacacttcaaatggagcagcctgtggcccccagccatggtcccttggtgggagctgagctgtgtcctcgaggggtgtggactgtggacattgttcacaggaaccagagacatcactctttaggattctaccagcaacacctgaattggctcgacatttgtggagatgcttcccagggtagctccaagtcctctgtccagcaggcagccttgcctgcacagcctccctctcctcctcccgacaagcaccctctcacccaggcagacactgctcctgctctgcccactggtcctaagaccacagagagcatcacttccacccatccttccctgcaccagctttccccaaatcccggtgtccagtgctgagccactaggctggggcttgggggatgactttctcagagctgccatggatagctgtacagactgtccactgcacaactccaggaggctctattttcctagactgtcatggcactggttcctctgtgaaccctgtggcctcttctgtaggtactacagggtcctttctctttaatccactggaaatcaggcctttgctgttagcctgagttgccc

SEQ ID NO: 473782 - DNA, 725 bp, Homo sapiens
cagaagagcagtaggaaaaacatgataggaaagattggaagtctttgtccgacacctgaacaggctgttggggactgggggccgggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcatggcagcaatttgataggtatgtctgatctcaatgtgcctgagcagctctatcagtacatggttggaggacataggcgctttcaaacaggaatgcatagggagaaacataaatcaccaagttatcaaatcaaacatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgctt

SEQ ID NO: 473783 - DNA, 1204 bp, Homo sapiens
acattttctatggtctttaatgattatccaaaaattaatgactgggaatatttactaaattcagactaccaccagagtgttgagtctcatcttttgaacagatctttatgtctgagtccttcagaagcttcacagatgaaggatgaggatttttcacagaatctcagtctggattcttctacacttctctttactcacatacctgcaatttttttcgttcttcgccttgtgtatgaggagcttaagttgaatactctaatgggagaaggaatttgttcactcttgaacttatcgttcagttggcaagagactacccaacgcttgtcagaactactggacaagtgtgcacaattgatccagagtattgcactgtacatacttggtgatgagagctcagtttctgatgaatcctcacagtatttaaccagaataactgtaggattcactttaagagatttggaaactcttccctttggaattgctcttcccatcagagatgcaatttatcactgtcgtgagcagcctgcctcagactggccagaagctgtctgtctcttgactggacgtcaggatctttccaagcaggcctgcgaaggaaacttacccaaagggaagtctgtgctctcatcagatgttccttcaggtacagaaactgaggaggaagatgacggcatgaatgacatgaatcacgaggtcatgtcattaatatggagtgaagatttaagggtgcaggatgtgcgaaggcttcttcagaggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaaggagagagcatgccaaacaggaatgagagctctctagtccatggatttatccagaacttgtagcttggttttcaggctttcgactgtccttggcttgaaggttgagtttcatctgagaatttacctgcctcctaccgccatcaatccccgctctgaagaggtatatctaactgctgttc

SEQ ID NO: 473784 - DNA, 931 bp, Homo sapiens
tttattggactcacagttccacatggctggggaggcctcacaatcatggcagaagacgaaggaagagcaaagggacttcttacatggcagcaggcaagaggcatgtacaggggaactccccttcataaaaccatcagatctcatgagacttattcactactacaagaatgccatggtgaaaacctgcccccaagattcagttacctcccactgggtccctcctatgacacatggggattatcacaattcaaggcacagcattaaggtccgaggtgacttgtatgtgtccccagattggctgagaagtaattcattgtatgattatagcacagtttgtttagtcattcacctgctgatggccatttgggctatttccaattttgtagtacagtagtccccctcctatccacaggataggttccaagactccccagtagatgcctaaaactgtggacagtactgacccctatatacactgactgtggatagtattgacactatccgtggatttgataactgagagggctactaagtgacaaatgggtgggaagtgtatatggcgtggagacactggacagagggagtatcactgtccctggtggaataaaacaggacatcacgagatttcatcatgatactgagaagaaggcacaatttaaaacttatgaattgtttacttctggaattttccatttaataattttggaccatgattaaccacaggtagcaaaaaccatggaaaacaaaactgtggaaaagcagggactactgtatcatgaataaagctggtaagaacaagtacaggtcattttgtggacaagtgtttttacttctctttggaaagtagaagtattgctaaaccatacataagtggatgtttaatgtataagtaactactaaataattttccaaagtggcgtatgttcccact

SEQ ID NO: 473785 - DNA, 901 bp, Homo sapiens
gagagaagcgccgcccaagcggtagagacaaaagaagagcctaggcggtcgcggggcgggacagtccgaccctccgctcctaccttccacgtcccaccttcccaaaactgccctgggcatctcccgagatgctccccgcctggcaccgacagcacagtcagccagctcccccatcatcccgcccccccgccccctgggcccggtctgcccatcccggggcccggcccggctgcactgtggaggggtttgccagaatccgggaatggggccgaaggaaggaggaggggggaacaggaaagaaaaagaaaggaggaggtggcaggagggggtatccggttcagtcactttctcagttgctgcttttagggtggggagcccctcggggcctcccgggcattcaactggggagagcaggtacgcggggaaaaggattctctcctcggcacgttcacgggaggacagtgaaaatttgccttgggtggccaatttcctcattcgcccctattaaaagaaaaagcccaagaaattcaattaaagccaccctggccaatgctctatttgaggcatgaatgtctcccctaaagctgcagcaatcatgtggcattagacacttccggaatcctatagccaacctgaaaaatcccagaccccctttttccctaatttttgctctgatctgtaattttatccacatttgcactagtttgagcattctggctctcccatctgaaagcctgcaattactatataattcttcgcaatttcagatgtcctaatatggactgtaatttttgcgcaagacaatttcctgctatttcaagcatcaacattgtcaaagttgtatgtacataataaatgggaatatcaatgcatagtttttagcataacatcttgactcctc

SEQ ID NO: 473786 - DNA, 489 bp, Homo sapiens
gtgagagcccacccattgtatcagcatgacctggatcatttggcatttctcctgcttacactcattctctctcctgctgtcctgtgaagaggtgccttctaccaagactctccccatccgactgaaagccacatccactgctcaacaaaatcctccacattcactactcttcaactcatttgcacaacctgattcttcttggatgccagacaaggccctgggtgcaggtgcaagaggctgtcccattgaccctccactgagttgtttaacacttaagccatccatgaatggcaagctaaaagagcaccctctaatgcaggccctctgggtctccaagtgtcatgggcaacctccagatgctgctgcaggccctgaaagagttctgctcctgccagttgccaagaagccctcatatcagcctctgtacctgctcacctgcatgctccctctcccacaaggtgttgagagctatgagctaagtaaataagc

SEQ ID NO: 473787 - DNA, 648 bp, Homo sapiens
cctcatcagcgagtgttaacatgaactatcacatctaccatatattaaaaatttgtggccatcatattatggaagcagttgaatgcaatattaagaagtttatgctaaattcagagagcaatttggagctactggcattttttaagtgggtgagaaatgttgatagaattaggtttcggaaggggacagatttacagcagaccagtaaggatgatgatgagaggaaaggagatactaggaagcttaatgtggcagcaaattcatggataaattggatgggaaagaagccggaggtaagaagtgtagctctgaagacatcagcagacagtgaagaggaaatgaaagggtcatgtgacttggagattaagcaaatgcaccagaggaaaagcctgatacatagttggtcacattgcattaagggaattgctttctctatatagaaattaatttgatatcaattttattgatttttggcactttactatctctttattcagtttaagatgctcatcattaagaatatttgagtatcagccttgtaagttagaagctgtcacttatattttgttttctgaaagattttgttttaagagttgtattattgcttcattaaatatttgcaagaatatgtgagagtagccagttaga

SEQ ID NO: 473788 - DNA, 676 bp, Homo sapiens
atcaaattgtcaatgaacggaattgaatggaatcatagaacggaatccaatgtaatcatcattgaattgaacccaatggaatcattaaatggactcgaatggaatcatcgaatggactcgaatggaatcatcatcgaatggaatagaatggaatcatcgaatggaatcgaatggaatcatcatcgaatgaaatcaaatggaatgatcatatggactggaatggaatcatcatcgaatggaattgaatggaatcatcgaatggaatcgaatggaatcatcctcgaatggaatctaatgaaatcaccgaatggacacgaatggaatcatccaatggatttgacgaatggaatcgaaaggaatcatcatggaatagattcgaatggaatcattgaatggaatggaatggaatcatcaaagaaaggaatcgaagggattcatcgaatggaatcaaacggaatcatcgaatggaatggaatggaatcatcatcgaatggactcaaatggaataatcttcgaaaggaatcgaatggaatcgaatggaacaatcaaatggactccaatggaatcatctaatggaatcgagtggaatcatcgaatggactcgaatggagtcatcatgaaatgaaatcggatggaatcaatgaagggactcgaatgaaatcatggaatggactct

SEQ ID NO: 473789 - DNA, 568 bp, Homo sapiens
aggcacaggatgggggaggggcgggctgtaggcttctcaccatgtcctcagattgtactccctttctagcccttctgcagcaaataaacctttgccatcagttcaccaaaagcactcatgagaggaaaaatggcatatcactaaatatagagttctttaaagatagcatcaatgccaatggagaaaaaatagagaagatccaaataaacataagtagaaatgacaaaggggatgttaccactgatcccatagaaagacaaatactccctagagactactatgaacatctctatgcacgcaaactagaaaatctagaagaaattaataaattcctggactcctataaccttccaagactgaaccaggaagaaattgaatcccagaacagactaataatgagttccaaaactgaatcatcatataaagactatcaaccaaaaaaagctcaggaccagatggattcagagctgaattctaccagatgtaaaaaaaagagatagtaccattcctgccaaaactattttaaatattgaggaggacaggctcctctgtaacttattctatgagg

SEQ ID NO: 473790 - DNA, 1655 bp, Homo sapiens
gtgaggggttgagcacagtgggtttgagtgagtgaagtttgtccccgccagtgttgaaatggctggctggacccagagctggtgcacttcagttcttgcctacaaaagggtcaaggagactctcccatctcagttatccccaccatcaatgtatggctttgatgatgatagaagacgcttagggagtatttcccataagcccactctttgcttccaaatgacaagggtggaaattgacggctgcagctttcagtgctgccctctgtacaaggacattcccccattcatgttactaatggttccccctggccttaggtttctaattcttctcatccaaaagattgtgccttttcacactgatgcctcctacatttctgggcagggcatgtggctggcacttatcctctggcctaaatctgtgcagctggggaagtattttattcccatatccctcatctcactggaatctgacaccttctgttttctccaagtgacttcaagtggttacctttcatttaacgtttgaattttatagggttgatatctatttgggaattactctttagtcagcatgccactattatgcctcaaccgtggctgtgtagtggaatcacctggagaggcaacaagttctccaacttacaccaatctttgagcacctccattcaatatatgcaaaagcatctggtgtattgaaatgagtcagaaaaaatatagaaataaaaacatatatatcaatgacggtgacatgacagcaggcgggaatttccaatcattcttaacagaatgtaaaaagcttatatctggacaatgccccgagaaaggcagtacaaagaaagaaattaaccgatagctgagacctgattctatgagaaatatgcagtatcacacagggataaacagtgcaggttctgaagctctgcgtcctgggtttgaatttggtttctagtagttaataacagtatgttgaacaaattatttaatctcatgtttttatgtttttaatctgtaaaatggtcatagtaataatagcacagatatcatactgttgctgtacgataggtattgaaatgacttggtaaacatgaacgttcaaaacacatcagccatgtgtgaaatgcagagagtgatattaacatattttatctttttgttgaaaaggtgtcattgtattatttgttaccattagagtccataattttggtgatccagagcaccttttatattaaaaatgcataaatgcattatttttcatatgagtcaatccctcctcaccatgatatctgtcatgtatgtatcaaatataatatgccttaattgagatgtatttttgtttaaatagaaatactacaaaatatgttttcaatatctcacttataattggatactaatattataattactttgcagaaatagattacaatatagctgataaaatgatgtaaaatttccatgaaaaatttgatgttgttcctttgtttttcttttgtatacaagagttgcatcaagtctttggatccagcgtttacgtatctagcatgtaaatgtctaattgactttatctgaatttgtttgtggcatttcaagattggtggatattattccattcaaatgttctaattaaatagtgataacagtaaaactttatgctgtat

SEQ ID NO: 473791 - DNA, 648 bp, Homo sapiens
cctttgaatattttaaacaaatccttcttggaaagctgcctcaaccctgggagaatcctgaggaaaaatatatgttcaatgttcgctatactgccatagtcactggcagaatacagtctttaattttctttgttcttagactatcatgtgtatgcccttatactttcaagtcagtttccgttatatgtagtttttccacggtgagcagacatacacaacactaccctcaaaggctgagagagttgagaggcctaagaaagaggctgacaaatcccgtttctcagaaagaaacatttaatagagatttaggaacagaagctatgtcctggcagcctcgagaggaggtggtggatcctagcactgttatcctccagacccaaagcttattccttccacagggaaggaatgtgtgggacagtcgactcttcagggaaaggcaaggatttacctacagacgggatttatgtgaccaaaattctgatcactcaacccaagttaggtgacaatagccataagctaggttttctgtcagggtatttttccaaagtagctggaaatgaattctaaagttgaggataaagctatgtcaggctagaccagactgaagacaataaactaagtttgatacagatcagattataacatgtc

SEQ ID NO: 473792 - DNA, 654 bp, Homo sapiens
tacacctggtccagtggtagcctcacagacagctggcacgggtgttggcacctgaacctaactcgaaaaccatgagtgaggatgcaaaaggctgtcacactgaccctttgcactggctggcggaaggcagccgactcacgcaaaaatgcagagcatccactgagctattaacacttaagccatccacagctaaaagcactgtaacactctttctggggcttcaggggtcacaggcatccccagatgctgctacttgtatctgcatggagtttgctcctgcgagtgcccaaaaacgctcaccttggctcctgcacctctcacctgtgtgctccctcccacaagggcagcatgatttatttaactatcgcaaggacaaaaagcaaacaccgcatgttgtcactcgtagatgggaatggaacaatgagaacacatggacacaggaagtgggacataacactctggggactgttgttgggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataattaaaaaataaaaataaaatgtgatga

SEQ ID NO: 473793 - DNA, 826 bp, Homo sapiens
gcacagtggaccgaatgaacagggcacacccgtcgcaagtctgatgaaggggtcaagaaaaactcttacatcattagtggtcccagagactcctctttgggtcatccctgacaaccgtaacttgcctaaggtcctcaagtgccaaaaagctgccctcctcagtctcatgctttatgcccttagagagccgattgctggtcacataatcatgcaagcagcaacctgcaagctcggcatggctacaaaggtgtccttgttacaggatgaagccggactggctctctggtatgtcccagctgcaggaaggagtggccttccttcttctcagtattttttcagacaccatgtgtctggtaaggtcacccctttcccaggcctcattgcttcctggggagtcactgggtatgaattgagtaaacagcaatgggagtttgtgcacctcacagatagtgttgccactgtcacgtatcagggagctcagtggaacattgccgctttttatcctttaaacaggacatccttgataaaagacaggccacaagggccagtacacttggccaaacttcaggcaattattttagcacaggatgcttgggccagtaatgaagccatctacacatttcgtatagactctcaggctattgtctaagaactggcacctgtggaatagagaattctagggatcttttgccccaaagatacaaaaccaaggtcatatatgtttgtaaacatattaaatccataacacgaagcctcaccaaatgcttcttatcccctcaagttccaaacatcattgatagtgtcctaggcactaatttcatatctc

SEQ ID NO: 473794 - DNA, 578 bp, Homo sapiens
tctgcaaactttctgcagtagatgtggaccagtcttttggaaatgaggtgttgaaggatatgagctctttggatgacctagttaaaatcggcttgtacttcgtcagttcaaaatcaaagacccgagaggctgaaaacatctttgcacttctgatattccatcacagaccgactctacctccaaatccaggaattcaggtcacagtcaccaatagatgccatggacctcaagaggagccacagaaagactcatcagcagctgcattagatactcataggagtgtgaaccttgtggcaaactgcatatgtgagggatctagattgtgtgtttcttatgagaatctgatgcctgattatctgaggtggtacagtttcatcccaaagccatcccctacaaccctgatccatggaaaaattatctttcatgaaatcaatctctggtgccataaagtttggggactgcttccatggacaatagacagatacttttacttcatgaaaaaccctcctctaaaacaatgggcaaaagttggtgtgatgtagagaatgttgggtaaggttttattgctttgcttctgt

SEQ ID NO: 473795 - DNA, 600 bp, Homo sapiens
cagacttcttggtcaaaaggatgtacaggaaacatggtggcgtatgcttgtgaggaggcctcaaggaacttttactcatggttgaaggcaaaacgggagcaggcagtttacatggttgaagaaggagcaatagagagtgagggggaagggtctgggtatggtggagagttcagatggttgggggttgtccaaaggttaacttctctcttttcaaaggagggccatggctgccctcaaccaaaggcagggtggccagcatttagcaactgggtccaactgcatgaaaaagtaggatactacgtggttctgaaagcaactgtgatatttgaagataaaaaggataaggacattacctgcattctgtcctgccaacctgagagtgaaactgccagtgcgaaattaacggagacagtgaaagagatcgaacccaatcaactccatcttgcttctaacctccaagttgtccttgttcatttcggggtgtacgctgaactaactttgcaaggaacttagtttatagtttgtagtttaaaacaaagacggtaacagccctttcccaaaacaaacccccttcttgcctgggacaaggctgcctttgta

SEQ ID NO: 473796 - DNA, 720 bp, Homo sapiens
gaccaggactgcaaacacttcccctggtggggccagccagcctgcccacggcctcagtgccctggaaaaccgccagcgtctcactgtcgcttaacactttgtgggaagtcactcctacactggctgcagacactttggaagaaaagaaaggatcgatagacttgcaaagccaggaggggaaatacaataagcatttggtgttactggcaaggaaaggttcattttgaggttgctgcagcactccatgtggcagcacatcacccagactccacctcaactgtgtttccctcgagcaatcgctgcacccgcggagctgtcttttggtcctcatagcaaccccaccgacgaggaaggaagtgtggctcagagaggcagacactggacccaggcatcagagcgcctcagaggcaaggtctgcatttggtgcagcttccaacgctccccacggctccactgctgcttcttgtacatgcttggctgccatgccccaggaaaccccaccagcatctctgttgagaggctgtgcacatcagccccacctcccttgggtggcatgttccacccagtgctgttcagaaccaaggacctctctggtgttttctgcctgaggagcccccgcctgcacccagcagggaagacccacagcaaggtaaagctgtgagtgcagtttgaggacagacagacctgacttcaggccagacacacccacagctagctaac

SEQ ID NO: 473797 - DNA, 1085 bp, Homo sapiens
actgcctgggacattccttctggggccatgagctacctttccccagagtgcgggcaggtgtcctataagcctgcaacccccacgggaaagcagacatcgccacagctggctccgccctgcagcacaaacagggaattgtcttatgtggagagtggcctcctaacctgccagccctgtccctgcaagtctgtgtggctgttgaggctgggaggctgggacgagcagacacagctgcggctcttggttgtgaatgctccagggacagcacaagctgcgagcaccagggacaggcgggtaatgtgcaggtgtgtgtgtgctggtggggactggggagtccatggccgcattactgccgtctctgcctgtatcgccatcgggccgtcctccctctgcatgaggctctgtgacctcaccccttccgtcaagaagccagcgactggtcatagggtctacctgaaatcctaccttgatgacatctgcacacgccctattccaaacaaggtcgcactcacaggcaccaaggccgaccctgcttggtctgctgccctcaggggtcccctgctgcatatccttcacctcctgcttccacagctcaatcccagcaatggattcccaggcaacgtggccgggcccagggccccactgctctgtgcagcttttggacatgacaccctgtttcccagccactacagctccagccatggttaaaaggaccccagatatgtctcaggccactgccccagaggttgcaagccataagaaaccttggtggcttccacatggtattaagccagtgggtgtacagagggcaagagttgaggcttgggagcccccacctagatttcagagaatgtagggaaatgtctggatgtccaggcagaagcctgtttcaggggtggagacctcatagagaacctctactagagcagtgtggagttctctactaggggaatgtgaggggtctccactggggcactgcccagtggaactgtgagaatagggccaccatcctccagcccccaaaatggtagattcacagacagcttgcactgtgcctctgtaaaagctacagaaactcaatgcca

SEQ ID NO: 473798 - DNA, 783 bp, Homo sapiens
gagctgacgtctaactgggagcagggaccccattacccaacatcagccccgacccctacatggtgtctaagtagtccctggcacaaagtgaaggttcagtagagatgagcttgctcctcctgggcctcagcaccatgcagaagggaggcccggcctctgtgctcacctcggtggcatcagccccaacctctacacgggccatgggcgccgacacgtccagcactggcgcagagaagactgatggccgctgtgagagcatagcaggggagaagtggaggaagtgcagatttctttttctacgccccaccggaatccccatctcttcctgtctgattaactctccttcaacctgcaggccacccagtgacaatcacctcctcaaggaagcctccttggctgccctggagccggtggtggacgaacccccagtttacagagttggggctgcaggcaaactacatctgcatggagacttccttgacggcttttggttcaggattggggtgcagatgcccatcgatgtagaccaagggacagagtgcagagggccgacggggcgcagccttgggcctctggctcatcccagctggagtggagatcagggtcatggatgccagttccctggaagctcaaatatcctggattcccagtgctgcaggctgtggcacccaaagaaagaacacacttcttatgcctttattctgtgagttgttctgaagaattctgctgggttccatctttggttttcagctctctatcgtttgactcccatgtctggggccc

SEQ ID NO: 473799 - DNA, 1666 bp, Homo sapiens
cctggatagacctcacttcccgacatcaccccccaaaatgatttcacaaggaacaagggcttagaactaaatgttgatgaattactctagtgccactgaattttatctccttggcttccctggctctgaagaactacatcatatcctttttgctatattcttctttttctacttggtgacattaatgggaaacacagtcatcatcatgattgtctgtgtggataaacgtctgcagtcccccatgtatttcttcctcggccacctctctgccctggagatcctggtcacaaccataatcgtccccgtgatgctttggggattgctgctccctgggatgcagacaatatatttgtctgcctgtgttgtccagctcttcttgtaccttgctgtggggacaacagagttcgcattacttggagcaatggctgtggaccgttatgtggctgtctgtaaccctctgaggtacaacatcattatgaacagacacacctgcaactttgtggttcttgtgtcatgggtgtttgggtttctttttcaaatctggccggtctatgtcatgtttcagcttacttactgcaaatcaaatgtggtgaacaattttttttgtgaccgagggcaattgctcaaactatcctgcaataatactcttttcacggagtttatcctcttcttaatggctgtttttgttctctttggttctttgatccctacaattgtctccaacgcctacatcatctccaccattctcaagatcccgtcatcctctggccggaggaaatccttctccacttgtgcctcccacttcacctgtgttgtgattggctacggcagctgcttgtttctctacgtgaaacccaagcaaacgcaggcagctgattacaattgggtagtttccctgatggtttcagtagtaactcctttcctcaatcctttcatcttcaccctccggaatgataaagtcatagaggcccttcgggatggggtgaaacgctgctgtcaactattcaggaattagccttgctctgaggacttttacatggtaaagcacttagtatggattctagaataatctgaaaagaacttgctcatctttgaactgcatcataattattgccattatcaaatgatttgcatgcaacaaaatacttttaagttacagctacggtttttagtatgcttagttgttacttgaaactcagtctattatttttaagacatgtcttgctatctagctatctatctatcatctgcctttcttaagatatgatgatttcacaattaaactttgaaaaattaaatgtcagagatagactatctatatagtctagaaaatagactagtggttgcttagggctgaggggaatgcagacatagggtagtgatagctatggggtacaggctttctttttgaaatgatggttgtaaatatctatgaatataccaaaaatcattgaactatacattttcaatgagtcaactttatggaatgtgatttatatttcaataaagcttttgaaaatagtatattagatcatgaagaagtattgtgaagaaaagtgaaacaggaatgaaagggaatatctcttgcaggagtgttgaaatttcaaataaggttttcagggaaggattgagagaggtaaggtggtgatacattcggaaacttgtt

SEQ ID NO: 473800 - DNA, 594 bp, Homo sapiens
gctctggattctagttagaacagatgcagaaagaggcagctgctgtatgtctggacaacactctggttggtaacatgacgggagtcgtctttggcagttttctgacaaccacatccagtcaagtcctgttctacttcttaaatactcctgccacatctgcttctctcctattgccactctccttctccaagccaccatcctttcaagaaaaacctactaactcatccctcttgccctactccagacctccccagcccagtaaaagattaacatcaataactaataatcaactggaacaatacaatgacagtcaatctgatgaccaagatggctaccgagtgacggaagagtgggtagcatacacagcagggagacattggacaaaggatgactcacataccagatgggacagaacaggctcatggaaggttgcatcaaggaacctcaattttggatctagcctccagaactgtgagtctgcagactcagtatctcctatctagagccaggcttcatactgatgcctctgcatttgtgtcccatggtgataatgaaaacaataccgacctaatcataagccttcaagcttggctc

SEQ ID NO: 473801 - DNA, 992 bp, Homo sapiens
gctgcagtgcctcacttctgtcaacaaaatgcggcaagtatatacactggaatggacttgtggggtttaatggtacatccatatctaatatcactaagcactgccaggatattcccccaaatgaccgaatatgaggattccctcccccttgatctcctcaacttcaacatgactttctcatgtttgacatgtggcaaattattcaaaatgggtcataaagcagcaaagacaactcgcaacatcaacaatgcatttggtccaggaaccactaacaaacttacagggcagtggttgttcaagaagttttgcaaaagagaccagagccttgaagatgaggagcatagtggctggccattggaaattgacaacaaccaactgagagcaccggcatcggtcaacagaggggacccagttctctttcacaacgacgcccaactctacgtggcacaaccaacacttcaaaagttgaacggattgggctttaaagttttgtctcatccgctacattcacctgacctctcaccaaccaactaccacttctttaagcacctgaacactttttgtggagaaaatgctcccacaaccagcaggatacagaaaatgatttccaagagttaatggaatcccaaagcacagatatttaagcaacaattttctcaatggcaaaactgtgttgattgtaatggttcctattttgatgaataaaaatgtgttttaacctagttataatgatttaaaattcatggtacgaaatcgcaattacttttctgccaacctaatacatgatacttctggacctttgatactgttcctttagtcagttatcttttcctacaccagtgtcatgctgtttttactctttgtactagatcccaagtgttgatatgacacattcccccttttttttatttaaaaaagtttacatttatttatgggcttttatttttccatattaattttagaaagccagtttctcaaatttcatgaaagaa

SEQ ID NO: 473802 - DNA, 1099 bp, Homo sapiens
ggaggcttcattacgtaggcatgattgatgcctctatttgataagcgatttgagattattaatgcaatttatgaacccacagaagaagaatgtgaatggaaaccagatgaagaaggcaagatttcggaggagttgaaagaaaaggccaagattgaagaagagaagaaggatgaagaaaaagaagagcccataggaattcctgaattttggttaactatttttaagaatgttgacttgcttagtgatatgcttcaggaacatgatgaacctattctgaagcactttaaatttattaaagtgaagttcttggatgctggccagcctatgagttttgtcttagaatttcactttgaacccagtgaatattttacaaatgaagtgccaacaaagacatataggatgagaaacattaagaagcagcagaaacacaagggacatgggacagtttgtactgtgactaaaagagtttccaatgactcttgctttaatttttttgcccctcctgaagttcctgagagtggatatctggatgatgctgctgaagctatccatgctgcaaacttccaaatcagtcactttttacctgagtgtataatcccaagatcagtgttatattttactggagaagctattgaagatgatgatgatgattatgatgaagaaggcaaagaagcagatgaggaaggggaagaagaagatgaggaaaatgatccagactatgaaccaaagaaagatcaaaacgcagcagacaagtgtggaagaagaagaggaagaagaagaagagaagaagaggaggaggaggaggaggaggaggaggaagaagaagaagaagaagaagaagaagaagaagaagaagaagatcttcagttatttgatgctttttgtaaaaaaaaaattaaagttcattttctttggtctgacgctcattcctgcccaatcctgcttcttccacccttaatttttctcggacattaacccccaatgaatcttgtatgcttctgactctttctctgaatctaactctgcagaacccaatgacacatagcatttaccatgattgcaatctataaatttatttatgtaatacctagtaaatatt

SEQ ID NO: 473803 - DNA, 1400 bp, Homo sapiens
tctctctctcttttttttttttttctttttttgagacggagtctttctttgtcgcacagacgccagcgagagccgctccttccccacgagtctatggctttcgggttacttaagccacggagaactctatggttccggggcgggccgggaggtttgagtttgaagactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggtgctccaggaacccgggaggccgcgggcaacgggggcagctccgccgggccatgggtcgggaggtgtcctcaccccacgggacttgcttcgttgcataccccattgggcttctactccccttctctgtgactggggcctggtgtggcaggtcactttctttagcttcatcccatcatctgttgggcggctcgttcctggtagtacccagtactccttacagacccttaagacaggattgttgggcctggagtacggcacaggctgttcggcgtccaggggaaggctggaagggattcgtaatgagattggttgggtgtcccgtggatcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgagttgtcaaggcattacttcattttctcattgctattgagaaattcagtgctatgctggtttttcatcctttgtaaacaattttttaaa

SEQ ID NO: 473804 - DNA, 578 bp, Homo sapiens
gcagcgctgacttcagcgccagtaaatgggaaagcagctagttactgctaaaactgtggattggagccagtggtttaagccaaaagatgagtagacctgcacaaagttctgatgatcaaatgggaaagagattaagctgggactgcctaagaaaacacagatgggttctgtatgaaaaacggtcctggatgagccatgttggaggaggaactgactctggagcccctggccactctatccggctcgtcatccacagtcttgcctgtgacaagtggttccaaggaggagggttgcaacgcccaggctccccctgcatggtaggccaagccccttttgggttcatggattatttgggcttggagctgccccaggaccctgatcccagaaatggagatgatgatgaaggaaggcagatcaaaatggctgcaagggacgtggttgccaacattggggttgccatgacaactgtaatgcctgtgatagttgagctgagaaagcaggcggtaagaaaggggaggtgaagaacctgtgttaaacagcatgccaattgatttataaaggactgctatgtctgtgtt

SEQ ID NO: 473805 - DNA, 575 bp, Homo sapiens
gccacagaccaataagtcatagtccagtgtttgagggatgaggaggtatgttagtttcctcaggctgcctaacagaatgtcacaggctgactggcttaaacaacagaaatgtatcttctcacagttatggagactagaaatccaaggtgaacttgccactggggtgctgtctagtcagcgctcttctccactgacttgcgcaggctcccaaagggagctcctaagagaagacatcaagggttcaaatcttgagttactacacatcgcagaagctgaaacccaggactccttccagaccccgctttgtgcattctgtatcagccctgatccttacccatctctccaggactcatcttctctaattctccccaaatactgcagcccaattagcctcttggattactttttctatttctcttcttcaaaattaaaaaaaaaaaagaagttgaagggttgtactgcgaccataattaatctttccaattcgtccttgcactgtgggaaatagcttatcccaagtaatggaaggagaaaagtctccttccctttttcctgagtttagtggtcttgtcatg

SEQ ID NO: 473806 - DNA, 805 bp, Homo sapiens
gctttagttaccagtttattataaagaatgcaaacgaagagccagacgacgagaaacagattaaggttcagaagtgtctggagcactggggtctgcttccctcttgggcccatctcaatccatgatgatggcatcaagattgttaacggaattacacccacaaaactcctttcatacattcacagcttccaggaggacattatctttggaggcactaccttcaacctgatgctttttcctgaaatgacttttttctttttacatttggctactgtgaagccaaaagttcagggtaatcaagatactgaatgtgccactgagatgctgcttgaactagccacctacatcaaagagctatcagtaccacaaagggatgctgtatctcatctcttctttcaaaacctcatgtgaatatctttccttcagcaaccagcatactttgttcaacagtgtctttgacttactgtccatttctctacacagtattctgagaagacataataggagaggccatgaattgaaggcattgactcttcttgctatttgtttctatatatatcgagattaggagccagattgttgcctgacagctggtctttgtgaatacagtggtgtatggttgacattcagctgcaagtttttttttttttttttaaatctgtgaattgatgctggttggtcagtcagtataccaaaagataatagcacacttaaaaccaagatgaggcggctctgcctatggagtagccattattttattcctttactttcttaataaacttgttttcactttaaaaaaaaaaaa

SEQ ID NO: 473807 - DNA, 702 bp, Homo sapiens
aaaatccaggtgttgtcaatgtgatggtattaagaggcgggggtctttaagaggtggcaggtttggctttagataagcgcagggacgattcttccatgatacgaggagggactgcagagtgcactggcacagctgcaggaagatgggaagatgtggttgggtaattcactgtggcatcttggggcacctgctggccctctctgagcctccattttcttacccacgaaatgtggatttggacccagttatctccaaccacccaagagtctgtgattctgctactaagaaaagcaaaaggcaagtacaagatagcatgtgtttagttgctggggaaagctcactcagcccacagctaacagctcagctcagaaagttcctaccacccactccgcttctaacgccttttaatattcgcacagagttttctcacattgtggctctcacacacttcctttatacatgctgtttcctcagcctggaatgccacctctttctttacctggagaacccctgtcccttaaagacgcaggtcagaagtcacgtagtactcctctgctaccacctaatgcaaagcgtgattattccttcacttctcttctgcatttaaattattgagggaagaggcttggtctcattgcctttggaatagctctggatctgcgttcatgttttgtatataatacgactcagtaaaggttgtgt

SEQ ID NO: 473808 - DNA, 931 bp, Homo sapiens
gtttttttttttttttcttttttttcttttttttttttttttgagacagcttaaaaggacaaaaggacactgctgggggctgctgccaggactcaagtgtaagccactggcagtgaccctcctgcccccagcagtggagctgctatgcatttacaagtacctggaggacaggctaccctgactgcagctgccacttggaggtgaaacgtgcactccccagccacctgactatggctgctgccactgaaagcaaccctgtccatcctagtagcagggccacagctcagccactgctgccccaatctgagcatttcaccagggatccagaatcaccccatcccttgcctaccacaagccagtgccttgcaaacaccatcgggggcctgagaacccatccgcctggcccagctccatatgcctgcagtgcccaagcatgctctctggggttctggggatcagacagcaccatccaccatcattggcacctgagcatgcctcctgggaggcagaaggcaggccaacccaacttgctatcatcaccacagctgataccaccccacgtgcaacctgttggcctgggcactttcctgaacaacccatctcagccaccaccaacaccagtgcaaattgtttgggagcctgagggttgtcctaccactgctactgcaatggcctatagtatgcctgctgccaaggagcctgaagacctgccaacctgcccagcctgccactgcagctactggctcctaagcaagccacctggagtccaagaatcagcccacctggacccactaaaaacagtgttggtatatgtcaccctggggcccaaggataggcacactcagcctgctaatgcccccaccagggcctcaggactggcccacctggtgtccccaaccccaacaaaacttcaccacagcctccactaata

SEQ ID NO: 473809 - DNA, 918 bp, Homo sapiens
gcgctgtgcagcgatatacctctgccgtccagatgtggtagcaaggagaagcacagagtgaagtccgggaaagcctcttgtaaacccatcagatcttgtgagaactcagtcactattatgagaacagtgtggagccttgcagaccatttgaaaggcgagaataatgggatttactgggaaaaaaggataaaagggaaacagcgactctccacaaagccagaacccctggtggtgcgcttctcgcctcgcagttttaaaatcccgggttctacacaggaagaggaagggccaggctcctctctgctggaaacggtacgaacttccgtggctccaccccagggcgcactcctcccagtgcaccggcgggttgcagttctgccaggaagcccttcccacccggctgtctcattgtcatttgcgtattttttctatttatgtcaaactcagcctaacagactgcgtctacttcctcactacctagccacttttttcgcctcaacatttttaagcatttactcagttcaaagagccactagataaataggaattaagcaaataaaaaagaaaaagaaaaggaggggaattctaagaaaaagggaaggtacatttgagctgaagcaatcttttgtttctctccattttttgcccaaagccaacttctccccttattagcaggaatgcatctttaatccatctttcttttaaaagactgacaatgactttacctaaaagctaatgtttcattcaattattaaaatatagagtgaaggtaattttctctggtggtatgttttaatttctttcttttaattttttctgcgtctgttctatgttttttgatttgaggctaccatgaggcttacaaataatatcttattacccattgttttaacctgatgacaatttaacactgattgc

SEQ ID NO: 473810 - DNA, 745 bp, Homo sapiens
ttttcctgtaaatgtcgggtggcatctcataccatccccgactggataatgaagcagataaactggctattccagttcctgtagcagtagccattcctaaccctataactgcttatgctgctgttctcccctctccttcccattttgatggctttggcagtgtgatagtccctttgtggttgccaaaatgtgtctggaattggtgggttcttggtctcactgacttcaagaatgaagccacggaccctcgtggactgaagctgcagaccttcgcggtgagtgttacagctcttaaggcagcacatctggagttgtttgttcctcctggtgggttcgtggtctcactggcttcaggagtgaagctgcagaccttcgcgaatacattgtatcattaactacagtaaccttgttgtacaatagatttcttaaataaacattttacctttcaatcaacataggaaatctgtcattagctcaaagcagttttgatttagcaaattatttgtaaactatggatgtacctcccatttcaaaatacataatgtatatcttttgtttcaagagatttttaccacaaagaagtttaacaaacagggctaaaacaatacaatttttaaagtaatagtttaataaaaaaatttttaaaagagtaagctatgccaggcaatacttcctataaccttcaaaaggtgttttacattgtgcactcagttcctttaggtttatttcttggggcatcgttccc

SEQ ID NO: 473811 - DNA, 1136 bp, Homo sapiens
tccctgtagaaaatgggtgaagaaagccccctgttgggctgtttttctagcactcattggagacccctgaagacgctggccttgtcttgggctccagggctccagctcacacgcacagacactatttatcaacactcaagccaagaggggatgatttccaactttggcttaacactgtgtgggagctggccatttccaagagtctttgggccaatagatgagactgcaggaccacatgtccctattcctggtctggaggctagaggtctgaaatcaaggtgcttgcagagtcatgttctctctgaagactctggaggaggactcttccctgccttttccggcatctggcagccccaggtgtttcttgtcttgtggcagcataaaaagctgaattggatcaaggactgcagaggggtgtggtgcggaatgtcgtgaaggggccaaaatgtacagagggagacccagaacctgatgaaatttcctcgtagtttaagtctactgtatgcatctcagatgcatcccctggaggggatagggacaaaactctgagaagtaattgaccatagtctccatgctacttgtgaaaagagcactctaacatcagcagagctcttgaattaggtgacctttaaggttttgccaactaagattctgtttttatttaaactggttaatcttatccacaaaatatcaatttaatgctgaacagttggtctaccagtgtataattgtatagaaaatagccagttgcatagcaaacaacagattatatgtctgaatttttttaactctacaatttttttggcagtacatactgcaggatattgatgtgaatggccatattttctttcagagatgagtattctttcttaatgtgtgtttcactctgcaaaggattggttgttgacttaattgggggcttaggaatggtttcaggagaagcgccgatggggtagaatgtgagttattttctgtggtgctggtatgtccaggttttctcctgtgcagtagtaataaatttctgaaaggataggtctaggtaagcaggtgaggttttaaatatcttagttatgttatgtaagtaaacttatattaaatatgtttacatatgctgcccaaactctcagagaggaaac

SEQ ID NO: 473812 - DNA, 1305 bp, Homo sapiens
ccaaagactttgcgttggctttgctgtgagctgcgcagtatctgaaccgcattgtggaaagccaggaaatgggctctttttctctgaaatccccagttctcacctgtgacttctggtgtggatgctaccaaggtcctatgagagatggcattgtcagtgtgccaagccacttctcaggtcctcacagcatgcaagctcttacaattattatttcttctccaagtgaacctcactttgtgaggttcagtgtttaccagtgtctttcattgtgtgacacattcttcaataagccatcgtgtattgagaagcgggctgtgggtcattgttcactgcacttcagggcactcatcctttcctctgtccctaaggaacacaagaaccacacctgtcttttcagcatcctgtcttgcaagcccagtcacacggtccttgagcagaagtgtcctgggttatccagtcctcagcatcagcagtgttcatctattgatcaattggagcctcagtcaggatctttgaacagctttccttgggccaagggccagcttccccaagtgagtgttctgcatagaggcctgcacaccccagccaggtcataccacctaaagtcactccacggagtaacagcccctggaatgctttctacaagcacggaattaggcaatggtaagcacttcttgaagattactcttctgtttcatcctggtatcttgaggtggatctccttggtatctctgatccacgatgtttgcaaagccagaccactcccttatgactccaaggggcttcctggtttactgcttctctggcctagcccttccaatgttcagatgtggtatatgacacagttacctgctctgcggtcttgcaatgatcatttattgtgttttttttataaatcatgtccccccaaatttgaaaatgatgggcttatagttggcattttttgggtgggcccatatatatggatgctgtggaatcgaagtgtggtatggagtacacgcatgtacagctgtttggttggtggcagaggtagcactaggaaaatgggaatggtggttgcaaaaggggccacaggtatggtgtaagatcttgacatatgggaagctgtcagtacctaacatacgggaaaaacattattttagagctacatgtgcctgctctctaaatcatagaagcattgaagaaagactttggatttacctgaagtcctgagttctagtcctgtttttgtctccaactggttgtgtagcctacaataagtcacttggactctatagacctctgttgtctcatttgcacctaagc

SEQ ID NO: 473813 - DNA, 750 bp, Homo sapiens
agttcactaaagctaagacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagacagtcagtcaccccatccagcctcagcctcatcctcatctggacccgtttctgaccaaccacccaatcagtttcaatgatccagactgtcagtcaccccatccagcctcagcctcatcctcgtctggacccgttctgacgacctaatcagattcaatgatccagactgtcagtcaccccaaccagctctaaagagaggatttgaaccactaaggcc

SEQ ID NO: 473814 - DNA, 768 bp, Homo sapiens
gtctgggaggtgtacccaacagctcattgagaacgggccatgatgacgatggcgcgtccagggcgcattcctcaccacctcatccacgtagcggcagtgctggactgcgtcatagcgctcattctcgttcatcacctatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggcacaacaaataacagagaactgtcaacttagaagccaggaaatgatttcccggggaacaagactaattccaaagtgaaataaacattaaaaacagaatcagcataatggtccatcatgctttaaataataaatct

SEQ ID NO: 473815 - DNA, 757 bp, Homo sapiens
gtttagactgaatgtcttgacggtccatccattcacttctgctttgaaaatggattttttttttcattttcatttttggtatggaagaaattggcttttttaaaaaaccttttaatctgtggaactttgaacttgagagagatgatttggggtacctggtggaagaaatttctaggcagcaaagtgttcaagaggaagcagagcataaaagtttagaaaatttgcagcctgatgctgcaatagaaaagaaaaagctattttctggggagaaattcaaacctgctgcagaaatttgcataagtaacgaggagccgaatgttaatcaccaagacaatggggaaaatgtctccagggtatgtcagaaaacttcacagcagtccttcccatcacaggcccgaaaggctaggagggaaaaatggtttcctgggccagatccagggacccactactgtgtgcagcctcagcactgcatcccagccactgcagccatggctaaaaggggccaaggtacagctcaggacattgcatcagagagtggaagcccccagcattggcagcttccatgtggtgttggtcctgtgggtgtgcagaagacaagatttgaggctcgctatgttgcccctgctggactccagagctcaagggatcttcctgcctcagtcccctgaatagccggggctatagaaaaaacaaatttgtcattgtttgaggcaaagccctacacatatattccatataatttccatttttaaaattt

SEQ ID NO: 473816 - DNA, 1849 bp, Homo sapiens
ctgctgcctttgactgcaatcagaatgcagctcttttcttccaactttcatgacgtgacatgggcaatgagcattttccttcccctggcttctctcaaactacccttcagcttttgcttccctgttggtcctcctcactcagacttggctttgaggtggtcttaccaactccagagcgccttctctcttgtgattcacacctgggtcaaagacaacgctagacatgtgttgcctctgacctgcctggccataaaccttccctgtgagacagaaaccacagctttcaggccatgcccctctcagtccgtctgtgaagtaggggcatccagttcctgtgcccatgactacaacacacttcccactgacccctttgttctggccaaggaggtttgtcccaacttgaaattacatcatgaatctcaggagcttccctccacctgtgaccaccaactgagttcgccaacagacttctgcgaggtcccctgggaggcaagagacataaactcttcgtgcatcgtgtggaagatgagggtgtgggatgggattaggcattctcaagtggcagcacagggagggtgtacttaaatagcatatcttcaagacccatgtcataattttatacttaagacgatagcctacagaataaaaaccgtagtgagcagaatgcagtgaaatcagctaatgaagcatatattaaatgcactgaaaaacacaggaataaaatgccaaaatatttcccagagctgatagccttggtggtccctaatgacggatgctaattccttcttgttcatacattgttgccttagtctctacttcctcatcattgttggtttgttactgcatcaagtccccttccagggtcttgggaaaactgtcctgtgagcacaaaatcattggcagattttaagatgccaaacatatcacttcttgcattgtatttaaacactattatttaaattcagttcaacaaacatctttgtatccttactgttattttaacatatttattgcgttttgattaactgtgtataaaaatgcttataataataactaaacacagaagaaaaaatgttcacacttaaggcctgtagttacagaaaataaatagaaaaatttaacgtatataaatattattgcagcatataaataggataagagtatgagtgaaaactttcaaagatgaatatatcaggatagaatactgagagaaaggaaaatgaaaatatcaggtcatggaaaataaaacaatgtataatttcacactgtttaagaagtcattcgtacacttttaaagcaacagtggttatcaactcactatggtattttgattctttacctacatttaaggtttttatgttaaaatgtcctggtttacagtatgagagaaattacagtttttgttacttcttaagattttaaaacttgtctacttaaaacgtgttgttttacatctttttttcataatttttttcgggggtacttcaacaaaaatttgaagactactgcttgtgatggtacttgtagccaggagagactgtttttctactcagcatcatttatagttttcagtatacaggtcttgtgcttctttcgtcgactttattccttagtattttgtaagctttatgctcttttagattatattgtacgttaaattttgattttctattccctgttgctagtatataaaatcataattgatttataaatgttatttattctaaatcttatataaattcccttattagttctagtaacatattttcaattccatctgatattctacattggcaattatgtcaaatgtgaataaaaataattttagttatttctttctaatatggac

SEQ ID NO: 473817 - DNA, 865 bp, Homo sapiens
cctttcatttcctcatcagctgctgcagccgtcactgaaaggggccaacatagagctcatagcttcagagggtgcaagccccaagccttggaagcttccatgtggtgttgagcctgcgagtgcatagaagtcaagaattgaggtctgggaacctctgcttaagtttcagaggatgtatggaaatgcctggatgaccaggctgaagtttgctgcaggagcagggcactcatggggaacctctgctaggatagtgcagaaggcaaatgtggggtgggagcccccatgcagagtccacactggggcactgccttgtggagctgtgagaagacaaccaccatcctccagaccccagaatggtagatccaccaatagcttgcactgtgcacctggaaaagttgcagacacccaataccagcctgtgaaagcagccaggagggaggcagtaccctgccaagccatgggggtggaattgctcatgaccatgggaacccatcatcagtttgactcgcatctgagatgtggagtcaaaggagatcattttggatctttaagatttgactgccttgctggatttcagacttgcatggggcctgtagccattgccaaccatgagaagagagaagagtatttctggcagaaggaacagcatgtgtaaaggtcaaaagtgagagaacacagtggctgggccctactttgtctttgctttattaattttcatgcaagctaaggaacgtagaatagtaaacattaatactttactgttttatttgggagggaaaatacttttaccttgtgtattgtattagtctgttctcatgctgctatgaagaactgcctgagcctgggtaatgtataaaggaaagag

SEQ ID NO: 473818 - DNA, 1873 bp, Homo sapiens
ggccgaataggaacagctccggtctacagctcccagtgtcagcaatgcagaagatgggtgatttctgcatttccatctcaggtaccaggttcatctcactagggagtgccagagagcagatgcaggacagtgggtgcagtgcacagttcatgagccgaagcagggtgaggcactgcctcactcggcaagtgcaaggggtcagggagttccctttcctagtcaaagaaaggggtgacagacggcacctggaaaatcgggtaactcccaccctaatactgtgcttttccgatggtcttaacaaacggcgcaccaggagattatatcctgcacctggctcagagggtgacacgcccacggagtctcgctgattgctatcacagcagtctgagatcaaactgcaaggcggcagcaaggcttggggagggtcgctcgccatttcccaggcttgcgtaggtaaacaaagcagccaggaactcgaactgggtggagcccaccacagctcaaggaggcctgcctgcctctttaggctccacctctgggggcagggcagagacaaacaaaaagacagcagtaacctctgcagatttaaatgtccctgtctgacagctttgaagagagcagtggttctcccagcacacagctggagatctgagaacaggcagactgccttctcaagtgggtccctgacccctgacccccaagcagcctaactgggaggcaccccccagtacgggcagactgacacctcacatggccgggttctcctctgagacaaaacttccagaggaacgatcagacagcagcattcgcggttcatgaaaatctgctgttctgcagccaccgctgctaatacccaggtaaacagggtctggagtggacctctagaaaactccaaaagacctgcagctgagggtcctgtctgttagaaggaaaacttacaaacagaaaggacataaacaccaaaaacccatctgtacatcaccatcatcaaagaccaaaagtagatacaaccacaaagatggggaaaaaacacagcagaaaaattggaaattctaaaaagcagagcacctctcctcctccaaaggaacgcagttcctcaccagcaatggaaaaaagctgggtggagaatgactttgatgagttgagagaagaaggcttcagacgatcaaactactctgagctacaggaggaaattcaaaccaagggcaaagaaataaaaaagaataaaaagaaacgaacaaacctccaagaaatatgggactacgtgaaaagaccaaatgtacgtctgataggtgtacctgaaactgacggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccataggtgaaaggaaggaaaaaatgttaagggcagccagagagaaaggtcgggttacccacaaagggaagcccatcagactaacagcggatctcttggcagaaactctagaagccagaagagagagggggccgatattcaacattcttaaagaaaagaattttcaacccagaatttcatatccagccaaactaagcttcataagtgaaggagaaataaaatactttacagacaagcaaatgctgagagattttgtcaccaccaggcctgacctaaaagagctcctgaaggaagcgctaaacatggaaaggaacaaccagtaccagccactgcaaaatcatgccaaaatgtaaagatcattgagacaaggaagaaactgcatcaactaacgagcaaaataa

SEQ ID NO: 473819 - DNA, 1755 bp, Homo sapiens
tgccaagaaaaaaatgaataagtatttttggtacatctatttcatcatttcatttcctcatttcatcatttcatttcatcatttcatttcatcatttcatcatttcatcatttcatttcatcatttcatctcaacatttcatttcatcatttcacttcatctcatcatttcatcatttcatttcatgatttcatctcatttcatcacttcatttcttcatttcatttcatctgaacatttcatttcatcatttcacttcatctcatcttttcatcatttcatctcatttcatctcatcatttcatctcatctcatttcatcttttcatctcgtcatttcatttcgtcatttcatcttttcatcccatttcatcatttcatcaattcaacatttcaattatttcatcatttcatcatttgacttcatcatttcataacatttcatttcataatttcatcttttcttttcatcatttcactttgtcatttcattttgtcatttcatttcctcatttatcatttaatttcatcctttcatcattttatctcatttcatcctttcatttcattatttcatcatttcatctcatcattgcattttgtcatttcatttcatttcaacatttcacttcatcttatcatttcatctcatgatttcatttcatctcatcatttcatttcgtcttttcatctcatttcatcatttcatcttttcatctcatttcatttgatcatttcatcaattcatcatttcatcgtttcattatttcatcatttaatcatttcacttcatttcatcatttcatcatttcatatcatttcttcatttcatcatttgatcttttcatttcatttcaccatttcatgatttcatttcatttcacttcatcatttcatttcatttcaccatttcatcattccatcatttcatttcaccatttcatttcatcatttcatttcatcctttcattatttcattgcatcatttcatctcataatttcattatttcacttcatctcatcatttcatcatttcatctcacgatttcatttcatctcatcatttcatcacatttcatctcatcaattcatcttttcatctcatttcattatttcatcctttcatctcatcattcatcatttcattttatcaattcatcatttcatttcatatttcatcatttcatttcatttcatcatttcatcatttcacttcatcatttcattccatcatttcacatttcttcatttcatatcatttcatcatttcacttcatcatttcatttcctcatttcatttcaccatttcatcaattcatttaatcatttcatctcatttcatttcatcatttcacttcatctcttcatttcatctcatgatttcatctcatcatttcatcttttcatctcatttcatttaatcatttcgtttcatttcaccatttcatctcgtcatttcatttcatttcatcaattcatcatttcatttcattatttcatcattacacttcatcatttcatttcatcattgcatatcatttcttcatttcatcatttcatcttttcatttcaccatttcacttcatcatttcatttcctcatttcatttcaccatttcatttcaccatttcagttcatcatttcatttcatcactccatttcatcatttcatcattttctttcatctcatttcatcatttcttcatttcatcattttatttcatcatttcatttaatttcagtgatacatgtattc

SEQ ID NO: 473820 - DNA, 758 bp, Homo sapiens
cagcaggtttagtggttcctgtggcgtctccttggcttgcagatggcggccaccaccttcttgctgtgtcctcacgtggtctttcctctggactgtgaggccacaggccagaggggcaggtatgggattggaaaggagcctgtggtggctgcctatgtccagctacatatgcagagtggtgagcaggtggaattcatggtggattcttttgatggggattttcctgctttgaaaggaaataataggacgttttcaatgtggaacaaggctgaggttctgactgctggcctaaaagaagagggaaaaatggtttgtgggtcaggcccagggccaccctgctctgtgcagcctctggacttgatgccctgtatcccagctgctccagctccagctgtggctaaaagggaccccagaatggtaggtccaccaacaacttgtactgtatgcctggaaaagccgctggcactcaatggcagccatgaaggcagccagtgtggagggttgtacaaagtcacaggggtgcagctgcccaaggccatgggagcctctcctttgcatcagcatgccttgaatggtgataaaggttgactcttacgattagttctacaagttttataattttcactcataagtttaggtccatggcatattttgagttactttttcatatggtgtgaggttttgatacaagtgattttcaattgaaccctgggtattttgaatattgaatattatgagactctacttttttaaaaaaa

SEQ ID NO: 473821 - DNA, 4205 bp, Homo sapiens
ttctagcacaaccagtcacagtgacgctctgagaacatttcggactcataaagccgccgcaatcgacggtgtagaggatgagcgagaaattatctagtagttgctctaggcctgtcttaggtcacgtgcagaaggcacatctggcttccttggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtgccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatctttgattccacagaaattgcaaatcctgattatcctgatttgtaagtgcacccagtcagctttctctctttcactccatggaatatgcctgttagatttggaacgaaggataagcccccaaaatgttaaaaatagactactgccctggcaggaaatttagcattggcaagcacagaactcagaaggaattgatctaacataaggaaacattcagagaaagatttgtgcattatgatcctgttctgaccattttcagagcagtcaaagggaagtaaagtgtatgtgggtgtgcgcatgtgtgcgtgtgtgcaggtttgctaagtttgtgtgtgtacatttgaatagctgtgtttcttaaaaaaaatactcaagacatggaaaaagtctgaaaagaagtgcttttcagacattttacattttgttatcttacatcgaagacatttaaaatgttgatactggaaaaataaaaggttccgaagacagcctcaccaaaaaaaaactatataatttataagatatgccaacaacaaaattgagaaaatattaaattatctttactcattttatgggaaacttagattttagttaatgacctttccttaaacatgaaaaaatcacgtttattcattcctaaaacggtattattatagggggaagaagtac

SEQ ID NO: 473822 - DNA, 707 bp, Homo sapiens
aggccaggcctttatgccctacattcactcggtgcccaccagcggcctcccctgtgtccctgtgaccgtggcggcaaagacggactcaggagtgcaagttgctgatgaagtatgtcacattttttgtgacataaaagttcataaatgctccacatcagaagaaatcaagaaaagaaagaagactgtcattttttgtctcagtgcagacaaaaagtgcatcattgtagaagagggcaaagagatctcagctggagatattggtgtaaccataactggtcctttcaagcactttgtgggaatgcttcctgaaaaagattgctgctatgctttatatgatgcaagctttgaaacgaagaaatccggaagagtattgtttgtttgtttgtttttgtgggcaccagaactaccacctctgaaaagtaaaatgatcttcacaagctgtaaggatgcaatcaaaaagaaatttcaagcaaatggaccagaagatctcaactgggcttgtattgctgaaaagttagatgggtacttaattgcagcttttgaaggatgctctgtgtaggccatcattcagtgccacaaatggaaagcttccatgtttaatgttatccgcttgctatataaataaagcaaacatatgtttttaaaaaagagaaaacaagagtagtgctcagatagaatgtgtagctcatggaattcagtactgggag

SEQ ID NO: 473823 - DNA, 938 bp, Homo sapiens
ccagcagtgcgctctgcagcatgtcgctacatgcctgggagtgggaagaggaccccgcaagcatagagcccatctcctccatcactagcttttaccagtccacgagcgagtgtgacgtggaggaacacctgaaggccaaggccagggcccaggagtctgactctgaccgcccgtgcagcagcatcgagtcctcatctgagcctgccagcactttcagctccgacgtgccccacgtggtcccctgcaaattcaccatctcactggccttccctgtgaatatgggtgtattccagccggctctcctcctgcttctgctattttgctggtgcacgctgctgactcgggcaggcaatgtggagtgctcagcctctcacaacatcaagctccagggaactggggagacgggtctgcttttccacatgaggttaaaacgagactttttcaatctgtatcttcaaggtcagaagggaaaatatgcaagtttgattgaaaaatataagaaacaccctaaaacagacagttctgttacaaagatgcgtcgtttttaccacattgagtatttccttctgccggacgatgaagaacctaaaaaagttgacatattgctatttccaatggtggccaaagtattcctggagtcaggagtaaagggcctttagagaaccaagtggttctggccttgaaggcattttacaatctgtttccaagcctcctcctcactgccactgccccttcacaccacagcccacctcctggtccctgcagacacgtggctctcccttgtggcctccctattccctgagatacacaataccaaaattaggtcaattaataaccttacaatggcctctaaagtgttcaagtgaaaggaggccttgcacatctctccctttaagtcaaaagcttgaaatgattaagcttagtgaggaagccacatc

SEQ ID NO: 473824 - DNA, 654 bp, Homo sapiens
tttgagtcgagctgggtttattcagattccctctctctctctcaaaccagggagatacgataaggatgaagatagccatctctaccatcatcatcgccaactgtggctttaagaagggggaagaggaaaggtataaggaggaggagggaaaagagagagacaaagaggagacggaagggaaggaagaaaagcagggcttccataacaaagtaccacaaacgggggtggctcacacaaaagaaatgtattatcccacagttctggagcctggaattccaaagtcaaagtgtcagcagggttggtttcgtctgagggctgcaggggaaggatctgttctgggcctctctccttggtttgtagacagtcatcttctccctgcatctcttccatcggcttcctttccttccttcagaaaacgtgtctccgtgtccaaatttcccctttttataagggcaccagtattgattagggcccatcctaatgacctccctttaacttgattgtttctgtaaagtctttattttcaaataaggtcacattctgaagtactaagatttgggacttcaacatacaaattttggagggacatattccaacccatagcattcgggtactatttttaatatccagtttacttctgtagaaattgagttt

SEQ ID NO: 473825 - DNA, 1143 bp, Homo sapiens
agtagtagtgttgggaagcaaggggtcacccagcgatagatcgcgctgagaccacaggacttatactggcttgccctttataacatcaaagttcatggtggccagagcacgctccgcgtctgccggctgcaggaagttcacggacacgtagcccacgaagaggtgggtgagccagtccctaaagacccggatggtgagggtggacctgtcgagctaaacttctcttggaacatcaattcagtcacgtcggggtgcaggtcccccacatacagcgaggccatgtggtagctgggggcgctggggttcatcgcggcacggctgcccacagggctacaggccgcgaccctttcgtgacaggaggagagcgagtgccgggccgggggtctcgcagccgggggcggggagcaagggcacgcgccgagggacaaaaatcatccgaatcagaaacaactcactggccacagagcgaggtcgcttgtccgccgctgtctgctggctgccggtgtccggttcgggcggcgggaaggcctgggtctcgtggttcctccttacggctgctgcagggccgcgggtgggagaaagagctgaaattgtggaaaaacagacacaagctctgcgagtggctgatctgcaatgaaagatgtatgcacagcctcaacaggtgtctactgttaaagtgagggcattgattggaaaagaatgggaccctgaaacttggaatggggacatgtgggagggccctgatgaaactggggacactgagtttgtaaactctgatgaaacttttttgccagaaggagcagctttcccatctctagtggagacaatatcccctccctatcctatgctgccatcagcctttccacctttgtctgaggagataaaccctgcactgcctgaggcagcagtgatgacctcccctgaggcagttgccagacaaaataatgttgattcttctcaggagaaacccccaacacccctgtttgcttctacaactatagctagactgaagtcctggctggcccctggagatgagattgagactgtgacccatgaggaagtgtgctacactcaaaaagaactatttgagttatctaatttatataaacagaaatctggagaataggcatgggaatgaacatt

SEQ ID NO: 473826 - DNA, 822 bp, Homo sapiens
ttgcttttttttttttttttgtcaggtttgtcaaagatcagatacctgtagcttttgcccattcagtatgatgttggttgtggattctttggcctgggccctcactgagcatgttgtcccgggggcactttcttctgcttccacagaagccctctccctgaagaaggcagccctccccagtccaggggtattgcaggcaacaaggagctttcacacagggcagccatgtcttgctcctctaccacctcttcctgaatatggaggagaagttcatcttgggctgatccctgaggaattcttccattttctttatactaaaactggtataacaggaccttatgtgtttggaactggacttacgttgtatgctctttccaaagaaatatatgataccattgatttggagaagtcacagcaggctgtgggtcacaagtgccattacctttttgatgccaagaggaataacattgctatgactttggagaatactcttcaggaatggctgcatcgagtatataaggaggagctgccagagagactccagcttctgtcaattgaggtattctacatccacaatgctgacagggaaatgaggaagattcaacctcagacttgagggattttatctttctttgaacctaaagtaattataagaagaaatgtatatatggatatgtaaacatgtgttatagccaaagtctggaacaggtgatttctgacaatagatagcaaaatttataattaacttaagcagctggctaagcaccgaagtgtcacacagaagaaaaaatagtgtctcattgcaagccaaatatcactgct

SEQ ID NO: 473827 - DNA, 466 bp, Homo sapiens
ttctgctctaaagacacatgcacagggacatggatgaagctgcaatccatgaatctgttcctgtgtcagtttgctgagcattctcaggaacagaaaaccaaacactgcatattctcactcataaaggagttgaacaatgagaacacatggacacagggaggggaacaatacacaccggggcctgtcaggggatggtgtgactatagaggatgttgggcagaatcttttggccttgcttctgtagccctgtgcacttctgtcaataggttttgtattgggctgtatggtccaacctataagccagtagatgacacttatgggcaatggggtgatccatggagggctcagtggtctgagctccatgctcagccccagggagacaagaaaaagatgggaggggccagacagggctggcccatctacagtttccctgatggcgggcactagtactaagggagaattctgt

SEQ ID NO: 473828 - DNA, 784 bp, Homo sapiens
ccagactcagctggtagatggaactatggctgggcgtcgcagagaagtggcttggcctcagagggacagcttgatgatgagtcgtgggtaccctgcccggatactgctgcggacctgcacggagttcactccagccggcacttcagcatccgtctggttcctgtacccgctcacctatgtgctccctcccatgaagggtggaagtcagtgggtccgagtgagtggagttcgatcctgccggcacccaagcagccagcctcttccagcactcattcactcgttcccgcactcattcgctcatgtgctcccttcagcggaggagttgagatccgttgtttcagttgtccaaggagcatccaagaagagctttctagaggttgtccttcagatgcttgccaatgcaacatttgattataacctatatgaaagagaatccacattttttagtcaggaagccaaggcttccaaaaccagccttgaagaaaaacttctctgtgagacattagataggtcctaactaaaatattgtatcatgtttactttcatccatcttttgaaacatgctatggaaaactgaaggtcctatggaaagaaatcaaaataaagaacatacttgcacaagtttccaagtgaaagcccatcaaagtttcttttggtcaattgcaactggctactattacataagagggacattttaatggcctgataagtgtgctaccatattacaaggtcagcttcacttcattgtaaaatgctttggaagactgactgatatgtgttcatc

SEQ ID NO: 473829 - DNA, 1476 bp, Homo sapiens
gaatatttagataagactttagcaaaggctctggtctacagctcccagcgtgagtgacacagaagacgggtgatttcttcatttccaactgtggtaccaggtccatctcactggggcttgccggacagtgggtgcagcccacagtgtgtgagctaaagcagggagattatatcccgcgcatggctcagagggtcccatgcccacggagcctcgctcactgctagcacagcagcctgagattgaactgcaaggcagcagcgaggctgggggagtggcatccaccattgctgaggcttgagtaggtaaacaaagtggccaggaagctctaattaggtggagcccaccacagctcaaagaggcctgcctgcctttgtagacaccacctctgggggcagggcatagctgaacaaaaggcagcagaaacttctgcagacttaaatgtccctgtctaacagctttgaagagagtagtggttctcccagcacggagtttgaaatctgagaacagacagactgcctcttcaagtgggtccctgaccactgagtagcctaactgggagacatctcccagtaggggctgactgacacctcataccgctgggtacccctctgagacgaagcttccagaggaaggatcaggcagcaacatttgctgttctgcaatatttgctgttctgcagcctccactggtgatacccaggcaagcagggtctggagtggacctccagcaaactctaacagacctgcagctgagggtcctaactgttacaaggaaaactaacaaacagaaaggtcatcaacaccaaaaccccatctgtacgtcaccattatcaaagaccaaaggtagataaaaccacaaagatggggagaaaccagagcagaaaagctgaaaattctaaaaatcagagtgcctcctctcctccaaaggagcgcagctcctcgccagcaacgggacaaagctggacggagaatgactttgacgagttgagagaagaaggcttcagacgatcgctaataatgaacttctctgagctaagggaggatgttcgaacccactgcaaagaagttaaaaaccttgaaaaaagattagatgaatggctaatgagaaaaaacagcatagagaagaccttaaatgatctgatggagctgcaaactgtgtcacaagaactacatgacgcaggcacaagcttcagtagccgattcgatcaagtggaagaaagggtatcagtgattgaagatcaaatgaatgaaatgaagctacaagagaagtttagagaaaaaagagtaaaaagaaatgaaaaaaacctccaagaaatatgggactatgtgaaaagaccaaatctacatctgattggtgtacctgaaagtgacggggagaatggaaccaaattggaaaacattcttcaggatattattcaggagaatttccccaacctagcaaggcaggccaacattcaaatttaggaaatacagagaa

SEQ ID NO: 473830 - DNA, 525 bp, Homo sapiens
ctgacaggacagcactgagttcaatgactcacaattgctgtgttctccctcctgcagtaccagagagggtctctataacacgccactgttgcagaggatgtggggggagcagtggcttcagtgattccagactgtattttctatctcttcagtgtccctttcagggatatgaggataaaaccaggtacccagaaaaatctctccctgtggccaccactgcctctggcccacagcaagtactgactggttacagtcaatgttcactcaaggccaaagggctcatcagtcagtttgtggtgaatgcttccaggcctgagtctctttcttcagggaagggtgggctcccccctgtcccaaagcaggtccagaaatgtcatccaatagccaagggatatcctaaccagaaacttataggaacactgggaaatgtagtttagcctagccaagtgacacattgcaaagccaccacaactgttttatattatttcatgtattccatattttggaattacaaacatatttata

SEQ ID NO: 473831 - DNA, 1337 bp, Homo sapiens
ccctctgcggtgaggttaatgaggaaagacttgtgctaacagcacccgaggctctggcccttcctcacagtcttctactgtcactgaaaacaatgccacatggatttgaggagtatggacgtgtgtacgtcctggcatatgacctgtcactgggcattaggtctacttccagaggtaagagcagatttctctggggcaatgtcacctgagctgagatctgaggaagaaattaactatgtgaaaatcagagaaaaaagcatatcagggatcaacatgtgccaatgcctcatggcaagaggaaacaagacctgcgtcaatatggcaactttcttggaaaaggctctggtgcaaaagtgtactcattttcttgtggtcatctgtggagaccaattcaatagcatggtaaaaccagagctggatgacctcaaagagctcttgttgtatggaattctaccaattgccttggagaaaagtgatttttttttctggtcaatgtttccaactctacaaaatgagggatattttccagaggggtattgtacaggatctgatttgtgattgaatgtgcattttgggactgagctgtcaggtttgatttcagcctagttttcatgtatagttggtgcattgagattattttcccattattgtttaatatgtgcttttatgagagtagaagtaattttcggccatcctgtcaatcatttctgcatagtttggacatacatatgagaaatatatatagagagacttgagtcatctcttccaaacagtctaacttatttacttatataaaaacctttattttgtgctctttgttggaactaaccataatttaagttaaataatgtaatgaaaatctatatagtgctaatgtcatggacataaatcattttatctgtttatacaaatgaattcattcagttttaatgccatgctcctttgtatattgcattgactgagtggtatttatctaggtagcttggaatataatgtcagctgacctaatctttttttagccttcttaagaatttaagggttttggatcatgtgaagaaattctgattaatataattattaatgaatagggaaagctttctgtttttattttataggatgatggtttaatatcactgttctgtatttattattcattcttcaaacatttattgtgtgcctgctttatataattaccctgttaggtggaaagggtgatactaagatttgtaacacaagatctctgagctccaggccgcaacaattcaactgcatgtaaaggtgtgtttataatggatactgggcttaacacctagatgatgggttgacatgtgccgcac

SEQ ID NO: 473832 - DNA, 683 bp, Homo sapiens
ccctggacccatagtgaaggcatagctcatcagcccctgtttaaaacttatccaggcgcaggaaccaccgcattgccaagtccacatgtggcctcggtcgtccagtgtcccctcaagcggggcacctgcttcagcgccttctccatgctcatgggggacccatgtactgttgctcaggtttccaccagagcccattcatgcagcatagctcaggatcctgtttgtgattccaattgtcaggttctaactaaggtccgaggagagtcgatgggccagtggcaggtagctggcaaaacactcgtggaatattttgacatggctttactctctctctgggcacagatcgagagctttaggagacagccacatgatggtgctgtagtcatcgatagagagatggagctaaatgagggcaaggaggtagtcattgatagagagatggagctaaatgagggcaaggaggaagaaaaattggcaaaaattggattaaacactgttaatgaagaaactaatgtaaggagagaagatgagttacttgttaccaggtacaccccagctgaaggaaaagactgaaagcatttattatctttcttagctgttagtgctgcattgtggaacaaataaaacaatgtgtctgaaaaccataaagtactgcaggaagataagaatttatttcaagacac

SEQ ID NO: 473833 - DNA, 741 bp, Homo sapiens
aaactgttctaacctctgcctgttacccagttccaaagtcacttccacatttttggatcctaaatctttaatctctggatatgacaatgtgatgcctaggtcctatcccctggttggtcacaaaataatggatgaagcaaacagtcacacaggaccctcagctgcaggtctgttggagtttgccggaggtccagtccagaccctctttgcctgggtatcagcagcagaggcttcagaacagcggatattggtgaacagcaaatgttgctgcctgattgttcctctggaagttttgtctcagaggagtacccagccgtactgctgtgctagcaatgagcgaggctccgtgggtgtaggaccctccgagccaggcacgggatataatctcctggtgtgccatttgctaagactgttggaaaagcacaatattaggatgggagtgacccgattttccaggtgccgtccgtcacccctttccttggctaggaaagggaattccccatccccttgtgctttccagagccttcagagagttgtcatctttttgctggcggagggtcttcccttgatgttcatggcttctgactgaccagagtgatggctgataaagattggggtggctgtggcagtttctttaaataagacaacaataaagtttgccatattgattgattcttgctttcatggaagacttctctgtagcatgcaatactgtttggtagcattttacctatagtagaa

SEQ ID NO: 473834 - DNA, 852 bp, Homo sapiens
tgtgttctcactgttcaattcccacctatgagcgttgactgggctgcactcccttcagaagtgctagaggagaatccatttccttgtctttttcagattccagagctgaattctttagttaatgatgcttttctacattttcaaacccagcagtgtaacatcttccaaattctgctttcattattacattgtcttctgccatcagtccttccacctttctcttataagtctctggttatgcatttagtgctcgcttggaaattacagaagactctcctcttctcaagaaacttaaccacatttgcaaagatttttttgtcatataaggtaatatttacagtttctaggggtcagaacctatgtatttggaggccattatttagctttcccagttttgtttgggtattagcttaacactagtctcataaaatgaatagctggaggggatggggcagagtggagattgtctgttagtaggtacattgtttcctttagtaaggaaaaaaatatactaaagtcagcgatagttgtaccatgctgtgaatatacttttaaaagcattgaattaaatattttaagtagtgagttataaggtatatgaatcatattccaataaggctattaaaaataaattaagtaggggctttgttttctttgtttctgtaacatacctacaatggacaatttcttttctgataaagcacattcaattaacggtagcaggaaatccaaagtaatgaaaagaagtgagactaggttatttttggcagccagtgggagaggtgtttatctcctcctctacccttccaaagcactctgccatacatgtatattgcagaaataaaactatat

SEQ ID NO: 473835 - DNA, 1197 bp, Homo sapiens
aagtagcaaggagcctaatgttaatccccaagatcatggggaaaatgtctccaggccatgtcagagaccttcatggcagcccttcccatcacaggcctggaggcccagcgaggaaaaagtggttccaagtgccattcccagcacaatccctgtgctgtgtgcagtctatggacttggtgccctgtgtcccaccctctccaactgtggctgaaaggggccaacatatagcttgggctatggcttcagaggttggaggccccaaaccttggcagcttccatgtggtgttgagcctgcatgtgcacagaagtcaggaattgaggtttgggaacctttgtccacatttcagaagatgtatggaaatgcctggatgctcacgcaaaagtttgctatatgggtggggccctcatggagaacctctgctagggcagtgcacaagagaaatgtggggttggagcccccacatatagtccctcagtgggacactgcctactggagctgtgagaagagggccactatcctccataccccagaatgggagatccactgacagcgtgaagtgtgagcttggaaaaacctcagacactcaatgccagcccatgaaaacagtcaggagggaggctctaccctgcaaagccacaggggcagagctgcccaagaccatatgaacccaccttttgcatcagcatgacctggacgtaagacttggagtcaaaggaaatcattttggagctctaaaatttgacttgactgctccgctggatttcacacttgcatgggccctgtaaccgctttgttttggccaatttatcccatttggaacagctgtatttacccagtacctatacccccattgtagctaggaagtaagtagatagcttttgattttccaggctcatatgcagaaaggactcgccttgtgccttctgtggatttttgggttaatgctgaaatgagttaaaactctgagagcctgttgggaaggcgtgattggttttgaaatgtgaggacatgagatatggaggggccacgggtggaatgatatgggttggctctgtccctacccaaatatcaacttgaattgtgtctcccacaaaacccacatgtggtggcagggacccacggggaggtgatagaatcatggggggccagactctcccgtgctctctcatgatagtgaataaatctcatgagatatg

SEQ ID NO: 473836 - DNA, 605 bp, Homo sapiens
ggagcccaggcagaggaggcaccgagagcgagctagggctatgccagcagtgtcctccacttataaccacccaaaatgtctccagatagcgccaaaggcctgtggggagcaaaataatcaccggaatccatctgtggccactctttacgaaatatgcccaccccaatgtagcagaaacctatcatgccctgcttcccaccccctaagcccacgtctgacttcagccgaagctgaagtggaccttttgtgccctcaaccttgctttgtgcttgcagcatcctgccccaagcttgcacctcctcctccttctttctgtgtcagtgctgtctccctgactgtgtgtggacctctcatcctgctaggagttaatggccctggggtctggatggatgaagaattggagtcttctccaaaaccatatctcaagatcatccctagtaaatgaaacttaaaatcaggtgttttggatttccaagtcaatgcctttttcactccttaatacttgctttccctgagtaatgaaacagaattttcaacattagccatcaaataaaacttgataaatttagtaggggctggatttctcttatgaaaccatttttcct

SEQ ID NO: 473837 - DNA, 587 bp, Homo sapiens
ctatagtgttggctggggtgattgacccaggctatcaagatgaaatcagtctactactccacaatggagaaaagtagaaaaaacactgaagcacaaatatttggttacaaagattccctcaagaaacttcagaatgagttcccagttaggggagaagaaaaagtccgagagagagtaatgagaacagaaatattggtgggtagcagacagatgagctctgtgcactatgacttaggtcaaagctttagggagagagtaaaaatcccaaatagttttatgggacctgagagcagaaaggacctgaggctgttcctagggaggagatatggccctcttctcacctttgtcctctatgcagatgtaatggctgaaggccaagcagccatctttggtctacgaggtagaaagcatacgttgagaatgatgaacaaatctggatctttgatgaattcatgaagctgccttatgcatacttgaagaacctatctctgacctttaatgtgagaaagagagaaataaacttcctaagctacaattaacattcaacttatatagcaactgctccagcatataaacctgttccaacc

SEQ ID NO: 473838 - DNA, 893 bp, Homo sapiens
aaccaaagccaaagccatgtacccaacttacattatagatacatcaacaggaaaaaatatttctctatggaagctactttataaaattgggaaaagtgacagttataccagctgtggaaatatcaatagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggttccaatcctcgaggattaactcctcctgtaaaagatgaagaatgtaccatttgtgtgaaaaagttccaaggtggaatgaaccagaccccacacttgtcccattgttaccctgatgcttctgagctccccttcttactcaccatggggattgctttaagagtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaa

SEQ ID NO: 473839 - DNA, 730 bp, Homo sapiens
ttgcgaagaccatgggaaaagcgtggtatatgggccagaatgcactgttcctcacagcacacgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcgcattgtgcacatgtaccctaaaacttaaagtataataataataaataaaataaaataaaataaagaaaataaaaagactcaggtcttcctagtttataattaattaatggttt

SEQ ID NO: 473840 - DNA, 1015 bp, Homo sapiens
tcttcttgaaatggttcaccattttagaagccgtgaatgttcttcaaaattaacaggagtttggaagaaatttatttcaaccctcatggatgactttgaggggttcaagacttcagtggaggaaggaattggagatgcagtggaaatagtaagagaacaggaatttgaagtggagcctgaagatgtgactgaattgctgcaatctcatgctcaaacatgggcaggtgaagagttgcttcttatggataaacaaagaaagtggtttcttgagatggtatgtgcttctggtgaagatgctctgaacactgttgaaatgcccaagaatttagaatttcacattaacctagttgataaaacagaggcaggatttgagaggattgactccaattttaaaggttctaccatgggtaaaatgctatcaaatagcatgacacgctacagagaaatcttgcgaaaggaggaatcagtctatgcagcaaactttactgttgtcttattttcagaaattgccacaatcacctcagccttagcaaccaccaccctcataagtcagcagccatcaaacattgaggcaagacccaccaccagcaaaaagattacaacttgctgaaggctcagatgatcattggcattttttagcaatacaacatctttaaagtaagatatgtacttttattttagacatacgctattgcacgcttaatagactatggaacaatgtaaatataacttttgtatgcactgagaagccaacatatttgtgactctgtttattgtaatatttgttttattgtagtggtatggaaccaaacctgaaatatatgcaaggtgtgcctgtaatctgccttccagcttctttaagactctttggtccaaggaagttgtgttaaaaaaaaaaattcctatggttaaccttctttcttgttattttgttatttgcttctctccccaatagatttcaggctatttagattttgggttcctctctcaagcatgattaacttaggatgattaa

SEQ ID NO: 473841 - DNA, 1711 bp, Homo sapiens
caccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacatctctgaagaggcaaagacactcacaatggacatattgacattggctcacacctccacagaagctaagggcctgtcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcctccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactaacacaaaaccacacatcactgaggtcacagcctctgccgagaccctgtccacagccggcaccacagagtcagctgcacctgatgccacgattgggaccccactccccaccaacagcaccatagaaagagaagtgacagcacccggggccacgaccctcagtggagctctggccacagggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagccccttggaagccgccctcaagaacttcaccccttcagagacactgaccacggacatcgcaaccaaggggcccttccccaccagcagggcccctcttccttctgtccctccgactacaaccaacagcagctgaaggacgaacagcatcttagccaagaccacaacctcagcgaagaccacgatgaagcccccaacagccacgcccaccactgctcggacgaggccgaccacagacatgagtgcagatctaagggtggggtggtggcatgtttcttgagttggttcctggaaagggagctgaaatggtttaatcgctcttccatgaaac

SEQ ID NO: 473842 - DNA, 494 bp, Homo sapiens
tgcagaaccccagaccacagggccaaaaggaccttgtagatcatgttgatggaggcccagagagggcagataacttgtacgttcacacagctcctggctctgagatgttgtgattccctgatgcggatccagcaggctttcttctacccaagagctgccttcatcagcgctcctgccctgaaattcccaagctaccttgtctggtcactggccagtggccataacagttcacgtccgtggcacatggagggaccccgtgccttcggtctggccaatgttcctggctttgactgggatgcagaatcacaggatgatgaagatggaaggatgttagcaattagagttgtcccatactggggagccgtctcttctccccaacgcttgaggatcagaatggatgtcggggttctcgctcatttactgagcacctaagatgtatatatttttgataagcatcagctgtgtagcaggcactgtgtaagagctttactgtc

SEQ ID NO: 473843 - DNA, 683 bp, Homo sapiens
accccttcgcagtctgctcgcaatccgtgctgaagtctaaaataggaaagaacttttcacaagatggcactcaaggcgaagaaggaagctcctgcccctcctcaagccaaagccaaagtgaagactttaagggccaagaaggcagtgctgaaaggtgtccacaggacaaagcctccatcgcacctgcccattccccagagaccagtcatccacatctggtggcccaagacactgcgacaccacaggataaaagaatataaaggggccattggtgctgctggagaagctgccatgctccaggggaagacctcaaggatatgtcagtgcctggagcccggcctgaccctggctgacttccggtgctggatttcaggggcagtttatgccaagcatttggatgcagcaacagtcttcttgggaggtggtggtggccacgaaaagcttcctaaactgccccacccccaattctctgtctatcatcgggcctgcttcagctccctagcaacagattcgctgattcgattgtaacttctctgggcatgaaagccaggaccctgtgcatttcagtaactgtacctctactctcctaatcaccagtggaaaagaggggtggcgaagagaacaacactggcaccaagctacagcctaatagacagtctgtttttgttcctggctggactgcc

SEQ ID NO: 473844 - DNA, 676 bp, Homo sapiens
actactagtttacaggaaatgccaaggacagggaacgtgttaaatgatactgctgaatgcagtcgccaaaactcagatgaacaaggtgtggtgtatataaatgactatgttatccatgtcccgatttaggaaaggagatattgcagaaattgaagtctgttaccttaaatgccaaggggattcggcatttctgtcctccccctggcttattctgaaatcgagcaccggcagccactcagctttcactatctccacggttttaccttctgcagaatatcatatggttgactcgtacagctccccatcaccttccaccatgagtggaaacaccatgaggccctcaccagaagctgagcggtttctagaaccgggcttcttgtacagcctgcagaaccaagggaaaaatgagtctcttttctttataaatcaccagcctcaggtattcgtttatagcaacacaaatggacaaagacaccagggtcccatacttctgcctaacgtggctacaaagttgaaggttcccacacgctatcccgcaggaacactcagcaagtacctggtagatgaaatccaatgtaaattctctgattaacttaggctcttatctacatctctgttgcctctctgttttttgcatatatatatatatatatatatatatatatatatatatata

SEQ ID NO: 473845 - DNA, 814 bp, Homo sapiens
gggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtgggcaagatctggagcaagagcgaggcgggccgtcagggcaccaagatgaagctgacggtgagtgcgcagggtatccgcatggtgcacgccgaggagcgcgcgctgcgccgcccgggccacctctacctgctgcaccgcgtcacctactgcgtggccgacgcgcggctgcccaaggtcttcgcctgggtgtaccggcacgagctgaagcacaaggccgtgatgctgcgctgccacgccgtgctggtgtccaagcccgaaaaggcgcaggccatggccctgctgctctaccagacgtcggccaacgcgctggcggaatttaaacgcctcaagcggcgggacgacgcgcgtcaccagccgcaggagctgggggcgaacacaccatcccgctaggtccaaggatgtgttcaatcctacacggaccctgtttctatattccggcggtggggcgcagccttagcgcgcacaagcttgtc

SEQ ID NO: 473846 - DNA, 3634 bp, Homo sapiens
gtgggctctgtttaaacctgaaagctcgattcgccccaagccaatggaatccagtgtcttttcaaagcctcctgaaggattcgaatgcgctcccagggctgagaactaaggaccctgcgcaggccgcgctgggcagctgtccatcagcacccctgtgcacacagagagcaggcagcagaccagcgccctggacggctgcttttaaaagcagggcttggtccttgaattcataaagtggtcactgagttgcatcatcgggggggtggcgggtggcgggaagagggtcagcagtgccaggagcaggtagcaccgttttgcagcatcacctccggtatctctgggtaaggtccgcattgcctgagccccttgtcagagcacctccaacgtatgggcagtggctatgtcatcagtgccctgaaggataaaatgtcaccttgtgagagcgttgtcatggcctgcagggagcagttatcgaagaatcaggtcaagtgggggtttgctggcattacctgtgtttctgtagtggtcattgccgcgatagtccttgccatcgccttgcggtggccaggctgtgagctggaggcctgcagctccgaggccgacatgctggattacctgctgagcctgggccagatcagctgccgagatgccctggaggtcacctggtaccacgcagccaacagcaagaaagccgtgacagctgccctgaacagcaacatcacagtcctggaggctgacgtcaatgtagaagggctcggcacagctgacgagacaggagctcccatcgtggcacaccctccggctatctacagtgatgacacactggagcagtggctggatggtgtgctgggctcttcccagaagggcatcaaactggacttcaagaacatcaaggccctgacagagtggggcaaagtccggcggcccatgtggatcaacgctgacatcttaaagggccccgacatgcccatctcagctgaggtcagtgccacacagttcctggccctggtccaggagaagtatcccaaggccaccctgtctccaggctggaccaccctgtacgtgcccatgttcccaaacaggacgtacacccgagccatggtggagaagatgcacgagctggtgggagtggtgctccagagggtcaccttccctgtgcggtcttccacagtgcgggccgcccaggcccactccagctggctgctgagccaatctgagaggtacagcctgacgctatggcaggctgcctcggaccccatgttggcagaggatctgccctacgtccaggataacactgctgtccaccacgtctactgtgatatctttgagcctttcctgttgcagttcaagcaggtggcctctacttggcagggtgccatgaggcttagagaggatggctgtagagctgtggcctacagaaggtgtttcatgaatagcagccacctcaccttggcgatttggggccccacagtgaatgccacatggaaacaaatgtactacacgggaggcagcctgatccctcttctccagctgttcgagggtgatggtcttctcaatgctgccccagggtggcagcatcctgaggttggagtcctgcctgcagcagctggccgcacatcccagacactggagcgtccatttgcaaatagtggagcccgcagccctctggccgtccctggccttgctggcatccctgtccagccttggcttcttgcatcggcctgtgtggatggggccaacatctcccacgggagcttttcagtcctcggccacatggctggcagagagctgcttacagctgtggctgaggtcttcccccatgtgactgtggcaccaggctggactcaggaggtgctgggcagtggctacagggaacagctgctcacagatatgctagagctgtgccaggggctcagcttccagatgcaggccaggccacggggccacagcacgcctggagctgttgccaggctgctggcatcctcccctggggctactgtcacagtggagcacagcccagctgggggcaactatgcctgtgagaggacagcgctgctgggagccagggctgtagacagaacccgaatctactacacgctgccccaggggtaccacaaggacttgctggccgatgtttgcagaaactgagcacccaggggtggtgggccagcagaccccagggtggagtcttcccatggggaggcaggaagaaataaagacctttgcctttctccaggcaaaacaaaacaaaaaagaaaggtttgaaaccctggtctggatatctagcttattgtgtgtggtcaatagaagatttttaataaatgaaaaatgttttactcaccttttcactgctttgctagaaaagacaacttggagtttccaagagaacagtctgtgccctggctatatttcagaaatgttcattctattcagtccagctgcagggaaaaggattgttgctggaagaaagggcctactttacacagctgtatctagggaaggctgagggttgctccccatggccctctggttctccccctgactgttttatggtcaggcccatgtgcagctgctgggatccctaatgatgcctgatatatggggagcttaagtggctacatttaaggcttagatattagcaggggactcttgcactgtctgaagacgagcagttgatgtattccgtgtgctgtagtctgccagcccattagaatttaattaggcacattctttcctgacagccttatggtgctcaggagcaagatgcttttggctttgtggctgcatttggaactcattctttctcctttttttctggaagctctcagcatctcctctgccttcagagaacctgtggtggtgtgtatcagaatcactcctggagattttgagtcagttggtctgggacagctatcttccttttaataatcctccacaggtgactctgaattgctctgaggcctgagacatgctgacctctgtaggttaatgatcctcaagccaacacctccactccagacctcccgagcttcagacatacgcaaccttctgtcttttgggcagctccacctggaatgtctacgaggcgcctcaagctccaagtagatgtcctataagttttggagtccctcacctgctctgtattcagttcattctatttatttattctttcttccaaaatatctcttcattctctcacctcctaaggaaaattctgccttttgtaaacaaggtctagttgtcactggatggagaagctgtttctctgattcacctgatttcccttttacttgagaatttctccctaaccattgctcccatctcgtaaataacttataataacttcggtaggggcctgtgatttcccccgcatgcatgcatgcttcttcccttagtttcctctagtacagctgagacaaggctggaaaacctgactggatttgtcccactggagactcagtgacaggtgaagggagatcaacacagggtgtactgtgacccaggatacctggcattcagcacctttccctttgaagcctgaagggcctgcctcacctgaactccccctagcatccctatggcaagtactatcttggcacttgccaagttgagtgtgtgcccagaacaggtcttt

SEQ ID NO: 473847 - DNA, 1695 bp, Homo sapiens
gaagagttcaccataatgcttaggtttccccggcacgctccgctcttctctcaaaaaccagaaaggcgccagatagagccattcccaggtttcctggtcagtttcctggtgctgagtgtcctttggcattttcccgcccagagtgggagtcaccaggcagtctccatccagtgtggcaccttcacctcgcaggtccccagagcactgccatcttcacacaatgctccacagttgggatcaaattacacgtggcctgtgattgtcagaggtaaaagacagagcagatttaagggttgctgctgcttccctactggaaggtgccagatgggtgccagtgacatgctgatgtcctggacagatgtgattccacccccacacagttcaatcacccgatatgagctgtgtgaccttgggtggaaaccagatgcccagaatgagaagggactcacctgggtcacggatgagtttgtggttgtgagaatattaactgccaggctcagctgggttaaatggtgtcctcggaattacccggtacctgtgaatgtagccttatttggacatagggtctttgcagatgtcattaacaagtcaaggtcgtactggattactgtaggctctgaatttaatgactggtgtccttgtaagaaggccacgtgaagacagacacactgaaggtagaaggctgtgtgacaacagaggcaaagactgcagtgatgcagccgcaagccaaggaatgcagggaaccaacgatcaccagcagcagtgagaggcaagggagggttcctccttagagccttcccagggagcagggcccggccacaactccagacttctggcctctagaagtgtgagagaaggaatttctcttgttttaagccacgcagtttgtgtactttgttacgagaaccctgggaaccgaatacacaggccaaggccctctctgctgtttcctggagcagcagtgacagggatgcgactcacctcatggagtgccacgctgagcctgagctaagcagctgacatacatcatctcaagtaatcctcctgagaagcgcaggaaacgattattattatcccacagcagctcccaaggcagggtgcttttttcaaactgtaattttgaatagtaatatagtcatatatttatattttataaaaatatgaaagctcccaaagggtgagacacacagtgaaaggtctctctcactccaccccatcccctgctagccggttccctcctctgggggagccattgtcaccagagtcttgcagagtcttccagagctgttccataagcaaacctgcaaataagctaaaatatcctcccgcttccaaacacacaacttttgaaaacacaaatgtgatatatactatacagacggttcctcgactcattttcactgttggtgtgtcttggagcttctgtcctcgtctcagcaacactggacttagatgggcatcctgacttcttgaaatgctcctttctggagccaccccctccttgctttcctttcaccctatcagttgctcctctgtaggaccctgggctgataccccctcccctcccctcccctcctctcccttcccctcccctcctctcccttcccctcccctcccctttccttcccctccctcagtgttggcaagccctgggcttaccttgctttctcctcacctctccctgtactctttctc

SEQ ID NO: 473848 - DNA, 594 bp, Homo sapiens
aaatgcattcttaggagagtgaacgggggtgagaaaaggggcctggcgagtgcagccaatgtggtcggaaagttttactgtgaagaggacagagccagcagaagctggtcagagatgggagaggatggggaactgtgtgttacaggaatgaccaagaccggagacagggagagagtggagctgaaacctagagtgggtgaggagaggggagagggcttcgagtgggaggcagagagtgatgacatcagcttattgcatgtgaatgcccagagaacaagccacacacttcgtcagaggacccccagatgccagtctctcaaggccacagaggtggctcccagccatttgatccagaaattctgtcatcccatgtgtctgtgtcatggtctggaagaggctgcaggggctgctgctggcatggcccctgaccctgtggatttccccacctggagctggagtaaggcctacactggggccatctgaagtgcagggttgaggcagagacttggactgcccagctgtatgggagattctgcacctaacgttcagttgactggaagactaggaacaactcactttccgtgtttattctgc

SEQ ID NO: 473849 - DNA, 694 bp, Homo sapiens
caggagaccaggtgggccccatgccctgggctcctgtgaattccagagcagctgagcatttagacaggaatcctcaggagaaggctggagccccccagcctccagctgcatcagggcaggacagcagggcgacaggcccagtggggtctgaagccttgaggggtgccctcgtcactgctgtcattgtgaaggctgctgtcattgtgaaggctgctgtcatgaagaaggtggagccgactggagggaaggtggtcactctccctgcaaatgcattcatctccttcactagttccagagctcttcaggtcgggctgtggaacaagggctctttacagacaatgcaggccatctttttggtatctgtggggacggtcctcactgccaccatccccctgcataccaccatccagaagtccctaaacagagctcctccatgtggttgtctgctaactgcagggctgggttgcatggtcacccttgcatgaaggcgcagctgggaaggcgagcattttccacttttcaggctccaccatggaaggactctgtaccaccgtagacaagacattcttttgcttctgtgtgtttaaactatttctctgtacaacagtaaatcattcttacccaggttgtgtctaggttggagtgctttggtgcctgcaggggttgctttgacaactagaatatttgttgggga

SEQ ID NO: 473850 - DNA, 2752 bp, Homo sapiens
ttctctggaggagaggtgccaagccaggtcccgtcatccccagaagggcctgagaggctccggctggggcggctgccctggcatctgccccagggggcatgggctcagccccagcagccagcactccattctggtcactgagccatgtaacatcctccccaaaccccaccatgagggacagccagctggcagctcagctaaagggacatgcaggctggagagcaaacaccgtggccgggactggctcgggccctggcttctcagcccaccctctcatgggattcttgaagcagcctcctcactccactgtctccctacccccaccctgctgtcctcagaagccccagaagcccacgctcctgcagccagagggaccatccaaagcttccatgagatcttctctcctctgcttcaacccccgccccccaccgtggctccccatctcctcaggcagtgatgctcagcacccccatgatgaaacagcatcacctgtgagctttaaaaagacacccatgctcaagctccacccagaccccaaaatcagaatgcagcggggggcggggggttggggtacagggaggcaggcatgaacaactttttaaagctgccaggtaattcaaatatgcagctcagtttcagagccatgggtttaaagagtaagggtggggaggggaatctccttagagtggaatgctggtgaggaaattctggtgcccaggatttagcagaaaaaaatgtgctgccctcccatgcaagtccgccagcattggcgcccccctccccagcctttgtgccttagctctccttcctatgtgtaccgcttcctctgcgtggaaacaccatatgaatgcaatcgatatttttcttacatgggcaaggatatctagggattccctggaatgtccaaggacagatgtgcagagacgggaatgatgatctaacagagcccctgtggagacctgccatgttaagcactcactgtgtgcagggcccgggatgagaactttaagtgcactgttttgtcaattcccaagaccaccctgggagcttcatcttacaggactgatcagagcctttaatgcactgaggagcactgagaatccccaagaaggggatccagtgtgaatggagtgtttcttaaacatttgcccaagaaacttttttgaccacagagtagaccccagtgtctcgttcccttctttgcgtccatgtgttctcatcatttagctcccacttgtgagaacatggggtatttggttttctgttcctgcatgagtttgttaaggataatggcctccagctccatccatgtttcctcaaaagacatgtctccttctgtttttttttggctgcatagtattccatggtgtgtatgtaccacgttttctttatccaatctgtcactgatgggcatttaggctggttctatgtctttgctatttatctgttcttttttgactttttaataatagtcattctgactggtacgatttgcatttctctaatgatcagtgatgttgagctttttttcaagtgctgtttggccccgtgtatgtcttcttttgaaaagtgtctgttcatgtcctttgccacttttttgtttgtgtttttcttataaattcgtttaagttccttatagatgctggatattagacctttgtcagatgcatagtttgcaaacattttctttcattctgtaaactgtttactctgttgatagtttcttttgctgtgcagaagctcttaaatttaactagatcccttttgtcaatttttgttttgttgcgattgcttttggcatcttcgccatgaaatctttgcctgttcctatgtccaggatggtattgcctcggttgtcttctagggtttttatagttttgggttttatatttaagtcgttagtccatcttgagctgatttttgtatgtgatgtaagggaggggtctattttcagtcttctgcatatggctagccagttatcccagtaccatttattgaatagggagttcttttcccattgcttgtttttgtcagctttgctgaagatcagatggttgtaaatgtgtggccatatttctgggctctctgttctattccattggtctgtgtctgttttcgtgccagtagtatgctgttttggtgaagtatagtttgtagtatagacgtgtagtatagtttgaagttgggtaatgtgatgtctccagctttgttctttttgcttaggattgccttggctattcgggctctttttttggttccatatgaattttaaaatacttttttctagttctgtgaagaatgttgttggtagtttgataagaatagcattgaatctataaattgctttgggcagtatggccattttaatgacattggttcttcttattcatgaacataaaatgtgtttccatttgtttgtgtcatctctgatttctttgagcagtgttttgtaattgatttctttgagcagtgttttgtaattctcattgtagagatctttcacctctctggttggctatattcctaggtaaggttgtcaatcttcctttttaaaaatgtcggctgcaattttaagaaatgatattgtgttttgcttcctagggctccttttattaatccccctcccttctcagggttttagcccaaccatgagtgtgtgattcgatctggaaactgtccagagcacaaatcaaaccaagagggctcttcctgggctccagcgtttccaccgagccatgttttcgcgtcggct

SEQ ID NO: 473851 - DNA, 501 bp, Homo sapiens
ccagtttttgagcctcagcttcctcatctgcacaatgggtatatgaaccaggagtccctcagtcttcaggctctggcctcactgactgcacagcctctgggccgggtgcttcctctgggaggaggcccagatgctggcccttcagtgactgctctcaaggctgaaggacgccccagagttgaaattatttctaaaggggtgaaaaaggcttatcccctctaccgtgggtctccaggtgactatgaagttcctcgcacgagctccaatactgtccacaccccgtaccattccttctaccccgaggctgatgcgattcctctacgagaaccagcagacacagaagccagagaaacccaccattcccttagacacagaagatttgggagcgttcctgccgaggttggagtaaagccgtttaaaaagacacctgagcctctccgggttcctgctcctcactcaaccccacagtagatctggtggggaggttgagggctcagtgaa

SEQ ID NO: 473852 - DNA, 2530 bp, Homo sapiens
gggcctcgcacccggcgctccgccgccgccgccgcccagctgcgccggggcgccctccggagatgctgccgtggaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctgggcaatgccaccaccatccaggcgcgcggcgacggctgcaccgaccttgctgtgggcaagatctggagcaagagcgaggcgggccgtcagggcaccaagatgaagctgacggtgagtgcgcagggtatccgcatggtgcacgccgaggagcgcgcgctgcgccgcccgggccacctctacctgctgcaccgcgtcacctactgcgtggccgacgcgcggctgcccaaggtcttcgcctgggtgtaccggcacgagctgaagcacaaggccgtgatgctgcgctgccacgccgtgctggtgtccaagcccgaaaaggcgcaggccatggccctgctgctctaccagacgtcggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggttggctgaagttcctagtctcaggccgtaggtgcctggccagtttcctgtttgtggggcagctggggcctgaggaggaggggttcacttcctcctcccaccccctgggagcggccctgcgctgtcactgacatctcattaaaaaaaaaaaaaaatttgctctcaaggtgtttgaggctttaatgcaaccctttagcccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaacagaacagagctctgactgatgtaattctagaagagatgtgaaggtgacacgtgattcacctcttctgacttctcagtcttccagggatgatatcactagagtaagaagagatgttttgaatgaaaataaaagaaagaccctaaaactactttgctcctggagctcagagggaaaagaatggagcgacaaaagcaaagctaagtcattagataaaatacaccttccagaaaacacctgaagtctggtttactcatcaaattt

SEQ ID NO: 473853 - DNA, 915 bp, Homo sapiens
tctgagcacccctctaaatgaccagtgcagctcttgtaccacaaagacacaaacatgaggaatggatggacgctatcttgatggctacatgcaccatcaccaagctactatgtatgcagacaagatcagacctccttacaaattatatcttgttttcttgcagtgcctttaaagagaaacgatggcttcagcagttagaaatagcaagagtcctggccaaaaagagcatttctaacttgactacccgaggaggtttctgccgaatatggattcccaggtatggcgaaatagccagaccgttatatacactaattaaggaaactcagaaagccaatacccgtttggtaagatggacacctgaagcagaagtggctttccaggcactaaagaaggccctaacccaatccccaatgttaagcttgccaacggggcaagacttttctttatatgtcacagaaaaaacaggaatagctctaggagtccttacacaggaagccattaagagattatcattggctgtacagaaacctaaagaggtgacagtcttacactgccagggtcatcagaaagaaaaggaaagggaaacagaatggaaccaccaagcggatattgaagccaaaagagctgcaaggcaggaccctccattaaaaatgcttatagaaggacccctagtatgggatgtgaaggacaaagtagacacagagaagtgaattgaaaaactcttccaatttttagtctgctagggagactcagaatatagagttgtctcaagccttagatagaaaagacagatatgaagagtcttcttcccttcccctctcttcctccacaccctccattttcaaggggttaagatttgaagaatcatattcctatcaattagcaactttatcatctctgatatttgaaccacag

SEQ ID NO: 473854 - DNA, 979 bp, Homo sapiens
caattaatcaacaataagcacagttcccagctatgcttcctgtgctccataagagacgtataaaaatgtgtccttcatcccttataaatacatgtagatttgagtactcccctgaaggcaaagggaatactggccagtgggctgtggagaagtttgctgctgccactggagccactcctgttgctgatggctctatttctggaacctttactatccaaatccaggcagccttctgggagccatgtcttctggtgcttactgatcccagagctgaccaccagcccctcacagaagcatgttatgttaacatacctaccattgctctgtgtaacacagattcttctctgcactgtgtggacattgccatccaagcaacaacaagggaactcattgagtgggaagggcagtctgcttctgagaaagctgtaaccaaggaggaatttcagggtgaaaggactgctccagctcctgagtttactgctcctcaacctgaggttgcagtctggtttgaaggcatgcagatgccttctgtgcctattcagcagttccctattgaagaccataacacagcctaccatggaaaattggtctgcagctgccactgcttaggccactgaatgggtagaaacaaccactgaatgtcttaagccatttttctacagacttttaaacaagatggaaatcaggttgatgaaaaataaacatcagttcctaaaactaaacaaaacaataattgtttttgaaaaaggaatgtatttttaggtgggaatgggatgggggaagcaatatggacttccttttttgatggttttttgttgttgttgttgcttcttcactttctcatttcttcatatttttttcttgcctctgtaaaatattgttaaaaccatggatcaaaatatacattgttaaatgtgtctttttgccttaaaatcctttttacacttataaaagaatatatgtttcttatataattctt

SEQ ID NO: 473855 - DNA, 825 bp, Homo sapiens
cggccatcttggctcctcccctgaaaatctctctctttgcctgctgccatacatgtaacacgtgacttgctcctccttgccttctgccatgattgtgaggcttccccagccacatggaactggctcagaagaagacaggaaaatgtgggacagtttggaacttcctagagacttgtcgaatggctttgaccaaaatgctcataacgatatggacaatgaaatccaggctgaagtggtctcagatggagatgaggaacttgttgggaaccagagcaaaggtgactcttgttacgttttatcaaagagactggtggcattttgcccctgccctagagatttatggaactttgaacttgagaaagatgatttagggcatctggtggaagaaaattctaagcagcaaagcattcaagaggtgacttgggtgcagttaaaggcattcagttttataagggaagcagagcataaaagtttgaaaaatgtgcagcctgacaatgtgatagaaaagaaaatcccattttctgaaaagaaatccaagccggctgcagaaatttgcataagtaatgaggagccaaatgttaatctccaagacaatggggaaaatgtcttcaggccatgtcagaggtcttcatggcagcctctcctgttacaggcctggaagcctaggaggaaaaagtggtttcatggggtgggcccagggtcctcatgctgtgtgcagcctagggactttgtgccctgcatcccagctgctctagtgatggctgaaaggggccaaggtagagcctgtttaacctgttttgatttggagaagcacagaaaatgagg

SEQ ID NO: 473856 - DNA, 613 bp, Homo sapiens
aagcatttcctgtaacagcctaaggatgagaaggctccctgatattgatagttctcattggtttctcttaatccctacatctgtgtgtgtggtccagaccagtcctgctgtcccagctttcaatgttatggccaccaaatgggtgtgtggccctcctgttcctgtagtcagtggagactggggagtaatttctgcttccaccttggctggcacaggagtcctctcatcttcagccactgtggctgctgctcttgcggatattacatgtgcctatgagcccgtcattgtcattatttcccattctggtgagctgaacacatcctctgtggcaggtggttccatagaagcatcactcagaactgaaacaactcctgagcccatggctatccctgggtcctggtggagtggaaactcaacaatgcctagagctacatctagtgtcaatgagctacagtcctgcagctgtgctggtaaagctggaactgaaatgtccttgagactacagatccaaacagttgaccttacaaagtgaaaaggacaataccccatctgggtgacactcaggtgcagcagtacagggtcccacagtaaggttgtgtggatctaatgtatt

SEQ ID NO: 473857 - DNA, 488 bp, Homo sapiens
aaaatgtataaaaccaaactgtgctctgaccccctagggcacatgtgggaccaagtgttttgtcaagcatttcttgagactgatctgtgggaaatttgccaaaaaaaaagtggctcaaatgttttgcagaaagctgcacttcttggaggggtggggagtgaggttggaggtgatggtgaagtccacagtgacagcctttggaagccagaccccttgatccaagctcaaccagtggatgctgccatggaggactttgactcttggaagagtgatgcaaagagttggggcagtcagaccagtcaaggcagaggtgcagcgagaggatgcaacagcaatgaagacctaagtagcttgttctggtggctggtcctgggctatctggctattaaatgcacacctataactaccacatcataaattatttggtagcttacacttcagtgtaattcgtttcccttgtaaccccatgcatttccttttctgcattt

SEQ ID NO: 473858 - DNA, 782 bp, Homo sapiens
tcacccgtcttctgcgtcgcttatgctgggaactgtagactggagctgttcctattcgctcatcttggaactgcccaacactccatccttatctataacccagcattcttctataccccatagaaagcaccccttacactcggacatgcacaggaaggaagctgctaattggagggaagactcactcacactgtccccaggctccactccaaaggtggccagtgcagctctttcacctccattacctccaagtggtgctgtcactcacagtcgtgaggatgaagtcttcacctatgggatcagtgcccttacagaaagacccaaaggagcttgtttgccccttccgccatatgaggatacacaaaaaccgccatttatgaggaacagagctgtcaggtttcagagcagcgtgtcagtgccaccccatgcctgcatccgggaagatcactcctccactggaccagcccagcctggaaaggggccagtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtttgtcaaaggtcagatggttgt

SEQ ID NO: 473859 - DNA, 560 bp, Homo sapiens
tcacccttccccatgagtaaaagcttcctgagaccctcaccagaggcacatgccagcagtgtgattcttgtacagcctgaaaaactaaatatgtacagtaaaggccagcctgatgaggtctcagatggaaatgaggaagttatggggaactggagcaaagatcacccttgttatgccctagcaaagaacttggctgcattgtatctatgtcctagggctttgtggaaggctgaacttaagagtaatgacttagggtatctggtagaagaaatgtctaagcagcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtagatctggtgttggaagtgcagtttgaagtaaaactctggtgacctacaggaacaccaggtgaccaggccagttgtgctcactgatcttttgattgtaactggaggttgt

SEQ ID NO: 473860 - DNA, 1447 bp, Homo sapiens
gatgctgtttcagcgctgcttcgcgattcgaagagcgctgggaatggctctggcgccagctagtggtaggagaggggagccgccctgtcgctctcaaatctgggaaggcgtcggtcttctcgcgtccccttatccctcatcctcctccttttttttttccatcagcataatgggggaatcattgcagtgtggccagagaggagcagacgagattatagatgaaagtagagaaaaacggtggggaacaaagagcttgagagatttataccccagcccaagatccacagtcattaaatggcagggctctagttcaaatccaggtggcgcccaggtctactgccgcgtctcgtctccgctgggcgcaaatcttggaacagctgtggatgttcgaggagtggttggagagatcaatatgatccatgtggagcagcttccctaccgtctgctccaaaaggcttttagcttaggaactcagagccagccaaatgcttactgcagctgcttgttggctggttcaaaggattttggaaaaggaacttcaaacgaaattggtaagggaggcaaatgcgtaagtggaaactttgaggaaactggcaatgagagactggaaatcaggcagtcatttacgttttacttcaccaccctttgcttatgtgagtacaaagcagggagctggcaaggctgtgagtcagaactctcctctcaggaactgagcagagagattcccagcatctgtttcctcaactatcacccagaggatactggtggtaaatcacagggaataaaaatagcctcagaaagagccagctgcgggaggatgaattatggtgtagacttgaaaagttatccgacccacggcccgtgggctgcatgcggccaggatggctttgaatgtgacccaacacagcctgctgagccttctgtgttttggggaaggtttgtattctttcttcctcgggattatggccctgagaaagtgtcttctagttctcatcaggaccaggatcgaggaccagccctgggtcaaaaacatgggatgtgggtgagcacacagtggggcactgggcagtacggactgagtcaccagacagtacctgagccatagagggctgctgctggggaggaagcagacagaggtgcaatggaggtgaatgtgccacgctagagtcaagcgccttcatcaagatttaaggagagggggagtgaaggactggagtagaaaccacaggtacagacatggagaagtaattttggacaaattgaaaataaaagtagtccaataatttaggatcaacagtgtaagcaccttgaattcatggcaagtaagacttggtgcatagtaaaattaagttttcttctgtgcctctcagactaatatcagacattgttgccaaaatgaatttccaactcaatccaaataaatggcagtggtgatagtaaagttgtc

SEQ ID NO: 473861 - DNA, 1126 bp, Homo sapiens
ggccggaggcacatacacttgccggtagtaaaactctaccttgtgattcactgatttctccagcagccatgcttcctgcagcattgaggcttggtcatatcacagtgctcagaggggaggttcagccatttctgccttgtgccactggacagatgattcctgcatttggtgagtttggcaaaagcaaacagtgctttaggcctaagggtaacttttacatttcaattggaaagaaagctgcagctttggcctgtgaaattgaccatggagaagaaaaggcttatttctggagcggcagtaggacccaaagtgagagttacggggagacaaggagatataaaccatcaattcatacatgtaagatgtaccttggtttggtccagaaacgtgggataactggaagcgggggctcccaggtcagaggtggattcaaagacttttcggattggcagttggatgaaaaaaccagcttcttccaagaagcctttcctgctgctccatgggtttccatagcatccagtgtggaccagctggagcaggactggcgagggaatgaactggatattgcagcagaaccacttcgtcgggattgtacacactgatcctgatccagttaaatatgaagtcaaacaagaaatgatttgatgcccctctgtatctcccaacagaatgacaagaattgcattttccgcatgtgtttttcataactcagtgctccatttcccttccaactaggactgagctgagggaatcagcctgtttttcaggcttaagaaattccaggattgacagaaaagggtggaaactattttcatgtttctgtgtaaagtgttctttacacagaatacccctttgtcattttttcccctgcaaaatgtggtagcttgagtggtgactaatgaaggtttgctccatcgtttagccctgggtcaagggagaagcacagaggcagacaagggtgggatgctgtcagaggtgaaagttccttctgggtaataatttatattcatcttttgagaataggtatttatattaacagatgatatagttacaaatttgatctctgtagattttaaatgtcagttttattacaatgctgataattcattatattttaaaagttaat

SEQ ID NO: 473862 - DNA, 529 bp, Homo sapiens
gattaatggtcaaataagagcttccaggatgagtcgtcatctgacctgtctgacagcgactagagaaacaaatcccatactttgcagacaaggattccatgcagaggaagggaatggtttgactcatgtttacgagagtgactttggctgttgcattgcgaatagtctcaaggtgggcaaggctgaaaagagagaggaggctgtggctgtcatcctgattacaaagaagaagctgcagcaaaccagtggagcacaaaaccaaggatgcccatataaaaagcatagcaaacattttactcacattatcttgtcccccagttcatcacagctcagcaccaagatggacccccttggctgtgacctcctcccagtgggaaaaaacagactagagggattctggcaacctttgccaccaaagacttcagcagtccttaccaccgctgcaaacacctgcagcttttgccaccaaggaccacccttctccccagttatcgccaacactggtatcagctgatggagctgatctgag

SEQ ID NO: 473863 - DNA, 906 bp, Homo sapiens
agacaaagaatccagtgactctgctcacccctgaggatacgtggagaagatggccatctgcaaaccaggaagtgtgtcctctctagacactagatctgccagcacttttatcttggacttcccaggctccagaactggctcagaagaagacaagaaaacgtgggaaagtttggaacttcctggagatttgttgaatggctttgacaaaaatgctgacagtgatacgaaccataatgtccaggctgaggtggtctcagatggaaatgaggaacttgttgggaaccggagcaaaggtgactcttgttatgttttagcagagagactggcagcattttgcccctgccctaaagatttgtggaactttgaacttgaaatagatgatttagggtatctggcagaagaaatgtctaaacagcaaagcattcaagaggtgacttggatgctgttgagggcattcagttttataagggaagcagagcataaaagttcagaaaacttgcagcctgacaaggcgatagaaaagaaaaatcccattttctgaggagaaatccaagccagcctcagaaatttgcataagtaatttggagccaaatgttaatccccaagacaatggggaaaatgtctccagggcacgtgagaggtcttcatggcagtccctctcatcacagagaaaatttatataacataggaataacgtgcttcttaaaagtttgggagaatgcatagagtgatcaggactcatttgaggagatacaattcattggttactacattaatttttttctttggttatcgacctgtttgaattttgtaattcttgagtgggttttctaaactcgtgtactgaatatttcatagcaaatatttaaattaaaacaattaaggatgacatttattttttaataa

SEQ ID NO: 473864 - DNA, 702 bp, Homo sapiens
cttgttttgcctaatgtttctactcttgaaccacctcaaatctgttcttcatccagcagccataaacaaggtgatgtcccctcacatcccctgttttgtccttcacttagaaaggaatccaaatttctacaaggtcttgtgctatctgtcccccacatacctctacccttgtttcttgccactggccctatggtcacttgttcagccgcatttgtctttccctcagttccttcaggacacacatgtagcctcctctgcttttcatgtttttcactcctctcccccttcaataggtcgttcttgctatcccccatcacataaatctgtcacagcatctatcacagattggaaatgtacacacacacacacacacacatttgcacactagttctccctttttggtggttttgctttctgtggtttcagttacctgcagtcaactgtggtctgaaaatattaaatgggaaattccagaaataaactgttcacaagttttacattgtgtgccattttgagtagtatgataaaatctctcgccatcctgctccaacctgcttggaatgtgaatcatcctttcgtccagcggatctacgctgtctgcattcctcatctgttagtcacttagtagccatctaggtaatcagattggcagatcataagaagaagggaggagtttattcttaccttttgtacttgtgtttc

SEQ ID NO: 473865 - DNA, 1261 bp, Homo sapiens
tccacagccatgtcaggttggctgcagctgcacctagggagctcctgccctgccaactctgaagggccagggcttctgcttgtccctggctcctgtaggcttcgtggagtgtgcagccctggccatgcctccttgcagcctggggcaggggctccaggtccttcctggccgtgggctggcatccagggcaggggtgacatcgccacaagttcttttcatggccctggtgctcagtggtggtcctgggctcctcctcacttggctcatagccctactccatgtggtgcctctgggagtggattggggaccctaggcttgaccactggaagcatcaggctcagcagtcaccctgatgtggggcagactctggggacactgcctcatgcagagcctcctcccaaggcgcaggaacccagcatcatcagcggggtgggtgtccctgacttgctttacttacctgtgtctatagtgtacatataggacaaatgaaacctaatttacaaatccagttcttgtagatgttaaagaggttgccagtgtatgtccaaaatagttagtaaactaatatattttgtacattttgttttaaaagtcataggaaagattgtcttctgaaaatgtgagcattcttgcccactgggttgatgaagataggaaaggttctaggccagaatgttcatatttggaagactctttcaaattataactgttgttacatgtttgcagtttattcaagactgctgtgtggagtggatgaattcactccttacttgaaacatctagtctacctagatgtttagaggtgcccaatgtatgttaaatgtagaggtagtaaaataccactttgtaaatttctttttgctaaaattcatgggaaatgttgtcttttggaaatttaattgtgaagccacctttgtgagcagtatagtactgtctatacttgttcaatggttcagaggaggtgggagggaagaaattgccaaaagtaatatgctagtgtgttcataattggacattttcagacaccatttttctgtgttgaaagctctgttcatttttctttaatcttttttttctgatcttcagattagataatttctattgatttattttcagtcactaacctaccactgagctattctagtcagttttttatttcaattgttatacttttcagctcctaaattttcatttagttcttaaaaaactgtctctttattgagattttctacttattgctttattgttaaacaataggaag

SEQ ID NO: 473866 - DNA, 1053 bp, Homo sapiens
aaataactaatcacagatatgaagtatatgactatggtaataatgaaatgctctgaaggagggcaccaagtttttaatgctgaagagcataacaacaacagtgatgacggtgatagtggtgatggccaccatttatcaaatagcaactacagaccagctgctgggccaggtgctctgtgtgttaaaaaagcattattaatgaaaatgagaaaaatgacatatttaagagagtgtcagatgaagagaacagtgggccgggataacggctttgctgttcacgggaagcagctgcaaaggcacaggagtgggggctgcaaggcgaagtggaaaatgagggtgatgcaagttgctttgggaccagaaaaggcccaggatagactcagacccatgagagttgagttgagcagaaaaagccccagtgaagcaccagaagcaggaatgtcagcaaaaggaacagagtggaattttgtgcagtattaagtgcaaatttagagctgggaaattgacacttggctttgttatttctcgtctatttatatgtgggaattgaacaatgaggacacatggacacaggaaggggaacatcacacaccggggcctgttgtggtgtcgggggaggggggagggatagctttaggagatatacctaatgtaaatgagaagttaatgggtgcagcacaccaacatggcacatgtatacatatgtaacaaacctgcacgttgtgcacatgtaccctaaaacttaaagtataataataataaaaaaaaaactcccgatttcatgggttgaagtatgtttctctcagtttcccattttcccagtcccaattcatatgttgacatccttaccccagtaccttggaatatgactttatttggagatagtcttcatgaggttaagagatcacatgttggggtcccttgtgaagcccatgttctgtggattccatgtctgccccttattttagtcataccggatttgtgaaaatggttttttagagggtaatagtctggctgtcctttagaaattatatattttaagtggatggttgc

SEQ ID NO: 473867 - DNA, 483 bp, Homo sapiens
gcaacccagtgtggcatctgggtttgaaccagcaatggaggtcattttgcttcacctctcagtactagggtccaaagccctgaaagccttgagctctgacgtcccagggcaggagaagatggatatcctagctccagaagagtgtgccctcccccgccatatttttgttctactcaggccctcactgaattggatgatagctgtccacattgatgaggaacctgatttttcttggataaaccttctgtgcataaataaagctacagaccaatggctctttgaaggcctgtggacacctctgagggccagtcaaaatgaagagagatgccgactactgaatttaaagtcgctagctttggagctggaaaatgggaccatgggccaagaatgcaagcagcttctagaagctggaaaaggaaagaaaatggattcatgcctagactctccagaaaagagtgcagtcctgacactttggttgtagcc

SEQ ID NO: 473868 - DNA, 1004 bp, Homo sapiens
tcgatgggactgggcaccgtggagcagggggcgggccgcgtgggagcccactgcgagggggttcaggcatggcgggctgcaggtcccaagccttgccccatggggaggcggctgaggcctgtcgagaattcaagtgtggtgcaggtggaccagcagtgctggaggacccagcgccccctctgcagctgctgccctgggtgctaagcccctcactgcccagggccggcggtgctggctggctgctccgagtgtggagcctgcagagactgtgcacacccagaacttgcactggcctgcgagcgcacagccctggttcccgcccgtgcctctccctccacacctccacgcaagcagagggagccggctccagccttggcaagcccagagaggggctcccacagtgcagtggtgggctgaagagctcctcaagtgcggccagagtggacgccaaggccgaggaggtgccgagagcaagcaagagctgctagcacgttgtcacctctcagaaacaaagtaacatttacacaacatgagttaggcataaagaataatgaacacctatgtgtgtaccacacattttaagaacattagcattacctttaaagtcctgtgtgcactctccttgaagcctatcttcttcccagaggcaacctcaatcctaaatttgtatttattttgtttttcctatagttttattttcatttctctccaaagaagagaatgtagttttgcctggttttgaactttatagaaatggagtcattctgtttatattcttttgtatttccatttttttaaagagctcaagtttatgtttgtaaaaatcatctgtatgattgtaggttgctctagtttgttaagttttattgctctataacattcttatgcatgaatatgataaagaaaatatcttttttatttatgactgacattcgggttgtttataggatggggttgttctgaaaaatgttgtgctaaacttcttatttatcacttctgggctc

SEQ ID NO: 473869 - DNA, 427 bp, Homo sapiens
tgaatttcgaaaacatgatactatggctgtataacccaggggtccccaactcccgggccgtggaccagtatgatttgttgccttttaggaaccggctgcacagcagaaggagcacgaaccctattaacagtgcatgcgagggatctcggttgggcgctccttatgagaatccaatgcctgatgatctgaggtggaacagtttcatccccaaaccatctgcgctcctcctcctggtacatggaaaaattcttctagagctcatgccttgcattccttggctggtggccccttcctccattttcaaaggcagcagtctagcattttgcttcaaagtcacatttccttcttctgtatcaaatctccctttgccaccctctctgaagagcacatgtgatgacattcagggcccacccagataattcagcat

SEQ ID NO: 473870 - DNA, 944 bp, Homo sapiens
gagggtccgtggcttcattcttgaagtcagcgagtccaagaacccaccaattctggatacactatcatgtactaccaggcacagtgccaagagacggacatggatgaagctggaaaccatcattatcagcagtctatcacaagatcagaaaaccaaacaccgcatgttctcactcataagtgggagttgaacaatgagaacacacggacccagagaggggaacatgatacaccagggcctgtcaaaatgcctgagaattcacagaaagaagcaaaatgtgaagatgcaggacagaggattcaaattacactggagagacagcagtgttgcaacaccaggtggtcattgctagaggaggaagcaaagccaacaatatgcgccctgcaaagcttcctggagaaaagggaaagctccttaacagcccttatgatgaagattcttaccttaaaaggaattttcagcaagagcctaagatcaagaagctttttgacaataatgatacagcgaatactttatcctagctcacgaaaataaagggcagaaactcagttgttagaaaaagggaaagattagatgtgtttgggagatggagaaagttagttcacaaggaaatagcctctacttagtgtatagggaggataaatctgcctgacacttgggacccagggattcctgaaacttcagtttcaaagggagaaaaaaatctagtctttctattctcacagactcccttctgcttggaacaatgattattcaacaaaggggctagattttttcagtgactccagtttctccctgttcaagtcagttttgcaatctgctatttgattaatctttgggaaactctgatacactcatctgctcaaaacttggaataagctcacattgtttctataacaagagtcaaatgttttttctgttatttgaaaatgttaattttacct

SEQ ID NO: 473871 - DNA, 642 bp, Homo sapiens
ggattttatagtccagctagaggaggcagtgtctgatttacattgggctcacagattggtttgatcagtggagcctgggatttccatgggttcaggatggggggccagttgggccagggtggttttggaaaaggcaacattggattgggaaaacgaggatgtaaagttctcactttgggccacagttccagactcgagggtggagccctcccaggtggaaagaaccaagtacattattacatccgttcaagtagcaagagagaaatgtacctggcagtacattattttgatgagcatgggtacaattccagtaaacacactgcacatgctcacccaccaagcacaaggaaggcactgcgcatgcaggtggtccaccctaatggaataatgaagggaaaggggcacaagaggccggaaaaccactgtatgaacataccgggaaaaccaaaagaattcacaggccttttgaaagaagcgacttgcttctgcaaattccgtgagacagctgaaaaactgagtccccgaagtgtgaggggaaaatgtccacctccaaacacacatcctcactggggaaactaaacatctagatcatgggagaaggatttaaacttaccttagagctgaaacaaatttagagagctg

SEQ ID NO: 473872 - DNA, 3593 bp, Homo sapiens
tgcaaaccattagcacaagatgcataaacttctagtatatttacatcatcatatggaagcagagcatgaaagttctgaaaatttccagcctgacaatgcaatagaaaagaaaaacccattttctgaggagaaattcaagctggctgcagaaatttgcataactaatgaggagctgaatgttaatccccaagacaatggggaaaatgtctccaggatatgtcagagatctacatggcagcccctgtcatcgcaagctgacgtaggagaaaaaaatggttttgtgggccaggcccagggtccccttgctgtgggattcagacagtgtgttagcattgtggaaattcagcaagtggaggtgacacagaatacagcacgtaggagtatggaaaggcatatggaggaggtgatagttgagctgcgaaaaagccagacttggaaacactccaagagcactccaagcaggaagaatattatgtgccacgaccctagaataagaatgaaattccaggaactggaagtaataccaggaacaggttgaatgcttcaacctgtgtggttgaagcatagttaagtgataaggtcagagaggttttctcataatagtatgtcatattttttaaataaagtatttaaatatactatataggccagtatgaaatatctcttgcattcaatcattcttactttctccaacttaaaattctctgtccctcttttaaactctgataattacttccacttctgttggttattcatggttttctgtctttcattatatttatttgtgtaacttttgtgttagaatgtcgtttcaatgggttgtatgcaattccatattattcttaattcaaatgggcataactatgatagattcaacatattattcttgtactaaaaactttgtgacatttatgttagctaaaagtaccattatttttaacctcctatgagtagccatgaagacatacatttttcacagagggaatctaaaaagttacataatagtatgaaatttcctcagaaatgaaatgttaaacaatacagagcatctactgaattaatataaacactgacttagtaataaggagatctatgttttatttcttgttttaacctctaaagagtttagctattttctgaagcactggtgatcatttctggggaagtaaggtttcagattggagcaatgatctataagttttccatgcatcaaattacagtatattctctctttgttttgtggggggatgtagtctagtttctttcactccatgttgttgcatgtttcagtagtttactgctttgtattgctgagtcgacttcattgtatgagtatactaaatttgtccattctacttattaatggacatttatgttgtttccagcttggagtattgcaaatatgactgccaaaaactttcatgtacatacagtttcattcttttgggtaaatacctaaaagcataatggctggatcattagataggaatatatttaatttattaagaacctgtccaacgggttttaaagtggctgtactattttacattttcactagcagtgtatagcactgatagatctttcacatccacacaaaccttctttggtcaatatttagagttagccatactaataggtgtgtcgcactatctcactgtggttttaatttatatctccttaataattaatattgttgagcatcttatgtgctttttgctgtttatctttttttgctgaaatgtctattcaaatattttgctcggttgaaaaatgatttattttcttgttatcagattttgagagtgatttagatactctgaatatgaatcctttgtcagatatgtgattcgtaaaaattttcttctccttttctaaggattgtcacttcattctttcaatagtttctttcagagattcttttatttaagttttataaagtcaaatttatcatattttttattttatgtattatacgtaagaaatatttttctaagccaaggtcacaaatatttatgcctatgttttcttgaaatttcaaacaataattgtagatttgtctttttttccttgcagttctatcagatttcgcttcaaaaattttggacctttgttactaggtacataaacatctgaggtaggtatattaagttgtgccttttttttttgaaaaaatcaaatctgataatctctgccttttaattggaattttaaatctattacatttaatgttatttaaaattaaaatttatcttgcaattaatattatatttgttttattcgttctcgccttacattttctcatttttttgccttctttgaattacttataagattatggttattccttcttatctcctctaatagctttttagcttcaatcaattattttgttatttttgattattgcttttatgtttacagtgtacatatgtaataatatagtctaccttaaagtgacatacaaattcacatgtagtataagaaccttgtaataatatacttccgtttctcccctctgggcctgtatgttattattatacattttatttctgcacatagtataaagtccacactacattgttataattttgtttaaacaatctgttatcctttaaagagatttcaataatgagaaaaaatcatatgcatttgcctacccagttaccatttccaatactctattctcggtgcaacccgaagttccatctggtatgatctttctttcatcttaagggtttcttgtaagatttcttcagtcttatgctgataaattcttttaccttttgtatttctaaaaaagtcttctttcaccttcatttcaaaaaatagttttgttgggtatataattctatgttgctgagtttttttctttcagtgctttaagatgttactctactgtattctcatttgcattgtttctgttgataaatatatggtcaatgctaatgtttaacaagcttcttggatctgtgggcttataattttcataaattttgaaattttattttttaaaatatttttcatttcccattccctctattatcttcatcaagaactacaattacacatacattagactgcttcaatttgtttcacagctctctagtgttgtctttaagtctttcttctctctgttttattttcgaaagtttttattgctgtcttttcaaatacgttattctaatgtctgatatattatttatctcaaccagtgtatctttcaactagacatttcatttttcatctctggaagttaaattttgttctgtttttatattattcttgcctctataaaacatttctatccttttctccagttttttgaatataaagaatatagttacaagagttttcatatccttgtctactaattgtacaatatttatgagttccatattggcttcattcgatgaatttttctcctcactgttggttgtagttttctaatcctttgaatatctaataatttttgatatgacaccaaaatcttaattttatatttttgggtgctgaatatttttgtattcctgtgaatagtctatagcttttttctgagatgtggttaagttacttggaaacagttttatcatttc

SEQ ID NO: 473873 - DNA, 635 bp, Homo sapiens
tttagaataggcaccatggcaccaacctatttcctaagaaattggaaaataaaattgcgcaaagttaagcttctagtaagtcagtatgacacaggatttttcttggtcattttgccagccagggacctctggctggcaatgcacctgcccgggtcttgcttgggcacactacctgctgcaggaggtgccccactcacttggttcacccaggctgagtctggcttgtgcactggcccagcctccaattgggccaggtgtgcccagctcacctgtgttatagttagtacctgtgtttggcagttcctgagctcttgtcccacatccaagaagaatgaggctgtgctgaaaaatggagattatttctgtgaaatccctctcctgagtggcatttggaaaatcctttttggaataaatgaatatcatgctggacatgcacaaagttgtaaatgggaaacatcatcgctgctgctcagtgtgaacccttcctttgtgcatgagggagttgaggatcaaggagatgaaattgtttgcctaaggttaccataaagccttgagaacctatataggattgtgaaataaacacattccaaatcctagggtctgtcccctacttcgtaagcatgggaaaattctct

SEQ ID NO: 473874 - DNA, 1024 bp, Homo sapiens
gcttctgccaaagccttgtcaacaggattacccattcgagggatgcttgggtgttctgatgggtatttgagaagagggtacaatcactataaaacattgggtatgttccgtgtcacagtcaagcagaccgactttattctaagtatcaaatacagggagtcaactcagtgcattgttataagagcagaagttttagcatcagcagaacgtgtggctgtgaatgcgggtgtggatgtagctatggatgtggatgtgggcgtgactgtgaatgtgaatgagcatgtggctgtggctgtggctgtagctgtggacaaggataaggatgtggatgtgactgcaaatgtggatgaaaatgacttggatgtggatgtggctatggatgtggatgaggatgtggctatggatgtgaatgtggctgtggctgtggatgtagctgtagacgtgggtgtggatatggatgtgactgtggatgtggatggggatgttgatgtggctgtggatgtgaatgttgctgtggatgtgaaagaggatatggatgtggatgtggagactgtggatgtgaacgaagatgtggctgtggctgtggctgtggatgttgctgaggatgtagatgtagacaaggatatgaatgatgtggatgtgactgtggatatgagtgtatatgtggaagagggggtggatgtcactgtgaatgtggatgtgactctgtatgtggatgtagctatgtatgtagatgaggatgtggatgtgattgtctctagctagacttgtgaagttgtcatctaatatttcattcaatacgttttctaacctttatgttctttcttcacccttggaaataccaatatctagtcattttatattgttgcaaatgtcatgaagacttttctcatcctgaaaatacttcttctgcttgatctagtctattaaagctttccattgtattttatatttgatttaactttacattgttccaaatgtcacaaagacttctcattctgaaattattttttctgctagatct

SEQ ID NO: 473875 - DNA, 1916 bp, Homo sapiens
tgttggcttgctttctcactttggcgattatgcctcttcttatctgtaccactctactgctctgccacctctctgccaatggaacttggggtttttatgggtacagtatgtgtatattgcctcatgaattcaacacctttttgactctataccaaggtccagaagtcagacctttaactactgcctggaatggtagaaagggacaatacaagtctcaaagcagtaaacttgctaggcaagacataaaatggcccctgaaagaatgcatttacttatctgaaacagtgaactttatttatcagggtgttaggggcttgaatattccatttagcctgagagcactaaatggtttcctgaggaagaatgtgaagcaggggctcaacacaattctttatttctgctgcgatcacccagagcacatgaccacttccaagccatatgattcttcattgttaaatatagaggtattcatgtacattgggcctacatcttgaggaaaaataggaattatttaccaagtcatttttttcatccttcttttcccaccctcaaccagaaggtggtttctccttttggaatgctctttcttcttatatattaatattctgtccatacttcaaagccaaatcagatctggaattttgcaaagttattcaaatactcatcttaaattaatgtatttttcttttgccccaaatgtacctctgttatgaaactaatattattctgtcttgatttagactttcctttccctctagtttttaatctccttgtttcaatattttaacttatatactgctcattgttgccagattttttttaaatccattttggtaaatagttgagatttacagttctcaaaacttaatgtaaaacacaattttcctaaacatttttaaaaagcgttcctctacacttcattacttcacgagatttcttacaagcactctgaacaaatatcaagtgtagtgcagtaggtatttccacttcaaaagaaagttttgatgttcctttgtgcttataagtacaaaaatattaggatgttttatatgttagtttttaccagtggattaattttgtgggcaacattatgcattcagagctgaatttatttccaaaaaatggtataacattaagatgttaatttactttaatggaaatattaaattcattttttaaatgttatatactatatttttccgagtgtcatgtaactctgcatattactatggaaatagactccaagaatacaggtagtttgtccaaggctacatactattctgtgatagagctgggaataaattctgtagggctgaggcccactatgccaggaaactactttgacctggccacattgaatttcatgacatctgtaatgccaataaaatcatgattgtgaagcagcgtaaatgttctaaatatttgtaaaataaagaccttatcaacttgacaaaggcagaatctagttttatagagattagtggaattctctgacaatggctggtagaggaggaatgagaaagaacagtgtttttttcctacgtcaaatccgtaccaaactggtggagttcctaagccaaaagaacattggccttttgaataaaaatgtctcagaaatccttgaaaatttgaatttctgacacatgaaaatatttcttctccagaataaaattcatgctacacagatataacctaaagattgttttcagttgcttcctgtaccatttttactaatttcttatggatttgcatataatcaaatgtacaaataatttggaagtttataaatactgttcctttttaaaaagtattcttcttattaaaatatttaccaaaaattgagtatttttacatatctgattccaagtgttaaattgcaaatgaagcgttgtgtcattctctgagctctctgatgt

SEQ ID NO: 473876 - DNA, 827 bp, Homo sapiens
tcccctcctcttcttaagaactattcctcctgcatggtcgctaatggagctcctgctgctgggtccacctacagacacatgctcaaatcctttattacttccatgccaccttcaggaaatgcttcctggagttggcaaagaagtaggaagacccaatggggatttcaaatctggtttcatctcctatctggagaaactaggtaagccccacactcatacacaaatacacagtaaacaggatgtattgggtagcaaagagggtcagcacatgttgacttgcagtccttgtggcctagactgcctttcaagtttaggactccagggcactgtagcccatggtggcaaagcttgcaggaactcaagttccaaccactgggatctggattcctttctagctagggctggtttaaatgctcctcctgtgggcagttgccggctgaatttgcaccctctctagtacatctttctattttgtaatgctgtttcttactagtctttttgaaaatttaaacttattgatgattttttgtttctgttgcctgtattacctgtattctgtagaattcttagcctttttgcgttctgaagtatgaaacagcttaattttaaattctggttgatcttcctgtagcagatgctgttggtgtcctgcaagattctttttactaggctgctgcacacattcctctgcttcagggaatggtgcttgctaatagcttacatctgcagccttctttggaagctgctgtcctgatagagcattggaatgatctcttggtggtataattgagggatccactgacacctgccaatcttgggcactgctc

SEQ ID NO: 473877 - DNA, 829 bp, Homo sapiens
gcagctgacatttagaagagacaaggtcttcatgggacaatatggcactagggtccactggggtgggcctgttaactgggtcccaagaggggtcctagatcttgggtccacaggggtgggcctggatctcgtatcagcaggaactgacctagagcctgaatcttcaggggctggcctggcaaataacagatgtgtgaaggatttcagctattggaactgcagggaggaaatgattgctccttttctcttcaaaattagtcttgtcaaactggtggtctccacagatgccaggtctgtgttctcaggtacttctcccattccacacacggccaatcctaactttatcccaatgcttcaattctctgagcagaacagtggaaaaagagaaagtggcatccacaggagccagggaccccccacagagtcaggaggcattgtgacactttagggggggaaaagggtaggagtatgtgagagagacattccagcttcagctgttttctcaaaatgccatggtgccacattttggggtagtgtgtcctaaactccatcaatattcttaaagagaattcttaattaagagcagtctgcactaacattttatagattcaaaaacgtttccattgacctattccattgggcactactactggattgaaataatatattaagttctttgtacatttattaaccatagagctgcttcgtgtcacgtggagtgctgctcttagggatatcaatgtgcttagtgtatttccctgccctagaaggatgcagaagctagagatggtaatgaggtagaggctgtaatatatgtataaataggatg

SEQ ID NO: 473878 - DNA, 750 bp, Homo sapiens
tggggcagaagaaagaaagagagaaagaactgaaatctaagaagaaagtatccaaatgattttcttaagaaacattatgctacagtgcaaaatgttttcagtagtaattttactgaagtgcataaatgtctctcatcaaaaacatagaaccaaagacataagagggaaaaaccaaatggaacatgtaattactgtggacacaatgttgaactatttaaacaagccctgcagtgcaagaaagaaagagcaattacttagaaaagaagaatgtcccaattcccaaaggcaagagtgtgtcataacccctaatcttcagagagtcttcagcagagtcttcaacagagcctgtccagtaagatatactaatatttgctctataaatctggatgctccagtttttggtgcatatatatttagaattgatgtatcaattgcaggattgatccctttatccttgtatagtgcacttatttgtcctttttttaattgttcttaaagtatgtttaatctgctgatactttcttcattcttgacctttgagaatctattatatgcctttgggtggtcttatttgatcagatatgtttgatattctctgaccttcctatacctgaattatctcattctcagggtttggtaatattttttctcatttttttgagtaagctttctacaatttgctctttctcaacttcctcttgaacaccaataattcttagatgtttgtcttttgggataatttttatattg

SEQ ID NO: 473879 - DNA, 599 bp, Homo sapiens
ccagcccacggaaccacttttttctcctaggcctccaggacctatgggctatgtacttaagtgtgtttttgtggtagcagggtcttttggcttcaattctatagccctatgcacctctgtcagtaggttttatattgggctgttcagttcaacctgtaagctagtagatggcacttacagacaagactcagatgtggccagtgtggctgggtatatacttgatccttgtttactggaagaaactctctgttgcatcagccaatgggttgatctgtggaatgctcagtggtccgagttccctgttcagctccagggagaggagatgggggcaatatggaaggactgtatggttccccctggtgtttttggaatgcttgccctggaggaaatctgccaccatctaggaaatcttactacctggaatccaccattctgaagaggacacatgctgaatggcatatcattgtgtatgtataccatattttcttcacacattcatcaattgatggagacttagactgattgcatgttttggctattatgaataatactgcaataaacttgtgagtgcagatatcacttcaacatactgatttcaa

SEQ ID NO: 473880 - DNA, 1924 bp, Homo sapiens
ggtcctacttctccttatgttaagatggttttacaaactttttgtatggaggtcactttacttcctttagattgggaccttttggcaaaagctgttctaaccccatctcagcgtttacaatttcatacctggtggtcagaggaggcccgtttgcaggctcagctaaatcgaagtaatggcattctaattactcaggctcagctcacaggctccaatagtttctctgatacttatgcccaattaaactttgatgccctcaccacagaacaagtaacaaaggtgtgtatgagagcttgggataaattacgcgctacagaccaagctcctgtttcttttaccatggttaaacaaggtcactctgaattataccctgattttttagctaaattacaagacgctgttgaaaaacctgtctctgatgagcacgctcaaggcattctccttcgtatgttagcttttgaaaatgcaaaccacgaatgtaaaatggccatgcgttctgtccaacgacaaaatttacctgatcacaaggttttgcctgcatatattaaagcttgtgaaggcattggatcagacacccacaaagctattctgtgggcacgggccatgaaggacaccaaccaaactggtcccactaattcttctcttggagcctgctatacttgtggccaacttggtcatactggaaaaaattgcactgttgaaaacttacaagcggccaagccggctcaacacacatggccaaatgctgctcctactgtttgcccacgttgtcgcaaaggccccaacatcaaatgggacacttcaaactcacaccaatgttgcatttccacttcaggcggtcccaacgcaacccccagcacaaacaaatctacctccagccaaaccaaatgggtcccagcctctccttctgtctcagtacaaagcttgtccacctccacagtaggaggcggggtggttgatctctgtagtactattcttctgaatttactacctgattctttgcctttgattgtccccacgggggtcactggccctttacctcaaggttcggtgggcctggtgttaggtagagcatctacctctgctaaaggaatcaccattcatactggtctcattaattctgattccgttgatgagattaaattaatcgtgtctgccaaggttcctgtttccattctggccggtgagtcaattgctcaattgcttttactacctaatatcgttttaaacaaaggagataaggcacgtggccctgggatgggctccggcggtgaaaaggccgcttattggattaatgtaatttctaaacaaaggcccacgtgcaccatacacattcgaggaaaaaagtctgagggcctagtagatactggtgctgatgtttctgttatttcctctagtttatggccttcctcttggcttaaacatcccgctaacatgggactagtaggtgttggaaaggctgaggaagtttatgagagcacatttatcttgccttgcactggccctgatggtcaaaagggcacaattcagccctatatcatgccaattcccattaatctttggggtagagatttactggcacaaagggggactgaaattaatattccacataactcttatagtgctcccagtcagcatatgatggaaaacatggggtttgttcctggactcggtctcagtccaaagcatgaagggattactaaacccctcccagttactataaaagaaaacagggctggtttaggttatcctttttagtggcggccgctgccacgcctccgaatcctatccctttacaatggaaatccgacatacccatttggatttagcagtggctgctttctaaagaaaaactggaggctttaactcaattggtttctgaacacttacaacttggaaatgtggaatcttctcttttctcttg

SEQ ID NO: 473881 - DNA, 770 bp, Homo sapiens
gctccaggtgactttggaggcttatgagatgtgccagaaattctttcaagatagcttcaaaacacaacagcttggttttagagtcacctgtaaaggtggattttcacctcctcaaggctcttgtatgccagctgcttcccccaaattgttgaatcagacatttctggttcccaaatcccttccaaaagatatggaaaatggatataaaatatgcgtgcagatccagaaaaaggctccacctctgtctcctctgaatcatggggactttgtgaaatttattgcccacaagggacaaaagagcaaaacagatgcccaggttgctcagagagcaaaacttgcagcaaatgaatgtgcactagttctttgtcttggagcatccttggagatgctggagtatgaggagagaagagcagtccaataaagtgtttaggagagaaatattccttcagtagtctatgccagtttccttttgcaaggcagacaattttaaaataaaaatactttcagtcaatatggttttcacattgcttctgactaattacttacacagcaatatcaaatattttaaatacattttcatttacatataattaactatatccgtataatttgtgtttaaaagaaatctggttatttatttaaggagctaaaagaaacatcaaaatctgttctcaataagaatgattttatcgagttttttttaaagaatgtgtgttgaaggagaaatttggtgtcagtcatattttatttggtgtcagtcatattttatt

SEQ ID NO: 473882 - DNA, 712 bp, Homo sapiens
acatgcaaaatgcgcgttaattggctgtttttgttgccactaaggcttctggtcaataacattcttattcagtggctccagagcagttttagggctcagcctctgggcttatcagaatctgtagggaagtacagggcatcagtagttttgggaatcaccgactcactgtgcgtagagtgctgcctttctagccaggagcttgttgtggcaggatctcccctaatgggcactcctgtttttctggttggtggagggaagtctcaggcctgtggaggcaatgaagcttcggccaggcttgttgtggccgccaatattgtcctgttgtctggaattttccttagttttgttcagtgcataaaccttccttcctcttaccagtcaaggatttgtgtgaaggataccatacgtataggctatgaatacacacgacacggcagctgcgagcgagagtgactgattagactggctgtttctctcctatgtaaacctgttatggtgcctgaaaaccttgacttttaccttcaatcttttgtgtcagtttttacttctcttgcttctgatttgatatttatgcatttcttagaaccaatgaggtgtctaggttgattggtaaggtttaattcttgcaggagaattataattcttttccctattttcctgatttttcaatttttcttggaatctaggatttggaaaatcgtttcccatgaaa

SEQ ID NO: 473883 - DNA, 727 bp, Homo sapiens
gcaaacgtccggggttgagcaagtttctgaaggcaagcaaaagtatttggtgttgcatgttgcatagcatgaccagaaactcaggtgtgcccaaatcctgccctgacaaccacccctattcctcaggacagcacaagtggctgatgtgcccagaggaggaggactctcagctaagtgagtgcagttctttaaggcttaatggacccactcatgggaattacagcttaatcaatgttctggactctgatcagattactaccctttcctttgaggggaacggcttgatggacgctcatgactatgtcaccacacagtgtccagagcaagcccaaggcattttaaagtatgaaccttcagttcagcatggcatgcagctggcctcgcttgtgctaggctctggcctgggccctggaggaacacaggtgaatgaggcctgctccctgatctccaggaaatactttcaccatataataaatgttagtatggaggtgagtactggccctcccatgagggccagaggaggggcacatggacaacctggaggctcagagagcgcttcttggaggaagtgttagttgaagtgttgaaggttgagtcagagctttccaggtaagggagtgaaaagggcactgcaggaaaacaaaataaaatgtggcagaaagttccactttgtcaggcctggaaagtgcctgtggtatttggtgtagaggctggcagtgtgctttat

SEQ ID NO: 473884 - DNA, 445 bp, Homo sapiens
gaagcatccgtgtcatttcaagttatggtgatcacatttagcattctactgatgtttgaagggagaggaaaaggggaacaagaatggacaaccttcagagcaccatatgtgaaatactcagaaaaacatcttttgttgagcaagggatctcccccagcagaaaaggaagaggtggagccttgcagtttcttaagaaaggctactcctacaagaaatcttgcgcaaactgaagaggagctttcagttttccttctaacagtcaggccccctgcttcagttctgctggagtttgctggaggtccactccacagcctgtttgcctgggtatcaccagcggaggctgcagaacaacaaagattgctgcctgctcctttgtctggaagctttgtttcagaggggcacctgccagatgccagccagagctctcctgtatgaagtgtctgtc

SEQ ID NO: 473885 - DNA, 2956 bp, Homo sapiens
cagggtctttttgctcccgcaggatgtgcctgaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatgggcctccatacactgggccacggttccccagaggaaggaggaagctgtgtctccccagtgacccactcgctaccttcacagcacctcctgcagctggctgcccagctgacccatggcaggacgacataccctggagacccagtgggcaagggaggcaccactcaccaggcttgtgcttgatgttagccttagacccacacttggaggagaccttagagatgtccactttcttgttctgaatctgaacctgaagagaaggacacaaaaga

SEQ ID NO: 473886 - DNA, 2767 bp, Homo sapiens
taagtaatgcatccaaggtcatgcactgattgcagcgggatgtttcatgaaagcctagacccggaagaataggaggataggagactgcagcagctgacctctggaagccagagctggatgagggacctgagcgagaggagacttgggcagccggagctgaaagctgagcagcagatgccactggagcctgtgagggcacgattgagtgtggggctggcttgctgctgctcccacaccactgcagaggcgtcctctctggaacatggagacaaggtttttggacaggggtttcccagtcccctggaagagattaagagactactgaagatctccagggcactgcaagccagatctgtaccctccacccaggagaaggcaaaatgtctttctggagagcctgggcagccagaggggaaaggtcaagaaacctatcctggccctgggaaagtggagggtaaggcagagccagccatgagaaaggatgatgtttgcccaggcatgaaatgtatcagcggatgatctctcacatggaagaagccaaagcagctacacccaatggcttagcaataagaaacaccaaaccagacaaacaccactgctgctgggaaagggacctggcagaaggaaaaggctgttcagagagcagaggtatttcgtgtgagccttttagggcttcttgtctctttagaccacatgcacatattacttgtataaaataatgcaccagatacaaacaatgaaatacaagtgctgagagccctgcagctgacagccatgagctccttatatgtgaactgcttgactctttaaaccgcatgaaataatgcgacgacacacagtgatggaccagcagagagtagcgcgtatgggagactcacgaacattgaagggacggaaagccacatgtccctccagtccttgtctgacggtgtccaacagcccatgtaggccacacacaggtctatgagagccaaaccaagagcccagcactgcaggctgctctcctgctctctggccacccccggtgccctctgcaggccaggatgggctgttctgcttcatgtgtcaagactgtccaaattcctgcctggctcacaccccggccagttgggcggtgagcccacaggcgggagtacaggtgtgaaaggagccagctgccgccatgcacctcagggagaggcgaaccacaaggaaggaccagggctactgagtgacctcactgggcacagtcccaccaacgtgggctgctcatctttagagggttaggagagggaggtgccagcttctgtgtttcggggccactgcattggaggtgtctttgttgcagcagcaccttgaatgcacctgtgggaacctggggctctgttttcttgtaaccccttggatcaccaccagcataccaaggacggcccagccaagtgcaaaggcagcctggctgcctgcactggagagctgctgccctggaggaacaagcctgggcctctcccagccctgtcaaggccccttcctctggtgtttggggaaaggggttggactcacatcttcttggacagctgcctgaccccagagctggtgccctgctcacattccctccatggagatgaggccaggactcaggaccaccctctgcctccaggggacacagctcccaccacaggctctggcacagggctggtgcctttcagccgtttaggagtcaggcacaatttctttctgctcatacacccttggagtccagcgctgacacaaatgagtgaagcagcccaggtgtccaaagagcacatgggccttgtcaaggggcagtctccactcacctggccccctgtgaccacctgggtcatgcgggccatggcagctgggttccctgaatagtggagaaatgtgaagtctctttcaaacatgggcagatagttctatttcctatccactttattgaggtagccaccatgatggttatatagaataattctataaccccaaaaatgttccctagtgcctatttgaaatcagtccactccccttcagtactgacccctgccaaccactggtctgtttctgtcactatagttttgcaagtagaatcacatggtatgtagtctatagtggctcattttgttcatttagcagaatgcatttgagaccaatctacattgttgtggacatcagtagtttgtttctttttgttgctgagttaataaaatacagattgtccctgatttgaccaattcaagctggttctgggtcattttgaagtgtcctcatcactctttgatcactgacttgctttctggcaaacaagatgttctaggctcatctgtgtgtagggggcggtgggtggagttgtgtttattgagataaattcacatgaattaatcattttaaagagtgcaattcaatggcatttagtacattcacaatattgtgccaccaccacctcttgtcaaaatatttccatcatctcaaagggacaccccatacccattaaacagtaactcccaatttcccacctccccagctcctgacaaactctattctactttgtctctatgaatttgtctattctagatatttcacaaaattggaataatatatgaccatttgtgcctggcttatttcacttagtttaatgttgttgaagtttatcctgttgtagcataaactagtacttcattcattttcatgctaaataatattccattgtatggctataacacattttgtttatacattcatctgttgatggatacttgagttgtttctgcctttt

SEQ ID NO: 473887 - DNA, 1000 bp, Homo sapiens
tgactttagccacacaacgtgccccagtgtaaggaccatggctgagcccagaccagatggtcagaccacaggagtgagagcaaagaagatggtggttgttttaagcctaagttttgggtagttgctgccaccgccctcaccctgggccagcgatcccctctccctgatcacaacctcagcttggcttccttctggcttcttccctggagcccagcctccctgccgagctgtcctgccgtgaggccagtgctgtccttctctgtctgcacacttctcagcatgtgaatgaagtcctccttccgcttggagaacccacggagagagctcaggctgctgtttttggggaaatggtcccagagcttcctcatcatgggggagaaagacttctttccacctctgtgtcagcactgcctgcggcagacaccgggacgtgcagctccctcagctggaatgaggtggtcgtcccctggcggccagcagggcttggggccgccagctttccagctccttgggggtggtcaaggcctgcatcagggttgtgctggactcaaccggtacctccaccgatattcgcttcctgcctgccctccagcagtgtgggttgccagggcagcgcgcttcctgtatgtctctgtccatctcagagtctgcttcagggagatcaataccctgcttagagcaacgagctggccaggaaggtgcccccgtcccagccaggccacggcgctcctccccacatgaccccaccctgaaaagggtttgtggtcagacatccagcttttcaaatctttcacctttaagatggctgtaatccctactgtgtggggcagatgttggctgcccaacccagcagctacttccaaaaacttccactcttgccttcctcccacaccagaggctagaaaagcagctcattcctttcccagtctcccttgcagtaagtgtgaccagatagcccagctctgagtaatgaaatgtgaaagggacttctgggaaggca

SEQ ID NO: 473888 - DNA, 1525 bp, Homo sapiens
aagacaatttcatcagttaaggcaggaaccggccatctggatgtgtacgtgcaggtcacaagggatatgatgttagcttgggctcagaggcctgacactgtgtctcagcagggagcacagcatcaggaactccatggtgtgtctggagttttcaggctgtttgcggtggccctgaacttgcccagaactcatcgagttaccttagaagtatccagaaagagagaggagactgtctttaagcagataacccttgtggctacctgcctgtggctcggcaacccctcactggcaaaggatctgaaggccagcccaagcagccacctagtgggaagtggatatacttcccaggtccactgggtttgcttcagtctgtcctcatctgccaccactggtcgttcaagacacctagacggtaccatctatgaggaatgggccctcgtcagacatcaaagctggcagtgccttgatcttggtcttcccaactcaagaactgtgaaaaaataaatttatactgttcataaatcacccagtctcagaattatctatgtgggttaaccatcagtttatcagtttattaatcaaatcacagtatttctttgtgaagatagttctgcatgaatttttttttgatgagggagagacatagatgattttaggtaaacagatatagaacttcctttattgcggtaaaggaatattgtctttaatattttcattcccaattgttgtaacttttgttcagatacattttctatgcaaatattctctttttctgccttctctgtataagttgtttacttttatctatctgtggctttccattttaagtgttttccaacttattcttcatgaccatgtatttttaccagtaaattttttatttcctttccaattttagtgcaacttttatttctgaaatggctttattttcagtttttaactgaattgtactatgtccccttttagctttttacataaaatatcaccttttatttggtcttatgtctttttattttaatatatctttaagaatctatactcttctcgatttatttaataccatggaaagctgttttgtgttacctttgcttcagtttttaggattaatgattctgctgacatgtatcttagaggtggtatgacatagtagttaggggtggtaatatcagattgcctggtcgctaatctcgtctactaccttcttagatatatgatttacttaaccttgttatgtttttttaatctgtaaaataaatgcataataggaagttaattgtgagaacagtaccccttgggaagagattcctttagtttaatatagtcctaagaaatgcatcagtgaggggagcaccagaattcttgaaaaattctttagtgaagatcagagaggacagtggaagacgaattatggaactggatttcatgatttcagtgtaaaataggattctggaatgacagatttcatgtgacagtgcttaatctttggagtcagttatatatttactgtatataaccatagaattat

SEQ ID NO: 473889 - DNA, 1467 bp, Homo sapiens
tgagtcacctctctccacatttctcctaactctcggtgtcttctttttcttccatttccacgccatgtgtacattgcatcttcagtcaggaccctcagctgcaggtctattggagtttgctggaggtccactccagaccatgtttgcctgggtatcagcagcggaggctgcagaacaacgaatattggtgaacagcagatgttgctgcctgatcgttcctctggaagttttgtctcagaggggtacccggccattccaggctaagtattgcttgagtaaactcggagagctcaaaacacaagttagtggagctcggaatctgagagaaaactcacccatgacctccagttacaatcaagagaccagtgagagcaacggcctcagtgggtacctcaccaggtcacctggtgttccagggggttgccagagtttttcttcaaatcccacttctgacaccagatctgttaaaagaaaacttcagacaagttaaatttgatggaaatagtattttagttccctttttaaaaattatgtaatcatggtgaatattcactttggtattttgtcttttgctacctaacatattttgtcagcatttccatgctgccaagtagcctttctattaataatatcattttctgcattatgtaatgttgcccagagcatatttattgtgacccacctagctagctccttttgattggataccttggttatctctaccttttgtagccaagttctttaaaagtctgttagtatccagggtaatttcttttcttagttggccactgccctccctttttcaataggtggatgagaaaaaagtatattggatcgctatgattgccagtaattcatggtgatctttaagaaatatattttcatcaaatttttttaaaacctttgtcagatttcttagtttaggtgtatgtggaggtggaattaatctatacttgcacttattcacagaatttataaagataaaactgttctatgttgacgaatccatttgcaaaaaaagcacactttcaaattgttcttctaatattaatgaggagagctttcaaattgatgtatttgccagtaccacagcgtagtggctgagagcctgtattctggagctggactgcctgggctggaacccgggctcctccacttccttgctgtgtaccttagtttctcatctgtaaatggtgttgataatagtagctgttttgtagggttgtcatgaggattaaacaagttaatactttagccctttataagaatagtatctgacatattttcttagtttcatactctatatgttttgatcttttccagagaaaattagaaaagcccttcctagttcagaagaccttgtaaagttagcaccagactttgacaagattgttgaaagccttagcttattgaaggacttttttacctcaggtaaggaagaagctgtttgatctaatttaaaaattt

SEQ ID NO: 473890 - DNA, 557 bp, Homo sapiens
gcatagactagaagaagaactggattttcataaggcactgctatgctgctttccctcactaatccatgtccctatgtcatagaagagttaaaagaaataacaagaaagaagttacagacatgcaacctgccccttagaaaggggcagtttcacacgagggaacttgctgaactcccttcagtacacacgagggaacttgctgaccgactcactggtagttgcatgtttaagttcacactttacttcattggacaaaaggatctaaggtcacttttggaaattcccacaataatgcagatgaagaaatcaaagcccaagcccgtagcaccagcaccagcagagcagttggagcagcggtggctccacagagcagagctgggccctgactggaagcagaggccactgaaatgtctgctaaccctttgcttagcagaaagagtggaggaaacacctctggagaataaattgtacttgtgtcagcataggcagatgggagttcggggttgagaagaggacgtacaaaagcccagggtagcatagagtgtatttatagaccc

SEQ ID NO: 473891 - DNA, 505 bp, Homo sapiens
gtaaactcattttattacccaccgggagaatgcatctcaactgcgctctccctgggcagccaatgccagaggatcaggccctacagctgactcttcttctaccagctggacactttgatccagttttcctggtcctctttgaggtttctccccaaccaggcgttgacaactggtggaagacgatggtgataatgatttcaccacttttcattttcagtgctcttctacgttcctgtctgacctgtggtccacaacctccctgccaggtggagagtgctgcttgctctgcagctggtccaagaagcttcacctcccaggagcaccagacagatgatctcctgtttacagtggttccaggagcaccaaccccaaggatgagttataagcaggtctctaaagagattttaggagaagctgctaaaatggtggcaaagctctttagaaacatagaagtatgaacctttttatggggagaacttataagagtttggagaggtcttccagg

SEQ ID NO: 473892 - DNA, 725 bp, Homo sapiens
tcccagctctgatgacctgtcagcagccgcaggacctgcgcttaaaggcgcctctccaggcctggctcagggtggggctcctcgtgctcagcaccctggtcaaggttagggctgggtgtgcgctggaggcttggagtgccagggcacccagtgaagagcgaatgaatgaacgagtgaacaccggactgggggcctgcagacggttcttcgcaggtgagagctcccgcaggcagcttctccccggagtctggcgtgagaaaacaggagctgtagggaggagtcggacaggtccccaggcccagcaactataccaggtgaggcaggaatgtggcctcgtgttgaccagattccacagccacgggcttccatccctcttctctgcttgctttaagactaaccaccctggcttcaagagaagccacatgaaagtcttcagcagctttgcgctgtttctgctgcagcacctctcagggcagactggagaatcagggagtcttgtctggaaaaacgagacaggctgggcctgacacattgatttctggttcaagtttcccagtgaaatgtgaaggaggaattttccacttcttgtcctgattcaccttggcgaaccagtctttggagtcccagactgaggcagggaaaatctgtttcaggtggattttccagccagacttatacccaaagtgagtggtcctctatgctgttcccagtatcagctgtctccc

SEQ ID NO: 473893 - DNA, 701 bp, Homo sapiens
ctacacggaaagcaaatccaaaatggaagacagcttggcaccatgggagaaactgttcagtggctgtggcatggctttgacaaggataagaacactgggcagcccagttcctgggcccctggggagtgcctgtgggtgcacaatggctctgctactgaagtggttgaggttgctggccatggcatttgcaagccccaggtgggccaaccccctgggaagcttgcacaggtttgtggtggttctactgctggagggggcagggtcactggcagctggcaatggcaggcgccgcggcgggacacaggaaaacaattagaaatgatggaagatgatgataaacagaagtttaaacaactttacagggagccaggctgcctgggaatgctgaggatcagccagagggcagagcacagggtgcagagtgaggacctccaggtttgggagtcggctgctgagctccaggaggttccagagacaccgctgcactgggtcttggttctcagcaccttcaccaagggtcaaggtgaaggctgaggcatgttcaaagtccactaaagatgagataaaatggaatgaatgtgggctttggaatctgcaaaccaactcagtctctcagctggggtctttggcaggttcattaacctctctgagctcattcttgtgttgtgagaagagccgtggcggggggttagaaacttttc

SEQ ID NO: 473894 - DNA, 875 bp, Homo sapiens
tgatatgaagttaaaaccagtggcaaaccacagttgacatgtgggaaatcaaaagggaacctgccaagataatctttgttctcttgttcagtccacaactactgggcaatatattcaaaaaaggatgcatgagatactacacagacaggagaggacctctgagccagcatgaacccaatccatcagggctgcccctgggctttgcctcatgtgccatctccaaatcagctgtaatatgttttcttaccagcaacatcagtcctgaaattcttaacctgacctgcccacaaaggcacctgtttagacccttctggtttctctctctgtggacttgcctcaacatttacccctgtcaccctgcacttctaatctggctcttctttggatgcccctccctggccacagctctgtcttgggccagtcctctgtgggggctctcagatttctggaaccctcactttcagcatagccccctgcagaaatgattgaacactgggtcagaagcatagcctagtagatagaatagatttcctaatcctatggaggaaaaacaggcaaaataagtaacttacagaagacaaattgactttttatcagacaataaatattaccggcagcaccacataattgtgaactcatttgcaaaagcaaaacagttgacaagcaccagcatggattatagctctgatgtttttccacagatatatttggactattacgttatgttcacttttttaaaagattctgccaaattatagtatagacaagacattaatgtctaatattagaagatatagccaagggaataagtggtaataaaatttgatagcatgtttattactgatgcaaagaaacacttgtgtttattccagaaa

SEQ ID NO: 473895 - DNA, 766 bp, Homo sapiens
gtgttgctcccagatgggccatcaaccttccctgcttttcttcattctctgtgggtcaagttaaggtaagacatggagatgtacagatgccaagagggacctggtggtctgcagtgtatcagtgctctacttctactctgtgtccagttcatcttcccaatgctgcccctacagaccagcagctgcccctacagaccagcccctacagaccctaaccccattgttcagtcctggacttcaggcccacagagaggaaccaacaagtcaatgtggaagatagaactaaccaagcaaccacctacaatgtgggaagggcatcaaagaggtatgaacacaaagcaacgggaactcagagaagggagtaattcactctgcccagggcagccacatcctgagagctaccctgcaggaaggccattcctgctgataattcgcgaggaaaaaatgcatttaactggaagcctcatttatgaagggttctttctgtgtgacagaggacagtatgactatactttattaaacattttgaaaagcatttatcttagtttcactaaagattaaggctgtctttccaggtcttgttgtctcagtttttaagactacaaaacccagaaagagaaagtaccaacttcacaccaacattttcaaacaagaagcccatcaaaggttaaacaagagtcatgtgttcaagtttgcattttaagagcattcataaagaggcacattaagaatgtacttaaagtaatgaaccattaagagtctgtgt

SEQ ID NO: 473896 - DNA, 498 bp, Homo sapiens
atttgtgatttaatgacgtagtgtttttcagttcaagaaactatgaggaacagaccaaagccaagagctagggaagggaaaggagaagactgctttgacataggcactgggctaaaatcatatgaatctgattattatattagtctaacatcatatgagtcagataaggaagatgagaatgagaatgttcaaatggtttatccagagacagctaatacaactagaggaatgcagctgccttactccccatttggcttagcaactgatagcagcttcttagagcatgagctattaaaggtcttcaaggtgatatcaggtctcagcagcagacagtgtcatgattggtcatgggttatggtgcagaggactggcagtagtacccatgccatttatttgatccatctggaagcaacaactgtattagtcagggttctaaagagaaacagcaacaataagatagattagggtgcactggtgaccctatcctacaaactccag

SEQ ID NO: 473897 - DNA, 1621 bp, Homo sapiens
gtctttgctcaaggtttaccctgacccccagctgaacagctccagtctacagctcccagcatgagtgatgcagaagacgggtgatttctgcatttccaactgaggtaccgggttcatctcactggggagtgctggacagtgggtgcaggacagtgggtgcagcacactgtgcgtgagctgaagcagggcaaggcatcgcctcacccaggaagcacaaggggtcagggaattccctttcctagtcaaagaaaggggtgacagacagcacctggaaaaccgggccactcccaccctaatactgtgcttttccaatgggcttaacaaatggcacaccaggaggttatatcccgcacctggctcggagggtcctatgcccacggagcctcactcattgctagcacagcagtctgagatcaaactgcaaggcggcagcgaggctggggtaagggcgcctgccattgctgaggcttgagtaggtaaacaaagcagccaggaagctcgaactgggtggagcccaccacagctcaaggaggcctgcctgcctctgtaggctccacctctgggggcagggcacagacaaacaaaaggcagcataacctctgcagaattaaatgtccctgtctgacagctttgaagagcgtagtggttctcccagcatgcagcttgagatctgagaatgggcagactgcctcctcaagtgggtccctgacccctgacccccgagtagcctaactgggagttaggctacccccagtaagggcagactgacacctcacatggccaggtactcctctgagacaaaacttccagaggaacgatcaggcagcaacatttgctgttcaccaatatccgctgttctgcagcctccgctgctgatacccagacaaacagggtctggagtggacctcctgtgaactccaacagacctgcagctgagggtcctgactattagaaggaaaactaacaaacagaaaggacatccacaccaaaaacccatctgtaggtcaccatcatcaaagaccaaagatagataaaaccacaaagatggggaaaaaacagagcagaaagaccggaaactctaaaaatcagagcgcctctacttctccaaaggaacgcagctcctcaccagcaacggaacaaagctggatggagaatgactttgacaaaccaaatctacatctgattggtgtacctgaaagtgacagggagaatggaaccaagttggaaaacactctgcaggatattatcctggagaacttccccaatctagcaaggcaggccaacattcaaattcaggaaatacagagaatgccacaaagatactccttgagaagagcaactccaagacacataattgtcagattcaccaaagttgaaatgaaggaaaaaatgttaagggcagccagagagaaaggtcgggttacccacaaagggaagcccatcagactaacgctgatatctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgt

SEQ ID NO: 473898 - DNA, 1026 bp, Homo sapiens
gactgacaaatagagtttacgtacatgccactatgcaagggactcaggtcacattcctcttcattttgggctcccttataccctatagtcagacaatggccccacttttatttctcaaataatgcagggaatcagtgctttccagaccatgcatgtggcttggcatcacaatcttctgggaacgtggagagagccaaccaaaccataaaaaagtacctcatgaaggagacactcaccctaatcttatgcctggagactgggtatgtcgtcccaaaggacaaaaagccactggagcctctttggattagatcataccaagttctccttatgaccccaacagctgtaaatctccaaggcctctctgtggatttacctcttcagggtcaaggtggcaccagcacccaacaaagaacacttaaacctgtgaaccagttggagactttcatctgttgttcagaattcagcagtttcaccttcgaataatgctgcaaatggaatatcagtctctccccagtgatgctcactaactgaacaaatctcccttggattcagctggacaccagtttcaccttgacatgctccccatctctgatgagtcgcttcctccagcaagatccaatatcctaagtcccacagtccaggacaatgacccacaggatctcccgacagaccaacagccatagttagggtcaactctacacccaaggccagcaggaagtagttggaggataagaccactgccctagtgccaaagacttgtcattgttgttctgtcagaggggaaaaggggagtctgaggaaggattcccaggtgggggagggtcccctgtggggagaaacaataaacagttattctgagagatggctaatcacaaacaacccatggtcacagtgaccttgttccacacatagccccctccagcatgaccctataaatcttccctccagtccctcatctcttggcagatagccccttctctattgtactgtctgttgtaaccttgcaatgtatttcatactttctct

SEQ ID NO: 473899 - DNA, 952 bp, Homo sapiens
cctcggccttcacatttgctgtttcttctacctgaaaacttgctcctcacatcttaatatggctcacccttgccttctttcagatgttgcttcctcaccggctggatgctgctcatccatattgagggcagatcttctgcacttggtccacctggattcacacaccaatctcctctggaaatacctaacagacaccgtccccccaccccccaccaatgatactttatcagtactaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatgctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgagggtcacttccggagccagcacaagagggttgtggagcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattgtggtctttctgtgttaataaaatgtgctctgaataacagaagtgggcctgtattctgattacttctttgtgctggtgatgacagcacaaaaattcaaaaatgaattatagtt

SEQ ID NO: 473900 - DNA, 1605 bp, Homo sapiens
cctgagccttaatgcttcaaggtgtagaccttttagtcgatgctgtagccattacaatggggccaaagggaagaacagtgattattgagcagagctggggaagtcccaaagtaacaaaagatggtgtgactgttgcaaagtcaattgacttaaagaataaatataaaaatattgaagctaaactcgttcaagatgttgccaataacacaaatgaagaggctggggatggccctaccactgctactgtactggcatgctctattgccaaggaaggctttgagaagattagcaaaggtgctaatccagtggaaatcaggagaggtgtgatgttagctgttgatgctgtaatagctgaacctaaaaagcagtctaaacctgtgaccacccctgaagaaattgcgcaggttgctacaatttctgcaagtggagacaaagaaattggccatatcctctctgatgcagtgaaaaaggtgggaagaaagggtgtcataacagtaaaggatgggaaaacactgaatgatggattagaaattattgaaagcttgaagtttgatcgaggctatgtttctccatactttattaatacatcaaaaggtcagaaatgtgaattccaggaggcatatgttctgttgagtgaaaagaaaatttctagtgtccagtccattgtacctgctcttgaaactgccagtgctcaccgtaagcctttggtcataatcactgaagatgttggtggagaagctctaagtacacttgtcttgaacagcctaaagattgattttcaggttgtggcagtcaaggctccagggttttgtgacaaagaaccagctcaaagatatggctcaatgaccattgctaagaatgcaggtgttgaaggatcttcgatagttgagaaaattatgcaacgttcctcagaagttggttatgatgctactagggtcggagattttgtgaatatggtgggaaaaggaattattgacccaagaaaggttgtgagaactgctttattggatgctgctggtgtggcctctctgttaactacagcagaagttgtagtcacagaaattcctaaagaagagaaggaccctggaatgggtgcaatgggtggaatgggatgtggtatgggagggggcatgttgtaactcctagaatagtgctttacttttattaatgaactgtgacaggaagtcaaggcagtgttcctcaccaataacttcagagaagtcagttggagaaaatgaagaaaaggctggctgatgtttaagaaatcattataaccatcagttactggttcagttgacaaaatatataatggtttactgctgtcattgtccatgcctatcaatactttattttgtatttttgaataaaaagacatttgtacattcctgatattgggtacaagagtcatgtaccaatgtactgccttcaacttaaataactgaggcatttttactactattctgttaaaatcaggattttagtgcttgccaccaccagatgagaagttaagcagactttctgtggagggtgagaataattatgtacaaagtagagaaatatccaattatgtgacaacctttgtgtaataaaaaattgtttaaagtt

SEQ ID NO: 473901 - DNA, 595 bp, Homo sapiens
tgtctgattgacgacatgcatttgttgtgttactcacggcgcttcaacttgagggatgctgttaatttattcctcattttggtggaacacaagttatagcggcaacccgaaaaggttgcagggaggttctgtgaagactaagagaagcgaggaagctgcagaagaaaagtctgaagctggcagaggttggtgcatgaggttgaaggaaagaagccttctccataatataaaagtacaagatgatgcagcaaatcctgatgtagaagctgcagcaaattccaataagaacatttgtgattcatggaaggaggtcaaaatatcaacgttaaaaggagtttggaagaagttgattccaaccttcatggatgactttgagggattcaagacttcagatgaggaagtaactgaagctgtggtggaaagtgtgagaattaaagtagagcctgaagatttgaacaaagaaatgtggactttatactataagaagaatgaaccttatgacgatagagaggaagaattgggtccctccattatactgtgaaagttgatcatactaattaggtcattcttgtcatacccagctaaatcagagtca

SEQ ID NO: 473902 - DNA, 1681 bp, Homo sapiens
gactgtggtgttattaatacacgcacacggatatttactgcagtgctgttcacaatagcaaagacttggaaccaacccaaatgcccaacaaggatagactgaaaaaagaaaacgggtacatatacaccatggaatactatgaagccataaaaagaaatgagatcatgtccttttgttacgggtggatctttgttcttagagctcccaaggtggtggcggctgctcccaagacggcagcaagccttttgttctctcacctggggttcttggcctcacagattccaaggaatggaaccttgggccatgcggtgagtgttatagctctattggaagccgtgggtcatggaagagaactgtggaacccagcgactagagttcagctcgatgaggacgaacctgggcacttagccctgcaggaacaatggcgagccttcagtgtgatcaggaactgtgatgggtgcctcactggatcagaagcacagcagacaccctgtcggatccggagcggtggaagtcagcagcaggtctgtgatggcagtgaacagcagtggtggacgacactggctacatggcaagcttacctaactatgggcttacttagaagctccagaactgaaactctctctgcccaggagattgcctcagctgatggcagtcaatttacatcctcaaggatgcccatgacagtactccatcccacctggagagtatctcagattatggccactttaaaacctagcactacctgtgatgatgccagctggaccacctggtagataaggcactgaatttaaaatataaatcccttactgtggctcagagtgtcctgcataactgagaggtgaagccagctgagcttctggatcgggtggggacttggagaacttttgcgtctagctaaaggattgtaaacacaccaatcagcactctgtaaaaatgcaccaatcagtgctctgtgtctagctaaaggattgtaaatacaccaatcagcactctgtaaaaataaaccaatcagcgctctgtgtctagctaaaggattgtaaacgcaccaatcaaccctctgtaaaatggaccaatcagcactctgtaaaatggaccaatcagctctctgtaaaatggaccaatcagcaggacgtggatccagcattatatattaaacaagctaattagttaaaaggcatttcaggaatatattagaaaatgtagaaacaaactccaagtgttttcccttgtttcttttaattgctatccccatactctgttttgtccaatattttcacaacttcaacagtcatctctgtttacgtgatttcaagtactatactttcagcttcaacatttttccaactactgatactgcctgttaaatatcttcactttgatgtttgctgagccttgttctaaacactagcacttgctcccaataaaatgtcaataccacagatatattgaatgtccctatatgtatggtgaaagccagtctttaaggtctgagatttttcctctcttggtctattctgcttttagtacttgtgattgcatcatgaaattcttgcgtgtgtttttcagctctgtcagattctctgaaaccacttggttagctgtcacacccttctatgaggcagtttcccagttactcattctgacacttgaatcccactttagaaattatgatttaatc

SEQ ID NO: 473903 - DNA, 564 bp, Homo sapiens
tcaagatatgcttagtgttgaccaagtaagccagaaacagaagacaatgagtatattgttaggctgccataacaacacaatgccacagactgggtggcttaaattacagaaatttattttctcacagttctgggatgctaaaagtccaagatcaaggtgccattggcattggtgtcgggacctccagaatcctagctgcaagagaccccacaagctccacgacacttgggtttgcaaggagggaagtttggagaggcagcaggggcaggactctagcttgaagaaccaaactgaactgatagagctgaacaactcactacaagaattttgtaatacagttgctagtattgacagcagaatagaccaacctgaggaaagaattccagaggtcgaagactggttcttcgaatcaactgaatcagacaaaaataaagataaaacaagacaaagaatgaacaaagcctccaataaatataaaattatgtaaagagaccaaatctatgactcattggcatctctgaaaaagggagagagaaagcaagcaacttggaaaacatattggac

SEQ ID NO: 473904 - DNA, 672 bp, Homo sapiens
tttcctgacacatacacaaggattcttgctgtggccattggtagaagcatccgtactatggagtggtctgagctccaaggttgcaaaagcctatttcattttgtcgaccggcagcttctgagcataatatgtgaagaggctaatggattttacggttatataaccactgttgaacctcctttgctggtgatggttgcagtggaaattgttgacaaatgctctgatcctgggcattcttcagtagagctcaccagatttccagacatattaattataggtcagaagaaaggcatgttaaaaggtccttactaccagagtcctatggagcttcccctctcttaccccttccacccatatttgtacttttcctttattaaagtaaaaactgatcaaaagggcaactatagttacaactgtttgaatgtcagagcatttgatgagtcaagacattgtagctcataaccattccttgagacatcgaagattttcattaactgtctaaatttgtttttgtgtgtgatcctcagaatggctacagatctaagcatgttcagatgaagcaggtgttgtgactatatacattagtatacggtgcactaaagattcttgaaatccctgtaaaaaacgtcctaagatatttggaacatattaataattctatgcaaattttaa

SEQ ID NO: 473905 - DNA, 747 bp, Homo sapiens
attggatttaaaacttgcattgggcctgtagcctctttgttttggccaatttctcccatttggaatgggtgtatttacccaatgtctgcaccctcattgtatctaggaaaaattctatgttgcatgagacgttcctggagatttgtcaatgccctcggtccatggtctgtttctcttcatcagaatcctggtgctgctttccttgatgatctgaagaatccctgtgagctgaagcccgaggacttgatgcaaacctcaccactaaagcagaccatgctgggcatcaagaacctttcttggaactcaaaatctgagcatcaactctctttgcgtttatattacaattataccattcttccccccagcaatggatgcctctggatgaataaagggaaggttttggatgaggaaatgcaaaagaaaaagcactttgatttatttcaagatgttttctcaatacagtctcaatcattcccacctattatccagcaaaatatgctcctagaagctgttgtgcttgccttccattttgtgcatggagccacagaaaagagactccttgtcacacacatttcatccataagccgtgacctccttgatttgacccttgctgcaggctgtttctcctaacagttggctgcctttgttatttctattaagcttttacattttcttaagtttgattcactctcttgctgccgtgttatgattttgtcttctccctgttattcatcttcagacaattct

SEQ ID NO: 473906 - DNA, 586 bp, Homo sapiens
gacatcaacaaaaaggacatctacaccaaaaccccatctgtaggtctgtaggtcaccagcatcaaagaccaaaggtagataaaaccacaaagatggggaaaaaccagagcagaaaagctgaaaattctaaaaatcagagtgcctcttctcctctaaaggattgcagctccttgccagcaacggaacacagctggatggagaatgactttgacgagttgacagaagtaggcttcagaagatcggtaataacaaacttctctgaggtaaagaagcacgttctaacccatcacaaggaagttaaaaaccttgaaaaaagaataaacagtgtagagaagatcttaaatgacctgatggagctgaaaaccatggcacaagaacgttgtgacacatgcacaagcttcaatagccaattcgatcaagtggaagaaagggtatcagtgattgaaaatcaaattaatggaataaagcgagagacaagtttagagaaaaaagtgtaaaaagaaatgaacaaagcctccaagaaatataggatgacgtgaaaagaccaaatctatgtttgattggtgtaactgaaagtgatggggag

SEQ ID NO: 473907 - DNA, 1510 bp, Homo sapiens
tacagaagattttctttttcttcagtctcttctgagcatacacgttgcctatggtcagggcagctggcagcactggagggacagtcacggtgaggaggatcagggccatggtcacagtatcttttggaggaacctgggagaggacagacattttcatacaggatagcccagcacagcagactgccacccttcctagtgccaaaggaatgagcacattgtctcctactgcagagcaaaggagacctttgatccctactcccaacacggaagagtttgaccctaaggactcagccttgtctagcgctgaaccagtgcagatagaggcagccaacagagccacaggttctgacccacaagaagttggggaggccttcattgtgtcacgtcatgtaaaagactgggactcaggaagtgtttgcggaatcatccagatttggtgccacatttggtatgggaaacaagaggagttggagatgttattaagagaccagcatgatggtgatgatattaacagagaaatttttgaagtccttcatgagtttgatcatggattgagagactatctgagagtaagaacaaagtttttctgctcaccatgcctttcctctactgcatttctagctaaatcaaagtcctcgtactgggagttggaagagaatccaacgggacttagatgtggtgtgtccctgagagaagaggtgtgcaccacagtagaacacgggaacatgcaacaaggttgtggaaacagcgcgaacagcaccaggatctgctgccctgtccaggtaaataggcctcagacagctcagagtggagtgggagcagcaggaagaagagctgccctccatcagacccctctccctgatgtcttgcacatcttaggacagtcagacaagggtgaggaagaccacctaactgatggggacaactgtctgactcatattagatattcacactggacacttttaaggatggcaaaatttggaaccgacataaaaattaagtgtagttataaaataaaggataacacaggggacagaaaggcagaggtgagagatgatttcatccatacagttccccagactgactgttggggcaacatcagcgagagaaagttccatgctgggccagccctggaagggcatgcatgtgacaaatccctgaaggacaagcacccaaaccttcagggaccacataggggccaactggaggcaaacaaagccatcaaagaagcacagaaagcacagagagaaagagaaaaattgatggggaaagtgtcccacttaagtccgtgtctctgggacaatgactaaacctttgtctttagatccttagttccttgcaaagtacctatttgttatttaacaaatcaatgaatatattaacttactcatttactctagaattatgtattgagctcctaccaaagaatcaggcactgttctaggtactgcagatatagtggtgaataacacaactaaccgagcaagcaaaatcctcatctccagggctg

SEQ ID NO: 473908 - DNA, 595 bp, Homo sapiens
tcctagcaaattaatcaaacccatggagggggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagtgcgtgcctttctgttttctattttgaaagccatgatcgtgtcttctgtattgcctctgtggcataactctgtggctggtattatatttcagaaggacgaatttcaaagatatatgaggaagaaggtattctgcctctacttatccacactgaagtttcctgtaagcaagaagtgggaagaatccctggtggctgaccgccactctgtcataaaccaagccttaataaagccagaattaaaagtaagttacttgaagggtatggtgttatgcatgtttacagagaaagcataaaataactgtttattaaatgaaagttccgaatatcacacttttggaatgggaatgacagctatgtatcaaagaaagtgagactggctgggcatggtc

SEQ ID NO: 473909 - DNA, 700 bp, Homo sapiens
ccgcccgctgaccctccagccccaccatggcagtgtatccagtgtcaactacctggagacttgccagggctataagtcttgtggccctgacttcctggctcagcagccctgtgaacaccatgagaacacatgccactccccatcttcccaagagccttgacgccttctgcatgggcatgtcttccaccgcaagcaatagaaactgtgtctggttgactggagcaagaattggagaggatgtgggtagctctcagaatcaaagaaaaagtgcaaaatcaacccataagagccagcgtgcagacagtcccctcttaggaactgagggacactcctcagggagccatggcagcagcacagcagatcaaaatcattgtatctgaaaatagtaatgttttatgtcttctctcttaataattatgtattctattttgtttttattttattgcactactaaaaaattttacaataaaaaagtgacagctgatacctctatttatttcctggacttgatgagcgtgtttctcaggttctgctgtaaagcacaatgtgtaaagtatgtaaaatggtaatacttggcatacagtacaccattcccccagttgtacttttcatccaggtgtgcccttcccaccagatgctcctccccctggtgtgcccttcccctgggtgtacttgactcactttccttcagtaggtttcc

SEQ ID NO: 473910 - DNA, 1108 bp, Homo sapiens
aggaggaggttatggaggatggtggagatggtggtggtggtgaaggcgaagttggtgatggagttgatgaaagtgtaggcactggaaatgaagctggtggtggaggagttggtggaaatggaggtggtggtggaggaggaggaggaggaagaagtggaggtggtagtggaggaggaggaggaagaagtggaggtggtggaaaaggaggaggaggaggtagtgatgaagtagaggtagtagaggtagtggtggtggtggtggaggaagaaaaggtgatggtggtagtggtgatgatggaggtggtgatggaggaggagatgatggtggaggaggaggtgatggtggaggagaaggtgatggtggaggaggaggtgatggtggaggaggaggaggagatgatggtggaggaggaagaggagatgatggtggaggaggaagaggagatgatgctggaggaggaggtgacggtggaggaggaggtgatggtggaggaggaggtgatggtggaggaggaaggagatgatggtggaggaggaagaggagatgatggtggaggaggaggaggagatgatggtggaggaggtggaggaggaggaaaaaaggtaatggtggtggaggagaaggaggtggtggaggtggaggagaaggaggtggtggaggtggagaaggaggtggtggagaaggaggaggaggaggaggtggagaaggaggaggaggtggtggaggtggaagaggaggtgatggtggtgatggtgcagctcgccgcgatgcacgaggaggcggtggtgctgccagccatgatggtcacatgcggtcgacgaggatcaggaagacgaggagcaggatcaggtcgtactgctctagcgatggtcgaggtcctgctgacccaggcggagtggcacaatgatcagctcgtgttcaaggagatcatcatactgctgcacgaccaggctctggtcctgtcggggcacgccgacgtcgcgactctcctgctcttgcagcggacgatggctatcgccatgattgttgaccaggtcgtcatgcctatcgctcatgtgatatggctggttgagcagctgtccttcatcgcggacaggctgtgactcta

SEQ ID NO: 473911 - DNA, 1052 bp, Homo sapiens
ggcccggccggcaacgactaatggattcaacactagccaggggtgttctttccttcatccccttttgttttctttatttctggcttttagtatgataaagccctctcttattgcagaaaaaacagaactcaaaatagcagagtctcgagaaggctatagacccatcgccaaacactcgtcagtgttattctttagcattgcagacctggctaatattgatcccatgtatcagtactctctcacgtggtttgtgaacctttatatcaactctattcatgacagcaaacaagacatagggtttattgaggactctttttttaaacttttacattcaggggtacatgtgcaggtttgttatacagacacagagacaaagtatagagaaacaacagtgggtccaggggaccggtactcagcacaccaaggacctgcaccggcatcgacctctgagttccctcagtttttattgattattactttcattattttagcaaaaaggagtgtagaaggagaacagggtgataataaggagaagatcagcaaaaaacatgtgtcgggctgggggacggtcaggtctttctcatcccacaaggccatatttcagactatcacatggggagaaaccttggacaatacccagctttcaagggcagaggcccctgcggctttccgcagtgcattgtgcccctggtttgctgagactagagaatgccgatgacttttaccaagtatactgcttgtaaacattttgttaacaaggcaagtcctgcacagccttggatcccttaaaccttgattttatacaacacatgtttttgtgagctccagttgaacacagttataataactgttttaaaattagtgactactaattccatcatttctggatctgtttctattgactgattttacttttagttatacatgataatttcctgctttttggcatgtctaataatgtctgattggatactggacattgtgaatatcacattgttgatgagttagatttcattttcctataaagattgttgagttctgtcctgctagtt

SEQ ID NO: 473912 - DNA, 572 bp, Homo sapiens
aatgtggttggagagcagtcaggtgtggcggaatggtgcaagcatccactcctgcagcactggtggcttttctagcacctgcattgcaggcagcttctccagtgttcagctcctacaaacacagcttccccagtgccatgttcctacagcagctggctcctgcagtgcatggcagccagaagtgcccgtggccagcagcttcccctggcactccttttgaacagtttcatagcagagtgcctccagagaaacaccttcccatgaaagctttccctggcactatactgggtggatttgtgacaagttctgacacggaagcctcacagcaacttctctgccattcagtgagccttttgcgagacaaggtgggtcccctggaccacgatgctcctcaagaaggacctgggtatgggaaaaaggacttaaatctagtgattgttgttacatcttaataaggtttaaaatacaaaaaaaaaaaatcttaatgaggcttaatatttatacagactttttagaggtatgccagtttttataattaaaaaaaaacttaagtgcattcttagttgtcaatc

SEQ ID NO: 473913 - DNA, 1477 bp, Homo sapiens
tccagtgcaattctatgaaagtctgtgtgaggcttactgtatgtacactccttttgatccagatagccctgaaaatcagcgcatgattaacatggccttagttaatcaaagcgcagaagatatcaggagaaaactgcagaaacaggctgggtttgtgggtatgaatacctcacagttactggaaatagccgatcaagggtttatgaatagagatgcaacgagccgcagagaaagccataaggaaggcgaacgccaggctaggcaaaatgccaacttactggccatggccattaggggaattcccccagaaggagagggaaaggggggttccgggaagaatacccaggaggccctggctcgagacctgcaaaagtttcctgctaaacacctaggctgcgtcttgctcctgtacgtggatgaccttctgctgggacactccacagcagtctggtgtgcaaaagggatggatgccctgcttcggcacctggaggactatgggtataaggtgtccaagaagaaagctcacgtctgcagacagcagccatgggcatcagtagactgggagttatatgtggactggagcagcttcatcaacccacaaggagaaagatgtgcaggatatgcggtggtaactttggatgctgtcattgaagccaaacctttgccacagggcacttcagcccagaagactgagctcattgctttaacaagggctcaagaactcagtgaagcatacaagtttatggagctgcttcttttgaggatcttcacagaaaatgcttttgaggatttcacagaaatgctgaaatgtggaggtaacacatatttgctggttcttgtgtgtacttactctgggtgggtggaggcttatctaacacgaactgaaaaggcctacgaggtgatcacgtgtggatcaaggactggaacagagcccctttgcggccatggtggaaaggacctcagaccgttatctggaccacccccacggctgtaaaggtagaaggaatcccagcctggatccaccacagccatgtgaaacctgcagccgctgaaacctgggaggcaaaaccaagcctggacaatccctgcaaagtgactctgaggaggacgacaagccctgctccagtcacacccggaaactggtctacacatggctgaagcatgaggagaatcatcatgggactcatttttcttataatttggacttgtatagtaaaaacttccactgatattccccgcagggaggactgctctcagtgtatacatcaggttactcgaggtaaggcaacaagttaaaacaatctttctgttctatagttactatgaatgcttaggatctttaaaaggaacatgtttatataatgacactcagtacaaagtatgtagcccgggaaacgacagaccagatatagtgttatgagcccctctgactctcccatgttcacagtttttgaaaaaaactaaaggctgaagggga

SEQ ID NO: 473914 - DNA, 1537 bp, Homo sapiens
agtcaactctttttcttctgcacatcccatgaattgctgtcactcactgtttgccctgaggataactgacttatgccctctgggtagaaagggcactgaaaagcagccacgtggattgcagcaatatcagttactgtgtgcctgctctgtgccagggttaacatggctgtatgaatggcatcttcaagttccagatcttcattttatcttttctcaagggaagtttccccattcacatagttctttcccactgctgtggctttccaggccaagtaagctccagatggatctgactgaaataaatatggttgtccctcattccaaccacaaacaagtaaagaaactccaaatggacaaacaccacctgactgagtatattcttgcattacagaagctactctccgcactagctgagctgtgggaatgggcacttggtacacaagatagtattgttgagctagtttcgagctgtgtgcacaagcactttgttatctgggcccacgccactgtacaccaaacctatgtgcttggtaattggttccactttgtctacacttcgctcatcatacagaatgaatttctgttttttctcggttgctaataccacaccatttgccgctttaattcccactgacagggctcctccagctacagcagccaaagcatattcaatccggacaagtttatcagacgggctgaatgtagtcagcgaaaagccgtaccgcgctccgccatctttacccgaagagccaaagcacaagttcagggaggtgtccactgtctctcaaatcaaccaccagactttagaggggcacaagattgttaacgcgcaaaggtggttgaggaattggaaaggttgactggggctgcaccttggaatttattttgtcttggataatatgtaacattaacagagagcagaagctgattaaagtatcttggtgccaaagggtagttctgtcatatcaaccaattgtaaacagttggtttgcaaattccaaaacaattataataattatgggacaatttgaactttgaaaactgactgaatattcaattatattaaagaattatttaaattttgggtgtaataatggtatcatgattatgttaaaagtcatttctcggtgcagcgcaccagcatggcacatgtatacatatgtaactaacctgcacattgtgcacatgtaccctaaaacttaaagtataataataataaaaaaagtcatttctcatctttgagagatatgttctcaagtatatatgaataaaatgatatgagcctaaaatttgtttcaaaataacatgggagagagaaaggatgttaggaggaacttttccagcactggctactcctcacttctttgcacaggtcaggcaatcattacacttgctccttctggagctgtttattcctgaagctggaaactgcccaaggaaaagtcttcaaaacgaaactgacctgaacggaactgaactgaactagataaccactaacactgggcagactccagttaccctggttttaataattagt

SEQ ID NO: 473915 - DNA, 852 bp, Homo sapiens
cccaccatctcagttcagctctgagaggagtgcagacacacctatgcaagctggccactctctgtccttgggaaaatctcaaattgccactgataatgttgtcctgggtcatgaaggcagaggacctccccaacagtttggcagtttggcagattgtcaacaaagtaaaaggagcagagcagcagtccaatccaccctttctgtagggctccaagttctttggggtcaatctcttccagactcactgcttttcttttctgcatcccaacttcttactgtgggcactccaacagatcctggttctgttccctcagttttccatacagagcttgtccattcacttacaaggcagcagtctagttttgaccatggagatgaggacaacatcctggcatatgtcaatgcaatgagatgggctagggccctgatacctccaaatgacagaatctaccagaaatcagttggcaatgaagtctgagaaacatcattttcaagttactactcccagtagttctagggagaatatagagataagtgatcatttgatatttgaaatggattttatcatattatagtttaatcaatatttgaatttagatttctatttgtatgtaattaatatacaaatagaaactattgaaatgacatttatattaattatacactatttagcaatattaacacatagaattttaattatcttccccattaaagttagtcactgctttataactaagttactaaactgatggagggtggagaggagggatcacttaaaaaatttttatatatgttattgcacttaaggatttctaggtactttacaactgttttgcaattcagtttgaaaat

SEQ ID NO: 473916 - DNA, 622 bp, Homo sapiens
cttccgtggagcctgtagctcctttcttttggctgatttctcccttttagaatgggaatgtttactcagtgcttatacctccgattgtatcttgaaaaaatcagtaaaaaaatgaatgttagaaagtatgaaaacacatggaaattaaacaatatgctcctaaatgaccaaatggtcaatgaagaaattaaggaaattaaaaaatttcttgaaataaatgaaaatggaaacataacataccaaaatctatgggatacggcaaaagtagtactaagagggaagtttataacaataagatcctatatcaaaaatgtagaaagacttcaaatcaacaaaccaacaatgcacctcatggaactagaaaagcaagaacaaactaaactcagaactagtagaaagaaagaaataatagagatcagagcagaaataaatgtaactgagaccaaaacaaaacaaaacagttcagaagcagccttatggagaggtctatgtggctagaaactaaaggccaatagccagcagagaattggtgccttctgccaagagccaggtctcaacagtgggcttaaaatattcagtaacccatgctctaaacagatgtactgttatcaaggctttgttg

SEQ ID NO: 473917 - DNA, 1314 bp, Homo sapiens
ggcactttggggggccaaggcaggcggctgggaggtggaggttctcagagcccccactgccaccaagccagccccaggcacgtcccctctgttgatttctggagtctgcctgaccagagagaccacagctcatggaggccctagtttgtgtggttggaaaccccagcctgtttttccctcccatctgaactgcagttttaggctctctctttttcccgcccccttgactgactggggtttttctaccaggtcaggaaatagagaacacgccatcctgggatgctcccgaggcatgttcacatcagatacgcagaaggactgcaaggcccgaagggataatgggcaggcatattcactcctttaactatttcctcaaattgacgtggtcactgcggaaagctttccattgctggtggtgggtttgccggacacagaagctcataacatatgtaaaggaaagatcaaatgaaactaatgcaaaaagtgccttgtggcttaatggtttgcaaaagtccctctttacttccttaatcatgggccatggattctgctttggaaattgcaaggaaaataggctgtctgttgagatacagagcgtggggagagccccctgtgagggtgaaggtactgagttccatgttgggcagattgggtatgaaatatccaagagccgatgtcccatggattttggtactcaagagagggagctgggtttggtgtgtggaattgggctgagcagcattccagaacttagaatagaggaggtatcctagagagggtatgtgagaaaagcaaggacagacttgggacactcacagtccttctccagagtgatctttgaatccgagtaagaatcaagtcatcatctgcaatgcactccaggcctcggataatattactcagaggaggttaacacagaacaggcttgtgtttgacctgattgttaaagagtgtctcaagaaacctgacctgagcctccattatggcaaataaacctcttctcctggctgaatatgggggaagccacatgcaaattgctaacctgggggctggttcactcctgtggcttggccatgtacttccagtgttttccatcttggctgtttttgaactgaatgtgttcctcatgctggagaaaacatgtgtttgatgttattagaaacctgaacaattaaaatatgttggaaattactagaaattggagcagctggttttgaaatattctagccctaggtttcaatgagtaagttggcttccttgataagcagtagtattaaattccagcccccaaatttggcaaaggacttggctgct

SEQ ID NO: 473918 - DNA, 907 bp, Homo sapiens
ggcagcagtattttaatgagggaggaaatgagaaatatattcctccaaaggaccatgaataaagaacagcaggactttcttttaaaaaatgcttccgaaaatgaacttggagtttacctgaacacccaggaggctgaacttgcatatcagtgccctcggattggtggatgcagaaggcatcactatggcctgaatattggtgtctccaaagctcatgtgttggaaactaatactcaatgtgatagtattaagagatggggcctttgggaggtgaatgagattggtgcccctgaaaagaggcttgagggagtgccccttccctttctgccatgcgaggacacagcaacaaggcgtcacctaagaagcagagcaggaaccctcaccagacactgaatctacctaaacctttatcctggacttcccagcatccagaactggaagaaataagtttctgttgtttataaattacccaatctaacacattttgttacagcagtctgaacaaactgatataggagtattgggtattggatcctgggcttaatatgtatggtcttggtgcaaattttggcaagaacttaggcttatacaccgaaagagcaataatactttatttaaaatatatacaaaattattactttgaaacatatatattactgtccaacatacatcatataacactgattgatgtaaattttggtaccttcatttattcagttgtgatttcccttttgttcaaggctcctgaagaaaattatctgaaatgcccaccagaggggaggtgcccatgggcttggtccccttggtgacttggctgtgctgttgggcactactgaggccctagagccctgctccatggagctgaaggcaaatccccaccttgctgggggacctggggacacagaat

SEQ ID NO: 473919 - DNA, 655 bp, Homo sapiens
accacagactcggcacagacccatgccagtgtccacttccctacatcatctcttacctcgcccctctctgctccttccctcactttatttaggcttggggcgggaagtctcagaagtttctaatggagcatcccctgactcccaccatactgctacccatggagagaatttacggtttgggattgctggtgcaacgtacagcggctgcacaacaaggtggttcaaaaaccaacagtctgctgtacagccaagaagacccaatgattcatggctgatgaagaccaccagggagaaggattctctcctacttgggaagctctccatcagcactgggccagcccggtgccaggggttgggttaccagttaggtgccaggagtaacttcgacatgatcacagaagatacacatcagttaacacagcagcagctgtgtggctgtgcttccaagacacctgggtccacatgtcttcaacggtgcccacgtactgagcgcaagctaatgccagtgactgcagtctgcaaagttaacccctcgggatcaagaatgaatcattaaacatggattttatttggacatctcttcttaatatggcagatgcattgggtttttaaggtaataagaagccattacattaaggtagtgtgaaatgaatac

SEQ ID NO: 473920 - DNA, 726 bp, Homo sapiens
attagggtagaatgaataccacggatctaacatttaactggaatgaaattgagcagaaaagcacaacctgggtgacagaggaagactccatttcaaaaaaaaaaaaaacaaaactggacaagataatagaaaatctatctgaagttatcagagagctgccaaggcaatgcagactcagaggatcaagatttggggaggcggggccgtatagagggattagagggaagagcaatcagagggtgcaggctaacattttgtgccagtttgcctttgaagtctatgctgactccaaaggggaacagagaaggctcagcaattggtcattaatgatcatcattggaataaataaacaaaattttaatgaccagaccctggacccaagctcatgccttaaacactgtcatcagaaatccagagcccaagggattcatagatttattctccgtgtgttcttaattaacttggaaaatatttgtgggtagaagagggtggcctgcctgtgcttcacccattaagagtagcccaatcaaagaggaatgaaaagtctgaggactaggtttctattaagctcaacatggagatgtgaaaactgcctctcatgtttctctccttgtcaaacttttcatctccatgtggctggcagtattggagacagatcctagacccaagtctccctaacatctgagctgccgcacataggaaatgtggcatcacactgcctacggg

SEQ ID NO: 473921 - DNA, 589 bp, Homo sapiens
ccgagggactcattgtaaaaagccttcatgaatggcaccatggccaaacctgggaaactactgcaatttggaccacataattccttttcgctggctgtcctgtccgttgtaagacgtttatttagcggtgtccccggcttctatctactcaattccggtagcaatccccactcccaactgtttacagagcagcggacacgggaagcccatgaatacggaggcagcatcgcagtgaaagacggtggggtgcggtgtgcaaggagagcctttgaggcagtcaggaaaacaccagggtgtgaggggtgtcgttacggtttgcagatgacaaaggtggcaagggaatctaaaaacctccaagcaagggcgaaacaaccatttgcagagaagtctttgagctctaaatgcctcgctgccacctcatactctcacggaattgatttccgccccttggagaaactatttgctgtgacctactttttcacatgaaagacctcactaaagtgttcttttctcttcactgaaggtttgaaaaaaaaaattctttttctaactcttacacatccatgctatgggtgaggacgccttagct

SEQ ID NO: 473922 - DNA, 1478 bp, Homo sapiens
tttgttggcagtggtgctgctgtctcccacgggatgcatttcctccatggagcaggtgcagcgtgtgagggaaacccactcaccatttgcgcccttgccaatcactgctgttgcttctcaggaaaaattccgtcctgctcttcaaacacagcaacttctggatgctggggaaccactggtgaccactgagcaaaaccgtttccctgtgaagcaccaaggggatttgtcctttcccaggggagaagacttcagcaggcagaacaggctacgaggcagggatggagaaagaaaacgcctccaggacactgagtccttgcatctgttaccacctccgaccttgttagaaatagataatcgatgccgcaaagagaagtcagtacagagacaaaagacctcagtaaggccatctttactttctgcagaaagggtgcttaatcgcagatggaacaatggtgggagcacacttgaacaaaggaaaagcagacttatttatcccttatgcatttgggttgtccttactgctgtgtcctgcatccattggctggagcaggacctcacaatcttaaactgatacccgatttgctaatagcctaaaactttcctaaatagttgttttgattaactcttggatgtatggtgcaacataatacctaagaagaaggagtacacttattatagttgttaaagaggtaagaagtgaggctacttttgtttttctctttctggttgctgaatgccagagtaaaagggatagccaattgaactagagccaccatttgttgaaaaaagacaatcttttccctcattgaattattttacatctttgcgaaaaaatctattgacttatctgtctctctttttttatatgtgtgtgtatatatgtatgtatgtatgtatgtatgtgtatatatatttatctttaggtatctttctttatatctacctgtttatccattcatccatccctccatccatccatatataaactcttttgttgcattgatctatacgtttatccacatgcacatttcacacagtcgtgattactgtttttgctttcctgggtctttcccagttccatataattttagagttagcttgtcaatttctatcaaaacaactcaaaaaaaaaaaacaaaaaacatttaaaaaaagccctgctgagatgttgattaggatcatgttgaatatatatagatcgatttcacaattggggaagatcaatctggggagacttatatcttaataatattgggtctttccatctacaacttaatatatttttctttttatgtaggtgttttttagtttgccacatcaatattttacagtgttttgtgtaaaggttttgcatatttttaattgaattcatctctaagtatttaagattttctgatgctcttgtaaatcgtacttcaaaattttttcttcttccagttgttgttggtatatggagataaaattagttttatgcattc

SEQ ID NO: 473923 - DNA, 726 bp, Homo sapiens
gcgaggctcctggagaacctgggccaggatatttaggaaccggatgttttcccagaactctgggggcaaagaccacaagtatgggcttccctgcaatggctgcagtaatgccagggtccccagctttccaatgtattcagagtaccatcttaatagtaagaggcttcccatcctgcaggtggacacaacctaaattacctgttccctggggctgtccatcttcctgtctcagtgcattccaaggatgggattttggatacaaagacactttcgttggatatcaaagagatgtctgcactcccctgttcattgcagcactattcacaatagcccagatatggaaacagcctaagcatcagttgatgaatgaattgataaagccaaatgtgatgtgtatggaatatacattctattcagacttaataaggaaagaaattctgccatttgtaacaacacagataaacatggaggatattatgctaagtaaaataaggcagacacagaaagaccaatacttcatgatctcacttctacgtgaaatctttaaaaagtcgaactcatgattgtataatatcatttgatctatcttcaagttcatcaattctttcttctccagctcaatctgttgttgaggccctcgagtgattattttatttcagttattgtactttcaaatttcagaatttgtattcagtatttggttgtaatatcactcttggttaataa

SEQ ID NO: 473924 - DNA, 1065 bp, Homo sapiens
aggcattggtcttttctctctctctctctctttttttttttccttaaaagacagaaactggctctggactgaagattcctgaagaaagaaacccttaatagagacttacaagcagaagccatgtctcaggcagctgcaagatggtggatctccgctcctgccctccagaaagtatcctttatacagcaagcttttaggataaaacacaggcagctgctgatgtcttcagacttccttgataaattcacaaccacagggaaggcatcaaaactcttcaatggaggaaaagaacagttttatcaaaactggcgctgggaaaactggatatacacatgcaaaatattgatgctggactcttacattctaacatatgcaaaaattaactcaaaatggattagagacctaaacataagagctaaacttataaaacccttagaagaaaacataggggaaaaacttcatgacattggactcggcaataatttcttggatatgacaccaaacgctcaggcaacagaagaaaacaatatataagtcgtatttcatcaaaattaaaatttgttgtgcatcagagaacactatcaagagggtgaaaaggcaattcacagaatgggaaaatatttgtaaattatatatctaataagatattaatatctagcatatataaagaattcaacaataaaaaacccaaacaacccaattcaaaataggcaaataacttgaataaatatttctccaaagaagaaatacaaatggctaataagcacatgaaaacatgctcagtatcactagtcattagcatatttcatgttggccaactcttataggcaagtttctcagcagggcttcctggaatgtgcttgtacattgccccctcctgcattgctcccttctcagaccccattaggtgaggtagcattctaaagagctgctctaattccacttgaacatccctaaaatcagctaagccgaggcaagtagcagcccatgcagcctcattggtatgcattccactcgagagtgtgggcacggtaaatgacacatgaattatgtatgccagcgttc

SEQ ID NO: 473925 - DNA, 620 bp, Homo sapiens
caggtcccagccctgatacgggctccctggaaccatctgcacgtcacactcaaatgcaagctgcctggtttgagtccctctgactgcttgtctccccagtgtcacctggttggctggatagctggaaggggcagtgagaccctgatgtctctgggagaaagaggccctgagaggcagtgctcactcaccagctttgaggctttcttcaaggaagtccccctatgccccgctcctggatcccacaagctgaggctccatgcctcagggactgaagagcacgggccccacacagctcactgcaggggaattgctgatgaatcattaggtaaagccggggccaccggcagagtggccttctggcagatggctggggcttgggaaatgcacatcttctctcggctcagctatgtggttcttctttcttcaagaagccaaagtactgggtgtaccccacaaagtcacaactgggcacagacgggaaaggctggctgtcagcaccttgctggccatggtcgtggaccccagagtgagctgacaaagcagtcagtccaagcatggctgcaggagcgccagaaggcgctgggtgctaacacttaggaggcagcatggacagtggaggg

SEQ ID NO: 473926 - DNA, 515 bp, Homo sapiens
gactgatcacattcatggactcctggcatctgtatgtgtggccatgagactctatagtcccctccctctcactgtgggcctgatcagtggcaagaatgacaaaagcaaagtcttgacaaagtgcatatgcatttcactctctcacttccctgtcattgctattaaaaacaaaaaccaacaacaaaaagaaaacccaccgaggccctcccctagagaatgtgcctgggctggcccactaaagggaagtgggagacatgcatgtctgagcagctcgtggggaggggccacgctggcccagctgaggtccatctggactggcctgcagccaactgaccctcagatatgtgagcgagcccagccaaaagcagtagaggtgtctatcccacctgcaagagtacagacccctgcaccagccaacatctacagaatatcttcccttaattcctaaaggttgttttcatcaatataggattttcaattgacggttcatttttttaaagcacttgaaaaatgtt

SEQ ID NO: 473927 - DNA, 544 bp, Homo sapiens
gtcaatttagatttggagatgctgcttgtcatttgcttcctcggccactctgacttcaacccagaagacggtggtggcatgaacaccttccaggccaggcctgtgggatacaagactctggctgaagtgctcactgtcctccagaagctggatggctgtgtggaaaaatcccaattggaaggaaattctacaaaacacctgactggtgttcctcaaaactgttcaggaacatggatgaagctggaaaccatcatcctcagcaaactaacacaggaacagaaaaccaaacaccgcatgttctcacttccaattcctagaggtgattgtcagaggcttggagacccaagaccagacttcattaaacattgcttccgtgtccagtctgcttgcatcttcagccaaagggagttcctccaggtagacttttcactcctgaaacttctggtctttgtttgatggcctctgtgctctgccctctctccctctcagctcatggtgtctgtcttaaggccatctgaaacactaggcatgggtgggaattagc

SEQ ID NO: 473928 - DNA, 542 bp, Homo sapiens
aaccaccattctattctgcctctatgaattggactattttagattccacatataagtcagatcatacggtgtttatctttctgtatgagaaactcaagaatcagaaaaatgatgagattgtcccacactctttgctagtcacatcttatactctttctgtgcacaagataaattactgtagacttgaaagcacagaagctcgaaacatattaagtgcaaagacagggctgagagaaagaaggcagacagagggggctgtctggccatgggcagctgcaatcagcctctcttcacaaaagggccgccatctctactttgtgtgtgcatttgcattccaggtcactactcaggctgcactgcatggtttgagtgcatataaattaaataaacagataggcagccaagctcctgactagtagcacgctgttaagtttatgtgttgactagtaataaaccatcattacagagtagttcatctagaaaacttatggtttttaggatagaatagattttcaataagaaaattaaagctcaaggaggga

SEQ ID NO: 473929 - DNA, 846 bp, Homo sapiens
gaaactgcaaattagtgcttctgatatgatattgcctcatgaataatcaggacattctcctaacctcggtggagaatctcacatgcattaatggatacagcaattaatacccaactgcctgatctgaggtttgcaggctatgtgacccgaacatccttggttgcatactctgtcctgagaaatggatgtcatttggaaattcacaaaagtatgaagcagcatatcagtgatgatgacagtgacagtgatagtagtggcagtggtggtggcagtgataatggtagaggacatatggttggttctggcagtggtggtgacaatgttgatagtagtggtggtgatggtggttgtagcaatgttgttgctggttctggtgccggtggtagtagtggcaatgttgatgttgttgctggtggtggtggcaatgttgatgttgtggtggtgttgtcagtggcaatgttgttagtaatggtggtagtgggcagcaatattggtcgtggtggtggcaatgttgatgttgtggtagtggtggtagcaatgttgacgtggttgttgttggtggtggcaatcttgatgttaacggtggtgatgatggtggcaatgttgttgctgttggtagttggtggtggcagtgttgttagtgatggtgaaaatggtggtggtggtagtggtggtaggaatggagatatacataaactgggaaataacttaggaccagactgacattctctaatatggttacagaatggaggttgtggacagccaggggctaacaggtatgttcctaggaaatgtctttaaaaggacagaattgaaagtgtgtgtggtgggggtgagtggaatagc

SEQ ID NO: 473930 - DNA, 712 bp, Homo sapiens
gtcccggcaggaggcctccctggcgcagggatctcaagtagaactaaccagttgagcagtaaaaccacagttgcttcactagggaaaagattaacaagctggagcgcaggaatctttgacagaatgtgaagcagaggagagtgacatcctactttaccagtactcatgaggctctcggggcctgtgtcaaccaaggcgggaagcctgcaggaggcgaccacagatcacgggagacacagcctagagtctgacagcctgcaggaggctggactggagaagcatagatccgccagccttcaggaatcttgccctccaccttccccagcacatgaaatcatcgaatcagatagctttggagaacgaaaagcataccacagacatactgtgtccggagttggctcctgccagtgggttcgtggtctggctaacttcaagaataaagccacaggccttgaagaccttcctgtgaagtgtagtacagccacactctattccctctcggcagccactgtgctggggcaaggtacgcagtctcccgttgctgctgtccatggctgaatccacttggaaccagtgggcaagaagcccagatgacacagtttctgtgtatcagcttgtggagatgcagagcaggaagagggggctggagaatgtgtttgcgggtgaggagaggcaaagggtagaaccagcatcatcacaacaaagaggcact

SEQ ID NO: 473931 - DNA, 962 bp, Homo sapiens
gggtgggaacacagccaaaccatataagatggagaccttcaagaaatggctgacagaagagaaagatcccctaaaatggaactatcctggttttagcattgaaagtctcatatcctgtcctcaaacgacaatggttggtcactcagtgtcgtgtgctggatactctacaagtatagttaaacgtaggaacatgtttagtgacccaaggaattatggtgatctcctttctttcttctcccaacacttactaagtatatcatgggtccgtgacttcaaagagccacaaagactgtcttattacttcatccggggatttattgcccaaaatgatgctcaagacccctcacatcagcagaagaacaaaacggtgagtgaaattacccaatttctgcagaacgcataaacatcctgaatgtgttacttgtgttgttaattgtttctgatctatggaaacaagcaaagacatatttttcctaaagtctaagtaacatttcaaaaggtcatttccatgcctatgtaaatcttttctgaagtttctgtgagttttctcttgccttccaacttattggcttatcacttgcatataacagaatttcttttgctgataggcaaaggactcctttttcgatggagtttatttaaaggtaataatggaaaatatcaaatctggaaatatcttaaaactggtttatatttttcaaaattgtgttctatttctgtctccttattttttcatgcacagtttttctctgattgtgaaaaatatacaataaacaggtaaactaatgcaaaaataagtttacttcactgaaataaagcaagctaagataacagagtgtgataaggcatttgtggatagtcatgtaagctagtggtcagggaagactcctctagggaaatgaacattaacacatttatgccggaggttgaaattttttgtttgtgaaaaatcagaccttggc

SEQ ID NO: 473932 - DNA, 1201 bp, Homo sapiens
ggcatctcagacaggctccagctctgtccaaatgctccaagatgcctcatgagagcactgtccaacactggtcaaccaggctgtgccattcacacctcctatgccagttggaaatgccattgagatgagcatcagccaggaggagagaggccatcgtccagccgtcagaagtgtgtgaaccagaggaactccatcttgaataggagctgggcccctggaagtgggagagctcaggaaggcgagcgcagaggggagcagcctgggtccatcccacatgtcccagaggcacaggaggacaccaactgtgcagggatcagaggccagggagcccatcaggggaagatgacactcacagccccctatgcaggtcgaatacaggtggcattgggcctccagacctggccccaaggaaggcagagagaaaagtcatcacccagcgtccctgggggtgctgaaacaaggagacttcaccctggccctctgggtccagcccaatggcctgatttaacttcagttccctctttgaacgccttgtctacaaatacagtcgcgtgggaggtattgagcttaggccttcaacacgtgaattttgagggggacactcttcagcccatggcagcgtcttccactcctgcagttattggtccccttgttctcccacttgacagcactgtgtgtctgcggcctctgagatctcactttcccgctgcgattggagctgcacacacgaccctgatggttctttggacatcccgacttcaccaagaccttctcccccaggctcgactccagctgtccttggtggagcttccatgggtggggacctgtctactgtggatagattacccaacagtggccaacaccctgttgcacttccaaattggactagtgcctggaaacttctgctccactgcctcagcctaccaggcctgcctgatcccacccgctgtctgaatcactctagaattggcctctgggcctttggttcccgggtcttggacccctggccgtctttcccaggctctgcccacacacaggccactcacctccacagtgtctgatgcccccaccttctcctccttctccgcaggcctgtttttcctggaaccagcaggactcccatccaggtccactcaagttgtgacactgcttggcttactgtaagcttttctgctttttagtttttaaaatagtttgattt

SEQ ID NO: 473933 - DNA, 2309 bp, Homo sapiens
cttcgcttggtacttctccttcctgccaccttgtgaagaagatggctggccttccctttgctgtctgccgtgtttgtaagtttcccgaggcctccccagtcatgctgagctccttagaaaaggactgtgtgcaggtagtttatttcaggaagtcaaccagggatgccagtgaggtgctagtgagggtcaacagggaaggaggaaaagccaatgccatcaatgccacacacactatacactgctcctacacccctccccctcctcctacaccccctgcccttcctcctacacttctccccttcctcctacacccctccccctcctcctacacctctccccttcctcctacacccctctcccttctactgcacccctccccctcctcctacacctcttctcttccttctacacccctccccttccttctacacccctcccccttctactacacccctccccctcctcctacacttcttctcttccttctacaaccctccccctcctcctacacccctacccctccttctatacccctacccctgcaaaagccagaaggacagaagcccacagttgcagcccggtagcgaattcctagaaatggcaagcaacttgcctgctcacagagcattcctttcaaatgcaaatcaaccaattcagagtccctatccccagccccttctttatctaactcacacacaccaagccaatattccacctgccctaaatcattaaggtgggccctgatccaatatgcctggtgtcctgttaagaagaagagattaggactcagacatgtacagagtccactgggagacttgcaagccaatagtgtggaaagagttgggagatctactcagagtatggaccagggatgagacaactagggaccacccctatatctcagacccatccgctgccccagattattcaagctgccctatcccaagcctgcccagcatgtccaccccacctggcccattccttcccgagaaaaccgcaataaaggctccggtccctgcctccctctggctccctctgcctcctgaatgaccctggtcctttccctcgtggccctgtgcagcctggcttgggggtatctgctcctgctgcctggcctctcttcctctgaggtccatgaaagccctggacttaaccagagcagggcagtggacagccagaggatgaagaggaatatcctctctgttgagagctgcagagagacgacctgctggcagagaggagccaccctctccagggcctcctttccactgagagctgcagagatgaccagcttgcagagagcagccaccgtcaccctccagagcctcctctccactgagagctatcaacatcaggatgaccagttgcagaggagctaccctctccagggcctcctccctgctgagaactgaacactcaacagaagacctgcctacagagaggagctacctactgtgggtctcctctgagctgttgtaatactcaatacagctcatccttgttttgttcacacttcacttgtctacatacctcatttttcctggatgcaggacaagaactctggcaagggcaccatggccacagaggtttccggccggaaaatcaacaccccaaagatcctgtaacattatgataccctggctgactaatacaggctctgaatgcttgtaataaaaacagggtggcttcaaaatggtttccacatcagttttctaaagtggagaaggactctctcctgagtctggctgaaaacgtagaaggggacaatgatgctctgatgcagctgagggacctccctgggacccagcccagatagtgcagctgtgtaggagggaagggtgtctacccaagcctgtctcctttggagctttgggttcctattgtagaccacagtggagttggcactagggaagccttgctcctctctactgctatgggtgtgtttggcattttaatgggctcttgtttcatttccatactcctccgagcactcccaagccccaggtgcggtagtgtgatatgcatccagcactgcagaaggtaggtgcttccacatgaaactctataggccgggcactttaatttggaagtggaggcaccctggtgtaccccatgggcctgagtcactcactccccaaccaaccatcaaacagagtcctacctctcaccacaaaagtgctttctggctttagtttttcctgtaaaaaactaaatatttattcacgggatatttatcagatgaataaagactttgcgtatctgtaattggtaagaccttgcctcctccctttccccattcttaaacaaaa

SEQ ID NO: 473934 - DNA, 601 bp, Homo sapiens
gcaccctctctacccgcagaatgcaagatccagaagcactcctgtgggaaagacccagccaaagccccagactccaatacaacggaatgggaacctggtggcaggtgtatggagactccacgctccgatgctgaggaatccagagctagaagagaagactgtgctagaggcaggggcctgcatctggacagggcactgcagtcatcggagaaacaccagcaaggaccagtgggctcgggcacacccacagggacagcagcacgccccagaggaggctgatgtcatgaggtgccagccagacctgctggagagccctgggagccgtcctgggaaaggccctaaatgtgacggggatgaggactctcctgcactggctaatagaggcagagaagaaaagaaacatattctatgggaccagcacaacgtctttcttccagaacgggtggtccctccttacactggcccactcatgaccattttgcactgggcagcttccccggaggtacctggtcccatggccatgtccagccacaacagcaacccacatagcatggcttaggaagactttgctcttcttgccccagaaggaaaagtgaagagt

SEQ ID NO: 473935 - DNA, 838 bp, Homo sapiens
caccaacatgatggtattaggagtggagcctttgagaggcaatgaggtcaagaaggtggagccctcgtgaatgggattagtgcccttattaaagggaccccagagagttcccacaccccatccaccataactgtggaaaataaagttctattgtttctaagcctcagttgatggtactttgttatgagagcccaaatgactaagacgctcctgcttggcatcttccttcttgacttccacctccagtctctttggactgtgggtcaggtacatcccacggtcatggacaccagccagaaccagcctgaaaagagtaaaacttgcgaatggatagctggccctgccctgtgtgatagcagcaacatcaaccacaagtatggccttagtgccaattgcaccaggatccaggaaacatcctttttcagtgaaacaggtttggaatcacagttctcacggaaaacaagaaaacatggctgctgtgatcagatcaagaagctgccggaaatacaatacggagctggagaatgctccactgtttcatacaacactgacctctttcacagagtcctgcctgctgcctgctatcacagctttcatgagtacctgaacccagacttttctgggacatgatcaggaatggagctgacaagtcaccctgctcttgaaatcttttgttcaaagccagttgctgagatgccaccttctgattcctgcagcccatcaaactgaattcttcccttttctctggcaaggtgctctgccacttgtctataagtgacacacctgcctgcccttgccaagtcctccagggtggatggtaagtgcatccttttcttgt

SEQ ID NO: 473936 - DNA, 481 bp, Homo sapiens
gctcccacagttccaggtgacagaagcaatgcaacagagcttctatttcctggcagatggaccatgagcctgggccagagaatctgggtcaaatgcaaacaaaaatgctgtgagacgcaggacatcaggggcatcccagggcctgaatattcttactctgaccagagccggctccgggcagctgtcagccatgccttaaaaatcagaagaagcctcagcgcagatttagcaggaccaataatgggaaggaagaattgtcaaggtgggagagtggctgggcatacagctcctgtgacttcacgggacagtgcccggggatgtgagccaggccaccgagctgagctggcagccccaggtgacccagagaactccagccggcctgctgtgaccccagccttccctgccgcagagagaagccaggtccgtcttccagactcacagtccaccagcagtttctgaggtcaaagattgtaatctcatc

SEQ ID NO: 473937 - DNA, 521 bp, Homo sapiens
ggggagttatgggatattctacctgggtaaaagtattcttcacactcagaaagcaattgtgtagccctttagagctcactcgtgtcaggtgcaatgcaactagctatacaagacaaggtgttgctcttgctctgttctacagatccccaaaatacagttgctggaatgtctcaggacctcaacagttactcttcacagaagaacagaacccaggggtcatgatggcaaactggctactcggggatggcccagtgctgggcttgggaacactacaggagtgtcaaagacaagatattcctcatgtcctggaatttgggggctcaccactgaatcctggggaagcagttgacagagagcctgtctgagcatgaggacctccagttcccagccggtttttgttttctttcttctttgttttctttcctttcctctcccacccaccccatttgttgtggtgcctactttgaacttgtcatcagcaatggtgaattcaggaataaaaggcgacagaagcacaggaa

SEQ ID NO: 473938 - DNA, 2923 bp, Homo sapiens
gtgggaaagaccagctggagccaagacctgtcctcagccccaagtgtgaccaccgccccaggcttccccacatcccccgcacactcagcatgggctcattcagcagctgtcagaggtcaggtttggtgcaaagacaatcaaaccggaggaggggtcgctgcagcagctggcccctgggagagtgctctgatgatgcacatctgctcacaactctggactcatcgcgtggccccaccgaccagatggacattagaggtacaatcccagcaggccccagaaggcagcaggggacaccactagctgcccctccagaggccttctgcactccagcgagaagctgccctgtggcctggtatttgcagtcgcagctgctccctgcctggccttctcctcgtagatggaatatcggagaagttatcaccaaatctccaacctcccctccagctgccagctccagcagaatgacaggggcagtttccccaggtgggcagagtttgggttctgccaagaacacagtgaatttaaacaccaccaacttgtgtggctggctgaaccacaatagaaaagcccagtgcctgcatcccggggtgtgcaaatttactcaagtgtgtgcctttgccgtgatcttcactcgcatgattgcaccgatcttcactcacacgattgcaccgggaggctgttgccttagtgccttttccaattcagaccaaggacaggcttcttccaagcccagttgacagccctaggtctactctgtcccctatcaatatcctgtttctgtgtgtggccaaacaaaacaaaaaaatcccatgattcacccagaaactgtgcctaatgatagacaaattaaatgtctataacttgttgtaattacttaataaagtttgtcgagcgcttaagaatccatctggatgaaagaaacattgttaatgtaaaacatgattacagcaacaactacaatcatgccaaaattccagagtcccaccccctcagtaaagagcatgagctgtgccattggtattccaccgcgggatgctgccatgcaaaccagcatccccgccggctcctgtgacatctgcccacccagggtatttgctaacaagaaggatggagtgggaggtgtaaaggaaagaagtgcagtcctccaaagtgaaattattcccttgtctccattctgtgaaagctccgagtccaagtgagcttgctaaaatgtcagccacgtgcctcagtgattagggctgcggtttgggcagcctgtcaaagattttcccaggcgacgctcaagccccttctcagcccagcgcaggaggtttggtgtttttactgcagggcagtccagagtttctgggagagcaagtgatatcctataagccatccacacaccttcattccccacatgcatcctaaactttaagttaatgttctgccttttctttttcccattcagggagattcacatgtttggccaagatagcctgtcccactgacaggaccgtaaagccaatccaactgggaggagagccagggaggctgcgttcgtggacttgaagagtctaacaggcctgctcctggaatttcatccctcactctccccacttctccctccagcccagcgtgaacttcactcgtgccaaaaaatcaactgcataagaacaggattaagcaggaggctggagacggaattaaataaagtgcatgaatgaaacctcaagattttcttaactgtgaactcaccaagagccaacacagcggagcttatgaaatttcactaggtgagactgtatgagtgcttccgcaccaagccaaattcaacctccccatagcttccccccaacatttctaaacctgccctctggaatcataccgatcaaacctaatgtctgaatgaatatgtttatgcccagtgaagcatagaagatgactgctgggcatccaagtcttccctttccccaaatgaattttcgtgggtctcctgtcccttgccgccctgacggttcgccacccactcatcacgttgtgggttgaccccagtttagggctgctgctcccatgagtagtttcttgagctgctctttccctggagctgtccactctgatgctggaagggcttcaattttggggtagatcagagtttctcaaacttagctctatggatcttttcacccagagaattatttgttctgcgaggtggtcctgtgcactgtaggatgtttagcagccaccctggcctctacccaccagataccagtagcaaccccctccccgcagtgacaaaaatgtttccagacattgccaagtgtcccttggggaacagagtccctcctgactgagaaccactggggtagaatgtttgattagggtccccttcaactgaaaggttctaaccattcatgattccatgaactgcccacattttctcaaatcatcagctcagttcagattgtgaaaccactaagaacacaaaactacttttaaaaaaggagctggtgttttgaaagttccccatgagtaataaaaagatgatgatggtcaagacaaaattgcaaaaatgcccagtccccttaaaatgaaagcagcaggaagagcggcagcccggggtggagggaagggttggtgaaactgaattcctggaggatttccctctttggccaagtgggttcatagcagaagcttagcaaatgaacttcacaaaatgttctttccacccgaaaatggtggtctcctgtaattttagctggtgagaagagggaggaaataaaggagccaatgtttaaatgaaatgaaatagaatcgcttagaacccttcagatcaatggctggctggctgaagcaaaatcttttttaaaaaaaattgagagccagccttctgactcctcattgctggctgaaatatggccagaactgtgaattggtttaaaagtct

SEQ ID NO: 473939 - DNA, 954 bp, Homo sapiens
ctgtggaatgatctgcattaaatgaggatttatgatcaatcctcataaattaaggctgcctcagaagcccaagtttgtggttatttattatggcagccaaaagaaactaatacagcacatgtgtgagcacgcacacacacacacacacacacagacagacacacatgaggcagccatgagcacagaggactcttggaggagagcagaggacatcttgagagaagctgacaccgcagcggcagcactgataccacgacccacatcctcccttgatgccctcatcatttccatccaggccctgcttctcgcccagaagccatccaccattcagcttggtctccaggtcactgccccaggaggccatctttacttcacacagtcgtgtgggactgtaaaaatgaccacagaagctgaaaccatacaaagtgacttaatgatcaatgggaaagttatgacggcttcataacctataaatttctttgtcaaaagattaaaaattctccttctgttggttacaaatgtataggaaaatgaaaaaaatagtaaaactaatatttatccaaaatattaattttaaaacattagaaatattgataattaaaatgtcttattctttacaaaaattatcaagagtagtgtgaacaatgtctgccttctttttattctataactcacagtatatagtggacatcttttctatgccttgacacactgtcatactcctttctaagctgtagtcagcttcctacatttcatcctttgcgcattctgtgtcatcaactatctctcagagtttccataatgtgaagttttatcctgatcctaaactctagaaatctcagtccttttggtcacaatcactttctgcatgtatgtcaggaagttgacattcaccaggttcctctggctggatatatagcatctcttaaatgacagtagtgtcagcattcccac

SEQ ID NO: 473940 - DNA, 868 bp, Homo sapiens
gccagttgttgtaaatctccagctgccaggagaccaggtggcctgccatgtgtttctcaataaaattaacaggattcataaaaacctaccttgtacaatattcttcttggattaaccaaaaaatatgtgttaactccttgtttaggctggctgtgggctcagccagtgtcagcttggggctgccagccacaggagccacggagtctgggccctactggttccacgccctcgtggttccctgttctcatggttccacgccctggtggttccctgccctcatggttccacgccctggtggttccctgccctcatggttcccacgccctggtggttccctgccctcatggttccacgccctggtggttccctgccctcatggttccatgccctggtggttccctgctctcatggttctatgtcctcaccattccagctcagcagctatgtcataggggaaacccatccaactaccgatctataaatttttcatgtataatcccttagtgctctatttttttccatttactcaaacctaattgacaaagtcattcagagaaactttattaaatattgccatttcggaagtaagagcttttattttaaaggagtggttatgatgtcacttggggattttgaaaaacaactttgtttcaaaatctacgaagttagccttatctcttgaagtctgagtgttatcttatctcagtagatgggaaaataccattcaaaataatatttcatgtttatctcttctcctgaaagttacatgccaggtactggaggtggaggtgagagttgggagaaccaggcagaggctggattggaagctttcccatcgcccattggaagcaatgtcctcatgacgctt

SEQ ID NO: 473941 - DNA, 621 bp, Homo sapiens
ggaggtgtctgagaggtgttcagaagttgacaaacactgatgttgtcatcattgtgcgcgcctactttcagtcacttgatctagctaatgcctatctatttgcatactcagcagtgttttgttaggttctctatggaaacatacagacagaggggacccatttgggttttaattcagttccaagaaactgcccagcctgagaagataaggaccactggggtccgttctggctttgagctaccgatgaagtgtgtgtcattccattttgggaactgtttctcggatgtccctggctgcggggtgaacccctggacccatcctcagtggatcccaccatcttggatctgcactgccaggatcttgctaagcccagactctcattctggacttccctggaatggacttcccagggtacagactggttttggaagcaaggactgccggccccaggaagctggctcctctgcctgccaactgcagcctgcttctctctctggcacattctgggtgctctgcaaattcatggagatggtcctataaaccccttctacactgctgtgcatggtgtacttgtcccattagctctggttaccctgggctccttgctggtctgcctttttc

SEQ ID NO: 473942 - DNA, 1349 bp, Homo sapiens
gtagttggtgagggtcctggacagaggttcatgaggacacagtacaccaggagtgactcacgagcctcagggctgtgtcctgggtggatacagagctcaatctcatggaggaagatgtcactggaaaaagtcctaggtggctctgatatctgcccctctcccttcctcccttctgggaaaataagaatggctaagggtgatgggcagcgagaacaaccagaggcgctttttgtgtctttttctagttttggcctgttctcaatctggtctgggagacgaatcctgctgacctcctacctctgctggcaaaactcgagtggggtctgggaacttgaaggaaggaaagtgttgatgctaacttccggattttgtggttacattgggataaagcgggagaatatccctatttgtgggaaatacacacaagtattttgagggtgacaggatatgagttcagcaaccttctctcaaatggttcagggaataaagattctttgttctttaccttgaaatttttctctaagtttatggttatttcaaaataaaaaggaaggaagggtctctcttattaattaattttgtctcacgttgttttaagctctttagagtgttttcaaatgagttttacagcttcagatctgggtatttatccaaaagacttgaaactggggtcctgaggagatacaaacacttctcagttcattaaagcactattcacagtatccaaggtgaatggataaaggaaatgtggtatatacatacaacaaaatattactccgtcttaataaagaaggaaattctgatatacgtgacaacatgaatgaaacttgacattttgctaagtgagagaagcctgtcacagaaagacaaatactccatgattccatgtatatgaggtagctaaaatagtgaatctcatagaatcaaagagtggaatgatggttactagaggcgagagtttgggggatgggaattactaatcagtaagcataaagttttgatgtataaatgtataacattatatctagtcaacaataatatattgtacacttaaaaatttgttgagagggtagatctccttttaagtgttcttaccacattaaaataaaatctaaaaaaagaagagtatggaaagaaaataacaacacaatttttttttttttttttttgaaagcacttccttaataaatcagttgtccctgaactcttaccttagggtctacttttaagacttaaaaaagtctgcagtcttaggacttaacaccctctgctataggtttctacaattgtttttcttttaagaatatattttttctgtggtactaggtaaaagcatgtgccatgaaatc

SEQ ID NO: 473943 - DNA, 555 bp, Homo sapiens
atatctagaattgtaagaatgagatatttgcatacatttaaagaatcttccttcaaaatacttattaatgacatagagaaaagggagtggaacagcctgacagccagttccaatcacagcaaacatcatcagtcatgggacaaattggtgttggtgaccactggatgggttgccatgagaacacaccctcacttctatgatatgcatgccagaaacatgtgtccaggttatgaaagtcaagggaagactgagaaactgggccagactgaaggaaactgcagagaccagcaactaaaggcaccacgtgattctgaggagtctttctctagaacagacacgctcgggatagttgtgatgcagggcaggttcttggctttgctcaggaaagaactcaacagtcagctggtggtggaaaaaagcagctttattgaaagtgaagtgttcaaccactgagtatgatgttggctctaagtattcatatgaggcctacgtcaaattcatacatgtcgaatatcaaattggggaagtataaatcccacttagtcacagtatatc

SEQ ID NO: 473944 - DNA, 1295 bp, Homo sapiens
ggctcaccttgggagaagtaggcttgcggcaggcctgcaggcatctggggtctgctgggacacagagagggtccagaatacgaagacaaggatggctcaaccacaggaccagctacaggggcggcagtaggagcagtgctgagggataccagggaggacaataaagtaggagtgaggtagatttaggaaatccggaaataatgtgaaaatgtctctatgcatgcacacggtgacccaacccccagcacgtgcacccttggccaaggagtgtggatggaatctggacatgatgactggggtgtcctactggtgtgagacacagcttggagtgggaagagaaggagcagcccacaagcagggccagctttccccaggcagccgtgttcctgggagccaggactccaaggagccctattccaaattcaaacctggcctttcagtgccctctcagcactgcctcatccaggaaacctgcctcgataaggcaaacctacccccttctctggatttccctggaatgctgaggagcaggacatctgaaagacgagaaaacagaaaagaaaggctgccctcgttacaccaagccagtctttcccatggtggagcctgcactctgatcaagaagtgggggtttcagggcacagccacacatactctcctcaaggagctctgcagccacctgaaccttgctagggaccctgcccagcgctcccctggaacagagcgctaggtaaagggaagggcaggctggtcacatttcattcagtcaagtgcttgcagatgcctcctgaccttcctacaacagctccttttgtttctgtgaatgtttttcagctttattaagttataactgacaagtaaaaattgtgtatatttgtggtatatgtgatgttttgatataggtatacattgtgaaatgattaaatcaagctaattgatattagattggtgcaaaagtaattgtagttttgccactactttttaaaatttgttaaaatagtatatagtatttaatttttattttaagttccaggcccagaagcacagaggcagggggaatgtgcaaatatggtcatttgcagcttttgtgcatcttccaaggagaaaggaaagctgaaaccacgtttaggtttggaaatttttgaatctctaacatataaatggcaaaaagcttcattagtgccactttgccactcacaacggagatgaaaaattcttattggcactgaaaataagacttaacgtcattgtatttattaggttctgaaacaatacacattcacatccttttgaat

SEQ ID NO: 473945 - DNA, 1384 bp, Homo sapiens
agttcccctatacaagccctcttgcctgcagccacgtaagatatgccttttgccttcggccatggttatgaggtctccccatccatgtggaactgtgagcctattaaacctctttcctttatacattacccagtctcagggatggcctcatcaccctgcttgggctttgattcttcatgcttcctcctccaactcctcactcccaccttgtgtggattcctcttcacccccaccttgggctacgattctgccagctgcactgtcctcctgggcagacatctccatgcccaatttggctcccatcattccactccgggccacagtgattccctcacctagcagagatatctgctctgctctgatcttactctgtcactctggctggagtgcaagtggcaccatcatagctcactgcagccttgaactcctgggctcaagcatttctcctgccttggcctcccaatgtgcttgaattacagtgcgcatgcttgagcccacttacctaacacctgagatcttattgggacgctgctgataaccagtttcagagatgctcaagcactgaattgtcttaagaaaacaagtaaggttttgtcacctatcctatttctcactgcaagttgaaaaaaatcaaatccaaacaccaccaccccttctatgacaacaaacggctgtggaggtaatcttattttcctaagggtagtttcatgatgacagtgtcaaaaaattactgtggataaagaaaaaattgtctcaatgaaatagaatttttcactgaacacagaaaccatctcaatagttgctgctccctggtttccaggccacgcaacagacatcaaaccaggaagccaaactttcatggacctgtgttaagaaaaacacacatacatgggcatactactttttccagaaaaacggaattaggcagagaaggaagtgtgggtgtacaactgatccacaagctattgggaaatcaatagctaaaaaatgtccacaccctggcttccttttatcaggaactccaggaggctgaaggaatgtgagtgcatgagataagcaagacagatcttaacggtcccctcacatccctttctgggcaatctccagaatgcctagttttgtggagacaccatgtactatctggctgcagagactttcttaggtcccgtgttagaccccatggggtctcagcatgtggtcatgtggtaatgcattcctttcaaaggctttgggttgaactcaagttggaaatacctggaaaagaccaagcttctcctttgggtgtctgcggatcctattaaaaatattcgtgatgttttaagttctccaatacaattttctccacgaaaacaagcatcagatacactacctctaagtatttatt

SEQ ID NO: 473946 - DNA, 933 bp, Homo sapiens
ctctccgttgtgtctttcggtgcctgcaagagccttgcgggtctgcagctcataaaccctcttcactcaccatctattttgctattttttaattgcctgaggtcaaatccagaaagcagcttctgagattcctgcggcttcctgcccgcctggtgtcctacgctaccattttcctgtgcaaacacttgaggggcgttgggagccgagggaattggagcagcaggtcctgttccttcccctggctgtgtattcgagtttcatgcctgcccatggctgactagcatctactgtgtgactgggcctcactgcactgatgcgtccctctgcggagggacaagtgggtcgcttccaccttctggtgactgtgaataacactgctgtgaacatgggtggaacattccagaaacccccactgtgggctgggcttctcagtcttttctccatgtcctgttgcaagcccgagagccctgagcccatgggcctgtgtggtggtggtccacagcctccaggccaggggaggaagggtagaccttgctgggcttgggtgctcacccgccaggctcccatcctcagtgcccctgggaaccctgtcggcatcgccttgagtgcccctgctgtctgtctccggcccccctgggtcagccccttcctgaatgccccttgcacccatccgtgcccgtcttctccaggagcaggaattcggcctgtaatggatgcagttttattattgagggaggcagtgagtgtgggtatcaaaaaggagaaagaaacccacccggcgttcttccacagtgcatgacgcggctgaaggatacagtggacttacccacttcagtgactcccaaattattcatcagattcctcgaattgtacacacatcccaattcctcatctagagggcgttttccacctggcatcagctcccagggattt

SEQ ID NO: 473947 - DNA, 1407 bp, Homo sapiens
atcccagtgccactccccacacctcgttctggcactgaaagaggaaaagctgatgggcatcctcacccagaggcctggcctgggcctgcaaataacaaggaaatgtttcttggcactgaggagagcgggagaaaagctcatctctgtgaagctgtatccaaacactgacccttgtgcagactggtacccaaattcacaccccctgaatggcccagaaattttccaggaacaaattcagatgaaggtgatcttggagtggaagtgtgtggagaggcaaaactgtcatagcctgaagctggtgggtgagagtggtacaatcattttgggcaaccattcggcagtatgtactgaagctaaatccatgctgcaccccgagcccagcaatttcgtccctaggtgcatgcccaacaagggtggatgtgtgtgcacacaaatgtgggggaatattcacaggagtcaaaactcctgtgaatacaaagatctaccagcagtgaataaaggaagaaattgaagtttaatcaccaaaagatcatatacagtaatgagagtggacaagccactgtttcttgtgacagcatgtgtacatcccacaaacataatattgagcaaaagaaatggacgcaaagaacatactgcaggcttttgattaacacacttgttcatatatatatatgaacatacttcatatatatatatgaacatacttcatatatatatgaacatacttcatatatatatatgaacatacttcatatatatatatgaacatacttcatatatatatgaacatacttcatatatatatatgaacatacttcatatatatatgaacatacttcatatatatatgaacatacttcatatatatatatgaacatacttcatatatatatgaacatacttcatatatatatatgaacatacttcatatatatatatgaacatacttcatatatatatatgaacatacttcatatatatatatgaacatacttcatatatatatgaaatttaaaaacagtaaaaagggatcaacggtgggcataaaaagtcagaagagaagttactcttgggagagtcagtgactgggcgggggcacaaggtagcttctggaatgttctgtgccttgatcttggtgttagtttaaccgagttcatttatgatttgtgcacttttctgatgtatattattgtcaatcaaattttttcttaaaaatgtgaaagggaaggagtcaaggtctccatcccttttcctccaagaggcttctcccactgtgtgctcacccacactcttgctgtgaatcgtgaattctgcattccaagggatatttccagggacagccttcatcaacacaagatgcctgttcccaggtgcatagctatggaggccagctctggggttctgccc

SEQ ID NO: 473948 - DNA, 696 bp, Homo sapiens
cggccgtcttggctccaccgcggcaacagcaattcttaatgaatagtgtgtatgatgtatgctctcagtggatctacatttctggggtctggaggatggtggccctcttctcacaattccactggacagtgccccaggcaacaaaacaactactgagaggcccgtggaaatgaagggctcgctggaccagtggaattcccacatcacacgcttgaggcacttaactactgaattctttcttctgaggaggcaagaattcaggttgctgcagacccgaccggatttaccgctggtagctcagataacttctgctgctggtaacaaatttattgatgcaagtaattccagcaaacttcaagaagttaaatgtcaggaagtagattttacccaaaagtaccagtctgaatacattttatccccttccagccccaggattcacactctctacaggttgaaggtggctgcaaattgataaatggcctgaagtctggtgtatacaaagaaaatatgacatatattaactgacattagtataagaatgtttttaaactgagttcccagatattaaaacaaaagtaatccagatgcccatcttcagtatcattccttttaatagtaatagttaatatttaaaatgtcctcattatgtctcagagatgttcttacctctttatatttattaaataatttatttat

SEQ ID NO: 473949 - DNA, 642 bp, Homo sapiens
acgggaggaacatgaaagtggatgaggagcgtgaccattgaagcacagcaccacagggaggggtttatgcctccggatgactgcgggcaggcctggataatatccagccttccacaagaagctggtggaacagagtgttccctgactcctccaaggaaaggagactccctttcgcggtctgctaaaaacatgtcagcagaagagtccacatatgatatctccttaacacctttccaaagttgggagaagatttccacttcctcctccatacctcttgggtcaatgctgccatcccccatgctgaccatggaattcattcaagagggtactgaaaatgcactattccggtccacccaatttccaacttgtatagaatcaaattcaaacagacatccacagtaagacagatgtaatgggcaaaatgcaatgtgtgtgtgaggacaaaaccagtcctacaatggtggagatgatggaaatagaagcctgcagaccaagcagacagggagaatcacaagctgattttatttctcataagttgagcaagcttctgccctggaaatatgggctttcttcccatatgacaccccaaagagtggggtccatctcaatatgttctaaatttttatattttgataatcaata

SEQ ID NO: 473950 - DNA, 1291 bp, Homo sapiens
tgctgattggtgcatttttacagaatgctgattggtgctcaagaagtcactctcaatgctgtgtttctgaagaaaagagaaatatctgaaagggtgaaggtacgctcaagcgtggtcattgaggacaagtcgacgagagatcccgagtacatctacagtcagccttacgaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgagggccaagtcctcttccagcaggtcaggtgcccgtaacattacaacctcaaaagcagattaaagaaaataagacccaaccgccagtagcttatcaatactggccgccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatactaaaagatatgaaagagggagtaaaacagtatggacccaactccccttatatgaggacattattagattccattgctcatggacatagactcattccttatgattgggagattctggcaaaatcgtctctctcaccctctcaatttttacaatttaagacttggtggattgatggggtacaagaacaggtctgaagaaatagggctgccaatcctccagttaacatagatgcagatcaactattaggaataggtcaaaattggagtactattagtcaacaagcattaatgcaaaatgaggccattgagcaagttagagctatctgcctta

SEQ ID NO: 473951 - DNA, 646 bp, Homo sapiens
cagcgtctggagtggacctccagcaaactccaacagacctgcagctgagggtcctgactgttagaaggaaaactaacaaacagaaaggacatccacatcaaaaacccctctgtacgtcacaatcatcaaagaccaaaggtagataaaaccacaaagatggggagaaaccagagcagaaaagctgaaaattctaaaaatcagagtgcctcttctcctccaaaggaaagcagctccttgccagcaacggaacaaagctggacagagaatgactttgacgagttgagagaagaaggcttcagacgattgaagaccttaaatgacctgatggagctgaaaaccatggcacaagaactacgtgacacatgcacaagcttcagtagccaattcaatcaagtggaagaaagggtattagtgattgaagatcaaatgaatgaaatgaagcgagaagagaaatttggagaaaaaagagtaaaaagaaacgaacaaagcctccaagaaatatggaactatgtgaaaagaccaaatctacgtctgattggcgtaactgaaagtgacggggagaatgaaaccaagttgcaaaacactcttcaagggtattatctaggagaacttccccaacttagcaaggcaggccaacattgaaatt

SEQ ID NO: 473952 - DNA, 1054 bp, Homo sapiens
ctcttcagtcaccaagagcagaaagcctagtgtaggtgtaggcttgggagcagagagtggtgccctaagtatgcgtgcatgcatgtgtacatgtgtatgtgatatggtttggatctgtccccaccaaatctcatgtggaattataatctctgatgttggagaactacgaggaggaaaggctaagtctgctggtccacagagactgcagctgcccctcccactaggggctcaggcccagggagataagggttctgtccctgagcctctggctggagttgttagatttcttgcagggaggtccattccagtgtggaaggatgggtcagggtcagtcctaaagaggcattctggccacagtctgccacagctggtgggctgccacaccacactgctcttttttcctctctgtggatcacagcagctgcctaatcattcctgttgggagaacctggataccttggttgacagtgcgggattcacacagtattatggttcttttcaatgggagcctctgatggtcagaggctgcttctagtcagccatcttggccctgccctcctagggtacccttggtatatagcattgattctcgtttggagggctaaccagttagttataacaataatctttacatgccttagagctatcaaatcattttcagatcctatattaattactttgcttatttaattattcattaaacaacactttattgactgcttgtgatattactgtgtgagatgcctggaatataatgatgagaaaaaaacataatagactctaccctcatggaaattgtggtctggtaggttacaaagatattaattaaataatcaaacagtattgttgagtatcatgaagggaaagtatggaatgctttgaaaatgtaacaggggcatttcttggtgagtttatgtgataaaggtagtgtccttgaggaagagatatttagtcttattagtctaaaagactagtaagagggaaaatgaagaggggagatgggtgaaatagagtgtttttgtttctattgctgctgtaacaaattatcacaaac

SEQ ID NO: 473953 - DNA, 537 bp, Homo sapiens
gcacatctagcatgttttctagtgatgtcgacctgccggtgtacagaccacactttgttactcatcaacggtttactgtataaggaagatgtggtacatatacacaaataccgcacagccataaaaatgaatggaaccatgtcctttgtaacaacatggatacagctggagattgtagaaatctctttctccccagtgttgaaagcctgctcagatgtcacccttagaaacaacagcaactgtgacagtaaaaggcagacaatggaaggactttggctgctgctgggagaggagaaaggcaatgagattccagaagctgactgggaaatcaactgtttatgccttttaaatctactggaaaatccaaatgttccggaaatgagatggccctggatctgcatatctcctctaagggtgttaacaattgaactggagaattataagccttaaagtgttgaccttttttttctaaaatgtgtgaacaaatttcatggagttgaactggataacaaatggcaaatattggactatatgttg

SEQ ID NO: 473954 - DNA, 487 bp, Homo sapiens
cattgcctctttcagtgatatgaagttaaaaccaggccaagatgacaagaggccaccccaagcagttctccatgagtgacccctttgaaaattcagccactttgtctggccgcattccagcttatggcagcatcctctgcccatgccgttgtggtcttagacatggccgtaacacagaatcatcttctggccctggccatctcttcttcacttggacgtgtgttcctcatcccttttctcgaagttctgaggtgtcactgcagcgtgtggccagcagggggctgtggcatttagtggccttccaggttcaggatgtggtgggcggggtgcttgaaatgagattaagttatagcaaagctaattttgttgcatccgttggaattgatgagggatgggtcagctgttggggagaaagtcaaagcctggccttcctggcccttgggaaactgctttggaaaagggaacaaaatgactccctgccttagaa

SEQ ID NO: 473955 - DNA, 1394 bp, Homo sapiens
aataacaaaatagaagaattataacaatattctagcatcactactttgatgctttggggctattactaagtaaaataagggttacttgaagagaagcactgagataccatgacagttgacctgatcactgagatagctaagtgactactgtgtagatagagcatgcagtgtggatacactggaaaaagagcagattcacatcccaggtgagaaggagcaggacagtgcaagatttcaccacactgcgcagaatgaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagcccttgagaaataaaccttatatatatggtcaactgatttttgacaataatgacaagaaaattcaataggaaaagaagttatttcaacaaatggtactgggacaactggatacacacatgcaaaaggatgaagttggaaccttacctcataccatatgcaaaaattaatgctaaatgagtcatagacctatatataagaattagaactataaaacttatggaagaaaatataggtgtaagtctttgtgattttggattacacaatggtttcctagaatgactcttaagcacaagcaaccaaatcaataagttggatttcatcaaaattgaaaacttttgtgcctcaaaggacattatcaagacaatgagaagagaacacatagaagaacacacttacaaatcatatatctgatacatatctgctttccaaaataagtaaaaacttttataactcaataataaaaacacaagtaacccaaaatggaaaatggtgcagtcactttggaagacaatttggcagtttctcaaaaagttaaacatagaattaccatattgaggagtatggctgcaggccaaaatcctatgtattatctttcaggcaggaccctagacagttacaaggctttgcccggcagacctcattgggggaaactgccatctccacatcagacttggtacacagctagtatgttacagcttctggagggatttgcagccaagaactcactgcctggtccctccacccccactagccctgctcataggcttctctgctttcctagctcaggcacttccattcagaggcttcagttcaggcccttttcaggagtcccagttgagacctccttagggagggcttggctgaggcagtgctttcagctactagtgatacttctccatgttgaatgaatagttacatacatcgtaaaagtataaaaacatacttttt

SEQ ID NO: 473956 - DNA, 524 bp, Homo sapiens
tgggaaagtggaatggtattccatatatccgggcttttgtactgtggttctaagcagggggcctggttaacgtgtgatgccctcctttggtatgctgagtcagatgtcaaagtaagggcaataaatgtgattcaaagtacccttcgaaaatgttacctggactgggatggatacatctctattacagataattttatgggattgcttcctcagtgcttctcaggaatgggtcaatttgcctccatattcttgctactggggaccctgtcccctgaggagaccctattggaaaaagtcttactactctatgctttgtctctcttctactacctgatcctattcttgatcacaggaagaattcatgcatccgttgccccactgaactctgagagccctaagaatcccaagcacacagccttctcttcacaccactaaggcagctaactgtgttctcactggctaaatttctcttggtggagaggggaaggaatatctaattctgcagctggaaaatattgcattag

SEQ ID NO: 473957 - DNA, 706 bp, Homo sapiens
cttgtttgcccaagattgcacagcaaggaggagtgagctgagatgagattcgaccccaccctgccaggtgttccaggtgtctctgctgagctgtgtagcatggcccctcaggacctgggtatgagcaagagcagcctatggggggcaacagcacttctcagtgggcccaagagaggcccttgtgaggactttactacattgactccctggttcccaacagcaatgtttttaagtgaaattgcaaaattttcaaaaccaaattacatccactttaattttgaaagcaaaagcaaacagatgtcctgcagcctcttcccctgggagagggtattgagatccaataaaccacgcatcttctcttcctcgagagaagctgggaatcaccacagaaccaaatgcagctctgcctctgtgagagcaaacagttttggctgtacttctagaagtccagaagcaaaagtgaccagagaaaagcaggagttataaaatgcttatgtgagttgaagccattattttctgagcaatcaaacagatcatttatcagcaaaacctactctttccttttatactcatagctcattagtttatataatatttaataaagttatttgactatattagcaaatacagccagcactgacacttttggaaacaaacagctgactgctaagtgtagtagccacgtgttggggtcaggaggatgccc

SEQ ID NO: 473958 - DNA, 737 bp, Homo sapiens
aacgtgcttgtgaggcctctccagccatgtgaaactgcctttgcctaggctgcctgctctgttagagctgccattgcacagtctcatcctcctggtccacacctgctcatcctttgagacctagcatgagcatcatagcctcatcgtcgtccaaggtggctgcaaagactcagtacgatgaggacaagagcacatcccattatgccaatcctaaccaggaagccagaggcaaggaagcccaggctcagaacaagacaaagaagtgtggagaagggatggggatgcaggagctgattatgctgtcaagcatttccctggggcccatgcgaagccaggtcctggtggatactgtacacactaagcctaaagataggcctggcccatatgctgctggctttgctggcacctggacacatcttctggagacttggagattcatctgtgacacctgccaccaccagtgcctgcatgcaccatccaggagcctgaggacaggtctgccctgcctcccagtgcctctgtacatcttccaaggagctgccatgcccgccattgcaggcactcatgcacactgtctggggccagagggtggtctatcccacctactgccactgcccatgcatactgtgcaggggtcctacaaactgaccagctctgcctgccactgctggtatacatgcaagccatccggggcctaaagatgggcctaccccaactgtcactcatgcttgcacata

SEQ ID NO: 473959 - DNA, 635 bp, Homo sapiens
gtttcaggatgccagttaatatgaacttaataccagaactaccaggaggagaggctacgtctgctggtccacagagactgcggccacccctcccgctaggggctgagacccagggagatctgaattctgtccctgaacctctggagctattggagatcctgcagcaggaagccctacccactgaggaaggatgggtcaaggttagacctgaagaggcactctggctgcagactgccacagtgggtgtgcagttgaaattcccagtgctggctgctgccacgcccacaaggagctcaaatggcttagacagcaggcagctgcagcagttgctcgttgcccctccccctaggagtttggtaggcttaagcaggttccagctaaaaggctgtaagaatctgcatgttctgggacactctttgaagtgttaggtttgtttatgaatgtttgaattttaaaaatttagctcattttaagaagaagaaatgaaattatattttggatagctttttctatctccctaagatttcatgcttaaacactgcactatttcaatcttagcagttagacaaaatagaatttttaaactcaattcttaaagtaattcactcactattcttattcaacaaaacactgaa

SEQ ID NO: 473960 - DNA, 1002 bp, Homo sapiens
aactcagcttccaaaagtactaggattatagagctgtgatggcttggagaaacggtgtaaaccggcagtgtaaacaagagcagggcatatatgagtagtcgagaacggtgaataggagtatgactagacagaagatagtagggatgacaagtttttggggcacagtccaagttggtctgatgtctggaatgagactggggcttaataaaatggagcgtccatacaggagctcaaatgggctgcctggtggaactgccatcaataaaccaggtgtgatcagggtgagaaacagggaagaaggaaatgtggggaaatggggtgaacgtcaggtggatcagagagatgcagtcatgagggtcaagtgtggtatcaggaataatgtgagaggccacattgaagtccgagccaggaacaatggtaattgtgggagactcaacaaagaggcctctaaaagtattagggcggcagcagccgctgcatggagacatgatggccagcctaaaacagtaaggtcaagttatttggacaaaaaggctacaggacgtgatcccggtccttgtgtaagaattccgacttcacagccctgcccttcggctgtgtgtaatgaaaagggttgggatgagtcagggagagctaggatgggggcagcctctaaagctgtcttcaaggaatggaaagaggagtggggaaaggatttaggatctatggggtcagctaggtttccttttgtgagtttatataatggttttgttaggatggcaaaaccagggcttccgaggcaatcgggcagtgtcagtcttcagccgctaagccaagaagatctgggaaggagtcagcagagagccttgggccagagttccaggggctctgggagtggctgccagggtctagggctgtaaagcatctcagggttgctgccaaacgagtcatgaactgggctggatttttatatttgatgaaaaagagcctaaatgctatctgatttgggataaagaaaaagga

SEQ ID NO: 473961 - DNA, 2598 bp, Homo sapiens
tctctctctctctctctctctctctctctctttctctctctcagccccatgagaatacagattgtttggttatttgagttgtttgagattcgatgtgaatttttggatgagtttttctatttctgcaaaaagctgttggattttgaatccaacatcaacctagacaagcccttgctggccactctacaggttgctgtccaactgctcagtgacacaggccaggccatactacatttgcaagaaaaaaatgagattggaaacacaggtatatgtcacttggggatgagcaggcacccgcagcttcaaaacttcatggaaggggtagtccttgtgggaggaacagctcaccaaggcacagaccctccagttcctgttgtagctgagttgctgagcgtcttctggcaggctcctttcaccaggaccttcttatggtatgtgcaccaccccttgctgatgagcctcatgcttcaccacctgctccctaagctgcttctgaatggccacccctacctcgttcttattctggtgcatgtaggcacagtcaatatggcagtacctgacatcgatcgccaccttcacagccttggttacctagccaggaggggacttccaggtgccaagccccaggatgggcatcttggtgctgtcggtgaggacaaggtggctcgccatggctgccgcactccccagacccccgcccggaaccatacattgaaatgtttaatatctaagttatcaggaaaacccaagagagttcctactggggcactgcctggtggagccgtgagaagagggccactgtcctccagaccccagaatggtagatccactgacagcttgcaccctgcgctggaaaaagctgcacgcactcaaggccagcccatgaaggcagccgggagggaggctgtaccctgcaaagccacaggggcagagctgcccaagactatgggaacctacctcttgcatcagcacgacctagatgccaactccctaggtagccctcaagggaaagtatttaatgaaccctctttagccggagaaggctttaaaagagaagactatgccaaattttagaagagcctatcccttaatcaaaaatgtcacacagggctgctagatttagccaaaatatttgaaaagaaacagaaagaaaacaaagaaaaggaaaaaaatgtatggaatgatccaatgatctttgggatatgtttatcctaaaaaattatttgttgtttacttgaaatttaactatgaatcctgtaaatgtttttgcatgtggcaaccctacaaaaaggggatctagcaacattttccatggagatagtagcattttgttatcttttctacccacttccctcacacgtgctacgaagtttccctgtccacaaaattttcagatctttttccatccctatagcatccagtcctttctaggacttctccatccattgctgtatcctataaatcggtgtagcttctttaaaaaataatggggtggaatatccactcgttaggaagaggaaggaagagagaagactgttgtgccatttgagaaactctctgtggagtgggtaaaaacactctaaacattcccaaattaatttgggttctattatatatacagaaattctactatctcatcagagtgactaatctttcatttctaaagtactgatcacagtttttgcctatatatcagtgaaatttaaaagtaagttttgccaaaattagaaattagttctatgattattggttaactaaattagctctttggacttaaattgttttctagtctgttttacactttatcacattgtttttattttccttcactatcgctatgttgttctaaaacttagtgtagctcatttctttagaaatcaaagccaaaccttgaatttatagttaatcatgtttctaatcatcaaataaatttctaattgtcaaattcacctatatgttaaaacacgagaagaatgtgattgcacagtaatattcagagttgggaattatagacaagattcattaaaacattgaaacaaggaaaagagctattaaaatgccatttttttgtgttcttgagaaaaatccaagaattcttttttctaagtctttgtaaactaaaaagggctttgacagctgattgtgtttatatttcatggaaaatttcaggtttattgttagaaaattgtaatgctattagcaataatggcaaagccaaatgtttacaatataattaccattctcctagaaaatttgtggttttggagaaagaaaattagacaaataacctctcaaaagattacatgtggctaggacccttgtccaaatggggagataatagtagcatttcatagtaatcattataattgaaaagtgacttaaggatctttggctcctcataattacattgaaggtggtttttaatttgggggggaacattttggaagagatagtttaataaatatacaaaatatcgaagtaaggaagtcactgttctaagattgaaaacatttgccttgaaatatacattgatttttgtataggttcttccttcaaatgtttccagttattctttctgtctgtttcaaccaccaataa

SEQ ID NO: 473962 - DNA, 481 bp, Homo sapiens
tttggatagatatttcacagaatgcgcaagtctacatccattcaaaatattcatttctttgttgttttggcaaaacagcttatgaagcttgcttttgataactactgccgactgatgagacatcagaaagatgtggtcacttctaaaggtggctggcctgcccagaaagccagaacaggagccaaatttgagggtagtgccacgggttatattatattctccaatctgctggaactggtcttggcagcagagtttgagagatacggaaagtacaggaagaagaaactgatactacttgtgacaacagacacacatcagtggttgtcagcagagacagaagtactcagtggagacctggtgagaaagcggcagtgccctgcaggagagctcatatgggacatactccagggacaactgaaaagtcgtgggagagggaattttgagagggcgctgatagcttctacgatatgatgaacctcgg

SEQ ID NO: 473963 - DNA, 1289 bp, Homo sapiens
aaaccaaaggacaaattccctactggtcagcaagctgtccccagtatggatccccactgggacctcgactcaaatcatgcagactggagtcataaacatctgctcacctgtgttctagaaggactaaggataattaggaaaaagcccatgaattattcagtgatggcaagtgccagctcatgtatcaccctcactgagccccgggtacatttaaccattgagggccaggaaattgacttcctcctggacactggcgtggtcttctcagtgttaatctcctgtcctggacgactgtcctcaaggtccattaccatccgaggaatcctgggacagcctgtaaccagacttatcaatgaggcactaattcctccatatccagttgtaacccacccctataccctgctctctcaaataccagaggaagcagaatggttcactgttctggacctcaaggatgccttcttctgtattcccctgcactcttacctccagtttctctttgcctttgaggatcccacagaccacacgtcccaacttacatggatggtcttgcccaatgggtttagggatagccctcatctgtttggtcaggcactggcccaagatctaggccacttctcaagtccaggcactctggtccttcagtcgaaggcccagttttgcctacagcaggtcaaatatctaggcctaatcttagccagaggaacgagggccctcagcaaggaacgaatacagcctatgctggcttatcctcaccctaagacattaaaacagttgtgggggttccttgtaatcactgccttttgccaactatgggtccccagatacagcgagatagccaggcccctctatactctaatcacggagacccagagggcaaatactcatctagcagaatgggaaccaggggcagaaacagccttcaaaaccttaaagcaggccctagtacaagcgccagctttaagccttcccacaggacaaaacttctctttatacgtcacagagagagcagggatagctcttggagtccttactcagattcatgggacaaccccacaacaagtggcatacctaagtaaggaaattgatgtagtagcaaaaggctagcctcactgtttaagggtatttgtggtggtggccatcttagtgtcagaggctatcaaaataatacaaagaaaggatctcactgtccagactactcatgatgtaaatggcatactatcagacaactgcctacttagataccaggcactactccttgagggaccagtgcttcaaatacgtacgtg

SEQ ID NO: 473964 - DNA, 1169 bp, Homo sapiens
agatgggatggcggccgggcagagacgctcctcactttccagactgggcagccaggcagaggggctcctcacgtgcttggggtggcactgacatgccagcctcctgctacctcggccccttctggactttgggtgttgacgatcatggaagggaggctgaagtggggctaagggcagcctggcatgagcctgcaggtgcccctcagcatgaacggcctgggtgctctgaatggtggccagaagcagaaaggctcctgggtggaaaggggcaggtccccagtgaaaccccaccttcaagccagggatgacctgaagtctgggggccaggctgccagttccgtggactggaatgagaacttaacggtgttttttctgggcctgcccatggccacccatggaccaatcagcacatacttcctcacctctgaagcctgtgtgggctctgggctggtagtgcaagctgagcacagcccaccaggccaagtgggtagaatgagcccagtaggcccaaggaaaactcagataaaggcgccactggccacagaggtttcctgctggcaaagtgacaccccaaggattcggtgtattatacatgagactgtgatagagctgcctggtctattctagtccatgggcaatttttttgtttctgcactaatgtcatattttcttaattatgagagctttataccaagtcttgatatctaaaaattaaggtctcctactttttttcttttgagggtctcttggcttttcttggcccttcatgttatatatccgctaactttcatagtcaatggtatgttgatctaaataggcaagtttttcattagtggaagcagaacattcgtagtaaaaaacttttaaagattttgattgtcataacaaatggccctctggcataggtgataccaatgtgtactccataaggagattgtaataatatttgaaatggaaaatgactatatcagactatatgtgtgttttgtgatttaatttggggaaaaatatctatttcatgcctctagtatttctcaaaaaacatgttgaatatgagtcttattaggttttgcttgtttggtgagtaaaaatgccaagcctcatgagaagcagaatgtattttctcttttattgtaactgcatgtacaatacctgctatggactgaatc

SEQ ID NO: 473965 - DNA, 679 bp, Homo sapiens
agctagcacaccaaatcttgcatgctttgctgcttagaaattcttccaccagataccctaagtcatcactcaagttcagtcttctgcaaagtcatagggcattggcaaatgcagcgatgttcattgctagggcattacaagagcaatcttcgctccagttcccagcctttgaatctgacaccaggaccagagggagagctgcatctgccgtgggagtctgggctgtcaggtgatgacaggggcttgcccttccaaggggagatcgcctttggcaggaagctggacttcaacctgcaggctcttctggagcagctcagccaggatgagttgagcaagttcaagtctctgatcagaacaatctccctgggaaaggagctacagaccgtcccccagacagaggaatcacaagaggccatcactggacctggttttgagctctggcaaatagcatggaaaagccaaaggtaaaattatatctctacactgacttcggcttcgtaaattatgtctgctcatgagcaaaggatgaaaggaaatgctacccacaaaaaaatttataaacagatggcattagactagagaaatttccatttttaaattttttatattgttattacacattaaatagttggaaatgcatgaaagtgtttctgcattttatgaatgtgaggctttcaga

SEQ ID NO: 473966 - DNA, 636 bp, Homo sapiens
atctgtaggtttctatggcccggaaatctgggcacagcttagctggagcctcttgcttcagggtattgccaatggtaaattggcatggagagtggggaaaaagtgtgggaaaaaaatgtggaagtggctttcgaacaggtcaatggatggagattggaaaagttttgagacagatgctagaaaaatactatattgctggaaatagaatgttaagggcaattctggtgatggctcagaaaaggagagctataaggaaaacttattttcttagagattttggtggtgagtttccccaggcccctggaagtccagagatgcagttcttttcactcttcccttcgctttccaaaggcaaaggagtctcacccatggccaccaccaccacagcccttggggagcattgccagactattactgatgttcccttaaggctcgagggctcttctatcggcttgtggaaaacaacaaatgtagccacaattatctgagatttgttattaatgcatgattttattccttattcttaaaatattggttcatatttgaaagtgaattactgctcagttttctcccctatttaaaaattaattttcattgaattattttatttaactataaactttgtgttgtgtcttt

SEQ ID NO: 473967 - DNA, 776 bp, Homo sapiens
tcatcagttaaggcaggaacaggccattttctcttcttttgtggtggaatgtcatcagttaaggcaggaaccggccatttggatgtcttggggctcctgggcctgtcagaaagttacatctttacttgccacaagaacaaaccctgtaaagggactatgcagacaaggtatgaggctagttttcccaaggggcttttattagatctggccacagacagaagtacagaggtaggccctatgcaggcagataaactgcttgaaaagccactggaaaactcagccctgaggtatagcaggaacaaaaagtgtatggtaagtcttaaggagctggcacggccagagttccaattagtgcctttcctagaagtgtgccagcagacaggggaaggattggaggtcagccaagctgatgtagatgcatatcaagaaaaatggtttgaagcaaatattttggatatgctcttacaataaaaatcatactaatatttcatttctgtattacttcatcaacttcttcattggaaaatcagaaatatttattactgataaaatttattttttgttttatgtgaatacaaactgagttatagtgttactcattataattttagtttagaatatctaactttgagttaaaatgttacttgaattccattttaaactacattttcatataattcgtttctcagcataagttgacaatatggcctaagtagtgaaaacattgaagagaaccaaataattacatcaaataatatttattgtattttcagcat

SEQ ID NO: 473968 - DNA, 633 bp, Homo sapiens
ctctggagggggtggagggtgggccatgtttgcacgatcccgtgttatggtgtggacagtggaaacggttatgttcagtgtgcctggactattggagcctcagagtgaaggtcgattaaagtacactttaggaatggttctgctgcctctccttatgacacagcagtctaagactactgggggtaaccctctgccttccattgggtttcctggaaacacaattaaagatgagaagtttggcgctgaaggtttattggggagcactcttggagatgaggatgagtgtgttggtcctggagagcagcccatgacagagcaccacagtgtctactcccctcccctcaaggggcttaccttagcactctccagcttgcctctggttccttttgagggcagtagtgaaaaagaaatgcaccctttacttaaattctacaccatccctattttgtgctttggtttaaataactggctaagccattgaaataaatgccattttattgaatggggaaaatgtagattgattccatttatataaataataaattctctgaacacataaaatatttcttgagctgcattagtgcacatttgcatttctctttaatatgaaacagctgttgtatttttcatttt

SEQ ID NO: 473969 - DNA, 775 bp, Homo sapiens
aggaaactgggtccctgcttagagtctgatgcttgagatggcagtgacttctgccaaccacctttgccaaagatattctattagtcttggttgtttattggctaagggagagctcccttcatgggcatctggcaagctccctggtgagaagagtttgtcttttcctttgcaccccgaagcccctgcctgggctaaaaacgtgcaggaatgcggcatttggagaaattacacctctgagctgccaggatatattcaaacagccaagaacagaagttggcccaactgggacgcatccgtggagcagcaaatatgcacactcctggcagtcatgcaagcaagatggtcaacgtcagatacacaaggctggcttgagcagtgttcactggggaaaattcatggacaggggagcagaaacagaagaaaaaccacccaccccaatgtcttgcacactgcaacaactctgtgaacactggtcattattctactgttgttattggtgctctttactggccaaagctcagtgggaggactactatctaacacaagtgccctgcaggacagaaagaacaagagtgctagagcttttgtgcatctgggccattttttcatttgacatatgaagaatctaagaacctgcaaggtggaagtgacctgttcaaatagcagcaaagtcaaaagcagatgtagctctctatctctgagcctctaataaaattaatctaaatagttgtcaattagcagttcacagctgtattttgtttaatatacctagttt

SEQ ID NO: 473970 - DNA, 1199 bp, Homo sapiens
tcttaaaatcttcagctgatattgctcttctctacaacacagttgaaatgaaaaaggattactttatatttacttgcatttttccttcttggaaacaagatgtggagcttcagcagaagaaaattggcagagacagacaaaaaggcaacactgaaaggagcacactatggagagtggagagaagcaagtacaaaaagaaaagaaatgtcttaggagaagaaagatttagaaagtttttgctatataagagtatgcagattaatatgcagttatccattgctggagatgaggataaaaatgatgagggtgacaatgacaagctttattttattgtattacaatttgatggtattaccattttgcaagatgtaaggagcaaatgcataaattcacctatgcagagagcagacgctgaattcctggaacgaaaggattgccagcctcatcaaggatctgtcacatgggcatctctggatataggtgttcacattcttctttgcaacctgttggttttcaagacagactgtcggcaagcaaaatgtcagaggcaagcactgagatttgacccatcagccctagggaagctgactctttggttttcccccatgcaccttgtcttcttgatatgcctgcaggggttggggggaggtgggtgggtggaaaggagtactggtttagggttgaagcaagtctaaagccagcttgctctgggtttaagatctggcctccactgctgtttctccaaagttgggagtcagtcatattcctgtttaagataatcttaagtgatctacattgaatctctcagtaggttattctctttaatccttctgaatatgccaaatggagagtttcggtttggtgctagaattaaatgcccctctaatggtggctagcctcactttttaacacagagactgaatctcactcctagttgctaaggcaagcaactatgcagagctggaaatcatcagcattgtttttctcttatgtttatttttatgcttaacttctaattacaggtagtacttgtttttctttgaggctgaaatataaagtttaagatatatatactaaaattcaaaaagtgaatcaagtaaataatgctctaggtggtccacaaagataagaaaaatcatgacaaaatgggaatgaatgcaatttggggaacactgtattcgcccaagtgatgtttattt

SEQ ID NO: 473971 - DNA, 724 bp, Homo sapiens
tcagggtgaatgggagggtcaaattatggcgttagcttgttctagaaagtttatctccgaggtattcttttggccacattttcatccgattagttttgtgagccagacctggaaatcaggactaaattatattctgtgcctttgtcacctctttacgtccctgcggaaactgtcatctgccagcatttggagaagacgcgctctcctacaacacctcttctgtattcaagtcatctttactacaaaaacaaaagacatggagccccttggtaacgggccatgtcaacttggagctaagatagttgttcggaagagaagtacaggtgtagaaacacagcatgtgctaaaagtagtttctgtggaaaacctgatccttctattccctgtggttactgatgatttaattactctgtataaaccagagggacgtcaagataggacaaggagtgggtcagtcttgggtgagaggaaggattagaaagctggagaactagatgagctagatttcctggcaaagttcaactaatggcagaataaggtgttccatggaccatttcccagaaaacatccataactgatgaaaaatataaagaaactcatttaaagtctctggaaattattgtaatggaatatgacaaatcaaaagcacttatgtgagcaaatctgaagaatctccctaagaacatgagagtctgtagcatgtcagacacagcctgctatctat

SEQ ID NO: 473972 - DNA, 674 bp, Homo sapiens
accagaaggaagaaactccgaacacatgcgaacatcagaaggaacaaactccggacacgccgcctttgagaactgtaacactgcgagggtccgcggcttccttcttgaagtcagtgagaccaagaacccgaccaattccagacacaattccaaactctttaaactttcttctataattttccattgttttctacattgctgtgcaattaaatatttcattccaaaatctactcaatattttatattcctcgacattattttcttcatgccagaggaagtaaagttacttaaggaaaaggtgcagaagatcacagaggaagtggaacatgagctgagccctgaaaagagaatggaactccaaccagttgtggaaggatggctggcagaagccttcagcaatggctgtcttgcaaaaacaatgggcttctccatttctgatgaaataggaaagctgtgggaacttctgtgtcatggcataggaattgtgttacccatggtgcaccgcaaagtatacttcataatggtggacattaaaattaaaacaagaaaattatcatacatcaacctattgttagtttcatattaaaatatgtgttgcctaaagttagatttaagacttaatttgaaatatagatgcatatacctttaatactgacaacagtcataacgtcatt

SEQ ID NO: 473973 - DNA, 683 bp, Homo sapiens
ttatattacaaatatgtcattttctgaacttattttaaatgaaattaatttgaacataaaaaaattgaattatgttgcaaaaaaaaatcaggacctaaatgaaaacttctttcattttgtcaattgtacctcaaaatccacatcgccaaaacagccacatgtcacacaaggaccaacaattttcaaaatatcttctttgtttgcattttggattgtgaatttaggcagaaaggggtcccacttctgcacaactgcttttgcaattcgtgcaatagccaccttcctggtcctcttttcttcagttcacacagacctaggcaaaattacaccatgtcagttttctgcttggaactcttcaatggcttatggatgcccttggaccatcattctcagcaaactatcgcaaggacaaaaaaccaaacaccacatgttcccactcataggtgggaattgagcaatgagaacacatggacacaggacagggaacatcacacaacggggcttgttgtggggtggggggggtggggtgaggggggagggatagcattaggagatatacctaatgctaaaagacaagttaatgggtgcagcacaccaacatgcacatgtatacatatgtaacaaacctgcacattgtgcacatgtaacctaaaacttaaagtataataaattaaaaaaaagac

SEQ ID NO: 473974 - DNA, 588 bp, Homo sapiens
tgcagggaagtgagaagggtgaatgtgtggaaatggactgtgagagctgggacaggcactggagtgggatatggctttttctcagatgagaggttcttggacatgtttaaacactggttgggggcagggtaggagagacagaaagcctgtggctttcatcctcaagggctccatgcgaccgctgcacatccagcacattgtcattgacaccatgaaccagtgcagtgttctgcaagacgttcagatggcccagtctccttcagactgtgatgacaaaggatgggaaaggcccagttccaaggtgcaaggctacttgtgccagcaagatagcagaagcaggacaagagctggctggaagacacctaccgtggtgggaagacatgtacccgtgaagatcgagaaagagtccatccgggtacaacgtagcagttacgtcagactaggacacttcctgtttacaggagactataaaacctttgccgcgtcctcacttggggctgatgccattttaggcctcagcccacctgcacccaggcgctcattaaaacagcatgttgcggccgggcgcggtggctcacgcctgtaatc

SEQ ID NO: 473975 - DNA, 840 bp, Homo sapiens
agaagatgttaatattagagccctgtttgtattacagttctttctgccccaccatttggtgggtcccaagtccttgtcctgcatccaggaacaatgaggtactcagacaagtggaggctgctgcagctcgagtcatggttcaaagggctccaagtacagcttgggccactgcttcagagggtgcaagccatagccttggtgacttccacatggtgtgttaagtctgcaggctttcagaatgcaacagtgaagaaggcttggcagcttccacctagatttcagaggatgtatcagaaagcctgggtgcccaaacagaagcctactgcagggagcccctgtatgggagtgcccctatatgggagcccctgcagagagcccctacatggcaagtaccaagggggtaatgtggggttggagcccctgcgcagagtccccactggggactatctagtggagctgtgggaaggaggctaccaccctccagacctgaaaatgctagaaccactggcagcttgcaccctgagcatggaaaagccacagatactcaactccaactcaagagagaagccatgggagctgtattgtacaaagccacagggatggagcagtccaaggccttgagagcctatcccttgcaccactgtgcccaggatgcaggatatggagtcaggattattttggagctttaaggttgaatgtctccttttctgggtttcaggtttgcatgggacctgttgctgctttcttttggctgatttctcccttttggaatggaaatatttacccaatgcctgtaccaccattgtatcttggaagtaaataacttggttttgattttat

SEQ ID NO: 473976 - DNA, 4589 bp, Homo sapiens
agagggtcagccatttgccccagatcacgcagctgctgtgattgaagacaataggacaacaaagcctgggggtggagagggtggcagagagggtcagagggcgatcgggccgcaggcctcaaacctgtgggcactggcaggtgttctccctccgggccactcacatgaaccacctcaggagacagccctcgaccaggtccagcctcgagtctgggtcctgtcagggtcttggtgttggctaagggggtatggtgggagtttctcctggggttcagggttttccaaagcaactcctgcaacaacacaagcagcgaatgagcttggtctctgaacatccctgcgtcctgtggttggtcactccctccttggggttccttattttggtgtgtgctagatgctgtggcgccccccagtacacctgcctctgtctgactccccagcctgagtctagctgtggctgtgcactcgggcctgtggcttgcctgaagtggggaatccgtgtccctgagcaggccctgatcaaggggctaggtgttgatgctcagctccctggcccctggggataactcagctctgtgctgcgtcaggcaccagctgtccactggggtgactggcagtgatctctgtgctggccctcgccttcccagactcacaccctctccctgctggtgtgcctggtccatccccagtgacaccctccactggggcccttgtctagggctggctttgggagagatcaacccaaaactttgccttctcctggttcttaagataataaatccatattcagggcagaaagatgaaaagttggaaagggaacaaggtaacccaaatcaccccaatcccagtgacttgtgtgcgctccctccgggcctttcctcctggcagcactgtaactggcatttgcacagtgccggctacggtcacgcatgcttatctcctttctcctaccagcaacttctcgaaggagttactgttttattatccccatttcacagataaaggaactgggacatagaaggttcagggaaccttcccaaggccacagagctaacacgtaacaaacagaaattctaacccggcaaatgtgtgactggccttaaaataggtgtattttacaaaattggcatcacactgaccttccaattagcttgccatgagcgttttcctgtcttaaaaggctgtgaaagcatgatgtttacagttgtttgataattcattttctaagggaactccagaatttattttttgctcttctctgttttctctctctctcttctttttctttctttttaaaattgctgttataaacaacaactaatgaatgtctatctttgggacattttaaagggtagcacatcttttggacaatgtttccccagctcctccctttccccccaacaatagcacttgggggttaagagatagtgtggccccatttgcccggtcccctctcccacactgtgtactccagcccagtgactgctcctccattcttttatatgaaagaggtggtgtccttgtcgattttctgctgcttataaatagaatacctgaagctgggcaatttaaaaagatgaatttgtttccatagttctggaggctgaaaaatccgaggtggaggggccgcatctgtactgccgcattggggattaaatttcaacacaagttttagaggggatattgaaaccgtagcagctggtatatatgtgctattctgtacctttcttattttacttgataacaggtcctggagcccttttcttatcagtactcagagagcttcctctttccaccctaacagctgcatagtattctactgtgtggagcaaggtacttaaaatcatttccttgagcgtcactttccaggttcaactccaacagttgtgaagtgcagccatgaagaggtgggacacagtgaaaaaggtccttccagtcaactagccatctcaggggcagcttccatcctgaagtggcctgcccactccctctgatagctgcactacctctgataggcatctcagctggcccacctctcactgccagctctggcacacacccctggcctcctgtttgtgtggcactttcgctcctgttctgggcccctcagtagcttgtcttcttagccaattttgggcctaggctccccacccatgagctcggaagtcaccacttcttggagttgttggagagctagggtttaatttggtgttgagtccaggtcaaataagggaaatatccaaggctgagatataatcagttcttatagtttttgccaatcgaatgggcaaaatctggaattagattttttattttaatttgcagttgcataattagtgagattgagcttcttttcatatgtttatgggctgtttatttttctctgcaagtaaatttcctgtttatgtcctttgccattgtttctgctgggttgcctgtcttttgcttattagggacttctaaaaacatctctttagagtattaatgtttttcccgtaataaatgttgtattttctcccagcctgtctttcgtgttgaatttgtttatggtgtcttttcccttatagaactttccattttatatcgtcaaaaggatttcctttatggcgtctcagtctttggtattgcttagaaaggccgtttctgctccaagttctacggagcttgtgccacattttaagcctgtgcttttatggaatctttatgttcagaatattgatctatctgaaatttatcacctcatatgctgtgaagtagaatgccaattttattgtgtccaagattcccgtatagtcaccaagtggttcctgaactttctatgtcctgttgctgttattatttttaattctgggctgttcctgtgccttccacatgacctgaaggaatcagcttgtcaagttcctcagaaaaattctgttgggttttgattgctatcatacagaattaacttattaatgactgtatgtatttactagaaaccaggggccaatattgagttaattatttatttattggacaccagaggcaaaaattaagttacttattactcttcatttcacggcccgctattatcatccatgcaatgctcttttcttactttgtagtaattatttccccttttccctcctaattcccactcctaagtaggtacttacttaggagtttgtttgatagttgtctttggatagttatcagtccttatgaaatatttagtgttgttttgtgtcaagtgcaatacatttttcaatgatcgtgttttaaaacatgtctagagttttttctggcttcctaatttttaccactgtggtggggtaattgttttaatgtgcattttctgattacgaatgaagttaagcatctctccatgtacttaagaactatttgggtttcccttgctatgagttgcctaatcatatcgcttatccttttgctgttgggttgattattttgttgttaatctgcagacatttcttgtatattcgtggatgttagataatgcaaatatcttctgcagtctatcacttgactctatctttgtgtgcctttatccaacaaaatgcttcatttttatataatcaaatccatcttttttctactttgtgatttgtgcttttatgtcttaagaggtcttcctccgcccttagttacaaatatattctcttacattgtttttttctattaggttgaccttttatatttaggttcaccttagtaaatgattaatacataccttggatatgaagttcccttagtatatgatcaaaagtagggatttaactttattttgccacttataatgagtcaatttccctactactgtttccaggacacactgtgctgaacagaagtgcctggtcaggcattcttaattgatttctaattttaaagagaatgtatttaacatgtctatatataaaggcttttgggtttgggtatacaccctttatcaggttgaggaagtttccttctattacttttcttggtgttcttatcatgcatagataggaattggacatgaataaagtcatttctgtgtctattgatataatcctgtgacttttcccttaggttattaattggtggatttcactgataaatattctaatattaaactttcttttaatttcttgcataaatcctattaggtaaactactttttcaaaaagggaattgttcatcaaggtgtaacttgcacacaaaagggagatgaaatggtaaatgaatgcaacagtggaagcagcgtctccatcaagaagcaacatgaccatctgtctggaaacttctcagccccttcccaggtcttgccctccaagggcaaccaccgccttgacttctaacaccattggttagctttgtctgcttctaactcttatgttagtggaatcatgagatgcattatgttttaaaatattctgttgggtttgattcacaaatattagtttaagaatctttgcatttatattcataagtgacatggcttgatgatgttcttgtcttgtcctgttcttctccaatttgggattgagatttttctagcttcataaaataactagggcagctttctctcttttctttgtttctgaacaact

SEQ ID NO: 473977 - DNA, 1811 bp, Homo sapiens
tctctcagctcacctcgccctctccattctggaagccctggcacacagcacccttttctgtctgctccttggagtaacagtagtagtaggtcccatttgtcatgctcctggcatgtgccatgggcatcccgttcatcatctctgattttcgcagctacctggtgatgccctttgtgcagatgataaaactgaagctcagagagaccaagacttcacagactccagagccttgccccggccctgctcctcagtccctggcactgccctccccacccccacctgggccccccacagagatcagcctcttgacaaccatcagctctgctggagtagagggaatttatccgcttggctggatcctcctccctgccacggaggaccatggcaccttcaattacaccaggaggcccccagaggcagcctgcttcatacccatctccctctccacctttctttctaacaagactctcgatgggttcaagtacccctcctgcatgctcccagcaagtcctgatgagtctaaaccagccaagacaatcccattcctcatgctagaaattgtggaagacgcaaatccagccactgagatgggaggttgcttctgagaaatgtttgttttttctttcttttattaaggtatcacacaaaataaaactcaccttttatactgcacagtctgatgagttttgacaaatgcatacaaccacataaacaccactataatcaagatatagaacaagttcatcacccccaaaactacctgtgtagacactatctcccctgccccggctcctgcaaacaccaagttgatttctgtctccacagtcttctgcttttctgaatgcctaggtagctttgtgaatttgacttttttcatttggaatttgtgactcagccatgttgctgcatatatgggtagtttattccttttgattgctgaatagtatgccattggatgaggtaccagagtttgtttattcatctgccagttgagggacatttgagttgtcctagtttttggtgattatgaataaaacgtccataaacatttagatagagtttgtgtggacatatgttttcagttaacttaggtaaatacctgggaatggagttgctgggtcatatggtagacgtatgcttagcttgataggagactgccaaattgttttccaaagtggtagcctattctgcatttcccctagcagtataaatatatggaaggttagctgctcaacaccctcacaggcactccgtactgtgaggtttttgtttttttttaaattttagcctttccagtatgtatgtagacacatatgtctcatcgtggtggctttaatttacatttctttaatgatcctgagtgtcttttcatgtgttatttgccatccgtatatcttttctgatgaagtgtctgtttagatcttgtgcctatttttaaacagagttctttgttttcttatcattgagttttgggagttctttgtatattctggacataggctttttatcagacacgtgatttgtacctactttctttcagtcttttcatgctgaactgtgactttcaaagaatagaaactcttaattttgatcaaatcgaatccatcagttttgtcttttatggaatgaattgattttggcatttgcttaacctaaggtcatagagactctcacttaggctttcttccagaagttttattgtttgaggcttgcacttagttttaagttctgttttgagttagttttttcatatggttcaagacatgaattgaagttgttctcccctcctcctcccccttctcattgcatcc

SEQ ID NO: 473978 - DNA, 489 bp, Homo sapiens
caggaggtggccaccagcccactctgggacctggcctcctctcatatgaaagacaatagccgtactcttggtgctttctttgagggctcttgtcagggtaaaatggggcaaagagctggttggtgctcaggccagcacaaggcactctcagatgcccaggcctgcacactctcatccccactgttctcagcccggcctgcctgggcacagaggtggactactgcagggcccgcacgtctctccagccttatcttgggctgttccacccacccagagcagatccacacagattccgaggaagttcagcaaggctctgactgtcctcgggaaaagggggtagctggcacacaggatgcaccaaaggaagggagactgtcaaaagaaccagaggatctgagattgcaaagggacatcatggggcccttgaggaacagcttcctgctggtgcacaaagcccagccagagccaaccagagccggctgagcatct

SEQ ID NO: 473979 - DNA, 550 bp, Homo sapiens
ccccaaattagttcatcatagtgtagtaatgttgttgttggtggtattggtggtagtggtagtgatgatggtggtggtgatattgatgatgatggtggtgttgatggaggtgctggtggtggtgctggtggtgttgatggtggtgctggtggtggtgatggtggtgctggtggtggtgatggtggtgctggtggtggtgatggtggtgctggtggtggtgctggtggtggtggtgctgtggtcacagcaatccctggagcttttgaaacaaggacgtgacatagaccaggagttctcaaacttgggtcctggctgctacggatttctgaaactctttgatggggtttatgagaataagtcagcaatctgtccaagatggggaagacttgcaggatggggaagacttggcgatagagcatattatgtgaagaaagagggtccaaagtggtcactggctgacttgttctatggaaaggcccaagctggcacatcaccttcccagagcaacacagctgaacaaccacactagaaagcagccccttttgttgtt

SEQ ID NO: 473980 - DNA, 615 bp, Homo sapiens
aaagaaactacccaaggtaaagacgaaaacccagcccggttcatggcccacttagcagcaacccttagatgctttactgccctagacccagaggggccagaaggccgccttattcttaatatgtgttttatcacccagtcagctcctgacattagaaaaaagcttcaaaaattggaatccagccctcaaaccccacaacaggaattaatcaacctcgccttcaaggtgtacaataatagagaggagtttgccagacagcaatgcatttctgagttacagctacttgcctctgctgagacaaccgacaaccacgtctccaacgtacaaaaaattcagaacatccaagccacagctcccaggggctccttcaaaacatcctcccgtgccctgtttgtgtgggcccccactggaggtcggactgtccaactcacattgccgccgctcctaaggaccctggagcccaaacccaatgttccttggctgactccttcccagatcccctcagcttagcagctgaagactgacactgtctgattgcttcagaagcctcctggaccatcacagatgcttcaggtaactcttacagtggagggatacatgtgcacaatgtgcagg

SEQ ID NO: 473981 - DNA, 882 bp, Homo sapiens
acatcccagtttcaaagaaattaaaatgtggtaccaaattattcttaaaattgaagaaatacagtatgtcaaactatttgtaatgatattttccgctggtatattccaatggtatattgaactattagaatattcaatggtacaacgcaagatatatatggctacatttactaaacaaattcacattggtcacaaattttgtgtcccaagcacaataatttggctaatttttaaatgcaaattgttagctagtcttattacaatatatgtccaattttccagtatttcccatcccgtgtaccttttgtttatttatacattcaacaactatttattgggtgcattcaagtgccaagcattaagacaaacattcctgaaccttacagtttggctcatgaaacatgactgaaacattaaaataaaagacacccaaactgtgtaagatgcatagtaagctctctgttctatggaaacctttgtgaaggagtctggataaaactggcccagaagggtagataaagtattgcaaggtggagaagcggacaatgatgtcacagaaagatttcccaggataagcaaaaacatggagggatggctggagaactgatattcattaagtgccaactgtattttaagctttgttgtttgttacacataacttaatctcacattagttctgagcccacttaaatatgaagctgaagcccaaaaagctcttctcatactgttgataattggttgagtcagaatcctaaactttttctttacaatactccagagcccatgcatcaaaacatacaagaaactaagctcaccaaaacacagtttgcttttagaagttgtgggatgttaatttggctgaatatgaaacatttttgcaga

SEQ ID NO: 473982 - DNA, 651 bp, Homo sapiens
atagaagagaaaggggcagtggatgcattggctgcaactttagcccacatttctggtgcatcaagttttgaaccacagtctttgatcgcctctgatgaccatgactctggaaagcctagaggaaatacaggatgtcacctgtgcctggaaagaacttaatagaaagctaagtagtaatacagcgtctcagattaccagtgtgtgcctcctgaaaggaaatatgggtgtttgctttgatgttcctacaactgaatcagaaaggttacaggcagtgtggcacgattccaactggatactctcagtgccagccaaattacctgaaattgaagaatattatgatggaaacaagtcttctaatccccaacggaggaatggctggtcaagtggctggtcaggcgggtcaggccagtcaggtggtccatctggtggcctatcaggtagacagagtcgacaagggagtcactcaggaagtcgacaagatggtagaagatgaagtgggaatagaactcgatcaagaagtgggggccacaaatggagttttgactgaatatttgatacttaatctaccagtgtgaacttgcctatttgtgcctaattatgtatattatccaccaaaaattagctcatgatagttgagatgagcaatgtgcc

SEQ ID NO: 473983 - DNA, 542 bp, Homo sapiens
ggttatctcccgtgttccctgaaaatcgctcctccccatagagcagctcccaacatggcggctggtttccctcagagtaaacaagtgaaggagcaagagagaacactcaaggcagaaaccacaatctttttgaaacctaatctcaaaagcagtatcccattccttttactctattctgttatacacaagtctaaactaaaagagaggatttacacaggacataaatacgaggaggaactctatttcactcctactcatcggagtaagtggtatctgcaatccctggagagacctggagtgttctgttatttccagagttcctgtggctacctccatgaaagatataatcattggagcaacgcaagagatcattactgctctagaattttgaccgtcaaaaagcccttcttcacgggactactgaaatctattattttcaggtttcttcagaattctcaggggagatcctgaattttggggatcctgaatttcatagactctaaatgagatgagaattctctaagtggaaatttagaacccac

SEQ ID NO: 473984 - DNA, 690 bp, Homo sapiens
ggtaaacattttctttatccatttaccatgcgcctgcccttttgacccccacattctcaccacctgtttctttgttgaattaccaataaatagcatgggctcccagagatcggggccttcgcagcctccgcagcctccgcagcctccgcagcctccacagcctccacaatcccgatggccccctggtcccactttccttctcaaaccgtctttttctcaatcctttgactctgccagacttcgtcgcccctatggcctggtgttgctaccagggccagtagagaaagtccatcaggtcggggtagggataggcgtgtctgagctcagactctccttgggcagggcttgcttcggctgctgtggtggatggaggtctggttctcaggccaatggagttatgttcccagggggattatggctgcgtctgctgtgtcatgcaggtcaccaggaagaacagcagctctggagtaaaacaggctggatcagcttcctggatcttctacctatcagtcgtgtgactttgggcacattactcaacctcttggggccctacttttctcatctgtaaaatggggttaataatcctcacttcctcctgttgtgaattttaagtgaaataatacatgtaaagtgcctagaacagtgcctgacatatgtcttcattcagtgaattatagttatttttgttat

SEQ ID NO: 473985 - DNA, 602 bp, Homo sapiens
cctcctcctcctcctcctcactcacttccttttttttgtttttgttttttttttgagacagaatgtgtgttagcggctatggcagccatcttgtgaccaggaggaagcttctgagaatcacagagatgcaacctctgaagctgccaaaccactgccagcagctgcctaaccactgccagcagctgcctatctccagacatcttggtagaggccccactctcaactctgcacgtcaggcccactttggtggtgccaaggctaacatgagctggtttggagataaaaccatcccatgtgcccatacgatggagaccttccagagcattgtcaccacacttgaatctactctgcaccactccctgagatccaggagaagatggatgatgtcaaaagcagtcctgtttgctagtggctgtgagaaaccctgtgtctggtcctgctgtgtgacttaccaatgtcctcctcatctgaaaaactggcatcccagagtttttggaaggagcagacatgcaatgtggtttaaaatgcgtgtaagcgactaaaatttatggatcactgtaaaagtgtcagccatcctagtgattatttatcttatctctgtc

SEQ ID NO: 473986 - DNA, 987 bp, Homo sapiens
tggatgaggaaaacaaagattatttagcagcttttgacacaatgcatgctgtgatagtgcaagtctgtgtattagtccgttttcatgctgctgataaagacatacctgagactaggcaatttacaaaagaaagaggtttaattgtacttacagttccacatggcttgggaagcctcacagtcatggcagaaggcaagcaagttccatcttatatggatggcagtaggcaaagagagaatgaggaagatgcaaaagtggaaacccctgataaaactatcagatctcatcgcttcagcctggatcttattgtccatatcactatcagcattttggggaagccattcaacaagtctctaggaagttccaaactttcccacattttcctgtcttctgagccattcaaactgttccaacctctgcctattacccagttccaaagtcacttccacattttcaggtatcttctcagcagtgccccactctactcataccaatttactgtattagttcattttcatgctgctgataaagacatacatgagacttggcaatttacaaaagaaagaagcttaattggagttacagttccatgtggttggggaagcctcacaatcatggcagaaggcaaggaggagcaagtcacatcttacatggatggcagcaggcaaagagagaatgaggaagatgcaaaaccagaaacccctgataaaaccatcaaatctcgtgagacttattcactaccatgagaacagtatggtggaagccatccccatgattcaattatctcccactggatccctcccacaacatgtgggaattatgggaatacaattcaagatcagatttgggtggggacacagagccaaaccatatcaacaaataagaaagccagcatcttgtggagacacggtatcacaactgcagggtttctgctatgcaaatacaaatactgatgaaaataatactgctgcccttctgcaaaacaat

SEQ ID NO: 473987 - DNA, 568 bp, Homo sapiens
cagggttatagtgagctatattaccagccattatgcttctacatgtttaattcctatctgactgactgtgatgaaaagaaagtaaaggaaacttccacagatggtgaggacagtctggaagctagatttgtggacagtgatcaaggaactaaagatgctgaagtggactcagctgacctgcaggtgaagtcatttttggtagatgagtcctgcaacttgtcagtgatcaaggaactaaagatgcttcagtggattcagctgacctgcaggtgcagtcattttttggtggataaaggagtgtctctcagagcaatgagctgtggccctttgactgtgtttaaccctggaggaaatccacttggccttaatgtataccccaatctgtgcatccaagttataagtcagaagcctggacaacttgcaggatgtcctgtaactcaacagaaacagtgaacgtggttctatggcattccgtatttggtgttctcaatactacaaggccaatcttcaggaagtttggaaccacctagaattttcctagaccagggaaaatgctttcatctaacat

SEQ ID NO: 473988 - DNA, 515 bp, Homo sapiens
ttctaaagcatctggatggttcctgtacctgctcagccatttgcttactcttgcaaggggtggaacgcagcaggtctgagtgagtggagtttgattccatgggcactgaaggggctggtcaattccagcgcttgttcacgccagttcctgcactcattcactcatgcactgcctcctgagggaattgagtgtggctgtccttcttatcaatcgacaccagatgtgctccgctgtgggaactggaatgcacaggtgctaggactagctggccgctttggtgtcagcaggggcagactccactcactctgtcccactgcgttccactcctcacaggacggggagcggcggtgcctgcaatccctgaaggcgcagaaagagtgttacagtcagtgctcttttagctttgctgtccatggacagcttgagtgttaacagctcagtagagagtcagtgtgacagccttttgcacctgcatgtgagttcttgtccagtgtccaggaggaatgagattgctc

SEQ ID NO: 473989 - DNA, 671 bp, Homo sapiens
tgtccctttctccttctctgatttaaagcagatcaaggcagacctgaggaagttttcagatgatcctgatagtcaagtaaatgatagctgaagaaagggacaaattccctaccagtcagcaagccgtccccagtatgtatccccactgggacctcaactcagatcatggggactggagtcccatagagatcagaagaaagttccaaaagcaagccctgggccctgaacaaaatctagaggcattattaaacctggcaacttcagtgttctataatagggaccaagaggaacagacccaaaaggaaaagcaagatcagagaaaggccgcagccttagtcatggccctaagacaaacaaaccttggtggttcagagaggacagaaaatggagcaggccaatcccctggtagggcttgttatcagtgtggtttaaaagggcactttaaaaaagactgtcctatgagaaacaagctgccccctcacccatgtcactatgccgaggaatcactggaaagcacactgcccccaaggacaagggtctctggggcagaagcccccaaccagatgatccatcaacaggactgagggtgcccggggaaagtgccagctcacgtcatcactctcactgagccccaggtatgtataaccattgagggccaggaaattgacttc

SEQ ID NO: 473990 - DNA, 617 bp, Homo sapiens
tcccctgaccccttgtgctcaccctgcttcagcttgccctccatgggctgcacccactgtccaactagtcccaactgcaagattggcccacctatcctcaacagtggctcggccaatttagggaacaggtgcctccagataatcgactctgtggtcgattatctgtacctggatgctactgagaacccaaggactttgattaaagacatttgggagaatgggatgaatgttggccttgccattaaactgggaactacagttgagtatttggcactgtgcactaataaaatagatatggccttggtaatgacagtggaacctggatttgaagaacagaaatttatgaaagatatgatgccaaaagttcactggttgcagacccagctcctatctttggatatagaggtgatggtggagcaaccggtgatgagggctgagaacttgtcccagaccaccagcctctccattgagaaagcaaactgactcgcagtttttcggcatctcagggagcctgcagtggtgatccagttccttcatggattctcttggctttcctggaatgttcctgtggtagttcttggagcaaaagttcatgatggagaaagtgagagctacac

SEQ ID NO: 473991 - DNA, 531 bp, Homo sapiens
ctgctgttcagttgtttgagcgccttgtacactttggatattaatcccttttcaaatgaatagtttgcaaatattttcttcccatgggttatggccactgggcccaatcagacatgccgactgctgcagaggggtgtgcagctcctgttgctggcaggaatgctggttctttgtgaggctgtggccagactaggcgcaccacaaggagcttcaacagtgacctggggaatacagaggaacgcagaaacttggacatgccaggaaccgcagggccctaaagaggggccacagccctggttcggagagtgcccagatgtggttccccgaagggctgcagttcttctttcttactcttcacccacaacgtggcaagcaatggtcatggttcagccctttttgtgttacagctcttttagcctcaccattcagttggtccagagtttttgtcctgccaccagaaagaatgaggtatgcagacaagtggcaggtgagcaggatgaagaggagctttattgagtgatagaacagctc

SEQ ID NO: 473992 - DNA, 1950 bp, Homo sapiens
gctccgtggagcatgcagccccagccacgtctccctgctgcagctgagtcagactctggggatacattaactcagtggcctgttttatatgagattggggaaacacagcctttgggacaaagtgaaagtgtgctccaagaagaggttggagagtcggagattataaaggcaaaaaactgcaaggccatgaagggggatctggggacttgtggggctgggctgggactcagcagacagtacttctgccttgacaccttcttcctgctacagtctggcaatggggacaccagaagaactcacaagctggagggtgaagatggggctttctcctttctgcaggcttgtatctgcttcctgttcctaactgacttcaagggactccttcggggacaccagaaccagccagctgacacctcctcttcagaagtctgagtcccaggcccactgatcgctcttccaagcttccaggccacaataatgccaactgtttccctttgtttcctgactcggggtggtcattgttccccacagtttctacttccatgataactttgatgcttttgtggttcacagctttagatctggttaacaattcttaaacacataataaattaattttgctgaaaaacttaagttaattattaagtgtttcttgtaataaacagaatattaatggtattagggactcagctccactgattataatagatactgcaaacctaacattatagaaaaaaaagagaacctttcaacaaatcattttacttttttgttttaaaaaaagctttacattgaaaggacagaacaaataatgaataaaataattcagcctaactgaatgaggaaataaaagaaactcaagatattttaggtaacacagatacacttctatttttaaaggcatgattgccattttagacactatagaagattaggaaattgattggggataattcttgccagctttagcaaagataaatattaagacactagattaaatttgaatttcagataaataacaattttgtattggtataagtatgtccaaacagttcatgaaatacaattatgctataaaaccattgtttatctgaaattcaaatgtaattgaacatcaagtattttacctgacaaatctatttgttgaatctcattgtacttgaacaaatacttgttcaatgaattaagttgtttcagaatctttcttttgagaaaaataatgtccttcactcaatgcagccagtaacttctctcagggatggactgggcaggcctccatcttggcctaaattacaaggtagcttcttaatgactcacattgaatggccgtctgatatgtgacatatgtgattctctaccagcaacatagatgcacttattaacgagctcaattatgtgaataagataatctttaaaaacacctttaaggcccatgttccattcatcttgtatattctgatatgtcctcccatagcaaggatagaaactggagggggtgcaagtggagactcttcacttgcacatatttttatgcactcaattttaatagtaggttatatactcttattaatacttatctttaatatttcactcattcttttactttttgctatattcacataactttgtatgatgcctaaaatcatacctgacacaatgtaccttttgatatgctttgaagtatacagtatcattcggatatattcttggccaaaaggttaaatataattaagcctctagagtttacttttatttaagaatcttgatactagaggaacacattaaaaaacacagtgtagttgctaaagactcattgctctacaatgcatacatcctgcatttacttttctcacaataatcctcttgccttgcatctaggtggtcttgtgacttgcttttaggaccatagaatgctgcagaagtgacactatttgatatcaaagggtagac

SEQ ID NO: 473993 - DNA, 634 bp, Homo sapiens
gcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtggctacgaccagttcaagaccgtgcagacggagcgctgccactgcaagttccactggtgctgctacgtcaagtgcaagaagtgcacggagatcgtggaccagtttgtgtgcaaggatttattttatgtggtattcagcagcatccctggcctctacccactagatgccaataacatccttccatttgtgacaatcaaaaacatctacaaacatgccaaatgtgccctggggagcaaaatcacccccagtttaaaaccatgactttagttggagggactgaggtttgaacacttggggaatactggctgaccaccttggtgaactattgagcttgcctaggttgactcatg

SEQ ID NO: 473994 - DNA, 1082 bp, Homo sapiens
gatagtgtgtgtcccgctccatggctttcctttttgttttggctttgaagagcagccaggcagacagccactgcaaagaagcgtctcagggggacgcgagggagctgggaacgtccagttcctgttgctctgcccactgtcaatgcctaacaggactcttgtcttctggagagcggagtgggccgcgaaagtggatgtttcagtcccttgtagctgctcacctgtgtgaaactcctgggaagagtgggaggagccctccacagcctctccccaagcatggcatttacagttaccctagtgaggtgggatttgtccgaggcacacagataggctggccctcggggaactttcaggggtcaaggtaccacactttgggaactgcttctttaaaggaaagtggaagcagtaaggataaatcatcaagagccacaagatctacctgggtcagcagacctacatttctgtgcaacagaaagcagagggcagcaacagggcctgcgaacaagaacccaaaaatatccaacaagtgttcactgggctacaccgtgggccagttgagaatagcagctgaaacaggcgcagggcttgctctctctcattacagcgagtgccagccaagttcaaggtccacaccagaagaagctgggggcagtaaacatgatgtcaagggtcctggctgtgccctgtcctgtggccccatggaatgggaacaagacggcccttcttcagaggaggcatgagtacagtgttttccttttcttccaccaaaaaggcatagtttgcaaaaattttctccccttctgtgggttgtctgttcattttattgatagtttcttttgctgtacagaaactcttaagtttaattagatctcatttgtaaatttttgcttttgttgcaattgcttttggtgtctttgtcatgaaatttttacccttatgttcagaatggtattgcctaggttgtcttctagggttttttttttcagtagttttgggttttacatttaagtattttacatttgggagaaggataaatcaacttacatcttaagttgatttttgtatatgttgtaaggaacggg

SEQ ID NO: 473995 - DNA, 923 bp, Homo sapiens
tctgagagcagccctgctggcttatagcttcttatcatgtctcttcttattcctggtttgtcattttcaaagattccatgttcagatgatctatgtgtagcagcatcagaaaagggacaggttgtcgttcccttcaccactcctgccttggactacaaaaccctggaccaaaccatcaccagctgtctcctggacatagaacagttttcaactactgtccccaaatctattcttgccctcctggaccctctactgtgctgcagctagtatgatcagaaaagacagggaagagttaccagtccccaggaaaagctgtggctgtaggaaagggctctctgccaggagcccctgagtggaatcaatgaaggagtaggcctgcagtagaatgaatgaatgaatgaatgaataaagaataaataccgcagcctctacagtaagaagctgatggctaatgagatgctgccaaaccttttagaagagtctcagaggaaagcggaaagcggtcccaatccagaccccaagagagggttcctggatctcacacacgaaagaattcagggcaagtccatagtgcaaagcaaaagcaagtttactaagaaatggactgggtcagccaagccaaaatttactcaggcccaaagccactgggcagggtcttttacaacatccacagcagcagccaatgaggaggcttgtgtagttcaagttcattgccttttgggattgatgcccaaggcctttgggacgggtccattgcattcctttgtaaggtacagtgaccacctcttgggcagcttgggagtcccatggattccaataaggccagctggtgtcatttcattggcacttaaggttggaagccacccctgggcttttcacaggatttggaaccttcaccctgcagctcagagtcctcattaagc

SEQ ID NO: 473996 - DNA, 947 bp, Homo sapiens
cgcgagtaagcgggttctttggcataacaagcttctgctgaatatggattcccaggtctgagggatgagcttgcaacctgtggcatacctgagtaaggaaatcaatgtagtggcaaaaggttggcctcattgtttatgggtagtggtggcagtagcagtcttagtatctgaagcagttaaaataatacagggaagagatgttactgtgtggacatctcatgatgtgaacggcatactcactgctaaaggagacttgtggctgtcagacaaccatttacttaaatatcaggctctattacttgaaaggccagtgctgcaactgtgcacttgtgcaactcttaacccagccacatttctttcagacaatgaagaaaagatagaacatacctgtcaacaagtaagtgctcaaacctacaccactcgaggggaccttctagagattcccttgactgatccagacctcaacttgtatactgatggaagttcctgtgtagaaaaagaacttcgaaaagcggggtatacagtggtcagtgataatggaatacttgaaagtaattctctcactccaggaactagtgctcagctggcagaactaatagccctcacttgggcactagaattaggagaaggaaaaagggtaaatatatatacagactctacgtatgcttgcctacatgcccatacaacaatatggaaagaaagggaattcctaacttctgagggaacatctatcaaatatcaggaagccattaggagattattattggtggtacagaaatctaaagaggtgacagtcttacactgccagggtcatcagaaagaaaaggaaagggaaatagaagggaaccgccaagtggatattgaagcaacaagagccacaagacaggaccctccattaaaaatgcttatagaaggacccctagtatgaggtaatcccctctggaaaa

SEQ ID NO: 473997 - DNA, 726 bp, Homo sapiens
ccccatcgtcttgctgtattccaccaccaccccccgctgggttacaaatgggcactaccctattgcggggcatgcagctgcctgccagcagccaccaaggactcccccaagtagcccacttctgctccacccgccaacgcacactctccacagggcgaggcggctgcagcaggaccacagccagctgcgctttcagcttgctgggtcatgggctccttggatggaaaacatgatgataacagaggactctctccccagaaaatgcacaagcataaacctatactttctctccctcctgtaggctccccaggcttctctgtggctcatgtcctggtccccagtctcctgattgtgaatacattgtcttcgctggcctcagatattcctcccctgcagttcagcacctggatttccaagacgcatcaccacacccttgagatagttctctctctgtccatttggggttgggacatgctagcactactttccctgtggatgaaggaggaactgggtgcaacaggctgttatactggatgggccagtccccaggagagggacaggaagacaggagtgaacgggcacacctgtgagaccacaacaggtcctggcaatggtcgggaagtgtgtgacagggcacagtgaatgattggagagaagctaggagggactgacttctcatggcctcctagcttcccttggagtgatttggtctaacactaggcttat

SEQ ID NO: 473998 - DNA, 597 bp, Homo sapiens
cttttctaattatgcctgaaagccccactcccttgttagggagaggcattctagcaaaagcaggggccataatacacctgaacataggagaaggaacacccatttgttgtcccctgcttgaggaaggaattaatcctgaagtctgggcaacaggaggacaatatggacgagcaaagaatgcccatcttgttcaagttgaactaaaggattctgcctcctttccctaccaaaggcagtacccccttagacccgaggcccaacaaggactccaaaagattaaggacctaaaagcccaaggcctagtaaaaccatgcaatagcccctgcaatactccaattttaggagtacagaaacccaatggacagtggaggtatggtaaaataaccagaccattatatacactgattaagaaaactcagaaagccaatacccatttagtaagatggacacctgaagcagaagaagcagctttccaggccctaaagaaggccctaacccaagccccagtgttaaacttgccaacaaggcaagacttctttatatgtcacagaaaaaagcaggaatacctctaggagtccttacacaggtccaaaggac

SEQ ID NO: 473999 - DNA, 852 bp, Homo sapiens
attagaagccgtgggtcacggaagagaaccgtggaacccagtgactagtgttcagctcgattaggatgaacccaggcacttagccatgcaggaacaatggcaagcctttagcccaatcgggagcggcaatgggcgcatcgctggatcaggagcacagcggacaccctgccggatccagaggggtggaagtcagcggcggctggacgagaagcatgggctggtatctgctcagcttctgatgagggcttttgtgctacctcaaaacacagcagagaaagtcaaaggggaagcaggcatctatgaggaggaaccaaacttgaggcacaccctacctttagccccagagcaccaggttcatacttggtgggagttcattaataattcagaaattaatactaaggagtcaaatgcatctttctttcatttatctccaggaactttctccaatccaagccagctttccttgcattccttgcagcaggactcaggaacccaaactagtgtctttttcctctaacaccctcacaagccccttgaggctctttttccctaaattggctgccgggtgctttaactcaattatcacaggtctccactgacttccacttaaggatttggattaactataaaactgctatataattgtccttgaatattagaatataaaactataatatattcctcacccttaatctgaattatttccttctgggtatacatgacgccaaagtaaatcactcctacagctctgatgtcatttatttacccataagcataccaataaaaataagcaacatggagtaattagtaataaaattctaaaatactatttgatatttagagttaatcaac

SEQ ID NO: 474000 - DNA, 961 bp, Homo sapiens
tatgttgtactcagtgaaggacaaaaggtgtttctgggttaaatgttattgaaggtatgcaaagtatgtgtttttgtgaggcatacaaccaaaaatctttggagatccctggcctgtgagaaagcatggagcacccatgcttggtggatatgtggatacacagtgaaaaaacacttgaacaaaatatggaaggaaatccaggaaggaaaattatgtgaggttaaggggtgggaatgggaagcaaatgatattgcttggactttgcaaatggacttaagcacaccagtgtaccctgagctggggacagaggccagtcccagaattggcactaatggtcaatgtcactcccactacattctggtgaaaggaagttacaaagctagtgcagattcaaggagagggaaaatagactccatcccacctattattatgcagaataatgtgagaaagaaagtacatgtttgctatctggaggaacttgggcaaatgtaggaaaaaaaaaagaagaagaaagaaacccacatacttctccattcttaagaaaaggaagtagtggtgacatcattctcggctaaaatgtagtctgtttatatctcaaatattcggtaacaatgttttctccagagttatgaagcaactagaacaatcaaatacaattttcttctaaatctttattgcctgattcattcattcatccaacaaatatttattaaacatcgattatgtgtttgatgcttagggacacaatagtaagtggagggaaagatacataatacctgccctcaagaaatttggagttgagtggaggatagaaatataaattaaagaatgacacaaataattataaagttacagctgttaaaagaaaagcatatggtgccaagagaacgtgtaatacaagatctactcatggaggtgagggaaagcttgcccatcaaagaagttatgattcaatccacga

SEQ ID NO: 474001 - DNA, 1418 bp, Homo sapiens
gcctaccctgcagggcccccctcctctcgtctccgcccctgacaccctgtccactggtcttcctgcagtcatcctgccagcctccagcatggaggaggccaccgactgtgcaggtaaaagaaaccggacctacctcatgctgcggtcctcccagccctccggcaccccactccaaaggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatgcccgcaggtccagttcagcccaggtctatcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagcagaagactagaagatgatcttttgaagaaatgaactaaccctacaaattctgaaataagctagctggtcatcatgctatatagtcctagagcaaagtacactcgtttacaaacagtaccctgtacacagagcttgcagttagtttttagtgcatccacactgcttgcagatgaggtggcatagtaagcaaaggctgtttggtaaccagccctggcccagaggtgaggaatctcagaatgtgctccctcacaaggagggtggtacgaatc

SEQ ID NO: 474002 - DNA, 840 bp, Homo sapiens
ttgtcttctgaattgaatataaaatgcccctgactctcaaggtcctgctcctaattgacctagagccttggtactcaaagggtggggctgttggacctgcagcagaagcattactcaggagcttattggaaatgcaaaattggggctctacaccagacctcctgcatcagaatctgcattttaaggaaacccccaatttaatcacgggcacattgaagtttaagaagcatgataacatcattgagcaaagctattacacaatattcaaccaggaaattaacattgatatagtgaagaataattatttggagatgtatccaggtttttggatgtatcagtggttcattcctttgtattgctgggtagtattctatggtatagatgtctgactgtctgtttaaccattcaccattgggcatctggactgtttctaagctttggctactatgactacagctactgtgcatatttatatacagagttttgtgtaaactaaccaccattctaatttctattagtttgactactctagggacctgtgcaagtggaatcatgcagtttttgtccttctgtgactggcttatttgtctcagcataacacccttatgttgtagcatgtgtcacaatttcctttttttcaaggctgtcaagtcaagccttctcaatgtatggatgagaagatggggacccagagatgagtactcccatcagcaggactctttatcacaaatgatagaaactctttgtggatggttgagaaatcttttggtactttgtaactttaatgcaaattcaggccactgaggagcttgttaaaatgcagattctgattcagtaggt

SEQ ID NO: 474003 - DNA, 598 bp, Homo sapiens
tgcctttccctgtcaaccctcttgttttgcctcctcttcctcccctcacctgaataggcatgcccgtacttcaagacactcttgggcagcctagacctagcaaggggcccacgtgcccatcttggtcacctaatggggccagactgtggtgtgccctgatccctgaggtggtagcactgaagaagctggacccaggaggacagagggcagccagcccaccaaggcatcacttgactttcaagttctgcctggacagactgctcagctccctacccgccccagttcacgttcaggttcttgaaatcaactttagtttcctccatgcctacatctatgctgatcccctgcaaaggcacctggtgacacacaagagccagaacccaaaggagctcctccacaggatcctcccagggcttagccaccagggaattttgttgatgatccccaagcttcactgccccatgcaagtctccattatctcaaggttatccctgttcaggatcactactctcctgattcttggcctcctagtccaaactcatggctccagggtcatgatgagtaagagttctggaaaagtctacaacctcccttgaac

SEQ ID NO: 474004 - DNA, 2765 bp, Homo sapiens
ttgtcagaccatggcgcctctccatccccatttccctaggataggccttggttcagggcgctgccacaccttcagccccgccccgccccgccgcaagcccaacccagaggttgcttatggtttccctaaggttcctgggctctggacatcagtccggtctgcaagccccgccctgattggctgcctccggcaccggtcgctgcgccctgacctaaggcgcccaggttcctcccccttatccctgcagggctggtgccttgcggcaccgcccacgctcggattggtccgaggtgagattcgcccttgtgccctcgtaggccttcggaacagcggaagagcagtgtcgggccatggccagggcccgcaggctggagctggccgaggccctggcgctggggccaggctagaggcatgcctgctatgcgctcctgcacgcgccggaccctggaattctctctggccgcctccctctgcgctacgccatactgatgcagatgcgctttgatgggcgcctgggcttccctggcggattcgtggactcgcaagacagcagcctggaggacgggctgaaccgtggtctgctggaactgctgggcgaggcggcggccgccttccgcgtggagcgccctgactaccgcagctctcacgccggatcaaggccacgtgttgtggcccacttctatgccaaatctctgacgctcgagcagctgttggctgtggaggccagcgcaacaggggccaaggaccacgggctggaggtgctgggcctggtgtgagtgcccctgtaccctgcatgatggtgtgggaggcctgcccatctttctggagaattgctttattggtgctgcctgggagcagttactggataccctccaggacttgggagtggtggaagctggtgctttctcaggacttcagatcccagttcgtctgaggcaaccctctgtggactcagggaacctgagctgaggactttggtacaaggaagggaatgttttctcttccggacctaaagacgataccaaattaaaagaagacatgtatatcatatgttttgagcagaggaccctccaattcatgggatcaggggcaaaaatccacagctcatcccaggggccctggcaggttctcagagcctacctcttccttgtatatttgcatacagcctggtaacccccaggcatgcatatgtacaatgtgaccacacacagcctgacatctttcacctgtcaagtccaatttaaccaggaattggcatttgttaccataccctgcctcttgctttgcagagagcttctacagcaaggctgagtccttcccacagtcctccatgcctgctctttagggtctaccccagcccatgttttttgggaaggatagagaagcagaggaccctctttgctttcctgaaagtagccatgcccttgctggagggttcaccacagcaattggtgggaaagggtcttaaccaatctccaacacttttcttctcctgaaactgagaaggggtaaggaagtagctaggtccccttggacggagcatggacatgagacctgtgagtactggtgtctctccttcagagctttcatctttggttcgctgtagactctgggactatcagaagagaactgacccatacctgtctagccctgcccttccaaaaaaagagcctcccattaaagaggagttagagctgggccttgaggctcttcacttctttcaacagatatttaatatgtacctactaaatgccaggtactataaaaggtatagagagccatccttgctctccaagactccagggaagggatgggcaaacattttcttaaaagccagatagcaaatactttaagctttgtaaactacatagttttttaaaaaatattttctaacattgactaataaaaattgcctatgtttactgtgtacaaaatgatgctttcaaatatgtatacattgtggcgtggctaaattgagctaattaacatatgcattacctcacatatttatcatctttcatggtaagaacacaaaatttactcttagcaattttcacaaattaatgcagtttattaactatagtcaccatttgtgcaacagatcttttgaacttatttctcctaactgaagttttatattcttcgatcaatatcttctcaattactgttccctacccccaacccctagtaaccattattttactctctgtttctatgtgtttaacttttttagatgccatatataagtgaaatcatgtggtattttcacctggcttatttcatttaacatgtcatctaggttaatccatgttgtcacaaatgacagaattttcttctattttaaggccaaatagtattccattgtgtatatataccacattttctttatctgtttatctgttgatggacacttaggttgattccacatcttggctattgtgaatagtgttgcagtgaacatgggagtgcagctatctctccagatcctaatttcaattactttgaataaataccctgtaatgggattcctggaccatatagtagttctttatttttaaatatctccatgctgttttccatgatgaccatactaatgtacatttccaccaatattgtgtaagcattcccttttcatattttctctaatacttacctttcatctttttaatcatagccattctaacagatatggggtgatattccatagtggttttgattttcatttccctaataattagtgatgttgagcattttttcatacacct

SEQ ID NO: 474005 - DNA, 4206 bp, Homo sapiens
aggtatggttatcagaacctagatgaagctggttctaggaatttgtaaagaaattgggggctggaacccaatgctgctgcacagggcaaggcccatttctaagacagaaagcaaaaaggaaggaacaagcaacttttggcatctgcctattgggagtgaaatgagcatccagtatcctggtctgggtaaccctgaggtaaaacactaccacttcctggaagccttcctgaaacatgctggcaccgttggtgacccagagcagctctttcatctgggaacagcaggccccagaataggctccttggagacagcagatccactggggatgaaaggagtccattcgggacaaaaggagaaaatgcgtctctccatgttatataagcctttcatccactgttacattaaagattctgaaaagtcctgcagaaaagtgcctgtttgtgtagcgtgtgacaccgattaacgttgcccaaagctttggcattggacagccttgaacccccttctccgctggtgtgccccatgacttcagtcaagttccttggctgctctgaatctcagatgcctatttgcaaaataagttattatgtggtcagtgaaagcaaagcactggtttggctggggtcctgggaggacaggatagctcacataggacactcttgtggttctaactatgtatcttttcatttatacaaatattggtatatgatttttcaaagcaaaaaatgggatcatactgttgatcccactgtgctgttttgtatcctaggttttttacttaataatatgcaaaggacatttttctgtgtcaataactatgaatctgtttattcagcgcatattaattgaatacccactatgtgtaaagcactttccataataccaggattcaatcatgaataaagatagtgcattcacagtccctgtccacatcctcatgaagtttataggctcccaggaggggacacaggcatctagcaaataattacacacatacctttttgacttttttcaattttgagatgatttcagacttacagaagagttgcagaaatgatgcagagagcttccacatacccttcacaaggcttccccggagattaatatctcacataactatacagtatgacaattatgaaaactaagaaattaatattggcataatgccattcagcacagactttcttttctactttttttttcctgttctgggatctgatcctgtgtctcactttgaatttgattgtcgtgtttccttaatctcctccaatctgtgacagttcctcagtctttccttgtctttcatgaccttaaggcttttctgagtactgggcagttgttttgtagaatgcccctcagtttgggtttgtctgatgttttctcatgattagattgaggttatgccttattgggatggataccacagaagtgacatgcctttctcagtgcatcctatcaaggggtacaggatgtcaacgcaacttattactggtgacgttaaccttggtcacttggttaaagtgaaatctgctaggtttcttcactctcaagttactattttcccctttgtaattaataaaaatttgttttggggaaaatattttgagactatgtaaatatcatatttcttaaactttcacccactgagtttaatatccatgggtggatcttgccttcaggggcatctggtattctaatggtgactttgtatttccttctgtattcactgagtggacttcttctgtaacagagagctgtcacagacacttctttagtgacagtagtgaagagttttacaaggatgcaaggagaacctgaaacaggatgacccaactcactatgtagtagttggggaaatcttccctgaagaggtgacattaatgctaatttttgaaaaatcaaaaggactcatcagggcactgggttgggggtgaagaggagaatgttccaggctcagggaagaacatgcacaagatctctacccatagctgacagatactgacatgaaactgcatgagagacagggtgggtagaaaccttggccacctggagggacttcctcatctgaaggacgcagctgcttcttgctccagccagagtcatgtcaagtggaaatgagggtctagtgttgccagagtttttgatgttcaagagaagctggacatctggatttttttcccataaaacttctcaatcttcttaatgttcgcaaacaatccccttctccttcatagccaaacaaaacctgtgaactaatgttttttttacctgtgcatggctgaaccacaatttatttatttgtctcctggggctggaccttgaagttattttcgatggttccctgttataaacaattctgaatgaacatccttggacagacaacctgaacaccttctctagctatgaaaatttgcaccagacagccacttgtggcctcacaactgccagaccctgtggcctcttcaggcccatcctctttccctcttccttccctacaggtcttcacatcctgttggtgccccagttctccttctacttttctaactgttcttttcaatttccttcaatgtcttagtcaactccacctatggctgcaatggaatccatatcacttgtaaggagtctatgaggtgatctgggctgtggtcccacagaagctcacctgggctgagagcacagctggttggtcatgggggcatttcaagccaaagccctggcctggctgactctgctgctctgtttcctggaagggaagggcctgaggctggctcagcaagcacactggttgctaaaagaccagcaaatacgttcttgctgtattctgccttgctctgataaggcaggtatggaggagatgaagagctagaagtctggtgccagaatccagagaggagttcccaccacacaggacagaagaaccagggatcctcttagagctggcaggcagggcacccagctctctggctgtgcccagctttcttcctatggtgccctcttgtgccatggcctttgtgttgtgactggactgtccttattgtgggcataaacagccagcctgaaatggggtagggggacagagggtgagagggagggcaacttcccttgcccccagggcttttattcagggagaaagaaaagctttctttcctgtttgtcttgaagcacccctcatctgtgtccagatagcaggtgagggtggtgcccagccagctgctcctggggagcaccttgtgctctttgggtcttggattgactcaaatggtgcctactggaagagactgccacatttttgaagttatgaataaaaagaagctataacagagtctggctgtcagtggacatccttctaaaataattgtaaaaataataaaagcataaaacaataataaaagttagcataaaacaataatgtccccatttactgaacacttagtctatgccaggcatcatgctaaggggtcgtcatttattatctcatttaatcctcatgtcagcccccagagtttagattaataactgtggtctcaggatgagcttaagaaacctgcttagaagttgcattaagatcatacctgtcaacaaggacaagcttgactgccacagggtccacagatccctacccagaccacagcagataagaccctgctttccacaaaatatccactcatctgtcttatgtttgctcatggcagtcctagatcatatgtcaccacctgagaccttggcatgtttccttagtctggggggacctgtatgtggagagagggccccacgtccccataagcttctgcctcttggtctggaacctaaagtgagacacccttgactgtagtggagcaagccacccaatgccccctcattcagcaagggcttcattctaagtttgggttttttataacctcccttgactctccagtttatgtggattatgcatacttagacatttgtgataatatgatggtcactattcctagtgtgaactctttggaggcccatgagatcctgtgttttatagattgactttttcattcacttgttgaggttcactgagcactctctgtgcctggcattgctagagggaatggggacaatgtggcgagtggggcatatgcagcccttccttcctggatcacattcttgtgggaaaaatactcagtgaaatactagcaaaatgaagttagtaacatatatgaaggagtatactgt

SEQ ID NO: 474006 - DNA, 805 bp, Homo sapiens
ttccagtgctccagttccaagaacagaagaagacccaagttttctcccccaagtctcctccttccactgctgccccctctccctttcactctcatgcttcaggtctggaatctccgttatgcacaaagggcctcatgggggtgtgtaactgcccagcgccttcacaatttccagtcctgcatggaagacgtgtctggatattgccccaacaagcaccaagaagaagggctggcagggttgtttccatggttccgtgaccccataaagtatctttcatttttctcacaaaatgagcctctttttctctcttatattttcatatggtacccagaagcccctggatttcctggcatttgtgtaaagaattccagctattccatccacagttttcacacacagcccctgccaacagacaggccatctgagaggcagcccgcgaccgtggccagagcttgtgctcctgagctctggagatctggcaaggactctggcttccccactgaccccttgtcatgattcccttgatgagtcatccatgtcgtgtgtatcaatagttcatcgctttctattgctagaatcattactattacgaataaagctcctaggaacattcaagttcaaatatttgtatggatatatagttccttttttcttgaatagtcacccaggaaagaaatggctggttaatatgtctctattttgcatatgcttttccaattattccagcactgtttgttgaaaaggctattctttctctacggcattactttcgagcctttgtcaaaaaaatcagttgttcatgccc

SEQ ID NO: 474007 - DNA, 657 bp, Homo sapiens
ttattttctgtgtctagtagagataatgtacgctccatgttgggtgaccaccctagtttgcccacggctgatttctggtcacagagtcttcctccagtggctacagctgctcacccagtgtatttcctgcatagcctcatcactaattatattcacccctgtttatctgcatgcttgcgtatttattacctgttgcccacaagggcaggagccttgtctgccctgttctctaccacagcaccacccccttgaacacaatgaattatctcccacatctgctggagcaacaccttgtggtcagggatggaggagagtgttggaaagatttcatgcacagagtgaggagctaatttcactgaggatcaaatgggttctttggacagtgaaggaattccttgtgtattttcaaggaagatatctgtaataaaaattatattttccatttattcagtacttaacatgggccaggcatagtgctaagcaccttctatacatcacctcatttaatccccacaataatctcattattatctctactttcagctatgaaaactaaatgtaaaatacactgtccactaactacctatccattcttcacatcttctttgttaatagagtcctggctttgtgtagggtgagaatgtgtccagccctgag

SEQ ID NO: 474008 - DNA, 1120 bp, Homo sapiens
tcccctctgagggcctcacggttctacccggcaatccacccttctatgctgcatgccttctcacgctgtctcttgaagatcctgggcctggcactgagcactcagggacaggatgtgagggatggagcagcctctctgacccgagacctgtggttgcatccctgcctacactgagctgctccagctgcatcaggcctgactttgcaggctggtggttaagtgggtagacgggtctggacgcacagccacttctggtcatccacagcgatgagcaagcgggagtttcactgcggctgcctctgacaccgtgcttcatcccaacctttctcacagcctccctcagtgtttccaagattccctgggactagtgaacaatgcagtcaggatggctaaaggtgaccccaagaaaccaaagggcaagatgtctgcttatgccttctttgtgcagatgtgcagagaagaacataagaagaaaaccccagaggtccctgtcaattttgcagaattttccaggaagtgccctgagaagcggaagataatgtctgggaaagagaagtctaaatttgatgaaatggcaaaggtggataaattggtccctaatccttcgtttggatcccactgtctggattcttcctgctctgttccaaattctgccctaatatcaaatccacaaaccctggtatctctattggaaatgtcgcaaaaaggctgggtgagatgtagattaacatgtaacagtgaaaagccaccttacatcaccaaggcgacaaagctgaagaagacatgcagcaatgctctggtggggctcggccacagccggcagcagagatgccctcacaaggacattgggcagaaggggcagcagtgctggggccagcgctggcactgctggagcctcaacaatgtttctggtgtctcttccaaccccaggggccctgcctgtgctctgttgtgcctatgcctttatctcacccctactgtaccccctggagccaaaggctgtgcttatagagacactcaccttggttatcaatcatggaatggaacactgggagtgagcacacccgcataagcctgccatgttggcagccagtggaaggtgccactcagttctccctcc

SEQ ID NO: 474009 - DNA, 2588 bp, Homo sapiens
tcccggaagcaaggtcatgtaggaaacagcaggtcaggtggcctccatgctatgcctggtggaggcaggccccctgccgcaccccaccgaaggctgggtgtctccacaggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggaggtagtatggggttttcaatctcaaagcgtccctttctgccttctcggctctggctatttattcccttgcaccaacaaatacattcgaaaatgttctgtgagctgctcaagaaactgtaaaaatgtgtgatgcacgtgcatatgcagagtgggagaactttgtgtgtgtgtagaggtgtgtaggtgtgggtggcatgtgtgcccgcctgcatgcaatacctgagaccaacctaataaaggtacaatcttcatagaactgcacttgcagcctggagttgctctggctgaaagtagactcaggcttaagaaatgaaacataatgcgtttgtctttatagactttaaattttcaattattactcagttatgtttttggtttaaaaaattataaaagtctaaaagtaatacatgctcagtaaaaacaagtccataaaaaatagaagcatatgacaaaaagcataagtcccacaaactccctagcggtgtgtatgtgtgtgtgtgttattcatggtcacactacatgcaaattaaaaaatgaaagtgtggtcatgctttgtcaactcactatatttttactttattaactatattctgtatcagccatctgaattgacccaatctttattggtgactgcatgaaattccaaggcagggatgtgtcatattttctttagctggtcccataatcatgaacatttaagtagctccaatttttcatcaattacagacattgccgccatgaacatgattgcatggcgtgcaagtatttctgcgaggtagatttccgtacgggatttctggggcaaagggtatgggcattcagtattctgagagaaactgccaaattgctctctgaaatggtggtgtcaatttacatttctcccaagagggtaggagactgattatttttctacaccttcaccaacacttggcattctcagacttttgggttttttttggcctatttaggaggaaaaccgattttaaaagctgcatttccttaatcatgaatgaagtcatctttccacttatttgccagacatttgtattttcttttctgcattgtctttttgttttaagatgtttgccctttgcttgttaatttgttggaaatctttgactctaataagtgtgatcaatcttttctctgctgacttggtataaatgttttcttccagcctctaatttgtctcttaactttgtttatagtcttttgccaagtgtaaaatgttaatttccacgtagtcaaatttgtttatccttccctttaagtcttttgagtttcatgccttcttagaaaggctgtcaccacttcaagattattgaaataatctgtgttttattctagtattatacagtatttcttatatattatatagtatttcttatatattttcatatatttcatatatattccctctaaattaatatataaaacctatattttatatggatttaagcagagaatggtgtgagttagggatctaacaagtttcatttcccttcaaatggatagttagttgctgtaacattatttcatagtccattctttctttactgctgtgaaagtatacttttatcagatattaggttcccacatgcacagaggtccatttgtgaactctgttctgatattatttttcagttcctgcattagtatgacagtgttttaattaaagttactttattcttttttgctgtctggtaggctgagttcccatatttttattctactttagttttttcctttgctatttttgtgcatttgtctttcatgtgataatgtcagtctatgaagcatgccacccctctccttttatcctcaaaatcccattggtgttttgattgtgattatatagaatttataattagtgggaatctgacttatttgaatatt

SEQ ID NO: 474010 - DNA, 632 bp, Homo sapiens
cgccgcgatcagggctccgttgggccattttggaatatcaggcagggcggataggtaccgggttcccggagagctggacgccggccgcgcatgcgccccacggcccgccctggttccgcctccctggaagaggggtggcgttgtctcggtaaccggagtaaacggaggcctccggcagacgctgtgaagagaggagccgcggcggtcagtaccttcggctggaccagtgttatagccttcgtcctccctgcggtagctcagcaaacttttgaagccacgagtattctcaggctcggagctagacactgtgtgcacggttcctgcctgcaagaccctgtcagtctgaccgggcggaagccagccaggcagcaggagcacagcttagacccggccaagtcagagcagcagcgagtcagctgggaaggtgctggggctccccgctccagtgagacacctgccctgcgctcagctgggtgcgacgcttggcacgctgggccctctgcacttcggcttcctcatctccagaaagaaaggtgataatgtgacctcatggagttattattaaacaggataatacaagtaaagtgcttagcacatgcatgacacatagtaggtgcacataaatatttgtc

SEQ ID NO: 474011 - DNA, 1281 bp, Homo sapiens
gattatatgctaaacaaggagtcgattattcatgagcatataatgagtagtgaggacgaccagaggcttccatttatccttccagatgggactgagaagggatatgcttatgtggactttaactacagcggtaacttgctggcctctgttggtagtaaccctgactacacactgactatctggaactggaaagaagaacaacccatactaaggacaaaagctttttctcaggaagtttttaaggttactttcaatcctgataaggaagagcagcttactacatcgggatcaggccacatcaagttctgggaaatggcttttacgttcaccggtctcaagctgcagggatcactaggtcgatttggcaaaacaatcactactgatatagaaggctacatggagctcccagatgggaaggtgctctcagggtcagaatggggcaacatgctgctttgggaaggtggtctgatcaaagtggagctctgtcgagggacaagcaagtcatgtcacaatggtcccattaaccagataatgctgtatgagggtgaagttatcactgttgggtcagatggatatgttaggacccaggacccagaatgcctcttctccttccattctggagctattgaagccgtggctgtttctcctctcacttatctcatggccacaactgccttggactgcttatattcgagtaatgatcatatggattttaagctacaattaaaatgtcccttctccatacccccttgcctttctggaaggctacacatcagtttttatgactcagctcaggtaaacttcactggagcacaaattattgtaggatttgaagatggagttgttcgaattcttgaactttatgatccaaaagggctcacgatttttgcgggacggaagaaaattttggatgctgatattcagttgaaacaggttttcaaaccccatactgcttgtgtcactgctttagcttatgaacgtgatggggaaattctagccacagggagtaaagatcaaactgttttcttctttgaagtggaaagggattataagccgattggttatattaatactcctggacctgtgtgtcagttaatgtggtctcccatgtctcattgacggtgattttctctggtggtatgttttaaatttcttgtatatccattgtatgtttttttcattgaagttactatcaggattgcaaataatatcttataacctgttattttaactgatgacaacttaacactgattttataaacaaactaataagcaagttcc

SEQ ID NO: 474012 - DNA, 1100 bp, Homo sapiens
ccgccattgctgaggcttgagtaggtaaacaaagcaaccaggaagctcgaactggatggagccaaccacagctcaaggaggcctgcctgcctctgtagacttcacctctgggggcagggcattgctgaacaaaaggcagcagaaacttctgcagacttaaacgtccctgtctgacagctttgaagagagtagtggctctcccagcacagagtttgagatctgagaacagacagacggcctcctcaagtgggtccctgaccccccagtagcctaactgggaggcacctctcagtagggaccgactgacacctcatacggcctggtacccctctgagacaaagcttccagaggaacaaacagacagcaacatttgctgttcagcaatatttgctgttctgcagcctctgctgctgatacccaggcaaacagggtctgtagtggacctccagcaaacttcaacagacctgcagctgagggtcctgactgttagaaggaaaaccaacaaacagaaaggacatccacaccaaaatcccacctgtacgtcaccatcatcaaagaccaaaggtagataaaaccacaaagatggggagaaaccagagcagaaaagctgaaaattctaaaaatcagagcgcctcttctcctctcaagaaatacagctcctcactagcaacagaacgaagctggatggagaatgactttgacgagttgagagaagaaggcttcagacgatcggtaataacaaacttctccgagctaaaggaggatgttcgaacccatcgcaaagaagctaaaaaccttgaaaaaagattagacaaatggctaactagaataaacagtgtagagaccttaaatgaccagatggagctgaaaaccatggcacaagaactacgtgacacatgcacaagcttcagtagccgatttgatcaactggaagaaagggtatcagtgattgaagatcaaataaatgaaatgaagcgagaagttcagagaaaaacgagtaaaaagaaatgaacaaagcctctaagaaatataggactatgtgaaaagaccaaatctatgtctgattggtgtacctgaaagtgacagggagaatggaacca

SEQ ID NO: 474013 - DNA, 518 bp, Homo sapiens
aaaagtccagaagccagaggattatggctgcctctgctgagtcatccaggttttcagggaagtgggggaaagccggcagtcacaggcctcacccagctgtcatgcaaaccaaagggccggtctcactctcaccgagccccgccaaaagccccaagtctgtttccaggtggagggcgagcgggcttgagaacttgcctaggctacccgccttccagctgcgaaagaaaaggacttggtttgtcccctgcctgtggagtctgcacaccggattcgtgccctcctccgattatcccagttcccaaaaagtaggaggcacagttcctgaaaagagggttctgatgtgggatgtgcgagagagcagaagagaatataagggcccgatcatcacaggccttccaatccatgctaaggaaactggactttattttaatgttgaagagaagccactggagggtttttgaatgagggagggacttaagctttgcattttaggaaaaggcagtctagctgtcctgggt

SEQ ID NO: 474014 - DNA, 772 bp, Homo sapiens
cctgccttctgcattggtcttgctgggagctgcagaccggagctagtcaaggaagcaagagcatcatgagttatgtctgtgaaatgtgggagtttggtgaagtggtctctaatattctatcgttccacaaacatatggacactgttaccaacttcttcagtatgttcttctctcaggacagtcacctccctttgtccattccagaaacacttgccacaaagtcaagctataaaacagtagaatatgatgatgacttagataacaatccttttaaagcatcactgttccctgagacagaacaatattctaggaccctgaagaattatgctaaatccattcttcctgtgctctataaatggaataacaaagcctggatgacagcacatctgtttacagcacagtttactgaatattttaagcctactgttaagacctactgctcagaaaaaaagatttctttcaaaatgtttctgctaaccgacaatgcacctggtcacctcaaagctctgacagatacatacaatgaaattgaggctttcatgcctgctaacacaacacacattctacagcccatggatcaaggaatcattttgactttcaagtcttcttatttaagaaatacatttcataaaactgtagttgccatagatagtgattcctctcatggatctgagtgaagtaaactgaaaactttctggaaaggattcaccatactagaagccattaagaacgttaatgattcatggaaggaggtcaaaatattaacaataat

SEQ ID NO: 474015 - DNA, 905 bp, Homo sapiens
ggcggcggcggctggggcgggacgggctacagcaaaaggcatttttgccattacccaaatcaagcacaaaatggatctagtcacctctctcctcctctcgctcctctatcctgtcaccccccaactcctatctcctctctccctggcccctctcttctcttcccctgtcctgctgctctctctccaacccccactcttttctcccctctcttcccccttccccctcctctctccccctcctctctccccctcctctctccccctcctctgtactccccctcctctgtactccccctttcccttcgccctccccctttcccctcgccctccccctttcccctcgcccttcccctttcccctcgccctccccctttcccctcgccctccccctttcccctccccctttcccctcgccctccgcctttcccctcgccctccccttttcccctccccctttcccctcctcactttccccgccccactttcccctccccctcccccactttacccctccccctcccccactctctcttgtaattgttaaactagaatatttgatttttgagccctactggtaaacaatggaggctctcattcagggatttagggctgttgaaagaagcctggttgtattcattctttcagaagctaacagtgtgggtaaaatatgaaatgtttgctatcaagttaaagaaaaaaaaggttctcaaaacaaactgtgaagggccaatgcaattcactggtcatatttttcaaattattactcttatattcaaataacaggaagattaaaaaaacatagaaatatttagctagaagggaataccaaatctaaatccctttcattttatagagacccagataaattatactttgaaataattttttaacaaagtctgtaaaaa

SEQ ID NO: 474016 - DNA, 549 bp, Homo sapiens
ctgcagttgtgcctgatgagctccctcaccaccatcttagaaggagcaaggctcccacttgtccatggctcccactggctccatggagtgcacagccctggccacattttccccacagcaacagcaggtgaggtgcaggtgatgccacaccctggccaaccgcacacaaacaaattcgatgctctcagcgctggctccgtaagtcccggctgcgccttcagccgggtgcttgagggctcccaagacacagcaaggagcgaggttgaggctgcagcagaggctccaggcctggagtgggtcctgcccagccatgtcagagttgcagaggttcatgggcaggcagctttgctatcatcttcatctttaataaatatacatgtgtatcaagctcctgttccacacaatagcacaccattagttcctcatactccaattgctggtcaaacgaggcaagcaacagagggagagtgaaacaaaagccaaattaacacagctgttaatatcgattacttgctatgcaccaggtatttaaggtcttttgtgtctgtt

SEQ ID NO: 474017 - DNA, 526 bp, Homo sapiens
aaattctcgacatgtggtattcaagttatggcatttatgaatgtagctgccataaccatctctgtgtgggtttttgtgtggacgtaaattttcagctcaattgggtaaataccaaggagtataattgctggatcatatggaatctgtggattcacaaggtgctctgctgttatcagggtggtgacattacacctattagcaagtctcctcaacttgcagagaactgctctggcctggatcattctgtagaaaaactagttactaatgctattgaagaaaaatatgagacaaagtcacagactcttcctttcaaccaatatctgctgtatacccagtttgtttccttaataaatgttgctggtgtgccagccatggacaggccctgcactaggcactgggtggacaaaggtggacaagagaggcctggccctccccacttggactggatattctgtttcggaagatcggcagttgatgtgtgcagctgacacgtgcactgaaaaaaataatgaggaaggggagaaga

SEQ ID NO: 474018 - DNA, 2657 bp, Homo sapiens
agctgcctccccgcggggcagggcttaggacctgcagccttccatgcctgagcctcccccttccccaccccccgccatgggctcctgcgcagcccaagcctccccgacaagcgccgctccctgctccacggcacccagtcccatcgaccgcccaagggctgaggagtgcgggcgcacggcgcgggactggcacgcagctccacctgcggccccggtgcgggatccactgggtgaagccaactgggctcctgacttcactcctgaagccagcgagactacgaacccaccgggaggaatgaacaactccagacgcgctgccttaagagctgtaacgctcaccgcgaaggtctgcagcttcacgcctgagccagcgagaccacgaacccaccagaaggaagaaactccaaacacatccgaacatcagaaagaagaaactccggacatgccgccttgaagaactgtaacactcacagcgagggaattagaagatctctcttaatacagccaccctgctaaaagttcagaaaaatcactttcacgtaaaaatgagcaatataaaaattttgaggtaaaattctatacaaagtgataaaaaaaaaggaacagaataacatcttacacaaaatgaaagcatttatcagacatgtcattacttgtctgtaacctattacttcaaaatgagctaaaagacattaagaataagatatacggcctgaaagaattacataaatcaagccacgtacagtgctcacacctgtaatcccagcactttgggaggccgaggtgggaggatcacttgcactcacgagtttgaagccagccagggcaagatggcgagacgctgtccccacaaaaaaatacaaagaaatagctgggtgtggtggtgcgtgcctgtgatcccagctatttaggaggctgagaaatgggggaagaaagaataaacttgaaaaaaagaaaaatcattctagaaataagaaaatacactagagggacagatagcaaatagatacaacaaataacgctttaaaaaaaactagaaggttaaaatgaaaaacaaaatcaaacagaaattaagagagagagaaggatttaagggaaagtatcgaatactgaagacaggtaaaggagatccaacatatagaaaataggaatccctgggtcaggtgtggtggctcacgcctgttatcccaccactttgtgaggccaaggtgggaggactgcttgagcccaggagttcaagaccagcctggtcaacatggcgaaattctgtctctactaaaaagacaaaaattagccaggcgtggtggcacatgcctgtagtcccagctactcaggaggctgaggcatgagaatcgtttgaacctgggaggcacaggttgcagcgagccaagatcatgctactgtactccagcctgggtgacaaagctcaaaactaaaagaagaaagaaaaaaaagtaggaatccctggagaggaaagcaaaggaagaaaattgtccaaatacctaaaactataattcaaagaaacattcctgaaattaaaaaaatattctgaaactacatattgcaaaaggaccctggacactgaagcatatttgctccaaatgaccgacactaagatataatctaataaaattactggacttaagacttattatgccagaagaaaaaggagtaacatatttaagatatgcaaagaaaaaatgtgaggcaacatttttaattcagtaaagattgtggtttaagtataaagaacacagcaaactgttacgaaaattcaagaattcagggaatacagtacccatgagccttttccaaaaaatctaacagaaatgaagtttagacaaaatgactacagacattgacataaggactgaagaactggtactgagcactgaacatacctgtattactaaaaagtacaatagggttagagttaaaagggggagagtatcatataaatggctaaatgtcctgaaaatgcaaatctaatacaactatcaaaaaataatgcaaagagtgagtggctcacacttgtaatcctagcactttgggcagccaaggtgggaggatcacttggggccaggagttcaagatcagcctgggaaacctagtgagaccccacctctacaaaaaaattaaattaaattaaattaaaaattaaaaatcattagccaggcatggtggcacatacctgtagtcccagctacaacagaggctgaggtgggaggatcacttgagcccaggagttcgaaattacagtgagctataatcgtgccacggcgctccagcctgggcaacacagcaatatcctgtcttcaaaaaaaaaaacataataatggagttagactagggatagcatatgtaataaaatgtttactcttcttgctaatcataactggtagtggaagtatttagtattgttattctaagactgttgtgtgtaaggtagagaaataagcagatgggcaattatgggatattctaatgctaccatcccctttgttctcgagaaccaaaactgtcagcatggaagaaaggagataaagatgtaataaataggaggttaaataaaagccctgtaatcctgattatgaaatggaaatatcaggatgaactcatgaggcctggacacactcacaacaaggagcactgttagc

SEQ ID NO: 474019 - DNA, 763 bp, Homo sapiens
ttggatagaatttagctttcctggctccccacaacccccataagtaggctccctgggtgcccttttgtcaactcttggatctggaggtgaggtggatggacctggggaaaagggctgtgtgggccctggatgtggacttggagtcagcaagcaggagactccaagacccagggtactcagaatgtgatctccaggtggtcatgggctccaagtgggcaccgttccttgtgatgcagaagcctcaccccacagtaaggggccagagaagagaagaccagggctccctccagcagtgctccccagtgcagcccaaaaaccagtgccagtccaagagcaggtccgagaaagctcagcacttcagcttctgtgctgaaaaaacagggtactactgcctggttttaaacaaagagctgctttatgaaaaggattactctggtgcgataatgagagagacagaagggagcaaaggtggaataaggagacctatcaaaaggcattgcaatcatccaaacaagtcatgacagtaacatggaccagggttgcagcagtggagctgagcggggttaagattttgatccagatgagagtcagcaagatctccttatgggttggatgtgtgacgtgagagacaggtgtctgtgcatattttattgtgttctgggcattttggatgatgcattgttcagtgtctggattttgtcgtcttcctttaaatatcagattttgtctggcagacagttaatttccttatggatcagcttga

SEQ ID NO: 474020 - DNA, 502 bp, Homo sapiens
ctgcaagcagagcccacaggtatctccaacgttgacctgagaatgttttcagagcagaaatgcagaagatctttctttcaaagcacacatgcctttgttccctgctttggatcacttaaggcaggcttgagcagcctcttaataggtttgttttgcggttggtttattcctccgttgggtgcaagggtggttttctttctcccccctcagccggacctttgggatctgttttactcacctggaaagttgcataatcttgacaagcacaaagcaattaagagattcctagctcctgctgctgctgctgctgctgctgctgctgctgctgctgcttctactatacactgggcagccaccgaggagggcaccagaacaaatcagagtgatgaccgcctcctctgctgtttcgacactccccactcatctttgggtgacatcttgtatgactgaagtacaatatctaaactgacactgacattggtacaacactaagacaggtctt

SEQ ID NO: 474021 - DNA, 593 bp, Homo sapiens
acagtgggtatttaacacccgattgtgaatgaatgcatttgcccttcaaagcaggaaggcctttcttcttgctgtgggttgtggaggggcctcggtgctgtcggtccctggaggtccagaatctcgtccaggctctcttagaggggaggaagccccacttcaccacccagcatatttccttcaggctcttgcctacctgctggccgcacttttggctgttgtgaataacgccatcacccagctccagcgattatcaactcagagccaatcctgctgcagcggacgtgagcttctgctctccctcggtgccacctctttccccctcaaacctagtcctcgggttcttgaagcagggaagactccaaagattccagaccactgcaaccatcctagttttagggtccctagttttagggccctgcccagagacatcgccaacatctcactggccagaactatgtcacatggccatccctagctgccagggaggctgggaagttaagtacttcagctttctagactctgtggtcatgatggcaagggcaaggggctgaagtgggtgttgagagagccaaccaaggtatctgccacgc

SEQ ID NO: 474022 - DNA, 525 bp, Homo sapiens
cagcttctgagatcagacaagattgggcaccttcagggtggtatggccctatggtatgtggcagaagaaatttctaagcagcaaagcattcaagatgtgactcgggtgctgttaaaggcattcagttttataagggaagtagagcataaaagttcagaaaatttgcagcctgacaatgtgatagaaaagaaaaacccattttctgaggagaaattcaagctggctgcagaaagtaatgaggagctgaatattaatccccaagacaatggggaaaatgtctccagggcatttcgtattaagcacatagagcctcagttatacaaaaagaggtacatgaaaatggagtctttgcaaattagttcatattttaatgaaaataattttgctgagaaagtcactttgtttcctcacctaagaattgaggaggttgaaatagatctgctcttccaatatgacagctactagctgtacatggctatttacatttacacctaaattcattaaatgtaaataaaatgaaatatt

SEQ ID NO: 474023 - DNA, 610 bp, Homo sapiens
agttatctgcagaagatggtaggaccttgctccaaaatcctagaggcctcctctgtgactcacctatcggggcctgccaaaggctccaaacagcaaccccatctgccactgacacctcaagcaccattggatctgctgggtcatatggctcaagtggcagagcagcttgcacagcagcctggacctgttgcagagccttctgttctagaacccactaaaaactggcagcctttcgggtcactcgctgaaggaaaattgcttctggtgggccttatggacaggaatggagtaaaaggcatttgccaagtcaatggctgcatactaggtaccaggaaatgtggagccaatatggaggttctgccagctgccaagtatgtctatgccaactatgcattctgacactggggaaatgaccacaggatgagtccagggacccactggacacattttttcatatcaatagcactacacttctaaacatgcaggtcaacgaataatcacttaataatttgtagctgtttttttcaaatgattaaaatgtaaggtaactcttcaagcttatggtcaactaaaatctcatgaataaaatgttaatttggttatcaccttt

SEQ ID NO: 474024 - DNA, 1223 bp, Homo sapiens
gtgaagcagctggattgatagaatggtggaaaggccttttgaagtcacgactacaatgccaactaggattcacgggtccaggaatcaaggggtggaagtggaagtgtcaccactcaccaatatccctagtgatccactagcaaaatttttgtttcctgctccctcaacattatgttctgctggcctagagttattagttccagagggaggaaccctgctaccaggaaacacaacaatgattccattaaattggaagttaagattggtacctggatactttgggctcctcctagctttaagtccacaggctaagaatggagtcacagtgttggctgaggtgattgacccagactatcaagatgaaatcactctactattccacaacggaggtggggaagagtatgcacggaatacaggagatccattaaggcatctcttagtattaccaagccctatgattaaggtcaatgggaaaactacaacaccccaatccaggcaggactacaaatgactcagccccttcaggaatgaaggatccattgtatctgaaaaagtatgagagaaaaacttattcaattctactctattttataataggtactgcaaaataaggatgataatttacaccatgagaatagaaatgaatcagaaatgtttaattgtgaacttgagcatactaagttttaaaatgtttaaggtacgcacaatgaattactaaatcgtctttatttcttatgcaaaaaagctttcagttatagagcatggatagtttcagattttcatgtaatctagaatctggaatctccatagtaacctgaattgatcatttgtcattgaatatgatccattgagaaatgcaggaagagtttaaatttgtaatgaaatgatacttgatattcttggtaagtcagtgtcacaaagccatatattaactttcattactatccagagtgatacattgtgctcacttcccccattcatgtactattttcagtgttgcacaagttaatgaacactttcaattctgtctcatcaataaaaagcactccacaaattctcaggggataaagatcatctaaatcttcaggccaaaattcatagttctacactatttctgaaatacaattcatgcttctttattatgcatcctttctgctcttatgtagaaacctgtgattaatactttactaaaatttctcctgacactctttccacagggtaga

SEQ ID NO: 474025 - DNA, 966 bp, Homo sapiens
ccgcgagggtccgcggcttcattcttgaagtcacgtgctggcagtcctcacagccctcgctcgctctcggcgcctcctctgcctgggctcccactttggcggaacttgaggagtccttcagcccaccactgcactgtgggagccactttctgggctagccaaggccggagccggctccctcagcttgcaaagaggtgtggaggcaggcgctggcgggaacctgggctgcccgtggcgcttgcgggctagcgcgagttccgggtgggcgtggcctcggcagacccggcattcggagcagctggccggccctgcccgcaggggcaatgaggggcttagcacaccggccagtggctgcggagggtgtactgggttccccagcagtgccagcccaccggcgttgcgctcgatttctcgcccggccttagctgccttcccgcggggcagggctcgggacctgcagcccgccatgcctgagcctcccaccccctccgtgggctcctgtgcggcaagcggagcctcccagacgagcgccgccccctgctccctggcgcccagtcccatcgaccacccaagggctgaggagtgcgggcacacggcacgggactgccaggcagctccacctgcagcaccggtgcaggatccactgggtgaagccacctgggctcctgagtctgctgtaacactcaccgcgaaggtctgcagcttcactcctgagccagcgagaccacgaacccaccagaaggaagaaactccgaacacatctgaatatcagaaggaagaaactctggacacacagccttttaagaactgtaacactcaccgcaaggactatgatgcagatttgatacctgtgaaaggaaatgaagaaagagggaagattgggtagaaaaactcctggttgtgttgtagctctaagaaagtgttggctaatccaaaggcaagatctggtagaaatcctgattaacc

SEQ ID NO: 474026 - DNA, 3034 bp, Homo sapiens
ggtggggggtggtggggactcaggacagcagagcagcaagctgcgtctaccttggaaaggtggagagaggactgcagggagctgagggtggaggaagggggagatggcaggacagaggaagcaggggacagacaggaggaagagatggtgctccgggccaggtgtggaggggcaacccaccccttcatctggtgcccaacgtgggtgcttttctctagggtgaaggtacgctcgagtgtggtcattgaggacaagtccacaagagatcccgagtacgtctacagtcagccttgcgatctaaaagattggaaaaaaattggcaaagaattaaaacaagcaagtagggagggtaaaatcatcccacttacagtatggaatgattgggccattattaaagcagctttagaaccatttcaaacagaagaagatagcgtttcagtttctgatgcccctgaaggctgtgtaatagattgtaaagaagaggcggggaggaaatcccggaaagaaatggaaagtttacattgtgaatatgcagtagagctggtaatggctcagtcaatgcaaaatgttgactataatcaattacagcaggtgatataccctgaaacgttaaaattagaagaaaaaggtccagaattagtggggccatcagagtctaaaccacgagggacaagtcctcttccagcaggtcagatgcccgtaacattacaacctcaaacacaggttagagaaaataagacccaaccaccagtagcttatcaatactggctgccggctgaatttcagtatcggccacccccagaaagtcagtatggacatccaggaatgctcccagcaccacagggcagggcgccataccctcagccgcccactatgagacttaatcctacagcaccacctaatagacagggtagtgcattacataaaattattgataagtcaagaaagcaaggagatattgaggcgtggccattcccactaatgttagaactgataccacctggagaaggagcccaagagggagagcctcccacagttgaggccagatacaagtctttttctataaaaatgctaaaagacatgaaagagggaataaaacagtatggacccaactccccttatatgaggacattattagattccattgcacacggacatagactcattccttatgattgggagattctggcaaaatcgtctctctcaccctctcaatttttacaatttaagatttggtggattaatggggcacaagaacaggtccgaaaaaatagggctgctaatcctccagttaacatagatgcagatcaactactgggaactggtcaaaattggagcactattagtcaacaagcattaatgcaaaatgaggccattgagcaagttagagctatctgccttagagcctgggaaaaaatccaagacccaggaaccgcctgcccctcatttaatacaagacaaggctctaaagagccctaccctgattttgtggcaaggctccaagatgttgctcaaaagtcaattgccgatgaaaatgcccgtaaggtcatagtggagttgatggcatacgaaaatgccaatcctgagtgtcaatcagccattaagccattaaaaggaaagtttcccgcaggatcagatgtaatctcagagtatgtaaaagcctgtgatggaatcggaggagctatgcataaagctatgcttatggctcaagcactaatgggagctgctttaggaggacaagttagaacatttggagggaaatgttataattgtggtcaaagtggtcatttaaaaaagaattgcccagcctcaaataaacagaatataactattcaagtgactacaacaacaggtaaagagccacctgacttatgtccaagatgtcaaaaaggaaaacactgggctagtcaatgtcgttctaaatttgatagaaatgggcaaccattgtcgggaaacgagcaaaggggccagcctcagtccggccccacaacaaactggggcattcccagttcagccctttgttcctcagggttttcagggaagacaacccccactgtcccaagtgcctcagggaatgagccagttaccacaatacaacaattgtcccccgccacaagcggcagtgcagcagtagatttatgtactatacaagcagtttctctgcttccaggggagcccccacaaaaaatccccacaggggtatatggcccactgcctgaggggactgtaggactaatcttaggaagatcaagtctaaatcgaaagggagttcaaattcacactggtgtggttgattcagactataaaggtgaaattcaattggttattagctcttcaattccttggagtgccagtccaggagacaggattgctcaattattactcctgccttatattaaggttggaaatagtgagataaaaagaacaggagggtttggaagcactgatccaacaggaaaggctgcatattgggcaagtcaggtctcagagaacagacctgtgtgtaagtccattattcaaggaaaacagtttgaagggttagtagacactggagcagatgtctctcattgctttaaatcagtggccaaaaaattggcctaaacaaaaggctgttacaggacttgtcggcgtaggcacagcctcagaagtgtatcaaagtactaggattttacattgtttagggccagataatcaagaaagtacttcccatgttaaaaaacatttattatcgtattttgctgtaatgggagttcgagaaaaaattaaaactgacaatggaccaggatattgtagtaaagctttccaaagattcttaaatcagtgaaaaatttcacatacaacaggaattccctataattcccaaggacaggccatagttgaaagtactaatagaacactcaaaactcaattagttaaacaaaaagaagggggagacaataaggagtgtaccactcctcagatgcaacttaatctagcactctatactttaaattttttaaacatttatagaaatcagactactacttctgcagaa

SEQ ID NO: 474027 - DNA, 811 bp, Homo sapiens
gccaatttggcaaggtaaaaatacaccctccctccccaagatggctgctgaagatgagttactgttgccgcggctccccatgctgctcgaaacaggcaaacagcttctggacgaagtagaattagcagctgaaaccaccggttaccagatagtccaggagaaggtgttcaagggcctgggcctccttgagaaggagaggcctccagtgaaatccttcattctcacgcggaacacagcccaagccaaattatttggagctagttatccaagtctggcaactatgacagtgagtgactggtatgaacaacatcggaaatatggagcattgccagatcagggaatagccactgcaacaccagagaaattcagaaaagcagctcagcaacagaagtatcaagaagtgaaggagggagaggatgatgaacactctacagagttcgggagtgggataactggaaggacacccatcctgggggctatggcaaccgacagaacatgggctgatcttcccccaacacgacaggactgcagggtgcacacctcccccaccaaggaaaaccatgcagtgttcccctccctgggctcccgcttcagctgtgtacaacgaaggcaaagatgctaaatattgctttgcattcaatgaagtgtcaagtgattaaataaaacttctcaggtgcttgctgtagaaagtggttgatgtttttggaaatataagtacggctgtgacaatgtctgcaaaatacatcctatatctaagagtccaaatccccatttaataaataaggaaagaactagccaatctcatgaaagc

SEQ ID NO: 474028 - DNA, 809 bp, Homo sapiens
tgggaagaggcattacttgttgatggtaacagggacctggaatcatagagttaatttgggaagagatcttcaaactcatctgtttgtggagctgcctgccagtcctgcgcctgcgccttcactcctcagcccttgggtggtcgatgggactgggcgtcggggagcagggggcagcgctcgtcggggaggctcaggcatggcagctaaggaccggcgagaaatcaagcacagcgccggtgggccggcactgctgggggacccagcacaccctccgcagccgctggcccaggtgctaagcccctcattgcccggccagcagggccggccggctgctccgagtgcggggcccgccaagcccacgcccacccggaactccagctggcctgcaagcgctgcgcgcagccccggttcccgctcgcgcctctccctccatacctccctgcaagctgagggagccagctccggccttggccagcccagaagggggctcctacagtgcagcggtgggctgaagggctcctcaagtgccaccaaagtgggagtccaggcagaggaggtgccgagagcgagcgagagctgccagcacgctgtcacctctcactaagatatgatgttctgtgagggtccacttgataaaaatccctaggtgagaagcaagaggaaggataggtctgtaattagaggggctggtgactgcaaaatgaattagatacccatcatttcattcattctaaggaggtacttagaatgagaaaaacatgactcaaaggaaagcaaatataagcaaccgtgggtgtttgctcgtcttt

SEQ ID NO: 474029 - DNA, 2670 bp, Homo sapiens
ggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaaggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggctccaggacgtgctccaggatttgcctgcaaggggccagtttgcatatctgcaaatattgctgggaaacaagcaagattggtgcctgattatgacccattaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacataatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtattctgaaaaatatttttaagtgttctaaaaataaaagtattgaattaaagagattctgcaatttttctaatgtacttttaagtgttaaaatacacattgtgggaaaattgaaaactctgatgagacttaacaaaattactctggaaagaatgccacaatattcttattcctttcctagtccctttcatctcattttaaagggaccctagtaagacaagatatgctttactactaaggcagccaagtgagtcatggtttttgagggtttattatttttgttcaacataagactaaaagtatgctgtgcattagaaaaatacttcatagtattcttcaaccagaaaaaaaatgtcactaagaggccttctagcctaattattctaatttttgtgaccctttgggctctgagagaaaagttgtctctaatttgcaaccagaaaatctctccatttgtttaaaactgtatagaacttttgcctgaaccacatggataattgccttactttggcttaagagatgtgctcttaatgagctaaatgttaaattccatctttttaattctctaaaccaggagtccccgatccccaggccatggagtggtactggtctgtggcctgttgggcagtgggccccacagcagtaggtcctcctgcatgacaaacattctcgtttttcaaattcttgccctattagacattcaataaaatagaaaccatcagaagctagatcccatcacctatctccttctcttgagtgattcttccacaatcttgaatggtccacaagtgcttcacagacatgggtttctttcaagtgtcgagtctggggtctcagcagctttgacagtgaggagagacgaacggggctgtagagttgcagccacccctcacttggaatggtgactactggttgtctgggcccagagatcaggagggacaagcagacggtctcttccatggactgggtttacacacaagaacacgtgtgtttcttctgttctagaaattagcatgggatatgcttcaaaaacatgactggccacagaaacagcttcatggttcattccattctttattgcatggttagtttttcactttttttaagcctgtgtctgcagtttacaagtagtgtagtatgcttgcaaccaaatcattccaatgctccccattggtctcctcttctgaaaaaggaaggtaatactagaatctacctaaaaggatcagagaaagggtaaaatggaacaactcgtgcaaagggctagcgttgcacctggcacatagtaagtgcacaataaatgtaagcacattttgaaatgtattattagtctttgggctaagcacctgcaccgaatttgttacctcctctttgctgctatttcctcattgatgaaattcagaaaacggtgggacctaattaactgtgttattgtgaagattaaatgacacaatacagtgccagcacctagttattactcaacataaatttgtcacagttctcacaagacatcagaacacccgctgatgtgctgtcccccatggcactcagcatattaagtgtggtcggcacaagcggctgcctggtgtgaattataattcccttgacttttaacaacagttggttttgaccccagctccctggtgcctggacctccagatccaccctggagcccacaggtggattt

SEQ ID NO: 474030 - DNA, 823 bp, Homo sapiens
aagtttgaccattctggtagtctgtcacggcttcccttggctaggaaaaggatatcccccaaccccttgtgcttccagggtgaggtgatgccccgccctgctttggctcgccctccatgggctgcacccactgtccaaccagtcccaatgagatgaaccaggtacctcagttggaaatgcagaaatcacccgtcttcttcgtcaatcacgctgcgatctgcagaccggagctgaagattgcttggaaaaagcggactttgacctgcatttttgagaatggaaataaattcaatctggataccttaagaattgagttcaacaattctgacccacagaatgacagtgttgagtttcctggattttctgtttgtctcatacatttcagacttggagctgaagaagctggcaaccaaaaaccaccaatggctggaaaaggtgcactgtctccaaacccagagcataagaaaacacagaaaactgaaaagaaacatgtgtctgaaaatgacatggtaattgcttcaaaatatgagccactgcttcataatttaagtccctctaaggcctgatatgccttagtcatctttggaaatcagtatctttgagtcaatgaatcttttggctgcttaaccttctccatggtaggaacagtttgaagctggaaggatgaaccagctttgcctcagtgactggacccttattttcatatgcagtcaggacccaacaataaaagcaaatttttaaaaacgctatgcttagaattgaaagaatgcagaaagaatgcaaattgcctttacagctgcctgaccatcctagtgaatccttt

SEQ ID NO: 474031 - DNA, 1657 bp, Homo sapiens
ttccctgaccccttgtgcttcccggaagcacaactccccacatccgtgcactaggtacagcttagtgaccaacaccttcgagatagatatgagtacatggactcccagtagacaccagatgtgtaggccaaaacccaacattgtggcctgtagaatccaactgactgtgaacaagcttacctacatcctcaagctcctcttggattattcttcccctcacattgacttgacaacaggaccctcagctgcaagtctgttggagtttgctagaggtccactccagaccctgtttgcctgggtatcagcagcagtggctgcagaacagcagatattggtgaaccacaaatgctgctgcctgatcgttcctctggaagttttgtctcagaggagtacctggccgtgtgaggtatctcaagctgtgttctgggagaaccactactctcttcaaagctgtcagatagggacacttaagtctgcagaggttactgctgtctttttgtttgtctgtgccctgcccccagaagtggagcctacaaaggcaggcagaccttcttgagctgtgcttccttgagcagggagcttgctcttgagagaagtgacttcagctgaggcatttcccgcagtgtggactgaaagctgagggttatttgctggcagtactcccagaacttgactggactcaaacatctggcctcaagtgatcctcctgctttggcctcctaaagtgttgagattacagacatgaatcaccgcactcagcctgagacatacttctttaattcctgtaacattattttatgctttgatacctgatggataatgcagggccaagctgcaccatgttcctaagagaaagccaagaacataagtcacacaagccctcaggaagagaaggaaagaatgagtgacagtagaccgcagatgtgagcaaattcatggaggatggaaactgaatgagggaatggtggctggcttaacttaacagaggaaagtgcattctaaatacctatcataaaagcaacaaagagaataagcctatccactccacactttggaactgcctgtttaaaagttgatccccggaccccaccaagtctacaagctccacctcaaggacagaatggaaactgtattcatcgaggggcttttaattgacaaataaaaattgtatatatttatccatgtataatatgaaggtttgaaatatgtatacactggggaatggctaaatcaagctaactaacatctgcattacctcacatacttattttttgtggtgagaacacttaaaatctactctcttaataattttcaagagtacaatatattgttattaactatagtcacaatgttgtctagcagacccttctcaaaatctaacaaaatgtttggctagtaataggggctcaaaaagtatttgtgagtgaaaagagtgaatatattaattaatttgttaatgtattcactggcaggtgtatttacctaattcagtctttaaaataatgttctatattccaagttttccttaaggagttaacccaatattatagcttgattgtttacacaagacccataaaacaaactataatagcaatagtcaacaaagagatgatattggcataatataatgctatattggttgtattgtgctgccata

SEQ ID NO: 474032 - DNA, 1444 bp, Homo sapiens
aaggtttctattttaggtgcattagtttctatttcggcatactttacttttacttaactaaaatttcaaataaaatgtatccacttttatgatctcaacaagatcggtcattcctatagcggagttgaaaactttcaacttattcacaattatcaaaagaatggagcagcccccacagagacttccagcaatgagttgtaaaatgcagtctgcattaagtagcttccttacaatcatcccgatggtaaaagtgtcaaatttcgcaaacgcctggacaaggaagtgaaatgatcatctaataacgcagttgactcatctgtcaaataagcgagtgggccagggtccctgagctcactaccctcagattctaactccagcttcacatcattaggcgtaagcagccaattgggccgtctgggagccgtgcatcctgggagttatagtttccggctccctccttcagattacaagctccacagagccgcgggaggacggttgcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagatcaatagctgcacagctctacagcatctcgatttatcagacaataatatatcccagataggtgatctatctaaattggtatccctgaaaaccctgcttttacatggaaacatcatcacctctcttagaatggcacctgcttacctacccagaagtcttgctatactttctttggcagaaaatgaaatccgagacttaaatgagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaagaggcagcatggtgatgtgggcagagataaaggtttggtgtaaagagagacccacaaagagagatgagacctgcttacgatagacaggggaaggcttcacttttttctctgctatctattagctgtgtggccttgtcaagttccttagggcttttctgaggctaagtttcctcatctgtaaaatgtgaatagc

SEQ ID NO: 474033 - DNA, 905 bp, Homo sapiens
ctcccacagtgcagcagtgggctgaagggctcctcaagtgccaccaaagtgggagcccaggcagaggaggcgcccagagcgagcgagggctaagaagacaggaaaatgtgggaaagtttggaacttcctggaaacattttcaatggctttgaccaaaatgctgataatgatatggacgatgaaattcaggctgaggtcatctcagatggagatgaggaatttgttgggaactggaataagaactttgaaattgagggagatgatttagggtatctggcagaagaaatttctaagcagcaaagccttcaagatgtgacttatgttctgttaaaagcgttcaattttaaaagggaaacagagcatgaaagtttggataatttgcagcctgatgatgtgatagaaaagaaaaacccattttctgaggagaaattcaagccagctgcagaaatttgcataaagggtgcaaggccaaagcattggcagcttccaggaggtgttgggcccgtgggtgctcagaaatcaagaattgaggtttgggaacctttgcctatatttcgcaggatgtatggaaaagcctcggacggagaaaaggggagcagtcagaccacaagagcattctcaaacaaatcaattgtaaggagaagtaaatttgaaagttgaagatctggaaactaattccttgacaaattttcattcccatataatccttgaaagtctaggagcagctctggatactcagttattttatcatgtgctctattacagttctctgtgcctgtatttgtctccctcactagatagcatgctccttaaaggaatgtatcttttccaactttgcaatccccatacttcacacaatgcctggggtacagttggattacaatgaatttttgatggaattaatg

SEQ ID NO: 474034 - DNA, 565 bp, Homo sapiens
tgtttcagttgaaggtgttgtgtttattcgccctttctgttcctctccatcactatgagtggaagtggtcagggacatattgtagagtacggaagaagaaagaactttcataattatgatacaataagatgttccagactcatctctcacactgatactgtcctagccctgaaatcagccatgtctcttagtgaaacaaagaaagaatggtgtgggagaaggccagttatgaagaagcatctaggaaaagtaagaaaagcagcaggaggagacaggactaacgtgcagcttccacttggatggaaaggacagcatatggaggttcacatcgtgaacttttgctccaacaactgccacaggaacataccaggaaaacctaaagaattcacagagcctttgaaagaagaggcctgctggaaagccattcctggccttatcttgcaggcatccttggagaagggaaggcagcccgtgaaactagggaggggccacagggtgaaggaagtgcctagctaaactttgtaataattttgactgagcacaaactttcctgagcagaatccag

SEQ ID NO: 474035 - DNA, 553 bp, Homo sapiens
cggcttgcactgtgtacctggaaaagctgcagacactcaatgtcatgccagcccatgaaagcagctggaggaaaagctctaccctgcaaagccacaagggcagagctgcccaagaccatgggaacccacctcttgcatcagcatgacctggtcgtgagacctggagtcaaaggaaatcattttggagctttaagatttgactgccctgctggatttccgacttgcatggggcctgaaggaactgaagctgcttgtaaggttattacacaactttttccttggaatcacaagccatactgtggtatgaagaggaaagtaccaagggctccatggttaagaaggctctcaatcctgaacaaattgggagagctggtcatcctaacgcaggatgataggatgtgcaaagtaaaacgaagtttagcaaggtgggcagaaggcatatgtcatgcagaacttcgcaaattagggtaagaagatggattctattctaagtataatcagaagtcatatgattatcttgagaaaggggcgacatgatttttactgtcagcat

SEQ ID NO: 474036 - DNA, 787 bp, Homo sapiens
tctcaggcccctgtgaggtggtagctgcagctgtgtcagcccaaactcaatctgacggtggggcacagcccaatgttaaattctcaaaacgtcatagtgaccctgggaccagagagggtagggtccctcccaggaaaacggcatgggcaagaagctatggggagtgaagtgggctcatgtctcaggctcaacaacattcgacaacagggtggtagagcccctcccgggggtgcatgtgagctcctggtctccctcctccctccatggagtggcacaatgacagcagccatttgtggataccccatatctaggctttcaaggtggtgcctagctgaggcttttctaggcttggatgcctgtgggaatccatgtgggctcctcttctggaagcaacgtttctgtgcaatctttcagcagctctgtgataccaaaaatgaaattcctcgaattgataggaccactggctctgatgaaagggacccgatgcaagggtatgctatttgcattcggtgttataagtgcacttttgtctgtgccagaaagaataaccagcagcatgaagtagagtccctgggcagctataagtagcattcttcatatgaacacaattatagttccagaaagctacattcttattcatgtgtgtgagtgtgtgtgtgtgtgtgtgtgtgtaggtttataaaatcaatcttatacattcttaatttaaaccaaatttatgtaagttaaatttattcatattacattaacagtaattttagctaaatgatttattaattttttcagt

SEQ ID NO: 474037 - DNA, 1435 bp, Homo sapiens
gcttccttcagagggtctgtgggtcctcttgagattgctggtttgttcttgcagtcgatctggagctgcagagtaggtgggatgacagacgcctgtcgccgcgcgcaaggggctttgggtgtgtggtgggggcgggccgcggggctacgctcgtcgtccgggccgctgggccccctgcggggcgccgggctcccgtccggcccccgccccccgcgccgcgcggccctgccgcccggcgcccccgggtcgcgtcccgccgcggcctcccgccgccctcggcggctccgcgcgccgcctccgcgtcgcggcgtcgcccctgttcgccccgggctctcgcggtctgtcgcgtccgccgcgtggcgcgcgggtgcgccggccgacggccgcgcggcctcctgccgtccgcgcccgcggcaacagggacagctcagcatctgagtctgaggcctttgtgcatggcagtttcagaatctgctggggttttccccaacccttcgcctccacttgaaagcagatctaagggcaagctggtctctcaaaaagaaatcacattctctcctgccaccagagggccccatcaccagcaagaaggaagcaaagaattgggagcaataaggaaagaggaagtagaggagcctagcgacatcctaaaatggctgtggctcaggggttccctgattctgtttcctttcaccaaatctagagctgtgatgttatccaggctaaagtgcaaaggcaccctggttcaagatgcaggtgctctcagcctaaaatggaaacagtcagggaaagaccagaagactgtggaggggcgaccagggctgaacaggcttgaggagcctcttgggaaggacatggatgaaattggaaatcatcattctcagtaaactatcgcaaggacaaaaaaccaaacaccgcatgttctcactcataggtgggaattgaacaatgagaacacatggacacaggaagggcaacatcacactctggggactgttgtggggtggggggaggggggagggatagcattaggagatacacctaatgctaaatgacgagttaacgggtgcagcacaccagcatggcccatgtatacatatgtaactaacctgcacattgtgcacatgtaccctaaaacttaagtataataataataaaaaaaaagaaaaaaaaaggagagattaataacacataaatagccaactggtggagcaaaactctcacaaccagcccaggaccacctgccacttgattctaataagtaatagggcacagacactgaagacagatagtctgggttaaggtgctggctttgtcttttactggctgtgtgatcttggacaaatgacaactcatttctgtgtcccagtttcctcatctgtaaaatgggatagtgacaataatgaaagctaattcatagaattgaagggtaggt

SEQ ID NO: 474038 - DNA, 755 bp, Homo sapiens
gttgctcctcagcttgcagatggcctattgtgggacttcatcttgcgatggtggtatgcgtgagaatgggaggttgcggaactcttattcacatgtaccgtgagatactggggcgcgcattccttccgtttcctctcccacaactctcaccactaatcactcatcgaagagacaaacaaattgaaaataattatatcaccatctcatgtacgcacttccattacccgtgtgacactgatcgagcgattcaagggataagacgtaccatgcattctctaaataatgtactgaatactacattccaactcttctcgcccaaatttagtggaaaacttgatgaactagacgtaatacggtactccagcgtacgtgctatccctacggatgaaaacataatgacgatgttctatgggcacctgctctctcctatgtttcactatcattcattcttattatcttgttaccgctctccgcgtacctacatatcgcacaaacacatcttaataagttttacatatgcgcactattccgacacctctcagtacgcgcacttactcaatttcttatctgatccaccaacacctcactccgctcgccatcaaattactccacctacagctatctatcagtcacagtaacactacaaacaactgacacgctcatttaaattaatctaataagatcctccgtattttattatagactacaacgtcattaacgctagatctctatccgtaaaaaaaaaataaaaaacg

SEQ ID NO: 474039 - DNA, 651 bp, Homo sapiens
aaggatcctgtgtcataggtatatctcctaatgctatccctccccccaccccatgacaggccccggtgcgcgatggttcccatcctgtatgcaagcgcccttttgcatttctctgatggctaatggagatgagaaacttgttgggaactggagcaaaggtgattcttgctatgttttagcaaagagactggcagcattttgcccctgccctagagatatgtggaaatgtgtacttgagagagatgatttaaggtatctggcagaagaaatttctaagcagcccctgaatggtagatctaccagcagcttgcactgtgtgccaggaaaagccacagacactgaacaccagcccttgaaagcagctaggagagagactgtatcctgcaaagccacaggggtggagctgcccaagaccctgggaaccacctcttgcatcagtgtgacctggatatccaactgtgaatggctgttgaatgcagaagacaataaaagtggataaaagaaaaatgaaaatagtaatagatcagattgtggaaaagaattgaaaaccaaatagaaatttttaagttaattataaatgaaatgtgcatgagtattttacatcggctatctcaaaggaagtttgagaagaaaaacaatgtaatactcatt

SEQ ID NO: 474040 - DNA, 546 bp, Homo sapiens
gctggcatgcactcgcccacagctaacccccacattacttgattggggggaatgcatactttgcctcctcttccccgctggcgcatgtgtgcatgtgcactccagcatgccactgctgctgccatgaatggaccctaccctcctaccgtgacaccattgtcaatggggaatgcacaaaaggagaccagcagccctatttcctgtcctgagctgccattgctgctggtgcaattgcatgcacagagaacatcagccctgtgcctgccaaagccccacctccacactgacactgctgctggccacatagatgctggtagctcctgtaccccttgccatgccaccaccactaccaccactgtgaatgcccacacagaggccagcacctctgtggcaatcagtgccctgcctcagtctatgagcatgtacaccaggggtcacagaacaaagccaggggcctgataccagcccctaaaagttagagtatgcatctcaggagttccgagctgaggctttgctccctaaaatcttccagaaatgaagccagtt

SEQ ID NO: 474041 - DNA, 827 bp, Homo sapiens
tcctcaaggtccgttaccatccgaggaatcctgggacaacctaggaagcagaatggttcatgattctgcacctcaaggatgccttcttctgtattcccctgcactctgactcccagttcctctttgcttttgaggatcccacagaccacacgtcccaacttacatggacggtcttgccccaagggtttagggatagccctcatctgtttggtcaggcactggcccaagatctaggccacttctcaagtccaggcactctggtccttcaatatgtggatgatttacttttggctaccagttctgaagcctcatgccagcaggctactgtagatctcttgaactttctagctaatcaagggtataaggtgtctagtgagatagccaggcccctctatactctaatcaaggaaacccagagggcaaatactcatctagtagaatgggaaccagtggcagaaacagccttcaaaaccttaaagcaggccctagtacaagctccagctacaacactcaccgggaaggtccacagcttcactcctgaggccagcgagaccagtcttttagaaaaagtataatttggaataatttgttcttatttaatttatggtggcttcatcgagtgtcatttcctttgctaaattaaataatttgctctaaaattttacctagagttgttcttagactcaccagcctaaaatttctctggcttatcttacatgtctggtgcctatattaacctaagtttcatgtttgattagtggccgagctcattatataactacttgtgcactcatttcagattcaatatggaccctttccttttctct

SEQ ID NO: 474042 - DNA, 574 bp, Homo sapiens
gcatacatctaaaacttgcagcctctggcttcattatgagtcagatggcaaattggaaagactgcgggtgggtcctgaaacaaggctttgaatgttttctgcgtctttgtgagcagctaggctttctactgcttgtaacattaaagttgaatataaaactgtcatttaaagaaaaagtgctagagcatctctttccttcccggctgtatttgggatccatcgacccttccacagagaagtctcctttgaagccaatatccctgatgaacatcgatgtgagaatcctcaataaaatactggcaaaccgaatccagcagcacatcaaaacgcttatccaccacgaccaagtcgtcttcatacctgggatgcaaggctggttcaacttatgcaaatcaataaatgtgatccatcacatacacagaaccaatgacataaacacattattatctcaatagatgcagaaaaggcctttgacaaaattcaacaccccttcatgctaaaatctctcaataaactaggtatcagttgtacctatctcaaaataataagagctattgatgacaaacccacagcc

SEQ ID NO: 474043 - DNA, 630 bp, Homo sapiens
gaaacttagggtagtaaagtgggaatggaaaggttaataaggcctggatcaaaccatcagggtttagaatgcaacagtgagaagtgtgagcttggtcccacaggagccatcaaaatttcctgtctgcaaaaggaaatatataatcacattaacatgagctcatactggattggggtggtccctaatccactgattggtgttcttaaaagtagtgcagagatatacagagacacaagcagggaagagggcaatgcgatgatggaggcagagattggagtgatgcaacttgaagccaaggaatgccgaggatgcagcaaccaccagcagcggggagagatatctgtaacaatttcctccagaccctccagaagaaaccaagcctgcaaaactcttgactttgcacttctggcctcctgaactgtgagagaatacatttctgttgttttatttcattcagtttggggtaatttgttactgaacacaacagaattttatgtagaacagaaaaatattcttgtaatcatcaagtccaatgggctgtaattattaaaaccacaattttaagtgtacttttctgcatagtattaaaaagttgctgaaaacatatagacagctgttttcttatgtgta

SEQ ID NO: 474044 - DNA, 1250 bp, Homo sapiens
gagaagccgtcgccgcccgtagttttcgactttcccgccaggcccgacgccgctctgacgccaccgaggcgcgccatgacgtgacgccaacttccgcgccggaagtggaaggccgggcagcccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggtgctaaccatctggttgtctcgatgcaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaaggaagctctccactgggcccttttcagcatgcaagccacgggccacgtgctgcttcacctcctgttacctgcagcagctcctcgatgccacagaggacgggcatccccccaagggcaaggcctcatccctcatcccgacctgtctgaagatactgcagtgaaagcccaagccctagctttccccagtgaaggactagactaggggccccacgctcaactggtagtggccacaagcctggcagctgtagagccgctaacctcccgacacctccctcaccacacaggaccctgagtgaggaggaggggctggaaacctgggatgggttggccaaaggagaacctcaggctcctggcctggcccagctccttcctgcccaagttagcttagcccatccagactggtcctgaagtctgtccctccattggcatgaagtctgcccctcagcagtccggcctcacaggctgtactttcatggtgctctctaccttctggcccccatcccagaacattcgtgagtgaattcgcaagcatactagcatgtgatattagggagtttgcaataaattatgatgctgatgtatcttgcctgttaaaggac

SEQ ID NO: 474045 - DNA, 3072 bp, Homo sapiens
ggacaggtaactttggagcaacaacctgagggagtggggactcaggacagcagagcagcaagctgcgtctaccttggaaaggtggagagaggactgcagggagctgagggtggaggaagggggagatggcaggacagaggaagcaggggacagacaggaggaagagatggtgctccgggccaggtgtggaggggcaacccaccccttcatctggtgcccaacgtgggtgcttttctctagggtgaaggtacgctcgagtgtggtcattgaggacaagtccacaagagatcccgagtacgtctacagtcagccttgcgatctaaaagattggaaaaaaattggcaaagaattaaaacaagcaagtagggagggtaaaatcatcccacttacagtatggaatgattgggccattattaaagcagctttagaaccatttcaaacagaagaagatagcgtttcagtttctgatgcccctgaaggctgtgtaatagattgtaaagaagaggcggggaggaaatcccggaaagaaatggaaagtttacattgtgaatatgcagtagagctggtaatggctcagtcaatgcaaaatgttgactataatcaattacagcaggtgatataccctgaaacgttaaaattagaagaaaaaggtccagaattagtggggccatcagagtctaaaccacgagggacaagtcctcttccagcaggtcagatgcccgtaacattacaacctcaaacacaggttagagaaaataagacccaaccaccagtagcttatcaatactggctgccggctgaatttcagtatcggccacccccagaaagtcagtatggacatccaggaatgctcccagcaccacagggcagggcgccataccctcagccgcccactatgagacttaatcctacagcaccacctaatagacagggtagtgcattacataaaattattgataagtcaagaaagcaaggagatattgaggcgtggccattcccactaatgttagaactgataccacctggagaaggagcccaagagggagagcctcccacagttgaggccagatacaagtctttttctataaaaatgctaaaagacatgaaagagggaataaaacagtatggacccaactccccttatatgaggacattattagattccattgcacacggacatagactcattccttatgattgggagattctggcaaaatcgtctctctcaccctctcaatttttacaatttaagatttggtggattaatggggcacaagaacaggtccgaaaaaatagggctgctaatcctccagttaacatagatgcagatcaactactgggaactggtcaaaattggagcactattagtcaacaagcattaatgcaaaatgaggccattgagcaagttagagctatctgccttagagcctgggaaaaaatccaagacccaggaaccgcctgcccctcatttaatacaagacaaggctctaaagagccctaccctgattttgtggcaaggctccaagatgttgctcaaaagtcaattgccgatgaaaatgcccgtaaggtcatagtggagttgatggcatacgaaaatgccaatcctgagtgtcaatcagccattaagccattaaaaggaaagtttcccgcaggatcagatgtaatctcagagtatgtaaaagcctgtgatggaatcggaggagctatgcataaagctatgcttatggctcaagcactaatgggagctgctttaggaggacaagttagaacatttggagggaaatgttataattgtggtcaaagtggtcatttaaaaaagaattgcccagcctcaaataaacagaatataactattcaagtgactacaacaacaggtaaagagccacctgacttatgtccaagatgtcaaaaaggaaaacactgggctagtcaatgtcgttctaaatttgatagaaatgggcaaccattgtcgggaaacgagcaaaggggccagcctcagtccggccccacaacaaactggggcattcccagttcagccctttgttcctcagggttttcagggaagacaacccccactgtcccaagtgcctcagggaatgagccagttaccacaatacaacaattgtcccccgccacaagcggcagtgcagcagtagatatatgtactatacaagcagtttctctggttccaggggagcccccacaaaaaatccccacaggggtatatggcccactgcctgaggggactgtaggactaatcttaggaagatcaagtctaaatcgaaagggagttcaaattcacactggtgtggttgattcagcactataaaagtgaaattcaattggatattatctcttcaattccttggagtgccagtccaggagacaggattgctcaattattactcctgccttatattaaggttggaaatagtgagataaaaagaacaggagggtttggaagcactgatccaacaggaaaggctgcatattgggcaagtcaggtctcagagaacagacctgtgtgtaagtccattattcaaggaaaacagtttgaagggttagtagacactggagcagatgtctctcattgctttaaatcagtggccaaaaaattggcctaaacaaaaggctgttacaggacttgtcggcgtaggcacagcctcagaagtgtatcaaagtactaggattttacattgtttagggccagataatcaagaaagtacttcccatgttaaaaaacatttattatcgtattttgctgtaatgggagttcgagaaaaaattaaaactgacaatggaccaggatattgtagtaaagctttccaaagattcttaaatcagtgaaaaatttcacatacaacaggaattccctataattcccaaggacaggccatagttgaaagtactaatagaacactcaaaactcaattagttaaacaaaaagaagggggagacaataaggagtgtaccactcctcagatgcaacttaatctagcactctatactttaaattttttaaacatttatagaaatcagactactacttctgcagaacaacatcttactggt

SEQ ID NO: 474046 - DNA, 596 bp, Homo sapiens
tatttccatggggagtctttgctctgacagactagtctccctcacccacccggggccagcctgtctgtcttctctgtccctgtacatgggagatgatcaatgttcatttgttggcatcagtaaaacaggaaggcccctgaggtgcaaggattggaagcccttccccccagcggagagggctcgggtgaggcatctggaggcgctgaatggggccgggagccgcgggacccgcagagggcgcctgtccgtgtgggcgcagcagcgcctagagggaggcggccccggcagcccgcagggggagcggcccccactaaaccagctgacgtgggacccctgggtcaatgctggccaggagatgcggctgacatcaaagaccctgggcccctgggccccctacaaccctggtcacgacagcccaccccatggagccagcctggcaccgggccagcctccagccataactgcaaaagagcaggagagcccggaatagcaggccctcttcagcgagcttcagccgctttgcccataggctgcagggtttgggtccgctgccataaatagctcccagaccatctttggtaatataggcctttgcc

SEQ ID NO: 474047 - DNA, 743 bp, Homo sapiens
gacctgtccccagtcagatgttttgtaagaggcagtcagaaccacactagctttctgaggggagaaaggatggcaagctgttttaaatgatcattaaacataatgatgaaatcacatcgatagaacagagctggaaggaacaaaggggagaagagggaagcgactccacccccaacaccctcacccctaccaggccacacccttacccacaactccgcccagaagagaagaccatcatgacagaaaggtctgcagctgttttcatccagggcctggtggcggggcatgctggtgcgacgcacactgctgcatgcagccctcagggcttggatcattcagtgctggtggaggcaggtgctgtagaagctgctggcaaagaggcggaggatggtgttggagtctattggcgctggcacagctgccattcccgtgtctttattgagggccactatgaactcaaagaaaaccaacttaatattcaacttgaaatctctttgggcttacaggcttgtaaggtgcaacaatgcataccccttccattaaaagaatgaccaggtctgctatatctgtgtccccagctctcttcatcagatgtattttcaggaggtcattgtttgagataatgatgggaaatactaggcatgtcacaagtcagctgtgaggaatcagcaggggttgtcttggtttccatgtggagaaggattctgagagccgtctgagatgagtaggacctgtgattgatt

SEQ ID NO: 474048 - DNA, 571 bp, Homo sapiens
cccaacagctcattgagaatgggccatgatgacaatggcggttttgtggaatagaaaagggggaaagaccaaaggcaatttaattttggttataattgaggatgttgaagaaagcattgaatggaagacattgcagaagaagaaacagcagaaaatcaaggaaaaacttagaataagaacaaaagcagctgtaaagatccaggcctggtggcggggcaccctggtgcgcaggacactgctgcatgcagccctcagggcctggataattcagtgctggtggcggatgacgctgtcgagggtgctggagaagaaacggcaggcagctctgatcgcctacgcaaccagagagagggcagtgatcaagctccagtctttggtccgtatgtggcgtgtccgctggcgatactgccaggtgctcaatgccatctacatcatccagggccactggcaatgccacaactgccagacctgcgctctcctccagggccactgtgtggtcacagccactcacctgcagttccacattgagatcatcaactcctaagggctggcaagaagggcactgtgtctc

SEQ ID NO: 474049 - DNA, 514 bp, Homo sapiens
cagccatgttgctcacacaaagcctaatgctccttattttctctccgagtcgtggactctatgcctgctcatgtgtcaagacgtagctcaacttccaacttcactaaaattatcaacctcacgatgcccaagccacatcccaagccaattaacttagaagctctggaggtggggccctggtatcactgctatggcagatatggcatctttactgatcggttcagcacatcccctggcacttggtatgcagttattgatttagcgaatacattcttttcaattcccaacagccacactggccttctgcttgctcctcagtcacacaaggtcatcctttgtggggctcatggcctttgcatctgctgttctgtcttacacattctcacccacatttttacatggtggccccttctcaacattcagacctgtccgaaatgcctcttcctcagagagaccctcctccatcaccctgactgacataacatcctgtcttccaggacttgcaaacctatta

SEQ ID NO: 474050 - DNA, 811 bp, Homo sapiens
cccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgtagccctgtaaggcaaatgttttacagaggcaagtgtatcgattggcagatgtgagaaccaagct

SEQ ID NO: 474051 - DNA, 1010 bp, Homo sapiens
tttcctggatgaagctgagaactcttcagggctaagccccaattgtggggctcgccgtccagcagcagaatcacgttctccagtcctgtctcccaattccctacttccctcttcagttttatagtttttgtcattaaacctatctgctgaacttagcatggctttaaaaagtcagatatcggagcagtatgaagaagaggtgagaacgacccccggaccgaccaaagcccgtgcgccgctgtgtcccgcgtccagcacctacgtcccgccgccgtcgccatcgccgcggccaccatgcccaagagaaaggctgaaggagatgctaaaggagataaagccaaggtgaaggacgaaccgcagagaagatccgctaggttgtctgctaaacctgctcctccaaagccagagcccaagcctaaaaaggcctctgcaaagaagggagagaaggtacccaaagggaaaaagggaaaggctgatgctggcaaggaggggaataaccctgcagaaaatggagatgccaaaacagaccagtcacagaaagctgaaggtgctggagatgccaacatagacttaactcccttaagcccagacatctgttgggacctgacccctagtcgttggttaccagtgtgtcaggcaatctggactttccagtgatgccactgagatggcacctgtcaaaagagcagtggttccatttctagattgtggatcttcagataaattctgccattttcacttactgaaagtcagggtcggcttgtgaaaagttgttaaacaacatgctaaatgtgaaatgtcaaccctcactctaaactttccctgttcagagcaccagatgaagacttcattgggtttatagtggctttctgatttttggtagtccattgcagaagggagtttgaaagttgttgtatactgttaacgattgtctgcccacgtcctgcctgaaataccatgattgtttatggaaagtatctttaataaagctggatacagcttggcttggt

SEQ ID NO: 474052 - DNA, 570 bp, Homo sapiens
ctccttctcttcattcagatgacggcttaggtgttgaagtctacaactatgattgtggatttgtctgttattgccaggtttatgggagtagaagcccaggctccccacaatgtttccactgatatcatcggaggggagccttatccgaatgaggatgaaagttctggctcccttgttggacaccaccctggcagagatattggggtgtctttgctacagcctcatgagggtggaaatagtgtcaaagttccatataagcccacatgtatgactttagatctttctgctatatatcactatctttgttactgtctggaagccagttataaagattatccttcatgtgatccacaccacagtgaatgtttggctctctatgcatttatatactgttgttatctgaattacaaaacaattaataactggattcttgatcattataggtggaaatagacaattgtttaaactacaaaatcatgaacatgttttccaccagatcttcctcttttcccagtctcacccacaatccaaacagaaatttacctgtttgattcaaattagagtaaaaaa

SEQ ID NO: 474053 - DNA, 721 bp, Homo sapiens
gccattgatattttgataccgatggcatcaaatttaagactgcttgggaacctgcaggtctgctgcagtttgctgggggtctactccagaccctgttacacctggtatcaccagtggaggctgcagaacagcaaagattgctgcctgctccttcctctggaatcttcatcccaggggggcactggcctgatgccagccagagctgtcctgtatgaggagagctggtgcactgtgctgggagaatcctccttgtcaggatcagctgctctcttcagtgccggcaggcaggaaagattaaatttgctgaagctgtgcccacagcagtcctttcctccaggtgctgtgtcccaaggagatggacattttttctgtaagctccttactggggctgctgcctttccttcagagatgccctcccccgttaagaggaatctagagaaacagtctggccacagcctctttgctgccctgtggtgaattctgctcagtgggaattgaacaatgagaacacatagacacaggaaggggaacatcacactctggggactgttgtggggtgggaggagggggagggatagcattgggagatatacctaatgctagatgacaagttagtgggtgcagcgcaccagcatggcacatgtatacatatgtaactaacctgcacattgtgcacatgtaccctaaaactcaaagtataataataataaataaataaatt

SEQ ID NO: 474054 - DNA, 932 bp, Homo sapiens
tggcttaggaatggcagggaaactccaggccactaccggtgggtttgctcagctgtgggtgacgtgactgttctgtggtcatgaaccaggggccctgcctggtgaagagtagcgggtgggcgctctgtgctgggggtctggaccagcccctggtactcacagaggacttttcagagcctggagacagtaagggcaagggctgcaagacagcaaacatcacaccccccaccctctcaccccccaacccccaaacactgggagcgctgtcccagagagttatggagctgctactggctcaatatccctggcagggggtgggtggagacccaggccaggaggactcatccagtgaggagaaacagagctccctctcagggatgtgtaatgctgctaccagcagctggctagagttccaagccagtgggtcttatcctgtgacctctgaagtgctatggaagaagccaggatatctaaggctcctggggctccgtgtgtacctgagcggctgctctgccaagactccccatagctctgtgtatctgactgaaggccctagtggagtgggttcatgaggggatctcctgacccaagagtagcaacgatccatgggagaagcattgtttttacctaatctgttgacatgtgactatacttgatgttggagcagttctccaacattattttcatcaatttcatgaaattctgcatcttttgcaagaatcacaactccactttgccatctatttgacttgtgttgtcagatgtttacagtattctacaagcaataagagttaggctgaaaaagttttgacttgtgatcagggatagtcattcaagctaagcagagaagattgtttgaaaggggaacaattttatgggtgttcggttcatgagtgaatactttcatgtaatggcaaatattcctatataat

SEQ ID NO: 474055 - DNA, 783 bp, Homo sapiens
tgtttctggccagaaaagcaacatgcgcatagctgcaaaccagagcagagctttcaatggaaattttttaaaatggctggacttgacctgggaagaatcttctgctgactctcaacttttcttggaaaaaatggatcattcccatcatacggggatgagctgtatggactccaacagtaccatgcaacgtcctcaccatcacccaaccacttcagcctcacactcccgtggtggaggagacagcaacatgatgatgatgatgcctatgaccttctactttggctttaagaatgtggaactactgttttccagtttggtgatcaatacagctggagaaatggctggagcttttgtggcagtgattatactagcagtgttctatgaaggactcgatagcccaagagagcctgctgtgaccaaatggaaccatccttatgtagacacacaaaactgttgggcagcagatgctgagctttcctcacctcctgcaaacagtgctgcacatcatccaggtggtcataagctacctcctcatgctcatcttcatgacctacaatgggtacctctgcattgcagtaacagcaggggccggtacaagatacttcctcttcagctggaagaaggcagtgactggctgccaaaggatgaagccagtgaaggagaaaaagcttaaattccatcttgagctcttggattgtgataatacaatgatttcattaacttttcatttctgtatacctgttcatttggaatgtaatgcttgacttctttgttcattttgga

SEQ ID NO: 474056 - DNA, 885 bp, Homo sapiens
ttgttagggtgattcgaattcggtgaattgccacctccggctccacgggtgcttttccggtatccttaaaagccatggctgctgcgcggcttcatgaccgacttgttcctcggcggcgagagcgaacagcggagagggagaaggagaagaggaagaggaagaggaggaacaagaagaagaaggaagagaaggagaaggagaggaagaggaagaggaggaagaagaagaagaaggaggagaaggaaaaggagaaggagaagaggaagaagaaggagagggagagggagaggaagaggaagaggaagaagaggaagaagaagaagaagaggaagaagaagaagaagaagaagaagaagaagattattcctcacatcttcctcaacctcaagcctcccagatttgtcctatgcagagtgggcagcatctccctcttggcactggcgcagtcctgtgggggagagagcatggtggtgcatattcacgttgatggcaccatacttcatattaaaaacaaagagtactcttagaaacaaagccctcaagaaggagcatttaggacaaaacaataaattaccaaaggggatggaattctgattctcatgaattcttctatatatgtatatatacataaatatgtatatatgcaaagaaatatatatatgtgcaaagaaatatatatgtatatatattcctaaataactcacagggtattatgctatgtatgatctataatctttcaggatttgctcttttcatttaatattatattgctaagattcatttatgttactgcatgtcactacagttcattcattttgactcctgtataatatttaattgcatgaatttcactaagtttatgttgttccttatcccactgaggga

SEQ ID NO: 474057 - DNA, 532 bp, Homo sapiens
cctcagacacctttgatggcagatgagtggagcagcctctggggacactatcacccaaagaagcgagctgctaatggcagatttttctgcagttttaaccaggcaactcccctcattggcatcatcacagagacaatgtgtcatgggtatcagcaaggattttgttactttgcagatcctaaagaaagtattccagaagaagtcattgttatcataggagatgacagctccatgtgtgttactgatcctgaagaccactcagtgggaaaacatgtggaggtggaagacagtgatattgatgatagtgacccagcaggagcctcagctgcaggtctgttggagtttgctggaagtccactccagaccctgtttgcctgggtatcaccagcaggggctgcagaacagcaaatactgcagaacagtaaatgttgctgcctgatccttcctctggaacctttgtctcagaggggcacctggctgtatgaggtgtcagttggcccctactgggaggtgtctcccaattaggctattc

SEQ ID NO: 474058 - DNA, 823 bp, Homo sapiens
ccaaaaagtaaaataggggtcaaggaccagcaaggaggtcagtatgggtcagagggctataaacaatgagagagaggaaggagagcagtcacatcaaaagggaccatgtagtattgctaaggccatatctgttgctctgaataatttgggacatattggagggaatcagcagaggagggatgtgatctgggaaatgattccactgatgccaatgcctctccatgttctcaatgacagtcaccttgaagctccaagagaagaatggaaagctgttcctgatattctaaacatcactgctacttgcttttctacactcactgaaaacaactctctaactttttcaacttataactcagtcattagcaaacataaaaaaccaatccaagtgatgcctgaaaaaggcatagtatgcttccaggcatcacgcactcaagatttgggaattacttatgttgatacaagtaattgctggtataatgtaaccagattaaatccagtagagtctctttttactagatatggttatacatccttacaacatgccataaaggggccacaaaaagctcttaacatcgaagtttagatttttgactgagactttatttttttagtttctttttttaaattttaactttttagatacagtgggtgcatgtacaagttttttacatgggtaaactgcatgatgctgagcaatagtcccatatgtacgtttaaagtctctgcttgtgtaaggtagctattgtctcactagtcatacctagttacaagaccaaccctaagtggtggagaaacagacgacatgcttgatgggagaatcttc

SEQ ID NO: 474059 - DNA, 736 bp, Homo sapiens
tcttaaggcaggaactacaaatctacctggtgctccgtactaccatggctaaggccactctttcctgcccttcccacaaaccaaggagtctctccctgtggctaccactaccacaggcccacagaaagtgtgctcccctgtggcccagggcaggtccagaaaggccatccaagaatcaaggcctggaactgggcacaccaagagcttggtgctctaccccgctgtggctgagctggtacctaagctgccccaactggtgtctcattaggatatgtgaccccaacatccactgtcttcatgcccaggacagtgctaggacttaccttagaactgtagtccgtgtaacctacactgccttccaagtttgtttagaaacccagagcactttagcccatggtggtgaggcttgctggagctcaattgctgactgctgggattggcagttctactctggctggggctggtctaaatgctctctccatgagtgggcatccactgagttcaggctgggtttgctttccgctgtgacagggcagcaaggagttcaatgcactgtctcacaggcactgagacttcccttcctcaaatacacagattctccatgccacacagtcatagtagtgcggatggaagaggggtggcattagtgattcaaaattgttttttctatcctcttcagtgcttctttcagtgatatgaataagtcaataccaggtactgtgattgctcacctgag

SEQ ID NO: 474060 - DNA, 755 bp, Homo sapiens
atcctgtctcagaagaacccccagaatgaccataaacttcacttttaggctgcaagcacattggacgaaaattttcctggtgcttggtgcttggcagaatagggggagggacatcacagatatgcaggttacattcttttactgtctacctggagttttctcacttctccgtggccctgggaagtgtctcatcttcatatttgaattgtctaatattgctagtgatgattttggtgctgaatttggcctgcaatcttcaagactgctgctgagcttgggagagaatgaaatggaggagccagaagggagatggaatgggaaggtagttttcctttctgaagtcggaccacttagtggcctgggctctccttcgactgccctggccaaactccgcatcaatccgccggttgatggcctgccggcctgccgctgtctgttggtctgctcctgcaccgggctgcttcaagcgggattggggcggcgtgggaacctagagtgggagagattaagctgaagggaggtcttgtgatagatttcacttatgagggctggaaaaaaacagggcagtaaggttcaagacgaatatttgctgaacttcattttccgtaactacacagttatcattaaactcagattgactcataaagttaccattaatcatcaaagaccaatgaaattcagagtgtaatcctgatcaaggcaagaaagttggataatttagaattacttgcagcagtcaatattatgtaatgctc

SEQ ID NO: 474061 - DNA, 661 bp, Homo sapiens
cagacttaagcgtccctgcctagaagctgtgaagagagagcagatcacccagcatggcgttcgagctctgataaggaacagactgcctcctcaagtaggtccctgacccccatgtatcctgactggaagacatctcccagtagggggctacagacacctcatacaggagagctctggctggcatctggcaggtgtccctctgggacaaagcttccagagaaaggaacaggcagcaatctttgctgttctgcatcctctgctggtgatacccaggcaatcaggctgtggagtggaactccagcaaactccagcagacctgcaggagaggagcctgacccaagggaacaaaactggacagagaatgattttgacgaattgacagaagaaggcttcagaaggtgggtaataacaagctcctctgagctaaaggaacatgatctaacccaatgcaaggaagctaagaaacttgaaaaaaggttagacaaattgttaactagaataaccagtttagagaagaacataaatgacctgatggagctgaaaaacagcatgagaacgtcgtgaagcatacacaagtgtcaatagctgaattgatcaagcagaagaaagtatatcacacattgaagatgaactcaatgaaataaagcaagaagacaagatt

SEQ ID NO: 474062 - DNA, 697 bp, Homo sapiens
ctcctcaagcgccgccagagtgggcgcccaggcagaggaggcgctgagatgagagccagcgagggctgccagcatgctgtcacctctcaatatcattgctggggagaaagaagcagagtcagaagatgaagaggaggaggacatgaaactcttaggtacccctgaagggggtagcaagtttacacagaaaaaagtaaaacttgctgctgatgaagatgatgatatgatgatgcagatgatgatgatgatgatgatgatgatgatgattttgatgatgaggaaactgaagaaaaagctccagtccctcctacaacacatgagaattctaggagatacaattcaagttgagatttgggtgggaacacagccaaaccatatcattccacccctggcccctccaaatctcatgtcctcacatttcaaaaccaatcatgccttctcaatagtcccttctacctatgagcctgtaaaatcaaaagcaagctagttatttctcagataaaatggaggttggaaattttattgtccatatttttagttaaaaatctgaggcctagaaaggttaactgacttgctttaagcttgagaaattgaaaccagtttgacatcacaattaccgtgctctactccctctctcttaaaagttcttgcttatgtccaaaatattagtagaaataaatgagagagatttcaccaa

SEQ ID NO: 474063 - DNA, 872 bp, Homo sapiens
ggacaagccccagtgagattaacctggtacctcagctggaaatgcagaaatcacccatcttctgcatcactcacgctgggagcttgcagccctaccttctgctgatgaacaagaccagtgacctctgccagtatggtagtgcctttctttgcttgcttggcttttggaacaaggagctcaaagtaacttacttaaagtataatgggactcatgcatcctctgatagaactgctactcctgcctatgcattctacctactaggggcacaatacaacataatggttattgatttaggtgtaaaccgtgtgtatatcctcatcttctggagagatgcagaatatgaaatgaccaatggatctcatggccgtgtgccaccctgcttctcctcctttgctgtaaatgggtccctttctctagtacagtgttgtgcaggatcctgtgctggtggactgaacgctccgtggataacatcttggataatggtactggcaaaggccttgtaggcatgaaagacaaaggagtttaacataaactccccatagcattttccccccaacaaatataccttgagaatcatacattctgctaggtcagataatacaagttacagagttgaatacatcattgctcggacttggtatagagccctttcctactctggacccacttaaaacttgcatcctttaatgccacttaataaatgagtttgaacagtattctcagatatagaatattctgcatccagagctcaaagatctccactagctcttatgcttccttctctaaatggaactatcaagtgggcagttgacatacattgttagagtcagaagggaggtctggactatagatgtaaattttcttgctagcgg

SEQ ID NO: 474064 - DNA, 677 bp, Homo sapiens
tatcatcagttaaggcaggaacaggccattttcacttcttttgtggtggaatgtcatcagttaaggcaggaaccggccatctggatgtgtttcctcactatgcgaggatcctccatcattaatgcctctttaataaaaactcttctcaaggccgctttacttccaaaggaagctggagtcattcactgcaagggccatcaaaaggcatcagatcccatcactcagcgcaatggttatgctgataagaccctgtgtcttgcatttagtttctcaattcatacaaaactgtatccaggccatcaccaaccattctatacaacaaatgtttcttctaacaaccccacaatatcaccccttatcacaaaatattccttcagcttaatctctcccactctaggttcccatgctgaccctaatccctctcgaagcagccctgagaaacatcacccattatctctccataccaccccccgaaaatttttgctgccccaacacttcaacactattttacgttatttttcttattaatacaagaagataggaatgtcaggcctctgagcccaagctaatccatcatatcccctgtgacctgcatgtatacatccagatggcctgaagcaagtgaagaatcacaaaagaagtagaaatggctggttcccacctttactgatgacatt

SEQ ID NO: 474065 - DNA, 652 bp, Homo sapiens
ttccactcccatcaatggtttggcatgcaggcacataggcagccacagcaacactgggtttcagggcagaggtgctcagaatggctgcggagacagggtctctggggtacactgcagcttcttgggctccagggtatgtgacacagtggcaactcaggtctcaaggaggtaccagggctgctcgggccctggggaaacggcacagcagcagcatgactctgggggtggtggagcatactggcaagtctggcactggcactagggtttggcatgcagcacagcagcagctccagcctcatgggtggtgtagtatcacagtagctcagatcttgggcttgaaacatgtctgggatggctacaactccattttggaccaggaagacaagggacctaacttagaaatggtggaggagaaagcttcagtcagcttggggtccagaggatggtatggcctctataccagctccggaatgcttccatatggacttttacaagaaagaaaaataactgtcactaatttttgtgtctttgtcattcctgggacaacctaatgctaaataatatatctaccctaagccttctctactcccctagtactggtcaaagtattaccagagaagtatatcctgctttatgtttcataacttaaggc

SEQ ID NO: 474066 - DNA, 956 bp, Homo sapiens
tattttccttgcgtatgtgggtttgctggccaacatgtgcactcattttagcgtgtttctcagaggtgttagcaaggctgtgtgctgcagtagcagagattccaacaaaacgatttttctcccctggagctgtgcagcaggttccagaaggccccaggaggaatcagcacaaacactgtgaccgttatttaccctatctgggacttcagcagctgggctgtttgcatgatatgcaaatgggcacatcattcaaggaagaaaggatgaatgctctggcacttgcagggcaaacattaactgctatgggaagagggccagcaaaagaggaaccagacagaagcgagtgggtggtgaggggcaggacaagaaacatcttccaaagaagcaaaatgcagaaggcagacactgcttactgggaaccattcagccttctcagcctcggtaaacaacagatgggtgtgtgctgcagccctttttcctgcagaaacagtgaatttcctctctacccaatttcttcctttgggtcaaatttgtaaaatactttatatgtggaaaattactgagagatacagagggaacaaattagctggaacagcagaagctctgggagctaagaggagactgactgacaggaaagaaaaacgtctggagtcaggcggacctaggcacgaatcttagttctaaaatttatcagctatggatattgagcaagattctcaatttctctgtctcagttttcttatctgtaaaatggacataataatactatctcatagtaggatcactgtaaaatttagtaaatctcctttgtataaagtgtctcttgccaacatgacagcaactgactatattttctagtttatgctcacgctttcaaaacgagcacctggctttttaattttttctgcaaagatgctgtgagaatcaaagagaatattaattatgcaagcacatat

SEQ ID NO: 474067 - DNA, 608 bp, Homo sapiens
agccacagggcgctgcagctgaggagctgatcatgtgcgtcttggactttcctcatccagtagacagctcatgcaaaaagaagcaagcctgttcaaacagaattctccagggacagtttgtctcccagatgtcagcggaggcccttggagatcctattaaacttgacccgaaccccaatgccaagccttatgagagccttgaatccacagagcagttgctctccgtacccacaccatatatcatcatgcctcattcagctttcatgccctcttatctaagagtgctgtctggttctgtcctgcaccacccattccaggaacaaagcccatttccttcacttggtcttcacaaaaacccacttgcattcagacgttttggaattattggccttacaaaagaggccccagagagctctctcaccccttcccaccacatgaggacacaaggagcagttggtagtctacaacttggaagatcaccctcaccagaagctgcccatgctggcacctggtcctggacttccagcctccatatctgtgagaaatgaatgtatgttgtcaataagccacccagtctgtgatagtgtattataggaacctgaacagac

SEQ ID NO: 474068 - DNA, 641 bp, Homo sapiens
gagcacagataagcccctccttaatgctgtgtagctctgtatcagttggccgtggggtgaaagtgccacctgtgtcagtctggtcacgggggcatgcagcccgagttgacctgggaggaagcactgatgaagcctttgtctctctccttcaattcaggcctcaggcaaacgtccatgttatgtggtattctccccatactgcaggtggggtgctcctttgtgtcttcgatgagcaggaggatgtacttcacttcaaatctgaactgagtcgtggaaagaatatacaccccagtgaagataagaaacatggtagtggggtaacaaaagatttgctgatcattccttggagcacagtaaaaactctggacagcatatatgaaacaaacataagaagactccgaaagatggagaatagcaggaagatcagctagagatctctggacccaacgaatgatttgtcggtgagttctctggatttttctttttgtctcatatgtaccaaactctgagctgaagaaactggcaacccaaaaacaccaatgggtacaaattttaaaaagccccaacaaaagcccgatctcttcaggtaaagaaccaggaagaaggcagactatcaacacaacaaatttttagataataac

SEQ ID NO: 474069 - DNA, 2602 bp, Homo sapiens
ttttaaaacaaggctgagcaccatgcctggcccaggccagcttgctttgttccagaggcaatttgtgcagaaagcagcaagttccctggtgctagagggcacagaaaaggacctgccaccctgcccctgtgactggggggcaggcaggggctgtgtgtggccctgccagcacctgccatgggccaaatccaaccggagaccagtgggctacgagcccagtgaagtccacagtgtccacctccccaagagtacagatctgggcagagactggatccaggttggggcagggtggaagcagagagtagccagcaggaagtgggctgtgggcatggcgggaatggtggagatggggaatatcccagggacttgctgccagcccacagcccatcaagcaggggcagggagagccagcacccagcgggggggtgagggagtcaactctcctgtgtttctgggccacatcgcctatcctatcttctgggaagccagaccccgtgtctggcggcatggctcatcatatgggaattacagctatatctaactcaccaagttgttgtgaaaagtaaatgggataagccagtgtttctcacattttgggtatttgcataccaccttcacactttcctccttacctgtgtaccatctcttattatttagttgatattttttttaaattggccctattttaaaccttagcctcattctaagcgataatatctatgaattctccagattgttagtcttaaactgagaaaatgaccatctcactcatgaaaagtaatgcagtgctacactttggtgaacactgagctgatctttacattcaggcagaatctggtgttcggcaaatatttgctatgctggcaccttcgatgctggccgatgctttgtcacttacttcctgagtgtgggctgctcatttatctccagctcttctgtcttgcttaggagcatcttgccagtggagcgatggccgtctcccaccgactctgcagttgctcatggacctggctcttccatgcccatgcaaaggccttcttcttgaagctcttgtcatccatctctacttccttctcccctcccagtggccatctttcatagcctcctggtcatttcctttcttccctgaaagctttcgcacctgcctcttggctttgctctccactctaggcttatccataaaccttgatgacttcaatgacatccaacatcttgtctcaaaggtccttgacctcttcacctccaataactatcttccccacgacctcttcagcaaacctggcacagccacatcctatggagcatgccacctgctagaactacacaatctcagaaatctttccatctcagacttcaccctctttccctccaactccttgtggccttattcccatgtttggttctttaaactcattagaactcaaattccttgatgctcgcttttctcacaggtctgcatcgaccttcactgcccagtctaggccccatgaggcattgcttagcaacttggaagttcctggccattttcagattccaccacacccacctgcaaagccccaatcttggagcaattaacctacctgcaggccagtcctattcctgggactgcagtggggcgtgtgtgggctgagcactgttgaagaaaatctactcatctttttctcagaagtttgttttgttcttatttccctatttgtggtactgtttctgttagataagtgttctgaaaatgataaaatgctaaaaaaaaaaaaagtaaagtatttgtatctttatcataaagacctgacctctcccatggaggggtttacagtcaattgattaattgtgagaaccatgcccctgtaatcatttggattttacacttctgtttggaaggcccttccccttctaactcaactttcaagactgtccaaaatcagttcttacaggaaatcttgtctgtgacccagacttggttaggtggttcctctccagctatgctttcatagcacttatcacaggactttgcaatgagctacttatgtagctgtctcccctatttgactgtgatgtgggtttttgaaaggaaggactttgtcctactcttcttggttcctccacctctcaccccagagcagattcacaatagttgcttgttaaacaaaactaaaatgacctaaagccagaaggagaacttcagcatcttttggagaagaaaaaaaaatttcttgcattaaaattatgctaagctgcaatagacaattaatattttgtctatttagatctccaactatgtgttatggaagttaatcacaggatcacttcctcttggccactgttgattggcttcagttgggccaatcagagtgttccctgggatcttttgaactggaattagagtacaagacatagttcctccttgttggtgaagctgtgaaatgtgaggcaggggggctgctgagagccatgttcacctccatttagaagaagccagtgtgcaatgagagtgatgtacacaggaccagaagtggattcctgcttcccgctgttccaggtgcctaggctgccagtctgtgagagatacagacagtcctctcatcaaattactcttggtcctaag

SEQ ID NO: 474070 - DNA, 760 bp, Homo sapiens
tgcagatggggggactgcagaccctgacctggttatgggggaacatggtgacctcacctcccatcctccccagcaacaagcttcagagggaaaggaggactcgagggccgagtgactccagctcactctatcaactcactctgcgcatctgtcagctgctgcagtgccctgtgcggttgcttgtggggacttgctgtgtgttggtcactccctggtggcaggccctgtatgggttccaaggatggcacttagagagggatgaagggcagccacggcttcaagaagcttcaggaaagctggacaagtggactgtgactggccagtgtactgtggaggtggcagagactcagtctgtaaatgaggaaagcaccgtgtccaagggcacaatcagcattggagtcccatcccttccaactccaaaatcccagctctttcctctaggctgcatcatctccctgatcagcctgatgctctggcagaatctggtagagtatgctgacttcaggcccaagcatctgcaattacaaggagctgagccccctgctgactggcagatcaggccagcttagttgtctcctgggggatccagagcaagaggtccacaggaggagcctggatgtgaaggcagatggtgaaggcttcccaagtttagcccagatcccctttgtttgcaggcccctgcaccctagctgcagtcattgggaaaggaaatgaaaggccactagcatggtattgaggggcatatgcttttgtccctccc

SEQ ID NO: 474071 - DNA, 1395 bp, Homo sapiens
tgagacccagagctctgaggaggggatgctgggcagcttgtacgatgtctctggccagggagtggttgatacatctcattctgcaaaatggaaagtggaaaaactgcaatgtggattcaccagctgcttttggaaggagctgctgctgccagggagaagaagccttgctgggtgctgctcacagaagcaaaaagcaggcagggaagtccttcaacaaagggacaaagagaagaggtgatgttatcagagtgcaggtcccggtaccatctgaggagaaccggaaccaagacaggagctgcccaagggagactgagaccatagaaaagggggtgcctggtgtgagtggaagacacaaggggatcttcagcctttgggcagaacagacaaagatattccctcacagaatctgtgaagaaatacttaatacagtagattgattcttctggagcagtttttgtttttgttttccagatccgctaagtgaccatctatggaaatgagtaacaattcttgactccatttcgcgtctgccagtgacatggctggcttctattccctaccctcacctcctatgagaccccatcaggctgatttaaatggctgtgaaagtgtgacttgttttaagtgcatctaaaaccacacttgtatgcacagttaatcttattttatgctacttgtgaatacattttaatctctcttacattttaatcagatgaaatttttaggaagagattgttccataaaatgcaaacttccatggtgcttagtacaatgtcgtgaaaacacaaatgcatgaatattttatgagtaataattcagcaaagaaatgtttaatattttattcaaaaatatttgaactgtataagtagaattatgctaagtgatatggatattaaaagattattaggtgattttatttctagccatgatggagtaactgggactagacttatcttctcactgttaactaaaaaaacaaaccaaatatataaggcaagagttttcagacactgggcaacaccgaaaaagatagaacaaaatgagcttgttaccaccctgactttctgtctggaggcactttctgcgggaaaggtgatctcaagtagagcatagctctttcggagttgaagaaatgaaattgcagttcagaaatgctgaaggggctagaatttgcaaggcagagtactggagaggaagaagctgcttaaagaaatagctccagaaaattgcacaagatcccctgaatctgttactgaacactaaatcatataagcatagagtgaagatccacagagctgagaaaagagcaaccagggagctgtaagctgaacagtttgcagagctcacatgtggctgacagacgaccaaattctgactagctagagtaaaagagct

SEQ ID NO: 474072 - DNA, 519 bp, Homo sapiens
acagactgagacaatgaaagaaaaagctgttttatcagaaattgaaggaactcgttcctctctgaaacatctcaaccatcagttacaaaaactggattttgaaaccttgaagcagcaagaaattatgtacagccaggattttcacattcaacaagtggaacggagaatgtcacggttaaagggagaaattaattcagaagaaaaacaagcgcttgaagcaaaaattgttgaacttaggaagtctttggaagagaaaaaatctacatgtggccttttggaaacacagatcaagaagcttcatgccaaaaccttcgaaaagtgcgggccttataaacaaggaaaggaggaccgtttaaggggggaaaagaggaaagaactctggcacgggaagttttatttgggacaaaagggagatagacccacccttttcgggttggggggagaggtgtctaaacgtttaacggaaaacggtttcccagtgggatctttttcctgtggggatttctaaaaacatctcct

SEQ ID NO: 474073 - DNA, 897 bp, Homo sapiens
caccacttctgccatatgaagatgcagcaaaaaggtgttgtttatgaaccaggaagcaagctctcaccagacaccaaatctgccagcagctggtactctgatgaggtgatgtcaaatggagctacaggccctgtccctggtgaatctcagaatttgtttgggttctctagatgcctggactgctgcctttgctctgagttcatatggagaagctacctaggctctgctatccagcgagacaactggctgaattctgcaatcagtctgagcttctgggtaggcactgcaattacctcagattggaccaaaccacaggaagatcattccttggccagaacatccagcaacagtacagagagcactagttctgagaaacacaactgggaaatgctgactgtcttaattaggatatatactattacaaatggaaatatattcaagctaactaatgcaagaaagaagtttaagggaaaaatacacgaatatctcccatgaatcaagaacagaaatcacagccagactttagcaggcctgacagtcaggccacctccatgtatgataatctctagtctgccttctttgacatccagcaattaactcattttgtatctcccttaacatgttacctcccaggacagtccctgctgtgcatcatgactagcacatagtaggccctttctcattgtctgtcattgagaccgtgaatgcatctgtctaaagacctgaagttgaatgtgtcaagctgcctaaggtttcagaactgcaatctatttcataagtgagacaagcaagtggactccaagactctaagtgaaatgaagtctgatgcattggcctaataaatgggaacagcatttggaagattattaaaacccataagagtcagataattaaagc

SEQ ID NO: 474074 - DNA, 589 bp, Homo sapiens
aaccatcccaccattttgggtcagcctgtgttagaatgagtctttggtacatgttcaatttcacagcaactgtgaccttcattgtgaaggttgctcctgccagtgacttcagccctgtatttaaagctgcacactattcattctctgttccggaaacgttgggaggaaaagagaaccatcattttggatttgacccaactcgaggttcaaatactccaaaattaattgtgaagaatcctttcaactttgaatgtagagctgaagtacagcagcagtaccatcttgttgtgcatataattgatgataacttgaaatatggcaaatccaccaagcccaggacaggcaccgctgttatagatatttatgtgagaagagccaatatgccacctcctccaaccactagttgtgaagtaaagagttatagaatttaatttgggtctctgtatgggaaatgttctactccctatagagaatgaccacctgaaaactttacttattagtgaattgccaaggaaatgtcaaaatcaagtcttacaagagctatgtacttagacaataagttttaaaatacatatggactctctgatta

SEQ ID NO: 474075 - DNA, 700 bp, Homo sapiens
ttctttgcctctggtgggggacaattttgaatgtgcattctacactcgcttccaggaagatgtgctattttgttacagagcgtggaactgtgtttactgctacacgtcttgacgtggagagagctgggtttgcaagtgtccagtccttctccattaaggctcgtgactgtgactggcagtgtgcagcaattctagtaactgcctatacccatggcattaatgacaattcacctttctgtgatcagtacctcattaggcacacactcaaggaggaaattgcgaaagatacagtagttgcaaaactcttgtgtcgggaccttgatgagcctcctgatacaatccattatgctcctagctcaggcccagttggttctggacaactctttgagcaagtgccaaatgctgaaaatgtcatccagccagaagatatggctgagaccactggtaacatttctctttctctggccctaaccccagatttttgtgacaaactccataagctacaagctggccttttgcatatattgtgaattttggaagcttaggcactgagccaagagatttcctgggttgatgttcattttgaaatgcaatgccaaactatcaccttttaaaatgaaatttggatgaagatggaggttttataaacatgatgctaagatttgggtcttcgtatgttcactttatatttgggtaacta

SEQ ID NO: 474076 - DNA, 574 bp, Homo sapiens
agggctaaagtctcttatgggaacaagttgagtctaggggaatggccacccctgcccgtgctgcactgcagacacccccacagcaaaccctctgggctacacatcagctggcttgttgccccaacacttccctaagcagccctccctgccacctcaagtgtccatggtggtcaaggggtccccctccttctagggttcccaaggcctgtgacaagagcaggttgctccttgccagttcaactcacccattccccctgagctgttgttgttcaaaagtgagtcctgctgcagggttgtatgattattcccatttcacagatgagggaactgagcacaaaagagtccaggcctgcctgagaaggcacagcttcaagggacagaactggaaggtgaactccaaagccaatgctttcaccagtctccccatagtcatcaccaacacagagttcttttccagcactcaaagtaggtccagtctttattctctgccatagcatcccctttatttccttcctagtgattattatctgtaacggtcaccttgctatgctgacttggttatctgttctccctg

SEQ ID NO: 474077 - DNA, 1072 bp, Homo sapiens
gacttagttggagaaaggatcccaagggacctgatcaagctaccgccacacatgcttcaaacaaacaaatatgtaccttgggacactttttgcacggtctgagaggcttcaactgtgcctctctgctgatggtggtgccaagcgccaggagcacctatcccgattttccatgcctgacctcagcaaagactctggaatgaatgtgtctgagaagctgagcaacatgggcactcttaactcgtccatgcagttccggagcgcagagtcagttcgcagcctgctctctgcccagcagtaccaggagatggagggaaacctccaccagctcagcaaccccattggctacagagacctgcagtcccacggaaggatgcatcagagctttgattttgatggagggatggcgggcagcaagctgccagggcaggagggcgtgaggatccagcccatgagtgaacgcacccggagaagagctacttcacgcgacgacaaccgccgtttccgacctcacaggtccaggcgttcccgacgctctcgctccgacaacgccctccacctggccagcgaacgcgaggccatctcccggttaaaagataggccccctctgagagccagggaggactatgaccaatttatgcgccagcggagcttccaggagagcatggggcatgggtcccggagggacctgtacggccagtgccctaggactgtgtcggacctggctttgcagaatgcctttggggaccgctggggaccctacttcgccgagtatgattggtgttccacctgctcctcctcttcagagtctgacaacgagggctatttcctaggagaacccatcccccagccagcgcgcctgcgatacgtcacaagcgatgagctgctgcacaaatacagctcctacggcctccccaaatcttccacattaggtggcagaggacagttgcacagcaggaaaagacagaagagcaaaaactgtatcatttcttaatatgattgggatcagggaatgggagaagatgggagctaagaatgtaaagtcagaaacttgcactgttttaaatgttaaagc

SEQ ID NO: 474078 - DNA, 603 bp, Homo sapiens
atgactctccatagttgatagaatgtgcaccggatccatcctttccacagcaggcacttgggaaggctctgcttggtctggccctcccctggcacgtgttcacccgggtgacagttgtgctatggtgcagcccgacctggtctccatgcacagctctcatgagttcctccttcatgagacagtctcagaactcagcctagctctagcccctcctgtgccttcagccatcactctgcacttgctcataacagttctgaatgacttttaccatctaagtggatcaaaaatcgaggaatcctttacgttcttcttcaatgtcttcaaaatgccccctacaaaggcaatggccacacatgaaggggacatagctttaaccacttgctcatcaacagactgggcttgtgaggcccagggcaaaaatcctgtgatggataatgcaggcaatgcagaatctcatccctgaaactccagctgcgagaatgctttccttccttgatggcagggataggggttggtactcatggacttgcaaatggtcacctcattctttctgaattcacttgccttttgtgagcactatgtggcccctccatggctgttctg

SEQ ID NO: 474079 - DNA, 1014 bp, Homo sapiens
agtgtttgcattacttatgacccagcaacaccactcctaagtatataccaaacagaaatgagtacccgtgttcaccaaaagacacgtactataatgtttacagcagcactatttgaactggcattaatagaaagccttggcaagtccttagagctcaactcactgggtcttggccctagacaagaccaggggaaaaaagacaaaatcttggctccttggcaagtgacccagttagcagaactgggaattttgctctgggagagggtggggaagtttattttagcaagaaaaagccttgggacacagaaaccaaaccaaatgcttgacaatccctttgtgcaaacccatggtgaatcctgccagggacataggttacaaatccgacttcggcacttcaagaaagataccaagaacctacagctaaagcaattaaggtgggggcaaggaaaaggtaagagctggtgctccaattcacataaattaaaaagataattcttttacaacaaatgctgatttacaactttagatgaaatgcatggtttcataagaaggaaaacagatgataattttagtatttaaatgaagaagcaaaacaaccttgaataaaagatgaatattgatttttaaaaatttgtttaccaagaattacagaattgtgcctcatttgacttaatttcagacttgttaattatgtgtctaagttagccacaaagagaacacacttattttaaattttaaaatttaaaggaaatgaacttattcaattttgtgcttaaacactagtcatacaactcttgtagttttgttgatttcctaaaatttttatagaaattcaaatttatgacagtatggttgttcatacctgcattgaaaattcaggtgaggtcaatagattttctaaagccatcgtgattccccatcttctttgtaattccttctttatagacagaatatattgcaataaatttagtttatgttttcttggtcatgatcatactcaggtgtatattgctg

SEQ ID NO: 474080 - DNA, 752 bp, Homo sapiens
cgcctatatttatgtattttctagggaagccattggagtgtgtctgaggaggtacatcaactgccatggagatacttttctgccttttgcttgcagggcattatttcatgccatttctcactatcagcactcctgatcctgcttcttactctaaggttctgggtttcagtttgatggaaacggaacgtgaacaccagaagagaagtgatgcgatttacaaagaaagaggtttaattggacttacagttccatgtggctggggaagcctcgcaatcatggctgaaggcaaggaggagcaagtcctgtcttacatggatgacagcaggcaaaaagataatgaggaagatgcaaaagtggaaacctctgataaacccatcagatctcttacactagccacatttcaagtgctcagtaaacacatgtggcttgcggatatacaagtctcttctcccagaaaattcttttggatagcagtgggagctgaattccaaatgtcattttcaatcttgatatggggagtaggaattacctaagtactttatagagaggtgaagagtaaataaatagatcatgtacaacctttagcattgtggcgcacatacaaataagtactgtataaatagtaggtatattatcattattataaatattatattctggaaaatggttaccaatttcataaggtcttaagagtagaacaagcttctctaagagggttgtgtaaaagtttagctctccaaggtagttatctt

SEQ ID NO: 474081 - DNA, 552 bp, Homo sapiens
ctagagctgctcacagggcgacttcagtatctgtggttacgtctgccacgagtggccctgtaacagtctgttgttaggaccatgtttggcaagcctgataccagggttacgtgtccccattctcaaatcagctcttctcagtttggggcttcatcagggtttcacaacctttaccctagatccaaaagctcccacaaaggcactcttgcttgtgaatggctgccagattgttgtctgtgtgggagatgtgagcaagagaccaactattctatcatgctgacatccaaagaaaatgggaaaaatgccacatttcaaactacctcacaagaaacaccagctgcctttgtcatttattctcaaacattgatcgcagttaacctagacaggggagccaagagtggtttagatggctttggaatgagaaataaaggccttcggtcaacaaccaagagagtatgccatcttgaaagaggatcctttagttctaggcaaaccttcacagctgcagccccagacaacatctgcttataaccccttgagagacctggagtc

SEQ ID NO: 474082 - DNA, 2959 bp, Homo sapiens
gtggttgccaggggttaggggtggtggggagaagggagttcatgtgacagtgaacagctatgtgttggatgcggccgcatgaaatggagatccgattgcctgacttagctttgaagcgaatcttctctttcctggacctgttcggcttgctgcaggtttcccaggtgaacaaggtggcagctcatctgaagtgccctatctggatgggagccagtgatggatatatgattgtctttaccagtggaccatacttgttactcttcagcatcactggcttcctgctgcaacgatttgaggaccatcaggcagccatcaacaacttctgggtggatccttgctatgtgctcaccacatccgagaactctgtgcacgtgtacatgtgggaagaaggaggccgccatccatacctcaggagctgctgtcacctggaaaacacgtggcatgatcacacaacagacaggttctctgaggatagatatcaataaactcatgcctgaaaagagaatcgctagttcttgaagtcatgggacttgcaatagatgttaagtcttcccaaagtggctctcaatttatattcccatgagcagtggatagattatgtcccaataccctgtgttttcttgctgagttgtaccttttgtgagttcattagccacttgcttgctgcttcagtgagctgcctttccctccattttgctgatttttgcccctggtttgcttgcctttaaattgtttttcttgagattttacgtagtacacgtagaagtcttgtctcttaaggctttgcacacattttcttccagattattgctagtcattatactgcttatagtgcttttttggcaacatctaagaaaatacatatatcctttgcactgccaacaccactaaaaagaatttactgtgaagctatacctccaatcattcaagtacattggctgttcattacagcatttgtgatagtcaagagctggaagctccctaagtgtccaaacataagagattgtttaaattaccatcgtatatccacacaaggaagtatcaggcagctgttattaacttttttacaagaataggaaaatgtctatgttcagataatgatttccagtgttttgaggcaaaaatactttaaatatctataagcatgcttagcagactttcatggtttttgctctgtatatcatatctaataaattttagcctacaccaatcataaatacttatttcctttcaataatttcaaatacttcccctggattttttttctttcttacatttgaatggatgtatagtgatacctcattgtgatatttattgtgccttttcccaataacattgagcaatttatttgccatccacattatcttctttaacacattttttcaaatcttttgaccattttttaattgggttgttaatattgagtttcttaatatcgagttttgatagtcctttatatatttggaatacacgtcttttatcagataagggtttgcaaatattttctcccactctggtttgtctttctattctcttcacagtgtctttcaaagagcaagggttaactttgaagtacaatttttcttctaaaatgactgggcttgggggattgtatctatgaaatctttgcctaacccaagatcacagagatgttctaagatttcctctaaaagttttacagtttagggttttacatttaggtctctgatgtattttgagttaaattttgtaagggaaagataaagatcaagatgtatttttttgtatatgaatattcagtgattcagcaccatttgttgaaaaaactccttactccgttgaattgcctgtgtacctttgtccaaaatcaaccatatttacatgggttagttttgagactttctcttttgttccaatcatctatatatgtatctcttatcaaataacacactacattgaaaatgtaactttatagagactttgaaatcagataatgtgagtcctctaacttgttcttttacaaaattattcagactattctggttcccttgttttccaagtgaattttagaattggtttgtaaatttttacaaaaattctgagatttatattggaatttgtttagatgtagagattaattaggggaattggcatctttactattttggctctttcagtacatgaacctgaatgtctcttactgttttaggccatctttattttatcagtgtttttgtagtttttaggataaatattttgcacatatttgtaaaatttatacctaaatatttcgtggttttggtgctattataaagagtactgtcttatttcaatttccatttttcattactagtatatagaaatacgactgacttttgtatattgaccttgtatcccgcaaccttgctaaactcattcattctaatagcttttattcatagattggtagatactttgtgctttctctatgtagacaatcatgtcgtctgtcaaacagttttctttcttttcaaatgtatgccttgttgttcttccctttttgcattggctataacctcctgtgtggcactggagtggagagccgacatccttccattggatgaaaagtgtttggtctttcaccattattattatattcactgtatgtttttgtagatgccccttactgggttgaaaatgttctcttctagtcctagatggctgagaggtttttgttgtcatgaatagatgttgaattttctcaaagacattttctgtataaattgatataagcatatagtttttcttttttaggttcttagtaaggtgaattatattgattttcttttttgttagtggtcaggacagagtatcttattagtttttaattaacaaataattatatatttatggggtacaatgtgatttcatagatgtatatattgtagaatgattaaatcaagctaatatatcaatcacttcatacacttacttttgtggt

SEQ ID NO: 474083 - DNA, 681 bp, Homo sapiens
tcagtggcgcccgtgggaagccaggagctgcatgctggctgacgctgcaggtgcctgggaacctgctaacctggcccctccacccatgctgcatcctgtgcaagctgtcacgggagggggaagggccctggtgaccctcagggcctctagagcctgtgggcaagagctggccctccatgccaaggtgccaggcctaaccctggtgaagagtgacccaactgggcgactgcctgaggcctcagaggaggacaaggagaagggttctcccagactgcagagcaagatccaggctccacacaatgccagaggccctgcctctatcttctctctggccagcggccctatcgctaaccccacacatgaaggatactgctttggcatcatcgtttatggaaccccaggctcccactgctccatgctgtgcaggttacacctcccaccctgccgctctctccgggggcctcagtccacctcctgagcccatgtcctcagtccatgattggaccgggtccctgggtcccttggaggaccagccaagcccaggtccttctttgcttcttactccccaccccagtctccttgttcttcagtcttttgctttcccactggctcccttctcacacctcccatggctgtgcccatttctccttttaactctgtcaacttttggatcctatattt

SEQ ID NO: 474084 - DNA, 959 bp, Homo sapiens
tggcttcatgggccaggtccagggccctgctgctctgtgtagcctcgggatactgctctccacatccaggccgctccagctccagcctcagctaaaatggccccaggtacagatccacctgctgctttggagggcacaagctataagccttggcagcttccacacagtattatgatgtctgtggacacatggaatgcaagagtgaaggagacttggcagctttcacttagatttcagaggatgtattcaaaagcctggattcccatgcggaagcctgccacagtggcagggcccccacagagagcctctcctatggcaatgcttggaagaaatgtggagttggagcccccacacagagctgccactggtgcactgcctactggagctgtggaaatggcattgctgccctccaggccccaggacagtagaactaccagcggcttgcaccctgagcttggaaaagctgcaggcactcaactccaacccatgagagcagccttggggctataccctggaaagccacaggggtcgagctgtccaaggcctcaggggttcaccccatacctcagcgtgccctgggtgcagggctatgacacaagaaaagaagatgaaacttatttaaaataaacccaaggcagacaaacaaaatgctttgttattgtaaatagagggtggtaacaatttttagaaaattaaccaactttatttttaaattacaaaggtttcttgggggatccccttggccaagagagagatgcattcaataagttggggagattcgaattttatttttggttttcagggtgccttgctgctatgtcctccataggagatgaatgctgtgtcctcaaatagtggaagggtggagggaaaaaagtcctagctagttccctccaacccagttataaagcactaattccatttatgaggacaaagccctcaaggcctaatcatctcct

SEQ ID NO: 474085 - DNA, 723 bp, Homo sapiens
agcacgttggaccagcgttgtaccatgaaacagagccaaattccagatgattatctatggcaatctgagaaacgtggaagaggaagatcagcaaaatgtgataaacaattaaaagacggagcagaaatgagagaagtccaaggtgaaagagaacacatagattattacgtggcttctaaagtttcttttagttctgattcaacccctaaaggttttgtgactccccatctgctgcaacttctgtgctgtgtctacacccctggttcaccctctcccctagattccgtccaggaaacttcgcataaagttgaaattgttacagagttcagctggagttttccctctccctgtggtctttccccagctccaccggcagccctccctaaggactcctgcgagacaaagacagaaatggcttccctgaggactgagagtggttacagggctcttcctgctgcttcctctactcctgtatttcacttggctctctaaatttgtttcagctccaggtcagtaactcttaaatttgtccttctgaggctaatttctagatcttgtaggtgtgcttcattcttttttattttttttcttttgtctcctgtgactgtgtattttcaaggagcctttcttcaagctcactagcactttcttctgctttattaatttcactgttaagagactctgatgtattcttgcatatgaccattgcatttttttagctct

SEQ ID NO: 474086 - DNA, 665 bp, Homo sapiens
tttccttctaaaccttccttctaaaaactgcctcctcttgaatgtctctatatctgtttattcatttttttcactcaacgaatatctgtggagtaccagggctgaggtggtttgctgggggtccatccagaccctattcactagggtccctcctgtacctggaggtgtcaccagtggaggatgcagaatagcaaaaatggctgcctgctccttcctctgggatctctataccagaggtgcaccaacttgatgccagtgggaatgctcctgtataaggtgtccagtgacccctgttgggggttctcacccagtcaagaggcacaagatccagaactgcttaacaaaacactctggctgccccttgtcagaaggggtgtgctgtgctgggggaaatcccactcatccagattgcctggattcttcggagccagcaggggaatgacaaagtgtgctgatttgtggaaactgcagccgcacctccctgtaggggctcatccccagggagatcagagttctgtgcctaaacccctggctggagttgctgaaattcctgaagggaggccctgtctggtgaggacagatgggtcagggtccagcctaaataggcagtctggccataatcggccatggccactgtgctgcaccatgggtaattccccctaggt

SEQ ID NO: 474087 - DNA, 3639 bp, Homo sapiens
cagaaaatctcaagttgctttaaatatccctgccaagggaatccacatttgagagtgccaaacctgacttcttatggatggaaatattctacaatgcattcacttacgcaaatgaagcagatgctgtgaccattgatggaggtttagtgtttgaggcaggcctggccccctacagccttaagcccatcgtggtagaaatctatgggtcaaaagatgctgtcccaacttttccagaaggcatatcccatgaactaccacagcctctggatacacaaggggaggttgaggggaaggtgtttcctgaggtaaagaaggactatttgggtttggctgatgtgcaagtgttcctgctcagctgcgtcccctgtgaggacatgaagaatttccctcgcctgtgtcaactgtgtgcagggaaagggacagacaagtgtgcctgctcctcccaagaatcgtactttggctacgcgggagccttaatcattgaaatttcaaatttaatcacattctcctgaacatttcattataaatgtctctcaactgcttcaggcaccttaagcaaaacatacaaattattgtaaatatttcagaacttattagcacatctgcatttaaatctgtttcaaaagcattattgccatggacaaaagtgtacttcttcttcttttttttttttacatttatgaaaaaaacccaaactttttcagaattttggacagtttaccacaaacaaacaaaatatttcagactaattgagtttccagattctgggtcttataacaaattaaatttctatcagatacagaacattcaaaacatttgaaatacatgtatatattcactgtgctaagctcatttttataatgtctgctacttgaggagaattttagatcatcgctttttacatgggtcccagttccttacaacttaatgtctttcctaacatgaaattgacttcagtgtcctttgttcccttgttcagttattcacaattcactgtctcctcattattacacattgactataattattactcattattgcactggtttgttagcattttggcaattgatgcatgtcttattatccacaattttaattagtggggtcatctatgggtctcatcaagttgtttcaaataattattatgtcctttggatgctcaggttaccacacttaatgatagtggcagcatcttctatctccccctgaagtatttgaaaacatcctcactttatggaaacgacagattgtcccagaccatcttgatttacctttgcccaaagtcacttgtgtgctattttgtaagatctcttcttgcctggtaggagaatgtcatgagactatgacaatgagtgggggtggagagccctgggctgctgctgcccccctgggcctttgagtggccaaggtggaaaagtgatttatttctgaggccattaggtcatattgattctctaaatttaattctaacattactaaatcattttgaaatttttcttttaatgtaaagatttaaaacgtattttctagagaaaatactaaattaaaattgtaaccactcacagcagccctgataacactctttctctttcagtttgagattttatcaaccccaaagaccatctgatgcaggagaatagggatatagggtaatcaagagttaaggcataagcaatagggcagcaggtgtagtcagttagttctaggcaagattaggcagcatataggccacatcctcactcctgtgataacaagactgtctccacttcagcctctaattggccatgggccagtccttcatatgggtataaccagctggaggcctctaaacagcacctggggtgttaccaaattctttttgcttaataaaaaccctaaagaacactgtgatcaaggctcttgagctgctcgctggagcctgctcccactctgtagagtgtactttcacttcaatcaatctgcactttcattgcttctttcattgcttcattctgttgttgctttatttgtgcattttcttcaattctttgttcaatgtgccaagaacctggacaactcacagtcaagactttccatccagtaacacatctgtattcgttttctaggactgctgtagcaaagtaccatgaactgggtggtttaagcaacataaatatcttgtctggtacctctggaggctagaattccaagatcatgatgttggcagggttgggtcctcctgagagctgtgaggagaatctgttccaggccactgtcctcgcttctggtggtttgctgctgatctttggtgttgcttgactcacagacacatcactccaatctctgcctttatgttcacatggcctgtgtgcatgtcttctgtgtccaaactcccccttttcatgaggacaccagtctttttggattaggggtccaccctatcccagtgtgaccgcatcttaactaattacattttcaaggtccctatttccaaataaggtcacattctgaggtaatgtggattaggacttcaatatatgaatttattgaacccacaacacttttcaatacctagacaatggaatcaaagaggctgttttactcatagggtctttctggttcatctttgtacctgcaggttaccctgactgggcccctagacctccttccatctctcaaccctctcaccttttcccagcaggctctgcatcaaagggaatgtggcccctttagtgggggacctgggccatcttggcatggtaatgcgtcagccccagactagttaccttaagtctctgagtctcagtttcttcatctgtagaatgagataatcatattactggcctctccaagttgttgtgaggattaaatgcaacagagcctggagagccttcagcaagtctttgatgagctatgagtgcacattacacatttgctgtcaccattcctattagcagagccaggcagttggagggccctgggccaggcacactgcccagccctgtgtctacctgcagtgagattgtgaaccagctgtttcactcctgaggcctctagtccttatctgtataaaatgtttttggaaaaaaattctccctcagtcctcttcaggccacatatttgatggttcggtgaggggcatgggtcatcctaactatggctcatggctctcctgcgttaggctcacctgggctttccctccccagagaacctggcaaacaaggctgacaaggaccagtatgagctgctttgcctgaacaacacccagaagctggtagttggatacaaggactgccatttggcctgggtcctttctcatactgtcatggcctgaagtgtgggtggcaaggaggacttgatctagaagcttctcaaccaggtccaggtatccccacctgccatcttcccctctggcttagtgctccctgcttggatttggagggaggttaacttccttgccttcttgtcattctggaagtcctggtatgttcagggtacagtgggagccatgccacatgtgatcctcttcactgacaagccgctcagtctatatgtgttatatacagcagaggaataaaacctcatctggaaccacgaacctggtggactgaagactctctgcagaagttcttcttgtcccatttaattatttttcattct

SEQ ID NO: 474088 - DNA, 1156 bp, Homo sapiens
ccctgaggagtacaaccactgttgagtgtcataagtgggtgcaggacagtgggtgcagcgaccaagtgtgagctgaagcagggcgaggcattgtctcacccaggaagtacaaggggtcagggaattccctttcctagtcgaagaaaggggtgacagacggcacctggaaaatcgggtcactcccaccctaatactgcgcttttccaatggtcttagcaaacggcacgccaggagattatatcccgcgcctggctcagagggtcctatgcccatggagcctcgctcattgctagcacagcagtctgagatcaaactgcaaggtgacagcgaggctgggggaggggcgcccaccattgccaaggcttgagtaggtaaacaaagtggcccagaaacttgaactgggtggagcccaccacagctcaaggatgcctgcctgcctctgtagactccacctctgggggcagggcattgccaaacaaaaggcagcagaatcctctgcagacttaaatgtccctgtctgacagctttgaagagagtagtggttctcccagcatgcagctggagatctgagaacggacagactgcctcctcaagtgggtccctgacccccgaatagcctaactgggaggcaccccccagtaggggcagactgacacctcacatggctgggtactcctctgagacaaaacttccagaggaacgatcaggcagcaacatttgctgtttaccaatatccgctgttctgcagcctccgctgctgatacccaggcaaacagggtctggagtggacctccagcaaactccaacagacctgcagctgagggtcctgactgttagaaggaaaactaacaaacagaaaggacatccacaccaaaaacccatctgtatgtcaccatcatcaaagaccaaagcaatggaacaaagctggacggagaatgactttgacgagttgagagaagaaggcttcagacgatcaaactaccctgagctaaaggagaaagttcgaacccatggcaaaaaagttaaaaaccttgaaaaaaaattagacaaatggctaactagaataagcaatgcagagaagtgcttaaaggacctgatggagctgaaaaccaaggcacgagaactacatgacaaatgaacaagcctcagtagccaa

SEQ ID NO: 474089 - DNA, 1472 bp, Homo sapiens
ggaaagccaagttaaagggagatgactgatcagaccttggtgaatttaacagtctgtctgctggagtttgctggagtccactccagaccctatttacctggatatcaccagcagaggctgcagaacagcaaagattgctgcttcttcttcctctggaagcttcaacctagaggggcaccccgcagatgccagctggagctctgctgtggcttcgtttatactgtaaggggaaaaccacctactcaaccctcagtaatggctgatgcccctcccctgaccaggctccagtgtccctggtcgacttcagactgccgtgctggcagcgagaatttcaagccagtggagcttagcttgctaggctctgtggggttgggatctgctgagctagaccacttggctccctggcttcagcccctttccaggggagtgaacggttctgtcttgctgccgtttcaggtgccactggggtatgaaagaaaactcctgcagctagcacagagcctgttcaaagggctgcccaactttgtggttgaaacccagggccctggtggtataggcacccaagggaatctccttgtctgtgaattgcagagaccatgggaaaagcccagtatctgggctggaatgcatggtacctcatggcacagtccctcagggcttccattggctaggagagggagttccctgaccccttgcgcttcccaggcatctctcagtccagacaatgtggaaagtcaacatactgctggaaattctgcctcccagaaggaattccctttactaatatcctgcggagctaccctgagtgggactgtcatgctacagctgcccaattctggttggtgtcaattatatctcacagaatcattcataaatcagaccacagatactgatccaggcaggccttttccagtcagcgcaagagcagttgccctgcagcactaggtccattacaaagaactttcccctaccaaaaaaaaaaaaaaaaaaaattcatgcttccagtagtcacctgaaactgaatgaacaggatttccctgaatcccagtctttctctgagtctttctctatgtttatgagtaaacctgggcatgattagggctgcagcaatcacacagctctctgaagaactgctctgactgatactcatcgtaagcaccttcctgccctccaaaattgcaaatgcacaaaacttggaattttcaattaagatgacctcttccctaaacgtgttgctaaatttttatgccacgagagagggaaacattgtgagttttaataatttatatctctgtggctctaaagttctcttttcttgttctagtctattgttgacatttttcagtgcattttgtatttttccaagtctttcatttccagaagttgtgattgttttttctttatgacatctatttccctggagcatttttcatccatatcctgtactgttttttaaaatttttttaagttgg

SEQ ID NO: 474090 - DNA, 638 bp, Homo sapiens
aagttgaagctgcagtgagctatgattgcaccactgcactccagcctgagaccctgtatcaaaaagcaaagaagaagaagaggaggagaaggaggaggaggaggaggagaaagaggaggaggaggtgaaagaggtggaggagaaagaggaggaggaggagaaataggaggaggaggaggaggaggagaaataggaggaggagaaggaggaggaggaggaataaaaacaaaagcaggaaagcagaaagaagtcaagaaaggcgaaacaatgagaaaacagacacaggtcaccaggccctgccaaggctctgggaagtctggcagctccacacttcccatccactccacacggccctgcatccacttcgatgtctactacttgcagaacagaagtagtgagggaacagtacctgatctcaaaggaaatgctttcaacatcttaacatgaagtataatctttgctgttttaagtgtaatcaattttatatagatgccctttattaggttaaggaaattctttcccatcttgagtttttgccaagacatgaaaaaattaatgtatgttgaattttaagtgataaatttaaagctttaatgtgtttgtaaacatgatgcatacatattttttaaaattccaac

SEQ ID NO: 474091 - DNA, 1053 bp, Homo sapiens
gctgagccagcgcctgggcctggaaccgggctgcagcccctgagcttcgcccaccacctccctgccatggacccccgcaaagtgaacaagcttcgggcctttgtgaaaatgtgtaaggaggatccgagcgttctgcacaccgaggaaatgcgcttcctgagggagtgggtggagagcatgggaggtaaagtaccacctgctactcagaaagctaaatcagaagaaaataccaaggaagaaaaacctgacagtaagaaggtggaggaagacttaaaggcagaagaaccgtcaagtgaagaaagtgatctagaaattgataaagaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaacagaacgagttaagaaggctcaagaggagcatgagagagcccagagggaggaagaagccagacgacagtcaggagcacagtatggctcttttccaggtggctttcctgggagaatgcctggtaattttcctggaggaatgcctggaatgggagggggcatgcctggaatggccggaatgcctggactcaatgaaattcttagtgatccagaggttcttgccgccatgcaggatccagaagttatggtggccttccaggatgtggctcagaacccagcaagtatgtcaaaataccagagcaactcaaaggttatgaatctcatcagtaaattgtcagccaaatttggaggtcaagcgtaatgcccttctgataaataaagcccttgctgaaggaaaaaaaaaaaagttaaagaaattgacatgctatttattaaacaagaatttcaattactcaataaacagaaattgctcaaactcactattaatcagggactacaaattaaaatgattataagataatattcataggactgaaaaaaatttcaagttgctcagattaggaattggtaaggtttt

SEQ ID NO: 474092 - DNA, 916 bp, Homo sapiens
acatcagtcacagacctgacctgccatctggagagacttgtgccaaatatgatgacatcatgaaggtggcgaagcaggctttggagggtcccctcaagggcatcctgggcatcgtgagcaccaggttgtctcctctgactttaacagtgacactcattcttccacttttgatgctgggactggcattgctctcaatgaccactttgttaagctcatttcctgatatgaccatgaatttggctacagcaacaggattaaaattggatggtggaggtgagggggacaaagaggctaagcacacggccaaaggggtggccttccagataaaggagacccagtcagttgtcaaatacagttaccagaaacctggtccatacggtaaaaggggcagctcccaagctgagagtgagtcattgattcaaatacagacaaatggagatacaaaattaaatttgccctactgaaggcctctgacagtacttccttacatttccagacatgttagggtaagagagagagagtcataaggaaggtttttggaaaagtttgtgaagggttggtattagtttctctttaaatgtttggcagaaatcacctgtgaaaccatgaagtccggagcttttctttgtgaggagatttttgattactgattgaatcttcttattagttgtaggtctaattcagatttttcatttcttcatgctttaatcttgggatagtttctgttattttttttactttgaatggccatactatcctgtttctctgtataccttgtgattttttgttaaaaacttgacatttgagtctaatattatggtaactctggaaagcaaatttcccctttcccagggttttctggatttgggtttttgtttgtttgtttgtttattcttgttaattttgttgttgtaga

SEQ ID NO: 474093 - DNA, 886 bp, Homo sapiens
ccttaaacagaattaccattcaacccagctatcccattattaggtcttgcagccacggataccagcattgctctggtggtagtagcagggagtgaagtgaagtctgtgaggtagcagggagtgaagcggagtctgtggagttgtgtttttgtttagcgtcttggttttgtgttcattggcctccagccagggggtggcactttcaagagcacatcagctgtggtcctacagggaggatgcaaacttgccctaaggacacctggttaactgttcaattttctcaggcagtgggcagggccacagagctccaaagagattatgacctttctcttccactaccatggctggtagagaaagaccaccagacgtgtgccagagacctcagaacgcaagctgtggaccaaagcagctgtgggcactggcagctaatgcagtgggaagattatggaaattctgatccaacagggttcttgctctgcccagcatgcacctggggtatcctaaacccagaggaaatagcagtgccaagacccattaagatcatgcagcagctggggaatcaggccatcaggccagtgacttccactggggaccccaggctgaccaggtttagatggttatataggccagagtctgtgcaagagcactctactaaggggaaaagatgagaatgaattctagcctgaatcccacttgccaaatcttaagttctggcatatggctttgaaatttttaattaatctttgtatttaaaaactattaataatcactttatgcaattatttttaacagtattttcaaattaggcaattaaaataatttaatgaaccaatttaaattatgtttagcataagtggtctaaagtaatgtctaaaacaatgttatt

SEQ ID NO: 474094 - DNA, 937 bp, Homo sapiens
ccgtttcttttctttccttcttgcactggacagcggagtctctcctcatgtccactactaccacaggcccatgggaagtattgccagggtatcaccagtgttcacttacatcccaaaggctctttagtcagcttgtggtggattttgcaggcctgggactcacccttcagggtagtagtctcccctctggcccagggcccacagtgtgtactactgggcctggaatgggggcctcacgactctgcctggtgccctatcctactgtggctaaactggtattcaagttggaaaacaaagtcctctttactcctttttcttctttcctcaagcagatagaagaggcctctttaggagttacaagctgcacagcctggggttgggggagggatgacacaaggactcctttagttaccccagctggtgtttcactaggtcacgtgcccccaaaggctactggctccaagcccattatagcacttggacttgccttggagttgcagtccttgtggcctagactgccactgaagtttattgaggaccccagagccctttaccccatagtggttaggcttgctgaaactcaagttccaaccactggcatgggtaattcccctctatctagggctcatctaaatgctccctctgtgggcatgggctgagttctgcctggtgttgttttctgctgtaacagggcagcactgagttccaatgcaaagtctcacaaatactgtgctctacttccccaaacacacagattctctttctgtgccacatggccactgccaggagatgagggaggggttttgttggtaattcaagattgtctttcctatcctcttcaatgcttcttttagcaatatgaagttaaaaccaggtactgtgattgtttacctgatttttggttcttatgagggtttcttttgtgtaaatagttgtc

SEQ ID NO: 474095 - DNA, 458 bp, Homo sapiens
tctggacatctgaaacttggaaaatgagtcccacaatgagttttctcatgcttcggctgtgcgtggaccagtcagcttccgggtgtgactggagcagggcttgtcgtcttcttcagagtcactttgcagggaaatccaagccaggtcacaaccaaaaccaaagcatcaagcaatccaagtcaagtcaaaaacaaaaaccaaagtgtcggtacgggcacaccatgggtgatcaggccatgcttccactcaaatggagtaggcaaattccaaagaccaatcctgtcaagcaattcaaaccaagtcaaaaccaaaaccaaagtgccgataaaggcatgccatgcgtgatcaggccacacttccacttaaatggagtgggcaagttcccaagaccggtcctgtcaagcaattcaaaccaagtcaaaaccaaaaccaaaatcaaaccgaagtgccgataaagg

SEQ ID NO: 474096 - DNA, 496 bp, Homo sapiens
atcaatgcagtggctgaacaccgggatggaacgggcacttggaatctggacatctgaaatttgggtggaaagaagaaaaactcgagccagcctaggaaggacgctaccttgtgctgctaaccaccaagactgctgctcgtacagcaaaaaaggatggactcatcacacccgagtcaagaaagcaccacctcctccagagtcgtgggccatagtcccaggggaaaaccctactaaactaaagctaaaaaaatttaactcttttcgtctattctgttactctttcttcattcctcgtcctattgctgaccatctggttattaatataaccaagtcaattttgcctccaactattgcatttaatgcttgccttgttataccctgtggagacttgccaagtcaaagacagttttctacttcacaaaagtacttctttccatcccgactctcctcagactcgacattagtaaactaggaccatttattccagggagatttc

SEQ ID NO: 474097 - DNA, 2267 bp, Homo sapiens
gcagtgggaaagcaggggacatggatgaagctggaaaccatcattctcagcaaactatcgcaaggacaaaaaaccaaacaccgcatgttctcactcacaggtgggaactgaacaatgagaacacatggacacaggaaggggaacatcgcacactggggcctgttgtgggtctgttctcacactgctatgaagaaatacctgaggttgaatgtggccgtgcatggtcagcatgctgcggtgcagagtgggccgggaaaagcgacactgacgctctggaacttctgcccagcgcgctttgtaaaatgaatgaaaataaacctggtgactcacagaaccttgaacaagctggatttaaacccactccttcaattgagtgtttgcatgtggattttcctgttggaaacaagtgtgataactgtttagcaattccaatcaccaatacatataaagagtttcaagaaaatatggactttaccataagaaacactctaagactagaaaaggaagaaagttctcattacattggacattaaaatgtttccttgaacaaagagaagcttctttaaaagctgctattgataactgtcttttgtttccctaaccttttcatcattactttgaacaaactagttagcttcttggcctaataaaatttatgatatgaacataaaggaattttacggccatttagggtaagaaaaatttttttttgttaaagcatactagtcaaaataggtgatagtttctcattttcttgatatacatacttcataaaccacaatataaatactctcaaaatggttgtatggattttatttaggtatggtagcatggtatataaaagtaaaacctgttttacccacaatttttgtaaattaggattacatatggaatgctacaatttttctaggtttattcaattttcaaattattcctcattttattttaaagcattaaatagaaaagctaattggttaaattttgtaatgtaaatcagaggcatatattctggggtttgtgttactatgcatgcttttctaggatggcaccaaattagttgtttaaaatgtttttagattactgatttatattaagatgacccacactgcagttagattatgcctagtgggaagtattatatgaaaagcagaattaagctgggcacagtggtatgtgcctgtaatcccagttataagggaggctgaggtgggagaatcgagatgttcagccagcctgggcaatatagcaagacctcatctcagaaaaaaaaagcagaattgcacaaattttctggaatctatggacattccatgggcttaaacacttttgaggtggataacatttagttgaaaatacctaagaaagtgtgtcttctttaaagccttggcttcagtcatgggaaatttttgttgttgttgttgttgttgttttttctgtatcctatatttggtattttgtatgtctgatccataatcattttaggtatttaagtgatctctgtggattcgtaggtttggccatttgaccattatttattatcaagatggttgtatgctaagattttaaaaaagaattatgctgtaaatctttataaattgtatatatatttcttaaatattgcaattgtctaaacgttgtatattttaaggctgttttctcttgctctcaatgttgaggaaaactataaattgacctataatgcatctactgctaatggttttggttagtttgatattcattgtttttaaacagtttccaatatggaaattttaacaccttttatacagttctctactattcaagataaagattctttaaaatatctcaccagaaacttataattttatactttgtaatatttagtttctataatttgaggaagggactttttcatttggattaagtaaaaagcctttatttgattgccagcatgagaattcaccttggtttctattttatgcatttgtaaattttttccctaattacatggaagctattggaacttttgtattcaatgctaaatactaagtcaaagggagtataataggtaagttttttcagttactgtgtctttagcattcagtcattataagaaaatgatcataagaaaatcattatattataaacatgtaattatttcatataatgattatcatgtactgcaatgttacttttaaaataagctattaaactagtttttatgtttcaactaatgcaaaaaaaaataaagaaatatctgagactggctaatttataaagaaaagagg

SEQ ID NO: 474098 - DNA, 744 bp, Homo sapiens
cttaaagaactaagacccaacagctgacatcatcagagaggtcagcagatgacacagtgaaggcatttctagcaaggaagacttgtttggagcagagtagaagatctggtgttccaacccagcaggaaaatgcggcctttgactgaagaggagacccatgtcatgtttgagaagattgtgaagtacatcagggagaatcttcagctgctgctggaccggcctgaccgcacctactgtttctggctgcacaacgaccgggtggactatgtgagtgagaagattgtgaagctggatgccaatatctccggggacaagctggtgtcactggggacctgcttcggaaaagtcactaagacccacaagtttcgcagagccagtgtgctgctattgtttgctggcctaacaaaaatgaaatcaaggctttcactgaacagtctgccaaatgttgaatcaacagcccagcttctgcaacagcttgctttaatgaccctagacagcttctatttgaatcatatactgggtcacaaggaggaaatagataagcaagtgtttgacattcttgtgggctctctaaagtcttagatcactccagccttgtatgctaactttggagactgataaaggctattggtgcctaaaaggctgtgaaatgtattttttaaaaagctgtgaaatattttaagtgtacatcacataatttagattgtaaatttgatacatctgcactatgaaagtgtcagaaac

SEQ ID NO: 474099 - DNA, 722 bp, Homo sapiens
cgcccgctcgacgcctctccacgagcccacgcttaccatgcattgccacccagcggaactatggggctccaggctagtactgagaagtgtctgcaaagagtcctgttatgtgatccatcttcaggtcttgcagccgtggataccaggacctgctctggtggaggtagtgggggagggaagtggactctcccccacaacagcaccaagtctatttgcaggcagccagtgaccagggctgagaacttgccccagaccatgagcctccccattgagaaagcaagccgactaagaggttttcggcatctcagggaacccatagaagtgatccagttcttcaaagggtctgtggattctctcggctttcctgtgggagagaagggttggcatgtgtttacaccatcttacctggaaccagaactctggacatctgtttttgtcacccagaattttcttcctccttgcaatggcccttcaactttccctcgacaaaatctctttttacctttcatccagggtacttccagaagagttggtcccacttatgactcagaatggaggaagtatttcaggctgaaaacaatccactcaatgcattttcttgaacaaattgatttaatagtgaacataagactcacttagagccaatgagagagaacaagattctgctgaaaatttagagcactatcactggttcttcacatctagatttagacctagaaacc

SEQ ID NO: 474100 - DNA, 996 bp, Homo sapiens
ctcggaagcatcagggtatcaatgggacaagtgtgggctctggttcattccaccttggaaccttttcaccctaatgatgaggaggaaggaaagtataatgaactaacagaagacatgacagagcaggtttgtttgccagctaaagctaaagcggcaaaggaggaagaggttcctccctacccttctgcaccccctcattattttgaagaaaaagaaggacactgggtgaaaagtagttgccccagtgaccgagcagtgcctcgagtgaccgctctcagttctattcaagcaggaatccagcaagctagaagagaggatgggtctagtaatggtaaagcttcttattctggatcgaaaggtaaagttttccagacgccctatacttcggctcaaaaagcagagcttgtagctataattgaggtattgactgcttttgatatacctattaatgtgatttctgattcttcatatgtggttcattccacacaattaattgaaaatgctcagttacgatttcatacagatgaacaactgatgactttatttacccaactgcaaacagcaattaggagtagaatgcaccctttctacattactcatattcgggctcatacacctcttccaggacctttgactccagggaatcaaatggctgatcgcctagttgctactgcaatatctaatgccagacactttcacaatttaacccatgttaatgcctctggtctcaaacgcagatacagcattacctggacagaagctaaagctattatccaccatgttgagactgacgctgagggggaccccaactgtcacgagcaacacccatcgaacgcagccacctacctggggacagatcaagaagctgtcacagatggcagaagaaaacctaaggaaagtgggacaaccagtcacaatgaatcagctttctccccataatgggggatgtggctgccattagttcctgagcctcatgctagaaaacctgtatcctgc

SEQ ID NO: 474101 - DNA, 1332 bp, Homo sapiens
cgccgggacactttattgcgtgaagtccctctcactccctctacctccctcttttacgtggactctgccaaagaccaggataccagaatgcagtggagtgaccaagtgtagtgggaccttgggaacgcgagtctggagccaggcggctggggtttgcatcctggttctgcccctccttagctggctgacatggcacaagccacttaccctctctcagccttactgtcttcagtggcaaatggatcggtcaacaggccccattgcctgggatttttctatgggaatactctctttgaagaacccaagaagcagtgtcaggctggtgtgaggaccagcagtgatttctttgaggaggagagcccgtttcttcactcacaggccatgtctgagtggatcaagaagaacagagtgcccttttatgagattttgtctgccaaactcatggagctggctctccctgggcctcttgaatctgcttcatcggaatctgaaggagagggaacccgcatggggcagtccatagagatccaccgcccagacacaggcagggctgagaatgggtctggagggcaaatggaagacatccccaaagccaagccagtcagcagctgagggcaccaagcaataagccaggagtagaatagtgccctgcacacagcagggtcttaataaatgtttgttattgacaagagctatcatggttttggagaaataagtggcagggaaactatactagacagtgactggagccctccccagcatagctctctcacctgggtaggggccagggaggtggtcggcaggcggtatgggtgagagaaaggaagaagcactcctctctcagaaacatgctaaaattagtttgatgtttatagattgtatcggtcagaactcgttttgttatatttgaaaaaaacgcaaatgacttaagtaaaaatgagatttattggctcatgtaactgaaaaggccaagggtattaggcgtggatggacccaggtgctcaaataaaatcagcagatgtcagtctctctccatctcttgactgtcttctcttggttgtcttcattctcaatgaatgggtttcttctttgcactggtaagacagcctctagcggagcaagggtaaatctcatcagtttagtaactgaggggaaatagagggcctctcaccaaatattccagtaaaggcccgggagttgactctcattctgacttggcttcacccacccttgagccaatcactgtggctgtggttgaggaggtgggaggtggggtgattggtcagatctggatctggctcagagctcagaattaaggatccccgcacctgg

SEQ ID NO: 474102 - DNA, 985 bp, Homo sapiens
tttaactagacaagctgcctagagagtgccctctggcccagctgatggacagtgagacggacatggtgcagcagatccgggctctagacagcgacatgcaaaccctggtctatgagaactacgataaacttcctagtgccaagtgtataagtgtgtccggaattggtgggttcttggtctcattgacttcaagaatgaagccacagaccctcctgatgtattcgaagcttattccttctggtggggttcgtggtctcgctggctcaggagtgaagccgcagaccttcacgtgcggggccaccaagcccacgcccactcggaactccagccggcaggcaagcagcacgcatagccccggttccagctcacacctctccctccacacctcccttcaagctgagggagccagctctgaccttggccagcccagaaaggggctcccaccgtgcacccgcgggctgaagggctcctcaagtgccgccaaagtgggagcccagacagaggaggtgccgagagtgagtgagggctgtgagggctgccagcacgctgtcacctctcataaggagtgattaatctgagcttctccagaaagtccattcctggtaggcactgggaataagaaatctcagagtataaaaaaaatcaagtggtagcacttttgtgaatggctcccaaattagatcctttaccttttgtcttttcatgaagcacagttgcacaaaacacgcttagcctgagatgaagcacatattagagaaaggttctctctatagcattatgtattactcgaatgagcattaaaaagaggagatgggacatgctctctctagctattattacctccactgtacagttgacatacacaagctcattattgcattatgttttattcaacaaaataactttaatgttgaagtttaaattgaatttgctaaaacatctttgtctccagcataatgtgcctcaagtgtcttcttggtgcctg

SEQ ID NO: 474103 - DNA, 699 bp, Homo sapiens
aggggcagagctgccagaggccatgggaacctacctcttgcatcagcaaggcctggatatgagacatgcaattaacttgtggtaatatgagtcagaattgttcatggattagttataaaagattaccacatttcaataggacaatacaaatgggaaatagtaccttatctattctgagtaggtccatacacttgagaagattttaccttgtccttagttttgtatttctcatctcacaactatcacagctgtcactccaactgtcttttatatgtggaaggtgtgaggttctattagatatgattagttcactgagttacaaaagggaaaggagatgctggctctccatggaagaacaggtaaattgtgatcaggccgacttagagcaagactttggtaaggtgcagtcactgactcttacgagtggaagcataccagtacccaatgtgcatgggaacgaatttaccctatgacccaatgctttaagtaaaatttatgtcatatacatttccacagtagtcatgtaaatttaaaatctaaatgctaacatgaagttatcccactactttctctttttgctgacagagttcaaagagtgctttaattgtgatgaatacaacaatgacaataagtactaaagctgacaactttctgtaggtcagaccatgtgccaaatgattaatatgtattatctcattt

SEQ ID NO: 474104 - DNA, 1419 bp, Homo sapiens
agataactgcgggtcacgctgtacgggaagcatagcagcttctgcttctgaggaggcctcaggaagcttacaatcatggtggaaggcaaagggggagtgagcctattaatatggctggagaaggaggaagacagcaagagccctttggcaaaagctggttactccttgccagttgaactcattccttcccccagagttgtcaggggccaggaatgtgtcctggtgcacagttgctctgtgcaagattcccagcttcctataccttcagcccagcttctgtttcttccctccatccactttcagtgccttgcctctgaagatctattaggagtgagcccgtcatctcgatccctcagtggcagctgttccacctggagcacaaatcgagttgtgattaaaaagcccaaactgcttagtcagactagctttgtgaactcatccaagttactcacctccctgtacctctacttctccatgcatgaaatggggtttcaatagtttctgaatcatagggctgttgtaaagaggagggagactcctcctattataattcagggtctttaaatcagagcaatgagaaatcatcttaattaaggaaaacccttaagtcttccccaacagctggtttgcttgcaaataggaaagactaaaaatgaatcagagaaaaagggtttgcacaatttctaaaataacttgatatatttagaagtgtgactctgtgtgtgttttcttgtgcaaatctagaaaaccagagagcttgtgtgagttttaactatgttgtaattttcagaatcttcaagtatcacgtaaaatacacagcatagttctgcagctctgtaatgttctgttatgcttggttgtgagattcgtattggcataacagtgcatgagagtaaacatttaatattttaaatttataaaatgcagttgctgtatgtacaaacatattaaaaaggtatatgatagtgtgtttgatattttaggtatatgatactttgtggctattagtgagaaacagtacaccagagaagtgctattttagacaagtgtgtgcatcccttttcctctctgtagcctgtgatgttatttggaggtttgtccatagaaaaacaggtgatgcctaatgttaaaagccaaaaagcagttactatggaaaccagatgcaaatttagatctgtgtccactttttactgcgtacagaaaaaaaaaagctataatagagttaaaaattatgattcacatccatgtcttctgagtcttaaatgtctgccaaatacggagatgttgagtaagctacaacttctcagcctgaacttccaataaaatctcaaaaatgataaaattagagaacacttcaaaatgttctttttatttcttcatttgccaaaattcccttttctaaatatagatctaaaataa

SEQ ID NO: 474105 - DNA, 531 bp, Homo sapiens
gaggagcaagatgcctttatatttactcgtgcctctgcatctactcttgggcgtgaagtctgcagggctgacgatcaagaaggaaagatgcatacgaaatggatacagcaaagaaaaaatgaaactcatagttgtttctcatggcctccatgtaaatgacttgcagcataaactgacgcttttcaccaaggaaacatacacatacctagccagggattcagagaagcagaagcaggggtatctagcaggacttgaaggagcccatgccaacagggtgaaccagcagatcagtgacaacttagggaattatttaattatgtatggctgtcttctcaaccagactgagagtaaggagtttttcttgtttactactgtgtaccaaaagcacatcgcagtggagaaagtacagcaaaaagataagaggagaaaagacttcacataaactcactttggacattaggcactttctcttaactagacaatgaatatgggatccggattggaaaaatggtctagggactgagttgtgat

SEQ ID NO: 474106 - DNA, 560 bp, Homo sapiens
atgctgtctgggaggcttgctcatggtgacatcctcatctccccatgcacgttactgcattcagagcttgggtcacctcgacactgaactcaggtgaattctctctgagatcccgggagaaggaggacagttctcaggaaggttttccagggccgatcacggaaaggatgagaaggcagaggtcccgatcggggacacaattacggtggcatttctatgggaatactctctttgaggaacccatgaagcagtgtcaggctggtgtgaggaccagcagtgatttctttgaggaggagagcccgtttcttcactcacaggccatgtctgagtggatcaagaagaacagagtgcccttttatgagattttgtctgcctatggctaccccagatgtctccagatgctttcaaatgctgtggggcaagggagtggtacgtgagcaaaactaccccagttgagagccattggtctacacttgtggaaatgtttgaggtcatcctggtaaaaggctgtgtattcccttgggggcaggctgggagaaagattgatagtataaattttt

SEQ ID NO: 474107 - DNA, 2033 bp, Homo sapiens
atggcggcggcagctgtcactgggcctagcccggggtgtggacctggggactccccagaagggcccgagggggaggctcacggagcgtcggcggaaggcacacaggatgttaaagctttacaacggcctctcggaaggggaggcggtgagactcctcgcggggaccgaccccctggaccccactgatctgaacggggcacacttcaacccggaagtttacctagacaagctgcctagagagtgccctctggcccagctgatggacagtgagacggacatggtgcagcagatccgggctctagacagcgacatgcaaaccctggtctatgagaactacgataagttcatccccgccacagaaattgacaaacagcataaaactacctcccagtgccaagtgtgtaagtgtgtccagaattggtgggttcttggcctcactgacttcaagaatgaagccgcagaccctcctggagtgaagctgcagaccttctcggtgttacagctcataaaggcagtgtggacccaaagagtgagcagcaacaagatttattgcaaagagcaaaagaacaaagcttccacactagacataaaggttctacaagtccccagcagactcaggagcacagctggcttcacccagtggatcccgcacaggagctgcaggtggagctgccggccagtccctctccgtgtgcccacactcttcatcccttgggtggtcgatgggactgggtgccatggagcagggggcggtgctcgtcggggaggctcgggccgcacaggagcccacggaggggggaggctaaggaatggcgggctgcagtgcggggctgccaagcccacgcccacccggaactccagccggcagacaagtagcgcgcatagccccggttccggctcacgtctctctctccacacctccctgcgagctgagggagccagctccgaccttggccagcccagaaaggggctcccaccgtgcagctgcgggctgaagggctcctcaagtgccgccaaagtgggagcccaggtagaggaggcatcgagagcgaacgagggctgtgagggctgccagcatgctgtcacctctcataaggagtgattaatctgagcttctccagaaagtccattcctggtaggcactgggaataagaaatctcagagtataaaaaaacatcaactggtagtacttttgtgaatggctcccaaattagatcctttacttttttttttcatgaagcacagttgcccaaaacacgcttagcctgagatgaagcgcatattagagaaagtttctctctatagcattatgtattactcgaatgagcattaaaaagaggagacgggacatgctctctctagctattattacctccactatagagttgacatacacaagctcattattgcattatgttttattcaacaaaataatgttgaagcttatattgaattctctaaaacatctttgtctccagcatagtgtgcctcaagtgtctccttggtgcctgaattttctccagaattatagtgctgaagctatggaaatggtgaaattatatgcaatctgcaaaacaatgtggctataacgtggtaattggccttccacataattaaaggaacatttcctcatcagagctgttccatcagagacccaaaggctatcgttatacaaatcacccacttaggaaaacctttattcccagtagcctataaaaatctggttatgcaaacagatttgcttattcagtaacattaatggcttctcatagttaaaaagtcatcaatgtgattgacctataatctgtttcctctgtgaccaagtgtcatttttattttgacagttaggagccttttgactctttcacagctggcatgaagtgattcctgagcacctactatgtgctgcccactgtgagagctgttagggttgaaatagggagcacagcagggtaggggctgcaatcaggagcttagtggggagaccattctgtaacatgtttccagagcttggggtggggaagctcagggag

SEQ ID NO: 474108 - DNA, 1363 bp, Homo sapiens
gatattgggagtaatgtcgtcctccccaaacctggatgttagcaacgagatcacagagggggtgtacacaccctgcgacattggaagtaatatgatcctctccccacctggactccccacctggatactgggaaagatatcacagcgcgggtatacgtttcctaccctgttgggagtaatatcattcttttcctttctggatattaggaagaatatcacaggggtgctgcacgattacttcgatattgggagtaatatcatcctctattttcctggatattgggcacaaaaacacaaaagggtgtacaaccccttcgatattgggagtaatagcatactctccttccaggatccagaactgcagccggtcctcgctttgctgtccctgtccctgtccatgtatctggtcacagtgctgaggaacctgctcagcatcccggctgtcagctctgactcccacctccacacccccacgtacttcttcctctccatcctgtgctgggctgacatcggtttcacctcggccacggttcccaagatgattgtggacatgcagtggtatagcagagtcatctctcatgcgggctgcctgacacagatgtctttcttggtcctttttgcatgtatagaaggcatgctcctgactgtaatggcctatgactgctttgtaggcatctatcgccctctgcactacccagtcatcgtgaatcctcatctctgtgtcttctttgttttggtgtcctttttccttagcctgttggattcccagctgcacagttggattgtgttacaattcaccatcatcaagaatgtggaaatctctaattttgtctgtgacccctctcaacttctcaaacttgcctcttatgacagcgtcatcaatagcatattcatatatttcgatagtacaatgtttggttttcttcctatttcagggatcctttcatcttactataaaattgtcccctccattctaaggatgtcatcgtcagatgggaagtataaaactttctccacctatggctctcacctagcatttgtttgctgattttatggaacaggcattgacatgtacctggcttcagctatgtcaccaacccccaggaatggtgtggtggtgtcagtgatgtaagctgtggtcacccccatgctgaaccttttcatctacagcctgagaaacagggacatacaaagtgccctgcggaggctgcgcagcagaacagtcgaatctcatgatctgttccatcctttttctggtgtggaaataccttcccacctatatgttcaaatgatttttcacatgagtgctaagaaagctcattggtggaaaagcagccttttcaagaaatggtgttggagaaac

SEQ ID NO: 474109 - DNA, 566 bp, Homo sapiens
gttctcaaggctggcaagaagacagggctgtagatgaaaaggttcagcatgggggtgaccacagcttacatcactgacaccaccacaccattcctggggctgggaatccaacaggctaaggaaaaaggacaccaaaacaaagaagacacagagatgaggattcacgatgactgggtagtgcagagggcgatagatgcctacaaagcagtcataggccattacagtcaggagcatgccttctatacatgcaaaaaggaccaagaaagacttctgtgtcaggcagcccgcatgagagatgactctgctataccactgcatgtccacaatcatcttgggaaccgtggccgaggtgaaaccgatgtcagcccagcacaggatggagaggaagaagtacgtgggggtgtggaggtgggagtcagagctgacagccgggatgctgagcaggttcctcagcactgtgaccagatacatggacagggacagggacagcaaagcgaggaccggctgcagttctggatcctctgagagtcccaggaggaggaattctcagacacctgtgagattcc

SEQ ID NO: 474110 - DNA, 2056 bp, Homo sapiens
agcggtgctgaacattcactagtaactgccctggtcacccccttatccaaaaagactattgacgccatcggagccatgagggtttcagcaaagcaagctttctgcttgtctcggacttgtactgtaggaggacataaagtcattcatcagttttggtacatgcctgactgtcccttgacctttttgggaaggaacttgctcagcaagctgagagccactatgtctttgacaaagcatggctctttgctgctaaagttacctggaacgggagtcattatgacccttacagttgatgaccttctgctgggacaccccacggcagtcgggtgtgccacgggaacggatgccccacaccggcacctggaggactgtgggtataaggtgtccaagaagaaagctcagatctgccaacagcaggaagctttggaatgtggatcccaacaacagcaactctttcatgagttaaaggaaaaacttctggcagccccagccctgggtctacccgatctgacaaagccttttccattgtatgcgtcagagagagaaaagatggccttggcagcaactgccctgctagtacaagaagcaaataagctgacttttgggcaaaacctgaacataaaggcctcccgtgctgtggtgactttaatgaatactaaaggacatcattggctaacggatgccagactcatcaagtaccaaactttgctctgtgagaatccccgtataaccattgaagtttgtaacaccctacaccctgccaccttgctcccggtatcagagagcactgtcgagcctgattgtgtagaagtgttggattcagttgactttagcagacctgacctctgggaccagccttgggcatcaggagactgggaactatatgtgtatgggagcaggttcttcaacccccaaggagagagagaggtgcaggaggctcaaaaagcagcatctgcccccttccgggcatcagtgctccctcaagcacctgatcttggacctacttcttctaaagaagaaaaggactttctccaggtagacttcagagagatgccaaagtgtggaggtaacaagtatgtactagttcttgggcgtacctactctgggtgggtggaggcctatccaacacgaactgagaaaactcgtgaagtaacccctgtccttcttcgagatctgattcgtagatttcgaccgcccttatggatcggctcagacaacgggcctgcatttttggctgccttggtacagaagacggcaaagatatcagaaacaatatcacaggggtgtgtcaacaacccctgcgatatttggagtaatatcatcgtctcccctcatgaatattaagaacaatatcataggggtggggggtgtacagcccctttcatatttgatatcatcctcttccaccctggatatgaggaacaatatcaggaagggatgtacagaccctgcgatatttgctgtcatataattgtctctcccgtagatattaggaaaaaagtcactggggatgtgaacagccctgcgatattgagagtagtatcatcctctccccccttgtatattgggaacaacatcacaggtggggtgtactgcctctgcgatattgggagtaaaattttcctctcttcccctggacattaggaagagtatcagaggggggagggtgtacattccctgccatattcaacgtaaccttatcctctccctcccagggtattcagaacaatattacaggaggggtgtacaccctctgcgatattgacagtcatatcatcctctttcgctctggatattaggaacaatatcacagggttgtgtacaccccctgcgatattgggagtgatatcatcctctctccctgggtatattaggaagagtatcacagggctgtgtaaaccccctgcggtactgggagtaataccattctctctccctctggatatgaggaagattttcacagggaagtgtacaccccctgcgatattgggagtaatatcatcctctccacccaggaaatgactaacaaggtcacgggggagtgtactccccctgc

SEQ ID NO: 474111 - DNA, 1469 bp, Homo sapiens
ttattttgattttactattgcagcaactcaggctatgagaagctgtaaatacccaggtccccagttgacaccaggatccaggtggaacacccaggctccaggtgaacatcaggccccaggtagatgctggactccagtagacatcaggccccaagtaaacacccatgattcaggggaacaaaaggccccaggtgaacaccagactctgggtggatatcagaccccaggtggaaaccaggccctaggtggacacctaagttccgggcccaaggtggataccctgtcaccaggggccatcaggctcaaggcaaatgccaggactctggtggacaataggccccaggtgaacatcaggcttcagacacaaggccccatgttcatacctagtctgcagatgtatgtcagaccccaggtggacaccaggcccaaggtgtataccagtcctgaggtggacataaggtcccagccctcaatggatctgagcaagcatgacaagtctcagcgtcatgacagcagcagccctgctgaggacagggctcccatccctactgccagtgctgcctggcctgagcctccctgtgcttcctccacagggcagcccatccagtatgctcgctccacctgcgaggccggcgtgggtgagctccacatccaggatgccctgccggaggaccatggcacctacacctgcctggctgagaatgccttggggcaggtgtcctgtagcgcccgggtcaccgtccgtggtaagcctgatcccaccatcaccctgagcctacgcccccggctcctgtgcatgactgggtcctctggtgctagcactgagtgcagcgtgactggtctcccatcagacaagcaggaggatacatctctccattccctggggctcaggcctgtcaggaacatctccctgtccaggtccagccctctcttgcccttagtgtggcaccaggccatggtggggagcatggatgtggagccagcggcctgggtcttcctcttgtgtgaaatggagatgctgacagtcacggtactgtgaggattaagtgaatgaatgtgcaaagtatccccagagcataggatagcacataccctccataggtatgtgctgtgattatgattgtccagcagagcccacctttaaacaagatacaatccttacaaatgccaagactgaggaggggttttcccaaaggatccactttgctacagtattgtgtgtttgtttggccatcagaaaatcagaggagggagatgtccagccagacacaagcgatgaacacacgcgcctgcttccaagggctctggccacaaagtggcgccatggagcaacgcgtgtccctccagttgtcttctctcaggggtggttgaggggcagctctgctgcaagcaagcttattctgagagctcagcagatactgtgccaaaggccagatgcaggggctctttctcacctctcgccttttgcc

SEQ ID NO: 474112 - DNA, 782 bp, Homo sapiens
gtcaccaacatcaaagatcaaaggtagataaatccacaaagatggggagaaatcagtgcaaaaaggctgaaaataccaaaaaccagaatgcctcttctcctccaaaggatcacaacttctcaccagcaagggaacaaaactggatggagaatgagtttgacaaactgacagaagtaggcttcagaaggtgggtaataacaaattcctctgagctaaaggaccatgttctaacccaatgcaaggaagctaagaaccttgaaaaaaggttagacgaattgctaactagaataaccagtttagagaagaacataagcgacctgatggagctgaaaaacacagcacaagaacttcctgaagcatacacaagtgtcaatagccgaatcaatcaagtggaagaaaggatatcagagattgaagatcaacttaatgaaataaagttacccacaaagggaagcccatcagaccaacagtggatctctctgcaggaaccctacaagccagaagagagtgggggccaatgttcaacattcttaaagaattttcaacctagaatttcatatccagccaaactaagcttcataaatgtagaagaaataaaattctttacagacaagcaaatgctgagagattttgtcaccaccaggcctgccctacaagagctcctgaagggagcactaaacatggtaaggaacaacaggtaccagtcactgtaaaaacataccaaattgtaaagaccatcgacactatgaagaaactgcattaactaataatggacaaaataa

SEQ ID NO: 474113 - DNA, 549 bp, Homo sapiens
ctcggatgatcctgataactatacagatgtcctgcaaggattggggcagtcctttgatctaacatggagagataccatgttgcttcttgtgaaaaagaatcagctttagcagctgtccagcaatttggggatctgtggtaccttagcgaggtaaatgatggaatgaccctggaaggaaagggaaaaattctccacaggcaacaggcagtccccactgtagaccctcactgggattctgactcagatcatggaaactggagccacaggcatttgctaacttgcattttagaagggttgaggaagactaggaaaaagcctatgaattactcaatactatccacaattacacagggaaaagaggaaaacccctccacttttctagaaaggctaaggaaggccctaagaaagcacacatccctaactccagattccgtagaaggccaacttattttaaaggataaatttatcacctaatcagcagctgacattaggagaaaactccaaaagtctgcgttaggcccagaacaaaatttggacacattattaaag

SEQ ID NO: 474114 - DNA, 1324 bp, Homo sapiens
gagggcagtggtgacagtgtgagttatggctttgccggctgccagtggagccatccgctctgcacagccgtgcaagggtgttttgaaaagtggctcagccggccaggagtgactgggtgagcgcagcgcaggccagggcccggcgtgtccgcggtgagcgcgggcggccagcagagggcgccagagagccaggagcggcccgcggaggagtccgcgcccgccctgatgcccagctccgcgccgcgcggacccaccgagcccgcgttcagacgccccagctccgccgacaggccgctcgcgccgggtccttcctcttccccaggtgcaggcagagcccccagagccatggccagcccttccggcagctccgaagccactggcaagccccgaggcagggatggcgggcccaggagggaggaggacgacgtccctcccgaagagaagaggctgcggctgttgctggagaggggaagcgcgcagcccgaggactgcgaggacggggaggacgcgccgcggccaggcaggaagaagaccggcacccagacaggtggcgacggcagaggagtaagtgacgttggcgcgggggtccgggggtgccaggggcgcggggtaggggcggcgggaggctccgtggccggccctgggttaaagttggtaattgagcggcaactccggcgggcgcggagtgacagctctctggcggcccctcgaaaagagggaatctggattttcaaacttaaaatttggcccaaagcccactgctgcccgcaatggccgccagacacattcctcttcccttttagtttctatgggaatactctctttgaagaacccatgaagcagtgtcaggctggtgtgaggaccagcagtgatttctttgaggaggagagcccgtttcttcactcacaggccatgtctgagtggatcaagaagaacagagtgcccttttatgagattttgtctgcgtagaccattagcttggtaaaaatgtcaaaaccatcctcgttctttaatagcagattattttggacttttctctgcaagaagcagcataggcattcagatgcttttaaggataaaatgttctttctcatcaccaggcctggtgctctggatggctgaggttttactgtgacttggtgtcccttggagtggctcccaggctgtgctcttgtggttgggtggcaaggggttgctttattcggtggtggctagaggacgttttagcagataaatcgggaccccaggagcccctgagtgccaagtcctgctgcagggcatgtgtttatgttggggatgtgggggggtggagggtgggggacat

SEQ ID NO: 474115 - DNA, 1957 bp, Homo sapiens
tctgctaagtagtgggtgttgttccttgacaccttttgctaccgctggaccacagtccgcctggtaacgggcgtcttcccagacgctggcttcaccgctagaccaaggagcccttctgctggccctgtccgggcataacagaaggctcgcactcttgtcttctggtcacacctcactatgtcccctcagctcctatctctatatggcctgtgccttgggaaagcattggagggttttgagcaggccagtgcaggatctaagccttccagctcctgtgtggaggagaggctgagaggctggaagcggggagaccagttaagaagctatggcaaaagcagatgggaaatcatggcagcctctaccagcatcttagcagtgggaaggaggaaagtggctgggttccggatgtattttggagacaccagtagcactgccacacacattgatgaccatcaaaaatatctccagacattgccagatgtccctgggtgtggaggggagtggtacacaaaatcacctcaagaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagtcggatttctcatccaacccttttcagtccgtgaaagtcttcaccagccctctctttgcctgtggatgtcccagcagtgtggctgtagtgcaggagcccaacaggacctaggtgcatatggtctttagtgtttactcctgtataaaaactggccatgtgtggtgggtggcccagtactgtcatcccagcacttgggaggctgaagcgagaggatggtttgagtccaagtgttcaaggccagcctgggcaagatagtgagacccccatctctataaatgaataaaatgaatgaatggtgtctttgaaattccagaacaaaagtgcttatcagaattcccagaattgtgtgtttgcttgtgaccactgagattcctaccgattcttgcatctgtttgcccccacctctgcctttaatagcacacctttacctcttgccctgggaaatacagtttgctgtgactcatgaaagccttgcttggtcacctggggcatctctagacaaggtgagaatcaagcttaccttggattttagaggggaatttcttgaaatatcagagccattcataactgaggacataactggaatatttggtctcaatttaaaagtccccttgaaatgacaagttaacaaactaaccccttatgccttggttcttttaggcgaaagctctccagtaaatcaaagaagtggaaatcaatatttaacctgggacgttctggatcagactccaaatcaaaactgagtagaaatgggagtgtatttgtgagaggacagaggctctcgggtaagaatcaacagcaattgttttatgatacaaatatttgtttcctaactctgcttattaagtctttggtttgatcatatcaaacacactagctctgaaagagaaacttataaattaactaggggaagaggagtcttttttcaaaacattttagacttaccaaaaaaattgcaaaaatagtacacagagaacctgtatacccttcatgcagcttctcccaatgttaacatcttatataagttatcaaagccaaaaattaatattgatacaatactcctaatgaatttgcagatcttattcacatttggccagctgtcccactactgttctttttctggtctaggatccaatccaggatctcacgctacatttggttgtcatgtttccttaacctctgccaatctaggacaattcctccatctttttgaccgtgataacttggaagagta

SEQ ID NO: 474116 - DNA, 701 bp, Homo sapiens
ggaaaagattgagaaatcggatgaatcacccattcccttggggaaaatgtcctcaagatgtgacagaatctgccagtcccagaatagacccatctgttatcttgggtcccccggacaagattttcatggaagacatccttctcatctgtgtcaatgcagctccagtagcccaaaggcggttctcagagaaagattgttggtgtcagcctttaaagctgaagcacaaaaaaggtgggagacaggtgcatagaacaagtaagaagtgtccaagggcatctgggtggagtaactaccatgttgatggcaactcatcatgtatcatacactgtgcagacttcttagttaatttatactacaatctatcatggtcttacctgtttattccaattcacaatggtgctttttctgatgaggttgtctatgagcactgaatatgaggcctgaaataaatgaatgagtaattaagcaagatcagagtcaagttcaaggaccaacgacaagagcaatggtggtataggaagctaactaaacactggcatatagagtcaaaattatacaatttactatatagagttaccttgaggatactgttgtagattacatgactcatattcagagactcctttgtggggaggtatacattcccactgtgctgaacacaggagggttagggaagatctgtcaataaaggtgacactaga

SEQ ID NO: 474117 - DNA, 642 bp, Homo sapiens
ttctctctggaaaggtgatacttaggattacacctaaaggaagagtggggctcgctatgtctggcaaagaacagaaaaatgagcatggacaaagacattgaggatgatggcattgggaatgggagaaggagatgcatgagaggatggatcttggaggctgagccaacaggacttggtaatgggatgtgggcagaaggtggatgcgttgtctggatggagctcaggagtctgagttttcactgggcaaagagtgatgctgatgcagattcaacaacacccaatgttgaacttatttgcagaatgtcaccgtcagggtctgatcttaaatgtgttgtgacgaatggtcaaatgggaggagggtgtgaaggcattttctgggctgctgagttatgcactgtgaaggagctgcaggctccatatcagaagacccaaggcaggggacctagttttcctcctagcagtgttgtcaaggaggattgtgaggttagagagagctggcctggaagccaggagactccagatttagagacttggaaataaaattgcatatatatttaatgactggcattctctgatttattgattactcaaaatgggaatggtaacattttttactcctatcagataggaatgttataaagg

SEQ ID NO: 474118 - DNA, 509 bp, Homo sapiens
cagagttaaaaccaggtaccatgagggctcatctgattttctgttcttatgaagagggtgcaaaccccaagcctcggtggcctccaaaaggtgttgggcctgtgggtgcacaaaagacaagagttgaggcttggaagccatcgcctagatttcagaggatgtatggaaatgcctggacgtccaggcagaagtctgctgcagaggcagagccctcatggagaacctctactaggacagtgcagagaagaaatgtgaggttggagaccccacacagagaccccactggggcactgcctagtggagctgtgagaagagagccaccatcctatagaccccagaatagtagatccagcgttgaagccacaggcactcaatgccagctaatgaaagcaaccaagggggctatacctttcagagccacggaggtagagctgcccaagtccttgggagcccaccccttgcattagtgtgccctggatataagacatgaagtcaaaggagattatttc

SEQ ID NO: 474119 - DNA, 563 bp, Homo sapiens
agtactcccattagaatttcttatagaaccaggtctggtattgatgaagtccttcagcttttgtttgtcggggaaagtctttatttttccttcatgtttgaaagacatttttgccagatatactattctaggatttcagaggatgtatggaaatgcctggaagtccaggaagcagtttgctgcaggaatggggccctcttggagaacctttgctagggcaatgcagaagggaaatgtggggtcagagcctccacacagagtccctactggggcactgccaagtggagctgtgagaagagggccaccatcctccagaccccagaatgctagatccaccaacactttgcactgtgcacctggaaaagccacagacattcaatgccagcccgtgaaagcagctgggaaggaagctataccctggaaagccacaagggcagagctgtccaagaccatgggaacccaccttttgcatcagtgtgacccagatccagtggaactgtaagtccattaaaccccttttcctgtataaattacctagttttggggtatgtctttatcagcac

SEQ ID NO: 474120 - DNA, 530 bp, Homo sapiens
aggaaaaccagagacctttgttcacatgtttatctgctgaccttccctccactatttggggcaccatgggagcaagactggcctcaccaactctgtgggagctggatgaggactttcactatgagctaatccccactccccttgcaaactctactgcacagcagaagcagccatactctcctctagaacataaccccattggcctgagatccacccctcctatcccccagcaggccatggcaggccttgcccagggagaatctgaactcaggcccgcccaaccctgccccgacctgatgaatacttcccctagacaacttaggccaagctcaaatgtcactgctactaccacagctggtgctctcttgcaagtgtcccctcctggctggaagccagccaactcaggccattacagcaactcttggcagaataacgcttcttccaggaaggagaaaacaacagctaataccactcactgcaacaccctggctaactaaaggtcctgagtctgtccacatgacaacttcacc

SEQ ID NO: 474121 - DNA, 828 bp, Homo sapiens
gagctctgagaagtcagcaatgcttgggtatttcaaaaacaggatgccctttttaatactcagagacagaacacccataaactgtttcacctgtcagcacacctgtaataaaatctttcccaagaaaactggctttccaaatccaaaactgctcactatctccttggccatgggctcatcattctccctgaggctgactctgatggattcatgtgcttgccctggatattggcctggaaccagccaagatttctatcagtttgcactcttggaagcatcaaaccctggtgcttctgaacttgagagatggcaagggagtgactataccatttcaaaatccagaatctgtgtggtaaacactctgtggaatggccagatatgctttggctgggctgacagagagccaaccagtgtaaacatgcagagattaaaataaagcaataaaatgaaggcatgtgcatagtgatgacaggacaaccaagttttattaaaattattctgatattattcttggtaaacatacttttgaaaaagctaattaaatttatatgaagaaaaaagaatattagatcaatttattttcaaattgtactttgactattgataattgttttttaatttctgcagataggtgcatttctcttctcataaaaagaaaacaagaattccataaagctgtgtttcctaggtgaaatggtggggcaataccactgtacagtgtttaaagtttgaccatgaaggttgaggattcctcttggtgtgtttagagtttaaaatatttggatttcaaaattagaagataattatatagaagcaaggaatgctgca

SEQ ID NO: 474122 - DNA, 683 bp, Homo sapiens
gatatattgttaccgctgaaaatgaactttatgaaccttttccaagttgatctatccagtgacgtggcctgggacccagattatggggactctggctcaacaaggtggccgccatcatctaggcaggaagtcacgtcctttctgctcattgatgagaattgtcatgtggccccacccatcacaagggagccaaggagttcacatttcccggtggccaaagggagaggaaaactggcatcagtgagcaacattaatgataaccacgactttcagcactgccatacctgtgtgatctgtggccacccagaagaattacaggacttggtttggctccattctgcggggattcttgttcttggtattttctctggttcttaccccaagtacaagtttcctacttgcctccagctctcagacattttcaagacgctcacccctatcaagatcacataaccctcagcccaatcgatccagccagtgcaccatcccctccaagcctaggcatcctccaagcctgtgctgacactggatgctttctgccacaccccgggatgggacaaggcccaaggttattttgaggagggtggggatttcctgtggtcgtctgaggacaggtggcatggctgttcactcaggacaattaaaggcctttctcctcgtctcacccttagtattttcctggc

SEQ ID NO: 474123 - DNA, 572 bp, Homo sapiens
tcgtgttcgaattcctgcctgcttctcagctggataaaatgtattatgcaggcactaggtctttccaccctaggaagtgttcataggagtttgaaatgctacatcttctttggagaaatgcctgtccaggatgttgcaggaggaactgacatcagtgaaaagatgggcgcatcaaaagacatttcagagcccatgagaggcctcgttggtgctgttaagaaggagaaaccaaatgatgcacttgctaccgagatgttgagtcatgcccagatccagggcaaacatcacttctctaatctctctgatgacagcccaggccccactggacctgaaattgttagggtgatgatggggcagaaaaaagttcaaggaaccaagatggtggggaaagacagcatggatgagagagtggtgttggagcagaagggtgaaacagatttaggagctttagggtgcttgagaatagagaacaagaaactttaatgagttgttatggcctaagttggactcccttaaatttttgaaagaaacatgaattaagattaaaattcttgtctgcactatgcttcttt

SEQ ID NO: 474124 - DNA, 464 bp, Homo sapiens
cgcaatttagaattcagcatgatgaagggagtcatcgggtgtgtgattggtcgggagaaacaggccagttcaccaccactatcagctcccaatagtggagaaagagggatggatgccagccagcaagcaaacagcagtcgtgcatcacacccagtcacctcttactacatttgcaaatgtatctttcattcctggtaccctcctccagacactcttgcactcccaacttccttctattttcaatgcaaagtatcattttggtggctattgctatttaagaaaaaaaaaagcaagaaaaagggaagctttatgctccttagtgcttgtgagagggaaacattttacctatgttttataatggggccaagcaaatttggtcaagatggaacccttaatgtaatggcctcttgctgtgtcagcatcagtttgaagaagagggaacctgcctgtgcctgcacctaaca

SEQ ID NO: 474125 - DNA, 672 bp, Homo sapiens
tccaggtctgatcaattcaaagtatttccttggacattgtttagcacaatggtgtttagcacaatacaggatgttcagacactgtctgggctcctggtagagaatgtagatgatgatgatgatgctggctttgcaaagatcgtcgttagtcctttggctcatcaatgccaggcctatcctgcagaaagtaacaggagtagagggctgtcccctggactggggcctaagagaaggtatagggaactcagggagaggctcctcctcagagaagtcttttctgcagattcatccagttcagcaagcatgagccctggggccccaccaattcaaggaggagctaaattggcagatgtaccagcatggccacagagggatagagcaccaagcagactcttggagtccctgattccagaacttaactcttggatggcatatctggatctgctctgggccaaaggggagcccactgctctaaagggtgagtcccagcccaggcagcatttaccacagctgacttaagagcccttgggccttaagagaacattgttggtaatctggcagttctctttgtggcttgtagttatggggaggctcctccaactttgaaaggggagagaagagtgggaaggactacatctcatggtttgagtgccagctcagctgcagtacaat

SEQ ID NO: 474126 - DNA, 604 bp, Homo sapiens
caggtaattacattgggaagaaagtcaattttgcgggtgacaaatacagaatgtgaggtcccgctccagccagtggaaaccagacacagcagtagggtgaatgtgtcaggttataaatgaccctgtttcctttgttcagtgtacttttgtggcaaaactgctagcaagtgtaccctttctgcaggaacagtttgggcactcacagcatttggggtgtctcctaggtcctgcaggagcagtccacttccctcagagggtctgtgggtcctctcgggattccagaaacaaattatcccccaaacatagcagcttaaaactacaaacacaatctcacacagcttctgggaatggcttagctgggtggttctgcctcggggtctccaagaggtctcagtcaaactgtcagctggggctgctgtctttgaagactacatggggttggagggtccattatacatggacctggctgttggcagttggcttcatttcttcagcatatagccttttctataggctaatgatgtggcttacctccagggtaagtgatgcaagacacacacagtgagaatgacctagatagaagatgcaatatctcttataacct

SEQ ID NO: 474127 - DNA, 1319 bp, Homo sapiens
tccccagggtctgcctcatagcggggtgacctctgagcctgatgctccctaggaccaggcccagggcctgcaatccgctcctggaggcactcctgctgggcagggctgtgagccaggcaagggagagccctaggccacccctgagcactgggaccacaggaagaacttgtggtgacgtcactcttgcctcagatgccagcatgggcccagcaaggaacctgaacccctaccccagactgcgaggaggcatggccagagccgcctgcacgtccatggagcaggtgggagactcgccttcccaggcacaggacctgggtatccgcactgtgcaccctcgggagccagatctcagagtggggttggagccgaagctgggcattgtcacagctcagcagggtgagctgaacacttatcggaacaccctggctgcggaaaggaggtactccctgcaggtctcctctgagctgttctatcactcgataaagctcctcttcatcttgctcatcctccacttgtccacatacttcattcttcctggccacaggacaagaactcaggacccgccaaatgccgtggaagctgcttgcatgcatgcctggtccagctgcagccttgcagagagcccgcacccatgccagcacttggagctgcctaccccactgcagcagctggtccagctcattcaagaggaggagataacacgagcacatgaataccaggtggcaatctttgaggagaccgtcttagaagtctgctgaccatagtcagaaaggagagaatacaaagctgggaatccaacccatcagcaagacttggcaactttccctccaaagtataactcaagcttgcctatttttctccatatccattcccacgtccatgctgccatcatcttccatggctttactacagtagattctggagtgattttccagcctccctttatgccccgctcccatccatcctctatggcaacagtgatctttcaaacataaatcagatcttgccagaccccacagtgaaccctcagtggcactctctttctcttcaacgaaaatgaagctccttgctgtggcctgtgaggccttatgtgatctggcccctgctccctcctccaagctcacttcccatcgctcactttcccattccaaccacaggcctcctctctgctctttccctcctcagggcctttgcagttgctgtcacctctcctggacaggccttctaggaattttaatgactcgttccttcttcttcaaatttcagttcacgaagttcctcaaccgcttaaagtactgtcctgttaacgccaccacatc

SEQ ID NO: 474128 - DNA, 910 bp, Homo sapiens
aggacagctccttgttgggctttccctggagttcctgcctgtctggtcccagaggagaaggtgctgtgctgtcatgaagagtgcatcgtatgtgtcccctctggactatggctcgcatcatgccttactcatccttttctccctagtgccagagccccggtgtctcagagctgccaagctccttggagcaatgctcctcaaacatcagcgaatcccctgggggtcttggtccaatgcagatgctggctcagtagatgctgaccagggcatcatctcctggcaggaggccagctgtgctgaaagtggctccatccctacaagctacttcagctgcaagatgggaaactctaataccatcttttggaccccagtccctacctctcctgctgcctttcaccctgtgccacccaaacttgaggatttctgggctccccagactgctgctagggacttctggaaagtctcacaaagctatgactgtatcttccgcaagcatagattgtgaggcctcggcagggccttgctgttgctcacttctttgtgatccacgtctggctgtgaagcatctttaaaaacttctagatctgcttaccatcaatctttagacaactgtgtggtccacattccttaccttggttcctcatcacaccattcattcctttacctcttacaagatgccagctttctccctgaaaaagtatccactatgccgacagtcctttcttggcttttttgtgtggtcttaccacttaagcatgaatccctaaacgctatacttacttttgtctgtgtttgaacttcatattgtgaaaaaatagagtggctattctttgatgtctgacttcttttgccttacattatgttttctttgttgttgtttcatctaagttgatattgcagctatagtttt

SEQ ID NO: 474129 - DNA, 736 bp, Homo sapiens
atcccacaacaattaatggatccaattaagcaccagagaggaggagtaaatcttcagcttataggcacctcatttagccccagcaccagcgaggatttggaggataattgctcaggaaaagagaagattgaggaagctattttgaagatatcaggcccggggcgttggggcccagtgctagcttttggagtttcctctgaatatctggggctgccggagttaggaaatggtcctttagggtcagttgtctttctggtgtgtctgggtctagatgagaagcctgtgtctgtacccgttcagccaactgccagaatggaatggacttctttcccttcaaatatgaccttgaaggtctggatgcatattggcaagggcatggaagtgattcaagaaatggaggaaaacgtgtatgtagacagtgtcagaattcaattggaggacacccagttggtatctgctgcagaagtgattgcttgctttgtggtggaaaggaatcctcaggaaatgcagaagtcttctgtgttgattgttgtgttctatgaaccatgtttaaatgccctgattggtaacatccgcgtctgttgtatgctactacgagccagtcattccaaaattctggaggcctagatttacaactggtgtttaaagtgtgtggggaaaaccccacacacatctggtcaccaaattattctcctgtgttgatgattgctgttgtgtaagagtagaggaaaaatac

SEQ ID NO: 474130 - DNA, 745 bp, Homo sapiens
caaagatcttgtaacaataagactatgtttagctttgttctaaaaaatgtatccattctaatacgtgcatggggtacctcattgacattttaattttcattggttttctgtgccatgagcaacgggacctagacgaaactcctggtatttcagtaacagattttggttccctaaccagcaacgtgttgccacagttgctcattgctcagctgccatgggccaggagtctcaaaagccctcctaagcagctgcccactcagttttggttggagataagtttcagtctgtctctggccccactacagctggtctcaactgtgttcctgattgcctatgaagaactgtctttgaaatttgacatctgcatcccgataggaatttttgtttgcaggttgattaagcccaaccagtggagagaggaaggaccccggctgtttcaatttggacactcttggggctttgttattgctgcagtggagttatctgaatgttaattcaaactatggacttgaaaatgttatttatgaaacaaggtagaaaggaaccagtaaataggggagagagatatgaagaaagttatgaatgtgacaacgtatttttgaatttgtaaactatttgtgaatattcctgattcatggcaatgtgtttatttgcataagttcaataagaagctgttttctcttataatgggacacagttggaggaattggttattttctaagggctttgactgaaatggccttgc

SEQ ID NO: 474131 - DNA, 933 bp, Homo sapiens
tctgccagcagcggatataattatggtcagtgccctaaagagctactgggagcagtgccttaaagtagtactgggaatgggaagttttctgaatcagggtaacatggggcagaattggtctgttgaagaaaaacattatgtgcagttgcttaaagttttgttgaaacaaactggtgctcaggctgaatctaaaaatctgaaagaatctgttgtcccacccacagctccaattgaaaataaaaaacaggagagggaggataaaaattggcctataccgccccctccagttgcagaaacatctgtaccgcctccttcggtggcagaaacagagaccccaatacaaagaattttacgttctgctgccatggctggagagcccttaggacctcgtgcttttcctatttccattcctcataccttggctgcagaaatgctaacctttactctagcttttgagaatgcaaacgcagattatgaacgcgcactggcaccggtgaggtgtacaaagaacttgggaaattttctcagagcttgtcaggatgtaagaactgaacttcattgctcttcaatgctagctgaagtaatagctaatttagtagttgacaaatctaaaaggagccaaggagaagtaaagcgagctcttgtcaaatggaatctcaaaattgctccagagaaagtgcaaacaacttccccataccaatacttaggaagtattgttaatggagaggagtgtacggcttcagaaagtagttctctgtaaagacaggttacagactttaaatgattttcaacaattaggagatattaactggctacgaccgatgttaagtattgctgctacctatcaacttacacatctttaccaaaccctgcaaggagactgttctttaaattcgctgcagcaattaactaaagaggcagaagccgaattac

SEQ ID NO: 474132 - DNA, 589 bp, Homo sapiens
gagagtaggtcttctgaaaccaccccgttcctttttccactgtcataattagctctccatcctcaatggtcaatactgtggcccacacccactttccaaagaggaaaccagggctgagaggaggtgaagtggttgcccaaagtcatgaactgggaaaagtggagctggactttgaattcaaggttaaggaaaggggccccattgttggcaaacaccctccactgccctttctttcatcacaagctctgctgaagcccctcattggagtgtgtggattcaaatgctctctgacttctggccacagctcacgcttaagatgtccccagggtagaaaggaggaagattgtcctggtgtttttttctgcagaggagggacctggagcactgaagtctgtgattcacctgtttcaggtgactccttgggctgctggggctgcctcgtgcagcctaggagaatggagactccttcactcactaaaattctctgaccctcttcctgcccccgccatcagcaaatgaccctgtcacctattttaccaagaaaatagaaggtgtcaggataaaacactcttagcttcttgccagaaat

SEQ ID NO: 474133 - DNA, 497 bp, Homo sapiens
ggtatcgccaagacccaagtgatgttagtggggcctagctggaaaataaacatacacactaatctgctcctcacactacacttcaacagagggactattcgaaggagaaaggaagaagaagaagaagaagaagaagaagaagaagaagaagaagaagaagaagaagaagaagaagaagaagaagaagaagaagaagaagaagaagaagaagaagaagaagaagaagaagaagaggaagaagaggaagaggaggaggaggaggaggaggaggaggaggaggaggaggaggaggaggaggaggagaaaagaaagaaagaaagaagaagaagaagaggagaagaagaagaaaagaaagaaagaaagaaagaaagaaagaagaagaagaagaagaagaagaagaagaagaagaaaaagataattaaataggacttaaaatctactaaaatatatttaaatgtttagatacacagtaaaaatctcatttgccatagcaagaa

SEQ ID NO: 474134 - DNA, 1520 bp, Homo sapiens
gagagattggtcagaccaggagggctctggggcatgtcaggggctgctacaggctcctggcagatttcggcgacttactccagacttgtggaacattcaggattcttagcatggccacaggagagtcaggctgtccacaagcactctctctttcttcacccactcattcctgtcactctaccatttccactgccttcccaaatgcccatcgagaaattacaaggaaaagtgtacgtgacaggaatggaggaatttctgtggaaacggtgtgtgagaaaatgtaggaagaaagaaacttcaggaaatgattcctattttgaacttcggattgcccctggcgatgtggagactgtattggaagaaggcaagaatggaggagagcccctaggtggaggtttggcaatgctctctccagaatatagcagaggcctcttccaagaaaagcacaacttctgcccccaagccctgggctctcctgagaggacaggaccagcctctgaagttgaaggtcctggttctgcccccaagccctgggctctcctgagaggacaggaccagcctctgaagttgaaggtcctggtttaccagatagggaaggggccctttccaagaccctttccagaaggtgtggctgagatgggaaccgtggactctgtgcagatagtaaatgaaatttgcaggaaattcagaaccttccacctgtacagtggatactgtgagactctgcccagatgccctcttcaagccaatgcatctctccatgctcccactcccatagatgggaacagaggtgctggaactcagatctactcccctttctgggaactggagctgcctgcccaggcaatgcccccttcccagggatggctgagccaatgactggctaatgttggattgcagaggcctagcgccctcccctcaattcctaattccttgtaggaataactgaggcctcctctgtgaccacgtgggcagcttctccctctgcctggtcctgtcttgttctctcctttccaattgtgtctcctggaagccctccccacaagtctgctgcatacaactctccttctcagagagcctgagccctggattcccaggaatccagcctaaaatagtctggcatttggtttcaattttctctttcactaagactcagtcacaggtgctaataaataataaaatgtcaccaccttgaattctatcactctctcttttcttgccccatctctgacaagtaggtggtccctcaagaacctgaaaagcagacattaggaggaaaggaggagtgggggcaagaggcccacacctcacctggccggctcccatccatgcgcccttgactgaggtaacacctaccctgggaatccttcccctgcctctcgtgagccaggccgggtgctcttgggacagctcccactgctcctgtgtgctcccccagcttggcacatgactccctgaattatagtcagttccgtacctgaatctccctctagaatgccagtgccacgaggacagaggac

SEQ ID NO: 474135 - DNA, 1088 bp, Homo sapiens
cccgtcttctgcattgctcacgctgggagctccactactgccagggttgagtcaggagccattggcagcaaccccacacccccaggaaaggagtggccaagcatcttcacatgccccaaggacaaattccacaatccacaatttctgcagctgcaggctgctgtgaggctgaagtgcctaccctaactgctatgacaaccacagctggcacccacccccatgtgccacctgcaggcctggggactggcccacttagccagtcacaccttaacatggaccaagaacacttgggtcccagagggttgtcccaccattgctactgccataacccacacttcctgctgcccaggggccccaagaacctacctaaccacccaaactactgctgccactcctggcacccaagcaaggcacctggaggtccaagaatcaacccatctggacttaccaacactagcactgctgctgccaacaatggggctaaaggactggccatggcattccagtccccagcaaaacttcatcacaacctccactaagaaccacaccctaagccaaagaggaaatctctggctaaagctttctcaattcagtttattttttcaaaaaaccaacttttcatttcattgattttaaaaattgttctctgtatctcaatttcctttatttctgctcaatctttattattcattttcttctactaattttgggtttggttagctcttgctcttctagttctttaagatgcattgttaggttgtttatttgaagtattctacttttttgatctaggttcatatcactataaacttccctctcagcagtgctttctctgtatcctgtaggatttggtatgttgtgtttccactatcatttgttttacaaaatttttaaattccctttttaatttctttattgacccactggtcattgaggagcatattgttaatttttatgtgttagtatagtttccaaaattcctcccatttttgatttctagttttattccattgtggtcagagaagatgcttgatattatttcaatttttttgaatgttttaaaacttattttgtggcctaacatatgg

SEQ ID NO: 474136 - DNA, 615 bp, Homo sapiens
tccttcatgtttaaaggatgttttcatcagtcagcacgtgatgaatcctggcaagactgggtccttttcttcatggcagcaacatttcttgggcccagagtgtgtccagaagcattgtccaggtgctagggccaagaataggagacttacaactctgcctagtgccctagcctactgtggcttagctggtaaccaagatacaagacaaagttttatttactcttccctctcctcatatggaaggaaaaagtctttcggtgcccttttgatttcaagtgagagatgtgtggcttttccttccactggagcacttggaggacacagcaggtttattatttggtttaatttcaatatttttgtgtctcagggaataagaaggacaggtggagagatagggaaaggacgagttggaggagcagtcagaacacacacaacatttatcggttaagtttgccatcttatatgggcaagatttatgacaccccccaaaatttacaatcataacatcaaagaccactgatcacagattagtgtaacagatataataataaggaaaaagtttgaaatactgtgtgaattgccaaaatgtgacataaaaacatgaagcgagcacac

SEQ ID NO: 474137 - DNA, 576 bp, Homo sapiens
gaccaccccagccaaactctgcattgttccaccagtcgatggcctgccgaaatctgtcagtgcctgtgggtgtgctcttacgcgggtgtgttcctctcaatttccagccgcttgtgtcctcaaccattggtgtgttcctcttgatgtccagctgcttgtgtgtgacaaagaaaccagtggtctcaacaatcccagtggcttttgggtgctctcagaacaatgtagagaagcttgtatgggctcaggggtcattcaaacctctgctcagtagcctggattatcttggtggaaagatgagtgttctcacgggtgaacaggggagaagaatgaatgcatggattcctgttttggctcatacttcagattctgaccgtgtggaagaaaggactaacagaaggtcaagtagagctcttacctggaactcgctgttccatgaagacgtcagcagttgccagtgctccccgggtgcaggcctaccctcaatacggcccagacaggttctcttttagcctgaacacgttgtattttaaggcaaatcccagacatcatatgatttcatccataagtacttaatgc

SEQ ID NO: 474138 - DNA, 781 bp, Homo sapiens
tgaggtagcttctcatgcagatatggctgcagccacctgtctccactcctgcctccaccatgtccatcagggtgacccagaagttctacaaggtgttcacctctggcccccgggccttcagcagcaactcctacacaagtgggcctggtgtccacatcagtttctcaagcttctcccgagtgggcagcagcagcttctgggatggcctgggcagaggctgtgatggggccagcagcaagggaggcatcacagctgtcacagtcaaccagagcctgctgagcccccttaacctgcaggtggaccccaacatccaggccatgtgcacccaggagaaggagcagatcaagaccctcaacaacaagtttgcctccttcattgacaaggtatggttgctggagcagcagaacaagatgctggagacgaagtggagccttctgcagcagcagaagatgactctgagtaacatgcacagcatgttacagagctacatcaacaaccttcagcggcagctggagactctgggtcaggagaacctgaagctgggggcagagcttggcagcatgcaggggctagtggagggcttcaagaacaaatataaggataagatcaataagcgtacagagatggagaatgaatttgtcctcatcaagaaggttgtagatgacgcttacatgaacaaggcagagctggagtctcacctggaagggctgactgatgagatcaacttcctcaggcagctgtatgaagaggagatccgggagctgtcctagatcttggacac

SEQ ID NO: 474139 - DNA, 535 bp, Homo sapiens
gcacaccgtggaatactactcagacataaaaggagcaaaatcatgtcttttgcagcaatttggatggagttagtgaccaatattctaagtgaagataaaggtttaaatgaaaatatgttcaaagttttactgctggcaatggcagaggcacagagaagagaaaacagacctaaagagaatgggcttactatgagacaagcttggaaagggaggagaggaaatgggaaagatcaggaagtgtttgcacagcaggcagatcaggatgggcccctcgccaacttctctcatccattccaaacacatcttcctacacacatgcactctagtttcccctacagagaaccatattgcatggctaaaccaataacaggtcagcttctggtagcatccaattctagtaaagaacatgggatttttgagtcaagaaattcaacttcccctggctagctatgtgaccttagtcactttttttagtctttttgtgcttcaattctctcattaataaattgaaattatttagaaaaatatgtttttt

SEQ ID NO: 474140 - DNA, 548 bp, Homo sapiens
ggacgcactacctactgcatatggttgtgtttataatcaataggaaaagacaaagaagggtattacggaatggtaatgagttcagttcaaccagaagatctaactatgctaaatatacatgtgcccaacacaggagcaccccgattcataaagcacgttcttagtgaccttcaaagagacttagactcccacacaataatagtggaagacttcaacaccaccacactgacaatattagacagatcattgaggaagaaaattaacaaagatattcagaacctgaactcaacattggatcaaatgtacctgatagacatctacagaactctctacccgaaaacaacacaatatacattcttctcagcaccatatgacacacacacccagaaacaatactttgtgtcctttaatccgatcaaattgacatttaacattaaccatcacagcagtgttaaagcagaaatgtatataactaaacccccacatcaaaaaattagaaagatctcaaattaacaatctaacttcacaactaaaagaactagagaaac

SEQ ID NO: 474141 - DNA, 1552 bp, Homo sapiens
aggagcccaggtctcctgagtggtatgaaaatgctggcctcaagtgatcctcctgctgtggcctgccaaaacactgagtctttcgctggccgtctaactgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcgctggccgtctaattgctgggtctagatctttcactggccgtctaattgctgggtctctggagttgattgaggagcggactataaaactggggcctctcatgctgtcagaagtattaatggcaaattgtctttctagttttcagtgtgagagttgataattgaccaagaaaatcgtgattgctacggaaactcgtagtctatggaaagacacaggtatgcaaaccacaaagtacaaaacagggtaacagttttctaatagagagccgcacataaattgttctcctctgttggtgcctttgagacataaattatttaaaataaattatggagatttattttaataagactaaatgagaacatcattgcaacaaagcaggagcttcttccataactgtctgcatcagcatcattagagttctggagaagccatccttgggtttaggggaacacttgcaggtttttttatataagtaaattatgtgccatgtggatttggtgtgtgaattatttcatcatccagctcatctttattattccgtttctgtcctgcattaccttttaaattacactgtcttttactattgttttagtggtaaccttagaaattaaaatatgcatttctattaatactgtctactttaaatttgtacattgtcacttcctaatcataataagattactacatttttactctttgtattgactttatgcattttgtgtttctgttttcaaatattttacccatatgtatgctcaaaatctcacatatcataatttttaatatcattactctattgttttaaacaggtactgaatatatcaattcttctgtggcttcgtcattttctcttacttgtgcttttatttctggttttaatgtttattgtgaaaatactgttgtaacatttttagttgattattaaacttatttacataaaaaaaaatatttcaagaaacaattgtttaagtaaataatcttgaatataatttaaagctgaattctgatttccaggatgtctttgccaatgtaatatcaggaaagaaaatatttatatctagaaaaataaaatggaatatgcatgaagctgtcaataatgtcttcat

SEQ ID NO: 474142 - DNA, 847 bp, Homo sapiens
ttaattcgtctcaaagtgtggcgttttctctaactcgctcagctgctctcctccagccagagcaaagggccagtgtgacagccttttgtatctgcactcgtggctcccaagctcttgcccagaatccagctaaaatgaggttgcacgaacgaattgaaggatggtaaatgaggaggattttattgctgacgaaagtcactctcagagggaaggggaaagggatggggcaggctttggggaacatgggctttggctcccagtggcagcagttgagagagccagttctcatggtgtgtgcaggtatgtggtggccctgctgctgggaagcttggggtcactgccagtaacacctgttttggtccctggcagcagcagcagcagctgctatggctatgggtggggagagcctgtgcttaaggtttgtgcaagtctgctactggcggggaggggtcaccgacagcggcacatgttttggcccccactggtggctgcaactgtggccgcagccaggatgaaagtcctggatccctactggccttctttgccaccacctcattggaaggattgggatgtagtatcttgtagccactttgtggtcacttttgatttatcttcctcctcataatgggaagcattttcatatttcttttcatggttggtaatttttcttggattctaacaatagtcaaatatatattttagatgctggatgttttcatatttttataaatgttaatgggtttttgttctaagtcattcaaatttattttgaaaaagtttgatctttcagggtctttttacgtgatcttttttgttatgtggtcttttttgttatgtggcattagag

SEQ ID NO: 474143 - DNA, 1054 bp, Homo sapiens
atcctttctgctgtcagtaacctcgtctatgccatggatacaggcaagacctccattcaggctcctctcctcctcctagcctggttatgtctcattatctttacagaagtgcctgcaaactctggcccgttcaaacattcacttctcattcatgtgatggtcgtttggagggaaggacccgagttcatcatactcatgaagcttgatatttctctgttctgctccctagcttcagtggggctccccagatcatgtgaaaattcatctaaagctttgatcagttcctgttcctgttacccactgtgggttgctgttctaaatgttcaccactcttctgaaattcctgtcactaccactttactctcagcagatgatcttgcctgcaactgtgtggagagtattgaggttctcagacagaaactctttagtttacctcatcaccctggtaaggtctattggtttcagaaaaacatctttgaaatacttttagaccacggaagcaaacaaaaagatgaccaaagtcaaggagctgctaaatctcaaattgcaataatactgttatcagtaacggtttatgacttcaaaaactgaaaatcatgtttgattaacaaaggcaactcctcttcatagttaaatttcaaaaggttgtcaggcaactgttgggcttggtaattgaggctggaaggatggtttgttgatggactcttgcagaaataagtagttctatactttgttggtgacaaaatgcaggagggttttagaaaatcttgtttacacttctaagataaaagcataagagaactatatcctctatatcactttttgggccctttatctgggagtttttctaagctaatagagtcagctcaaattttgcacaagcaaaaaaatttacctgctaattctggtctttgagttctttgctgataggcaagcacttccctgcatggatttgtttttcagatgacagctttttgccatctgattcctagttcttttaagattgtgcatcccaaatggtttgcaacggcagacttccatttaactgcctggg

SEQ ID NO: 474144 - DNA, 631 bp, Homo sapiens
aactctaagggggtgtgcgtgagagggtcgtgatcgattgagcaagcggggggcaaagagccagaaaatggtaagaagatgggggccagtaaaaattcaagggatggagagccaacaaatatttttaagaatgcttcagcttaattgttactattatttgcattgctatgaaataatcattcttctcccttatacaaattttcaaaatattttagcaacttttcgagactacacctgttttgtggaaactaaagagtgctatgtttgtgtgtgggttagtgcagtatgtcacagaggaatcatgagcccagatggcaaaggaggctatgagaaacaggcctgcgggaatttgcagaaattttggcgagcgctgagtgaacactcgaggtaccagcactcgaggacccacttgtgtccatggatctctcagagcggctccggatggtgggaggaaaccagaggcaagtcctgtgttttactataaagtcaggtgcaggaatactaaccaattcctttatatttcccaatattacccagttcattcgttggtacacagtaggttccagaaaaatgttaaggggaaaaattgattgctatgagaatttcacatgaattatgtttcttccaaggc

SEQ ID NO: 474145 - DNA, 948 bp, Homo sapiens
actcctcccacatctccttgcttcctcctggagacaccttctcagatgtctccctgagagtacctaccctgcccactttgggactgtcagctgacagctaggactgccacctggctgggaatggagaacactcaccagtgctcctccagggcacctcttcagggtagagtctgtagagcacactctgggcttaacccccaggcaagcttgccccccagaggggaccaccctctgctgaagtggatgaccctcagggctgggttgggggaccatccactgctctgctatcactctagaatctctctctggcaggatcccttcctgccctgtgggagagggacccagtgggcaatcctccacccaggaaatgtgggagaaaaagggcattgctgccacctgtggccccagccctgccactgttaccccacacggggaccctaccaccttcaatgtcctagggttttctcctaccatctgtgttggttcctgaaatccagacacttcttttttgtacctgtggcatttctggttttgggcatgaaaacagcagcccatgctggtccagaacctgcctccgtttctgaggctccactcttatgcataagcatgaccctgccctccaggcccttctcagagaacacagcctccaacagccagttggagctgcccaacctccacccagggccccccagaacaagagacatttatgaaaacaagctggaatttccccagggcttctgacatctttgaatgaaaccagtctccagaaagctgatcttgtccccagctcccactccctatcctccattggcctccaaagaattgctctgggaagctgctgcccaccccagcagtgaatgatacctctgaaatcttacacctgagaaatttcttttagagtcaagtaccaaaatctttaccctcctaaaaaacagatatatattgtgt

SEQ ID NO: 474146 - DNA, 584 bp, Homo sapiens
ttttaaacaaccagatttcatgagaactcactttcatgagaactgcaacaaagaccctggggatctggtaatggcagtggcagtggcagaacaatcttcttggttttgggctatgcacactggtgttggcaatagcttctgtgggcttgatgggcctatctccaggcccgctgatgttgcgtgcattgattggcatctgagggtgtccgcagtaatcaggcggaggcgactagactacagggaggttgacacaaacttgccctaccttaactgtgtagctgtatctatgagctggttacttgctagtggagtcgaaaaggctaaacatatcgctgcgtggacgtgcatttctgcgaaagggcgtgtaaaccactttagtgtacaccactttctgccgcgttcgcgacgggaggttcctgaacacattactattaaaattaaagatataccacattttaaaactttgcaacaagagtggaagagtgggcaaaaatactgataaatatgtactaataaatatgaggatttcaacgtgactcttaggccagtgaaataaagaaaataaataacacgatacctaagat

SEQ ID NO: 474147 - DNA, 904 bp, Homo sapiens
aactgcatctcctctgctgcaaggacaaagcttctgtgggccagaagcccccaaccagatgatccaacaacaggactgagggtgcccggggcaagtgccagctcatgtcgtcaccctcactgagccctggggatcctgcagaccacacggcccaacttatgtggacagtcttgcctcaaggttttagggatagctcacatctgtttggtcaggcactggctcaagatctaggccacttctcaagttcaggcactctggtccttcagtatgtggatgatttacatttggctaccagttcagaagcctcatgccagcaggctacactagatctctttaactttctagctaatcaaggggccctcaacaaggaacaaatacagcctatactgggttatccttaccctaagacattaaaacagttgcaggggttccttggaatcactggcttttgccgactatggatccctggatacagcgagaaggccaggccactctatactctaatcaaggagacccagatggcagatacttatctagtagaatgggaaccagaggcagaaacagtcttcaaaaccttaaagcaggccctagtacaagctccagccttaagccttcccacaagacagaacttatctttatatgtcacagagagagaaagtcgatttgtggagaatgggacacaaagggcaggttatgccatagttagtgatgtaacagtactggaaaatagtgttgcccccacttttcctggacctcttcagccatggccaccccttttcaattcggcaaaagacccccgacacttcgcgcgtgcccccctgacctcaatcagggggcccccgctccagaccaaggctattaattatttgggttgacgtgccttgcccccccaaacttgcgcggt

SEQ ID NO: 474148 - DNA, 740 bp, Homo sapiens
ggtgaacaaatttattatttgttcttgataactcataagaaatatagaggaaatagaaacatgaaaccattaaaatccaaacttggaaaactctgcaagtcaaatagcctgtgttcttcaacaaattacattcatgcatcaaagaatgatattccagtcatgtacagcattgacctaacagaacagaaaatcattttggaaatacccagccgcctacagccaaacaccaagggaacccaactgccccatggtttcagtgagaaagagcagagagctgacattccaccccatccattccccagcaaaataggtggcggcactcagacaagtggtattggtaaaaagaacaaggagctaaccttccacccccacctgggaggagcaggttctattccagaccatggcaataaagcagggagactaattggtgcagctgtggcagaacacagtctttcttctgggaaagccgccttgcatgaaatagaacatgctaaaggacttgcaggtgttatgaattgagtaaattgagcacttattgtgtgtcagatattgctctaagtgggaaggatatataagggagtaaaacagatatagctgcatatgtaaagcttaccttcttatagaaagaaaaatatgacacaggttaaatatataaagtagattaaatatatgaaatagattatatagcagaagatgataaaagctttggagaaaaataaagcagacaagtttcatagtgc

SEQ ID NO: 474149 - DNA, 1645 bp, Homo sapiens
ctttctctctctctctctctctctctctctctctctctctctctctctctctctctctctctctctctctctctctctctctctttctctctttctctctttctttctttttttgagacggagttttgctctttcgtccaggctggagtgaaggaaaatgaacagaggcaggaggtctcctctggcgatatccaccgagccgccacatctggagcagcatggtcaactctagttggggagttggtgatctcatccataatagacttccggatgaatatcttcgaggcaaggatagacagcgagccctgattgcagcagttcggcatcacctgaagaaagttaattaccaaaagtttgacactttgctggcagccttcaggcactatgacaaggccagtaatgggggagagctttttggtaatgcatgggcttacagatcccagcagtttggtgtagatcaggggtcagcaaactatagcctgtgggccaaatccagcccactgtttgtttgtgtcaataaagacgagctgcaggaagcttgtgaccaggccaacttgagtttagatgacaagctcctggaccagctatttgactactgtgatgtggataatgatggcttcattaactatctggaattcgcaaattttcttaactggaaagacaaaatgcttcttaaagagtatgaagagagggtcattattaaaggtagaaaaccagattgtgtaaaccctactgaggctaatgttgaagaacctgaacaaactctcctcataaagccagaagatattgtcttaaaagaagcaggaagcacagaaaagactctccggacacttctgagaccaagtgataaagtttccaactactataagacaacttcttctgagatcaatgcaattgtaggagccattccttctacttgttaccccatttgtggtgttccaaccattcgatctgacattcctgctccccgaattcgtcgcatcagtgacagaactaattatggtgaagaaggtagtgcatattcactactatatcctaccatttttgcccggaaaggagtgtttgaaagagacttcttcaagaccagatcaaaagaagagattgcagagatattgtgtaacattggtgtcaaactgtctgatgaagaatttgaaaatgtatggaatcttgcatcaaaaaagcatcacagaggagaagtttgtgttgagaacatcagaaatgttctagatgagctacggcatgcagaccggatcaagtgtaaaacactcatgtgatatttttggacttcattcattcaagcaaaagaattattaactctgtgtttatctaaaatgttgaatccattctggttttagatattatgttagagttcacagtggtaagactcatatgcctgtatgtgttgctaataaattagattttggattttaaaatttattgttttccataaagcacctaagagcttgacaagtgattgaagagttaacattcagcctcagcaaagacagttcagaatgatattagaagtttttttcagccaaggtgtttggaagacctggggagaggtgtgtttcctttaagcagctgcgtcttgagctgcttctcactgggaagaccataggtccatcctggctcttaaactcat

SEQ ID NO: 474150 - DNA, 535 bp, Homo sapiens
gccattctaactggtgtgagatggtatacaatcatatcattggcaaacagcagcagtttgacttcctctttactggtaatgatgatgttgatgatgataatgataatgatgatgatgattattattattattattatttaagacaggacctcactctgtccctcaggccagagtacaggggtgaccaacatcaaaaaccaaaggtagataaatccacaaagatgaggaaaaaccagcgcaaaaaggctgaaaattccaaaaaccagaatgcctcttctcttccaaaggataacatctcctcaccagcaagggaacaaaactggatggagagtgactttgacaaattgacagcactaggcttcagaggtggaataaccagtttagagaagaacataaatgacctgatggagctgcagaacacagcatgagaacttcgtgaagcatacacaaatatcaatagctgaatccatcaagcagaagaaaggatatcagagattgaagatcaacttaatgaaataaagcaagaagacaatat

SEQ ID NO: 474151 - DNA, 670 bp, Homo sapiens
tagtttctgtaggaatggcatatgctgcagctgtacctgctactcagcagactgaacccttgtgccccaactgccacagagtgcatgcacacctgtggacctactggccaaggcttctgctacaaccctgtgtgtgcccatgagcccggcaaacccaacccctgcatgtccctggaactgatgtctccggacacagatccagacctggagccactgtgcactttgcccagctggcactctcacagctacccatgggaagaagtctttccctacctaggccagtccttgaagtttggaagggcctctggtaaccgctattctactctccacctccaggtgagtgagcacggcccctggaccagcatcatcagcatcatctgggagcttgttagaaatgtagaatatgaggccttgctccagaacttttaaatcagaatctgtatgctaaccatatctgcaagtgtttctatgtacatttgagctttggaagcactgcagtagaaaatcagacatctaatgaagcctggttatctagttccttataggactacctcagatttactgctccataaataaaatacctccattgaccctagtctccttgatattttaaaaacatcataaagccctgtggtccatcatataagtaactccttttaatttaacctgg

SEQ ID NO: 474152 - DNA, 1016 bp, Homo sapiens
gtaggggaggctctggctgcgcagaagcccgcggcgggagggaggctcgggcacggcgggctgcaggacccgagccctgccccgcggggaggcagctaagtcccggcgagaatttgagcgcagcgccggcgctccggcactgctggggaagccggcgcaccctccacagggccggccagccggccgctccgagtgcgggccgccaagcccacgcccacccggaactcgcgctggcccgcgagcacccgcgcgcagcccgggttccctcccgcgcctctccgtctacacctccccgcaagtagagggagccggctctggcttccgccagcccagtgaggggctcccacagtgcagcggcgggctgaaggcctcctcaagcgtgggcggagtgggcaccgaggccgaggaggcactgagagcaagggctgccagcacgctgtcatctctcactttcatgggtctccatattttaaaaagctaaagaaaggacttcaattatgtctccaggagaaatcaagagaagagtccaagttttaagtctggatcaatacaatattggaaaaagtctccctcatgtgactagactgtggcagaacaatcagggcttcaagacaggtaagacagaagccagtctgcttgggagtctccttgcaaagttgcaaaccaactttgcaatccagaagggttggatgcacaaagcaagcccttccctctcgtgggtaaaactgggagcttgggagtctccttctcattatatggcactgcactgggggcatggtctctggcagtttcagtgtcccaatctctctactgacttcagtgagtctggtttcatattcttctgggatgcaggagcctctcaattagtttctgatgtattacaaaggaaatatgcctatgagttgtgtctgaatcagtatgtgaggggaagaagtgtccagggctttccatttcaccatcttgctgacatcatttctccccaaaactttctttgcttttaggatatgtagtgtttc

SEQ ID NO: 474153 - DNA, 805 bp, Homo sapiens
gtaacattaggacttccagtactatgttgaatcacggtgatgacaatgggcatccttttcattttccagatcttagaaaaggtagatccactgacagcttgcactgtgcacctggaaaagccgtaggcactcaaagccagcctgtgaaaaaagccatggggcctgtaccttgcagagtcacaggagtggacttgcccaaggccttgggagcctaccctttgaatcagcatgccttggttgttgaagctataaaagttgtggctttcaatgtgtggacaaattcctttcaggagggattagtagaactggcatcctggggtgagctggggggaaaagcttgggaagtgccaatctgcatttcagctgccagcaggctgtttgcacctttgactctccaatgtgatgaagcccctagatgtacttgcatgcccacataaaattgctacagagacttacgtatgcctaatcccctctgctcccattggtgaattaacagccaaacttgcttttgattactttttatctcaatgggattatgtttccctctttctcctcacaccaacccctataacttggacagcaagtgtacttcattccaaacatggatactgtcttaattcatcaaccatgtggtcaattaattagcctaaattcttgagcacctgttaagtcttgctgagttggcaggtccttctccttccttactttcattttatgctttgtctttttgacgagtcatctggttccagtgatgaatcatgtggttttgctgcttgttaagagtgtttttaagtggaaatgtgaa

SEQ ID NO: 474154 - DNA, 656 bp, Homo sapiens
tggctttgactaaaatgctgatagcgatatggacaatgaagtccaggctaagttggtctcagatggagatgaggaacttgttaggaactggaataagggttatttttactatgctttaccaaagagactggcagcattttgcccctgccctgtagaactgtggaatgttgaacttcaaagagatgatttaagagtccccagtggggcactgcctagtggagctttgagaagagggccactatctttcagaccccagaatggtagatacgataacagcttgcactgtgcacctggaaaagccacagacactcaatgccaactcatgaaagcaactgggagggaggctgtactctgcaaagccacaggggtgaagctgcccaagcccgtggaagcccacctcttacatcagtgtgacctggaaattgccccagcaactctaaccttcagcagctactcaccttgatcagtcagcagacatcaacatggaagcaaaaccctccttagtaataaagtatttttaattaagacatacattgttttttagacatgatgctattttacacttaatagactatagtgtaatataaatataacttttatgtgcaccaggaaacccaaaaacttgtgtgacttgttttattgcaaaactcatttta

SEQ ID NO: 474155 - DNA, 657 bp, Homo sapiens
cggtaccatgtttcctgtacaacctgcagaaccaaacgcataatgtcatgtatctaccaatacagtttaatacaaaatgattttgcgtccggaattggttctttccggtgggttcttggactggctgacttcaagaatgaagtcacagaccctcatattcagatgtgtccagtgtttcttccttctggtgcgttcgtggtctcgctgactttaagagtgaagctgcagaccttccggtcagtgttacagctcatgaaggcagcaccgcagttgttcgttcctccaggtgggttcatggcctcgctggcttcaggagtgaagctgcagaccttcccggtgagtgttacagctcataaacgtggtgcagacccaaagagtgagcagcaacaagattcattgctaagagtgaaaaaacaaagcttctacagtgcagaaggggacccgacagatatcctcagagcaacaaatcactaggccttttaaataaaaaacagtctaagattctgtgtgttttatgtatgaatatcaaatatttatattacttgcatctgtcttatgccttttttggagaagtacatttcctttttctttttctatttccattgtcttttgtatttttagtataattagaaaaagcaaatgtcttctttctaccct

SEQ ID NO: 474156 - DNA, 2210 bp, Homo sapiens
tcgaacggaacggaatgtaatggtatggaatggaatgcactcgaatggaatggagttgaaatgaatggaatcgaatggaacggaattgaatggaatcgaaaagaagagaatggaatggagcgtaatggaaagaatggaatggattgtaatggaaagatatcaaatggaatggaatggaataaaatggactcgaatagaatggattggaatggaatggactcgaaaggaatggactcgaatggattggactggaatggaatggactcaaaaggaatggactcgaatggaatggagtggaacaaaatggaatggaacggattggaatcgaaaagaacagaatgtaatggaatggaatggaatgcactcgaatggaatggagtcgaaagcaatggaattgaatggaatggaatcgaatggaatggaattgaatggaatcgaaaagaagagaatggaatacaaattgaatggaaacgaatgaaatggaatggaatggaaaggaagaatggaatggaatcggatggaacacaatggaatggaatggattcgaattcaatagaattgaatggattggcaatgaatggagtggaatggaatggaatggactctaatcgattgtatttgaatggaagagaatcgaatggcatggcatcgaatggaatggaatggaatggactcaaattgcaatggaatggaacggaatggaatggacccgaatggaatggaacagaatggaatggagaggaatggaatggaatggaatggaaaggaattgaccagaatggaatggaacagaatggaatggaatggaaaggaatggaatgcaatggaatggaatggaacagaatggaatggaatggaaaggaatggaatggaatggaatggaatggaatggaatggaatggattgaaatggaatggaatagaatggaatggaatgtattggaatggaatggaatggagtcgaatggaacggaatgcactcgaatggaaggcaatgcaatggaatgcactcaacaggaatagaatggaatggaatggaatggaagggactcgaatgaaatggaatggaatggactcgaatggaatggaatggactcaaatggaatggaatggaatggaatggaatgaactgaagtggattggaatagaatggacacgattggaattgaatggaaaggaatggaatcgaatggaatggaatgcaatggaatggaatggacacgaatggaatggaatggaatggactaaagaaaggaagagaatggaatggattcagaatggaatggaatggaatggatttagaatggaatgtaatggaatggagtggagtggagtggattggagtggaatggagtggaatggaatcgagtggagtggagtggaatggaatggaatgaaatataatggagtgaaatggagtggagtcgaatggaatggaatggagtggagtggaaaggatttgagtggagtggaatggaatggagcagaaagtaatggaatggagtggaatgtaatggaatgtaatggaatggaaacaaatggaatcaaatggaatctaattgaattcgaaacaactcgaatcaaattgaatcgaatgcaatggaatggagtcgaatggaatcgaatggaatgcaatggaaaggatttagaaagaatggaatggaatggaatggaatggaatggatttagaaaaatggaatggaatggaatggaatggaatggatttagaaaaacggaatggaatggaatggaatggagtggagtggagtggaatgtaatggaatggaatcgaatggaatcaaatcgaattgaatggaatcgagtcgaatggaatcgaatggaatcgaatgaaaaaatggattcgaatggaatcgaatcaaatggaatcaaatggcatcaatggaatcgaatggaatgcggtgaagaggaatggagtgcagtggaatggagtggaatggaatggggtggaatggaattcaatggagtggagtggagtggaatggaatcaaaccgaacggaatgggaaggaatggaattgactggagtggagtggagtggagtcgaatggaatgcaatggaatggaatggaatgcattggaatagaatggaatggaatggaatggaatggaatggaatggaatggaatggaatggaatggggaaatgaaatatgaactgagattgtgcacctcagtgcagcctgggtgataga

SEQ ID NO: 474157 - DNA, 680 bp, Homo sapiens
cttattcatgcaacgaactaccatctggagattaggatggtggagtggattagtcgctttagacctactcatcgctgctgggagggtccagaagatatacccttgaccaatgccttgcaaaataggtttgcgagagcagcacctgcatctttgaagatccctgtaattgctcttttctttatgtcagatctaacagtgggaaccacagtccctcaactacaaaatttaaatacaatgagaataattggatcccaaggtggcagggggcaggtggcagcactaaactgtcaaaggcaaggagacttacagccttttaccagggtaactgtgcattgggaaaagggaaatgatcagacattttggagactactggacactggctctgagctgacattgattccagggtacccaaaatgtcactgtggtctgccagtaaaagtcagcctgcagacagcctattgtgggaccttgtgattgtgtgggttaatacttgataaactcccctttatatatacctattccattagttctgtcctctagagaacactgactaatacacctcactttacagatgaccaaactgaggcaatgaagaggtataaactcaaggccaaggagttagtaagttttggagccagcgcacaatcctatagagcccctatttcttcctagagggtact

SEQ ID NO: 474158 - DNA, 624 bp, Homo sapiens
ttaagaaactgtggttatatgatttttttttaatagcatggactcgtggctacgactatgcttttgcccttcattcacctgaaaggggaaattgaggtcctggtctgctgggccgctggccctgatctgagcctagcagtggaattggagaaaacaccacagttcctatttgaaattatacagttggatgatgtttctcttggcttcaactataaaagctggtgcccagagccaatttttggcaaaactgagaagtatgaaggttttttccttcgaacattcccagcatccttctttagcactttttatcttgatcctcctccaacttccccaagacttgtttcttcctttacctcatccacatgtgaacagcaaaggctcagaaacatattgtctctatctacactgaagagccttcagatggaactcattttggaaagcagaaagaatccagcccacaaacctgatctaggaccaaagccacagtcctcagtgacacagattggtcctcatcccagccggactgactcaattatgctgtcacagggagagaaaagcctgtgagccaatacaaaaagtttattttcatgatgattctggctttagtgcccttttaacaggatg

SEQ ID NO: 474159 - DNA, 645 bp, Homo sapiens
ttttttttttttttttttttttttttttttttttttttttttaatagcatggactcgtggctacgactatgcttttgcccttcattcacctgaaaggggaaattgaggtcctggtctgctgggccgctggccctgatctgagcctagcagtggaattggagaaaacaccacagttcctatttgaaattatacagttggatgatgtttctcttggcttcaactataaaagctggtgcccagagccaatttttggcaaaactgagaagtatgaaggttttttccttcgaacattcccagcatccttctttagcactttttatcttgatcctcctccaacttccccaagacttgtttcttcctttacctcatccacatgtgaacagcaaaggctcagaaacatattgtctctatctatggaactcattttggaaagcagaaagaatccagcccacaaacctgatctaggaccaaagccacagtcctcagtgacacagattggtcctcatcccagccggactgactcaattatgctgtcacagggagagaaaagcctgtgagccaatacaaaaagtttattttcatgatgattctggctttagtgcccttttaacaggatgtaatgcataaaagaaggaggtcaacctt

SEQ ID NO: 474160 - DNA, 592 bp, Homo sapiens
ttatcatagtatctgggacaaagacagagaaaatatgactcccagaaggactggcttcatgggcatgtgacctgggctgagcaatgcccccacttactgtcgctggcttgaaattcttagggggcctgcattttcattttgtactgagccctgaaaattatgatgatggtggtgaccacaacgacaaaaatgattactattttaaaaaaggagtcaggcactatgcagacttgagattgggagatactaatattgttctttccatttctcttgccctcaggtctccagacctaccagtcatgccccatgcaggattctgtgaactgtctccagatcacttccatttaaatccttcaatggctaccaatgccctgtgtgattttgaacttgaccctctgcaattccccgtcctcatctcagaagtaggtcaagagcaggcttggagccattccattggagcagcttctctgagaaacaccaaatgtaacctggcatcaaattgttagtagagaaatatctcctctcagagattactgcatgtttttggaaagcttaagacacttggggatggaaagatcatagcatactaatc

SEQ ID NO: 474161 - DNA, 768 bp, Homo sapiens
ggacagcagtcaccggatcccagaccgccctgttcctccgagcctttgagaaggatcgctttccaggcatcgctgccagggaagacctggccagatagacgggcctcccagagtccaggattcagatctgatttcagaatcgaagggccaggaacccgggacaggctggcagggcgcctgcacaggcaggcggccggtgcaacgcggcttccggcgggtgtcaccctgctccctcgtggatcgccttcgcccataccggtgcatggggaacggggcttcccgaaccccacgtgtcctgtgctcctggagctatcccacagggggctttgctcctccagaagaggcgctctcccagcctcaggctcctcgggggcctccacacccgggcaaaatccgggaggaccgggacacgcagcacgaccgccttctgggtccttgcatggtgggacagcctgggcccactcaagtggggccacagggccaaggtgtgcttgcgccacccacatcccaggggagtccgtggtggggctggggacggggtccccaggtagccggggtggcgtgggaaccgcaagctggggcagctccacctcgccagccggtgccaccagaggcctgtgcgaggcaggggcagatgaaaggcatcccggcgccctcccaggagctccagaagccggggcgctcgtctgcactcccctccggcctgctgctggatgatctcctagtgagcccagagtttctgtagcaggcacaacctttcctagaaac

SEQ ID NO: 474162 - DNA, 713 bp, Homo sapiens
gttaatttccatgtaggagaccagagcgagaccccagagagatggtgcctccccagcgtgatggcctgaagatggattcccgtgagcggcaacatggggactctgcagtgtggccggtttggaaactggcaaggagagcgaaggcaccatttgggtcttccacccttccctgcatgtttccgggtgcccgcagagctctgggagcaaacagtgacgggcccttgtcttagatctgtctatgagggcatagtgacatatctctgcactgatcactcatgtgatgtaacggtttttaagctgcgcctaaaggggaattgtgacagatatctccactgctcacccaggggctttgtgacatatctctgctctgatcaacctagggaggaaacacttgactgcactctgcatagaggagactttacgacttatcactgcgttgattacaaggtgatgtaacacttgtctaggctctgtctacacgttaattttcatatatctctacactgatcacctaagtgatgtaacccttgtctaggttcagccttttggggatttctgacatacctatgcacagatcaccgaggtgatgtaaatcatttccaggctttttgtactggcgacattgtgatatatctctgcactgatcaccgaaatgatgcaagtctcccctaggctcctcagggtgggggcattgtgacatacttctgaagtga

SEQ ID NO: 474163 - DNA, 879 bp, Homo sapiens
ccaggacccacagcgtgacagcctgctgggcccttgcacggtgggacagcctgggcctgctcaagcggggtcacagggccaaggtgtgcctaagccacccgcgtcccaggggagtccgttgtggggctggggctggggtccccaggtcgccatggcggcatgggaaccccaagccggggcagctcaacctcgccagcctgctctcccagagacctccatgcggcaggtgcagatgaaaggcatcccggcgccctcccaggcgctccaggtttcggggcgctcatctgcactccccttcggcctgctgctggatgagctcctttcgacaccagagtttttgcagcaggcacaacctttcctagaaacggaggccccgggggagctggaggccttggaagagggcgcctcgctggaagcacccctcaacgaggaagaataccgggctctgctggaggagatttcagatgcggggtttggccaggatcgggtcgtggcagagcggtggcctctatttcggggggaacacctggctggctatggaggggcgtgtcttccccccgccccctccaccgggctgaccggcctaggattcctgccctatagttctaggcccggtgagaagctccacacaatggagaactgccattctttcctgggcatcctggggatggcagagccggcccaggcctgcgctcattgtgcaccccagctgatgtgcaagggagccagctggcctctctctgcccttgtccgtccgtgaaattctggctgaggctctcccaacaccttccaacgctctatagtcaaagcctggagaatagttacatctcctggatgttcagttcagaaatatgtcacaatgccccctccctgcagagc

SEQ ID NO: 474164 - DNA, 726 bp, Homo sapiens
gctggcctgcctgtgcccctgcagcctcccagctgccaccatggagcgcctcatggtggaacgcagacatctagctctctttgccggcctcctggctcgacctgcactcattgcacaccccgggcagaacctagacaagagtcccatcacctgggtgatcagtgcagagttatgtcaaaatgccgccttttggcagagcctagacaatggttacatcacctgggtgatcagtgcagggatccatatccttgacaaaagtgacaactcctgggtgaccagtgaggagatatgtcccaatgtctccagtagtcagagcctagacaagagttacatcacctggatgatcaggcagcgatatgtcacaatgccccctgtaagcatatcccagacaagagttgcatcacctcggtggtcagtgcagagatatgtctcaatgtcccctgtcggcgaagcctataccagagttacgtcatctcggtgatcagtgcaatgatatcttaaaatgcccctgtaggcagagcctagacatgggttacactacctgggtgatcagtgcagagatatctcacaataccccatgtaagcagagcctagaaaagagttacatcacctgggtgatcagtgcaaagatatgtcataaatcccactgtaggcaaagcctagacaagtttttcataaaatcagtgatcagtgcagatatttgtcccaatgtccctataggcagag

SEQ ID NO: 474165 - DNA, 2153 bp, Homo sapiens
gttcatttccacgtaggagaccacagggaaaccccagagagaatatgcctccccggcgtgatgtcctgacgatggattccagtgcactgcctactgggggcattgtcaaatatttctgcactaataacccagaatcgaatggaattatcattgaatggactaaaatggaatcaacatcaaacggaatcaaacggaattatcgaatgcaatcgaagagaatcatcgaatggccacgaatggaatcatctaatggaatggaatggaacaatccatggacccgaatgcaatcatcatcgaatagaatcgaatggaatcatcgaatggactcgaatggaataattattgaatggaatcgaatggaatcatcgtcgaatagaaacgaatggaatcatcatcgaatggaaatgaaaggaagaatcatcgaatggactcgaatggaatcatctaatgaaatagaatggaataatccatggactcgaatgcaatcatcatcaaatggaatcgaatggaatcgtaaacgaatggaattatcatcgaaaggaatcgaatggaatcatcaaatggaatcagatggaatcatcatcaaatggaatcgaatagaattatggaatgaaatccaatgtggtcatcatcgaatggactcgaacggaatcatcatccaatggaaactaatggaatcaacatcgaatggaatcgaatggaaacaccatcgaattgaaacgaatggaattatcatgaaattgaaatggatggactcatcatcgaatggattcgcatggaatcatcgaatgaaattgattgaaatcatcatcatatggaatcgaatggaatcattgaatggaatcgaatggaatcatcatcagatggaaatgaatggaatcatcagagaatggaatcgaatggattcattgaagggaatcagatggaatcatcgaatggacttgaatggaatcattgaatggactcgaatggaatcattattcaatggaattgaatggaatcatcgaatggtctcgaatggaatcattatcaaatggaatcgaatggaatcaccgaatagaatcgaatggaacaatcatcgaatgaactcaaatggaattatcctcaaaaggaatcgaatggaattatcgaatgcaatcgaatggaattatcgaatgcaatcgaatagaatcatcgaatggactcgaatggaatcgtcgaaaggaatggaatggaataaatcgaatggaattatcattgaatggactaaaatggaatcaacatcaatcggaatcaaacggaattatcgaatggaatcaaagagaatcatcgaatggccacgaatggaatcatctaatggaatggaatggaataatccatggacccgagtgcaatcattatcgaatagaatcgaatggaataatcgaatggactcgaatggaataatcattgaaaggaatcaaatgaaatcatcgtcgaatggaaacgaatggaatcatcatctaatggaatcgcatggagtcatcatcaaatggaatcgaatggaatcgtcgaatggactcgaatgcaataaacatagaacggaattgaatggaaacatcatcggaggtaaacgaatgcaattatcatggaatggaatcgaatggtatcatcaaatggaatcagatcgaatcatcatcaaatggaatcgaatagaattatggaatgaaatccaatgtgatcatcatcgaatggactcaaacggaatcatcattcaatggaaactaatggaatcaacatcgaatggaatcgaatggaaacaccatcgaattgaaacgaatggaattatcatgaaattgaaatggatggactcatcatggaatggattcgaatggaatcatcgaatgaaattcattgaaatcatcatcaaatggaatcgaatggaatcattgaatggaatcgaatggaatcaacatcagatggaaatgaatggaatcatcagagaatggaatcgaatggattcattgaatggaatcagatggaatcatcgaatggacttgaatggaatcattgaaaggactcgaatggaatcattattgaatggaattgaatggaatcatcgaatggtctccaatggaatcattatcaatggaatcgaatggaatcaccgaatagaatcgaattgaacaatcatc

SEQ ID NO: 474166 - DNA, 891 bp, Homo sapiens
gaatggaatcgaagagaatcgatggaataatccatggactcgaatgcaatcatcatcaaatggaatcgaatggaatcgtcgaatggactcgagtggaataaacattcaacggaatcgaatggaatcgtcaccggatggaaacgaatggaatcatcatcgaatggaatcgaatggaatcatcaaatggaatcagatggaatcatcatcaaatggaatcgaatagaattatggaatgaaatccaatgtgatcatcatcgaatttactcgaatagaatcagcatccaatggaaactaatggaatcaacatcgaatggaatcgaatggaaacaatatcgaattgaaaagaatggaattatcatgaaatggaaatggatagactcatcatcgaatggattcgaatggaatcatcgaatgaaattgattgaaatcttcatcaaatggaatcaaatggaatcattgaatggcatcgaatggaatcatcgtcagatggaaatgaatggaatcatcacagaatggaatcgaatggattcattgaagggaatcagatgcaatcatcgaatggagttgaatggaatcattgaatggactcgaatggaatcattattgaatggaattgaacggaatcatcgaatggtcccgaatggagacattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcaaatggactcgaatggaatcatcgaatggaaaggaatggaatagtcaggaactcgaatggagtcgccattgaatggaatcgcatggaatcatc

SEQ ID NO: 474167 - DNA, 825 bp, Homo sapiens
tggaatcaacatcaaacggaatcaaacggaattatcgaatggaatcgaagagaatcttcgaatggactcgaatggaatcatctaatgaaatagaatggaataatccatggactcgaatgcaatcatcaacaaatggaatcgaatggaatcgtcgaatggactcgaatggaatcatcatcaaatggaatcaaatagaattatggaatgaaatccaatgtgatcatcatcgaatggactccaacggaatcatcatccaatggaaactaatggaatcaacatcgaatggaatcgaatggaaacgccatcgaattgaaacgaatggaattatcatgaaattgaaatggatggactcatcatcgaatggattcgaatggaatcaccgaatgaaattgatagaaatcatcatcaaatggaatcgaatggaatcattgaatggaatcgaatggaatcatcatcagatggaaatgaatggaatcatcattgaatggaatcgaatggattctttgaatggaatctgatggaatcatcgaatggtcttgaatggaatcattgaatggactcgaatggaatctttattgaatggaattgaatggaatcatcgaatggtcacgaatggaatcattatcaaatggaatcgaatggaatcaccgaatagaatcgaatggaacaatcatcgaatggactcaaatggaattatcctcaaatggaatcaaatggaattatcgaatgcaatcgaatggaattatcgaatgcaatcgaatagaatcatcgaatggactcgaatggtatcatcgaatggaacggaatggaatagtcaatgaactc

SEQ ID NO: 474168 - DNA, 590 bp, Homo sapiens
gaacggaatcgaatggaatcatcaatggaataatccatggactcgaatgcaatcatcatcaaatggaatcgaatggaatcgtcgaatggactcgagtggaataaacattcaacggaatcgaatggaatcgtcaccggatggaaacgaatggaatcatcatcgaatggaatcgaatggaatcatcaaatggaatcagatggaatcatcatcaaatggaatcaaatagaattatggaatgaaatccaatgtgatcatcatcgaatggactccaacggaatcatcatccaatggaaactaatggaatcaacatcgaatggaatcgaatggaaacgccatcgaattgaaacgaatggaattatcatgaaattgaaatggatggactcatcatcgaatggattcgaatggaatcaccgaatgaaattgatagaaatcatcatcaaatggaatcgaatggaatcattgaatggaatcgaatggaatcatcatcagatggaaatgaatggaatcatcattgaatggaatcgaatggattctttgaatggaatctgatggaatcatcgaatggtcttgaatggaatcattgaatggac

SEQ ID NO: 474169 - DNA, 1648 bp, Homo sapiens
gaatggacccgaatggaatcaacatcaaacggaatcaaacggaattatcgaatggaatcgaagagaatcatcgaatggccacgaatggaatcatctaatggaatggaatggaataatccatggacccgaatgcaatcatcatcgaatagaatcgaatggaatcatcgaatggactcgaatggaataatcattgaacgcaatcgaatggaatcatcgagtggaatcgaatggaatcatgatcaaatggaatcgaatgtaatcatcatcaaatggaatccaaaatcaccatcatcaattggtactgaatggaattgtcatcaaatggaattcaaaggaatcatcatcaaatggaaccgaatggaatcatcattgaatggaaatgaaaggagtcatcatctaaaggaatcgcatggaatcatcatcaaatggaatcgaatggaatcatcatcaaatggaatcgaatggaatcattgaacggaattgaatcgaatcgtcatcgaatgaattgaatgcaatcatcgaatggtctcgaatggaatcatcttcaaatggaaaggaatggaatcatcgcatagaatcgaatggaattatcatcgaatggactcgaaaggaatcaacatcaaacggaatcaaacggaattatcgaatggaatcgaagagaatcatcgaatggactcgaatggaatcatctaatggaatggaatggaataatccatggacacgaatgcaatcatcatcgaatagaatcgaatgaaatcatcgaatggactcgaatggaataatcattgaacgaaatccaatggaatcatcatcgaatggaaacgaatggaatcatcatcgaatggaaatgaaaggagtcatcatctaatggaatcgcatggaatcatcatcaaatggaatcaaatggaatcatcatcgaatggaatctaatggaatcattgaacggaattgcatggaatcgtcatcgaatgaattgaatgcaatcatcgaatggtgtcgaatggaatcatcttcaaatggaatggaatggaatcatcgcatagaatcgaatggaattatcatcgaatggactcaaatggaatcaacatcaaacggaatcaaacggaattatcgaatggaatcgaagagaatcatcgaatggaatcgaagagaatcatcgaatggactcgaatggaatcatctaatttcattagaatggaataatccatggactcgaatgcaatcatcatcaaatggaatcgaatggaatcatcgaatggactcgagtggaataaacattcaacggaatcgaatggaatcgtcaccggatggaaacgaatggaatcatcatcgaatggaatcgaatggaatcatcaaatggaatcagatggaatcatcatcaaatggaatcgaatagaattatggaatgaaatccaatgtgatcatcatcgaatggactcgaacggaatcatcatccaatggaaactaatggaatcaacatcgaatggaatcgaatggaaacgccatccatttgaaatgaatggaattatcatgaaattgaaatggatggactcatcatcgaatggattcgaatggaatcaccgaatgaaattgatagaaatcatcatcaaatggaatcgaatggaatcatcaaatggaatcagatgaa

SEQ ID NO: 474170 - DNA, 593 bp, Homo sapiens
gcgtttccaaagaggaaccaccccagctgcagcttgtttatgtgaaggtcttggagcctgcagacaggaatgtttaagtctgctgaagctgcacccacagccaccccttcccctggtgctctgtcccagggagatgggagttttatatataagcccctgactggtgctgctgcctttctttcagagataccatgcccagagagaaggaatctagagaggcagtctggctacagtggttttgctgagctgcagtgtgctccatccagttcaaacttcctgggggctttgtttacactatatgaaagagaggcaggagagtcaacgtcagagttgtatgatgtgaggaagactcaccagccattggtggctttgagagtggaggaagaggccacaagccaaggaatgtgggcagcatctagaatttggaaaagtcaaggaaatggattcacccctgaacctccagacaggaatatggctctgctacaccttgattttagtttctgaggccttcagaattataaactctaaacttgtatacccaaatgactagtagatatcactcatggacactcagatgagtatgtcaatttaaa

SEQ ID NO: 474171 - DNA, 1038 bp, Homo sapiens
accacactgcaagtgccacccgggtcctgtagggttcattgagcagggctgaagccaggacatggggctgcttttggtcctgcattcaagtctgcaaatggcaggcttgttaccaggagcatggataagtgtggctgccagcagccctaagtgggctcctgctggttccctggacaagcagcactacatctgcaccatgacaaaatgggacaaactgcagccaaatggagctaaatctaagtccataggaggatggagtggttttcagtcagcacctggacccacatttggcaagcctgccaccaggaataaccaagatctggctaaacaggactctgtggggagatgggtgtggctagcagtaaatcctgggaacttcggatttataggcctacaagagatctccataaacagccaggatagagcaggatacgtgcacattcgtggagcaacacagccgtgtgctcacttctcagctgccacatctttgtctctttctagaatgcatttcccatattctgtctgcctgagccacattcaggccccacacagatactctattctcaagagacttttctacatgtacaaagtcaagattcatctttctctctcttcttttcctgttgaactctgactcactcgtaggacttaccacaccctgtcttctattaatattgggcatgtgccctgtgctaggctagttaaatgttcttgaataaaaatattgactgtagataatgaacactaatctactttcaagttcaacttcctgaagcacatttattcagctttctctatggagtatctgggcatttaagcaattacattatagtatgttgcaggggtggtagaaactcccctttaccctgcagcagactgctctgagaaatctgacttattcattgatttttaacagatgtgaaaaacaatcttacatctatagcaatgagtagctttctggctatagtactttattcatctattttccctttacacctaagttcattttatatacagatgtttttaaaaacacatttt

SEQ ID NO: 474172 - DNA, 1218 bp, Homo sapiens
ctggaacatcagatccccatgggtctccagctgcagggccctcaaactggaacatcagctcccccaccagatctccagctgcacggacctcaaactggaacatcagctccccgccgggtctccaggtgcactgcctgcaaactggaacatgagctccctgccgggtccccagctgcatggccctcaaactggaacatcagctccccaccagatcgccagctgcacgaccctcaaactggaatatcagctccaccccggggctccaaggtgcacagccctcaacttgcaacatcagctccccaccgggtctccagctgcacggctctcaaacaggaacatctgctccccacagggtctccagctgcacggctctcaaacaggaacatcagctccccacagggtctccagctgcacggtcctcaacctgcaacactggctccccaccaggtctccagatgcacggccctcaaactgcaacatcagttccccccgggtctccagctacaccgcgtcaacctggaacatcagctccccgccgggtctccagctccacggccctcaaactgcaacactggctcctcaccgggtctccagatgcacggccctcaaactggaacatcaactccccaccgggtatacagctgcatggccttaaactggaacattagctccccgcccaggtctccagatgcacggccctcaaactggaacatcagttccccgccaggtctccagctgcacggccctcaaactggaacatcagcttcccgccgggtctccaggtgcacggccctcaaattggaacatcagctccccgctaggtctccaggagcacgggcctcaaactggaacatcagctccctgccaggtcaccagctgcatggccctcaaactggaacatcacctccccgccaggtctccagctgcatggccctcaaattgcaacatcagctcccatcagagtctccagctgcatggccatcaaactggaacatcagctcccccgcgggtctccagctgcacagacctcaaacttggacatcagctccccgccgggtcatcaactgcacggccctcaaactggaacatcagctccacccttgggtctccagcagcacggccctacaactggaccatcagcttccccccgggtctccagctgcacagccctacaaccggaacatcagctaccttacgggtctccagctgcgttgatgt

SEQ ID NO: 474173 - DNA, 5067 bp, Homo sapiens
ctggaacatcagatccccatgggtctccagctgcagggccctcaaactggaacatcagctccccaccagatctccagctgcatggacctcaaactggaacatcagcaacccgccgggtctccagctgcactgcctgcaaactggaacatgagctccctgccgggtctccagctgcttggccctcaaactggagcatcagctccccaccagatctccaggtgcatggccctcaaactggaatatcagttccaccctggggctccaggtgcacagccctcaacctgcaacatcagctctccactgggactccagatgcacggccctcaaactggaacatcagctccctgccgggtctccagatgcacggcctgcaaactggaacatcagctcccgtcaggtctccagctgcacggccctcaaactggaatatcagctccaccccggggctccagcttcacggccctcaaactggaacatcagctccccaaccaggtctccagctccacggccctcaacctgcaacatcagctccccaccagatctccagatgcacggccctcaaactggaacatcggctccccacagggtctccagctgcatggacttaaactggaacatcagctcccaggccctcaaacaggaacatcagctcccaggccctcaaacaggaacatcagctccccacaggctgcaccacttcaaactgcaacatcagctccccgctgggtctccagcagcatggccctcaacctggaacatcagctcccccgaacccgggtctccagctccacagccctcaacctggaacatcagctccccccaacccgggtctccagctccacggccctcaaactggaacatcagctccctgccgggtatccagttgcacggccctcaaactggaacatcagctccccaccaggtctccagctgcacggccctcacactggaacatcagctccccaccagatctccagctgcacggctctcaaacaggaacatcagctccccacagggtctccagctgcacggccctcaaactgcaacatcggttcccccctgggtctccagctacaccgcgtcaacctggaacttcagctcccccccgggtctccagctccatggccctcaacctgcaacactggctccccaccgggtctccagatgcacagccctcaaactggaacatcaactccccaccgggtatacagctgcatggccttaaactggaacatcagctccctgcccaggtctccacatgcacagccctcaaactggaacatcagctccccgccaggtctccaggagcacggacctcaaactggaacatcagctccctgccaggtcaccagctgcatggccctcaaactgggacatcacctccccacgaggtctccagctgcatggccctcaaattgcaacatcagctcccatcagagtctccagctgcatggccatcaaactggaacatcagctcccccgtgggtctccagctgcacagacctcaaacttgaacatcagcttcccgccgggtcatcaactgcatggccctcaaactggaacatcagctccacccccgggtctccagctgcacagccctacaaccggaacatcagctccctgccgggtctccagctgcacagccctacaaccagaacatcagctccctgccgggtctccagctgcacagccgtcaacatcagctcctccccgagtcctcagctgcacgaccctcaagttagaacatcagcttctccccaagtcttcagctgcgtgaccctcaatctagaacatcagttcttctctggggtctgcagctgcaagaccctgaaactacatcagcttctctccagttctgcagctgcaagaccctcaaactacaacatcagcttccctccaggtctccagttccatgaccctaaatctagaacatcagctccttcctgagtctccaactgaaagaccctcaaagcgaacaacatcagttcctccccgagtcttcagctgcacgacactcaatctacaacatcagctcctgtctggttctccagctgcacgaccctcaaactacaacctcagctcttccccgagtcttctgctgcatgaccctcaatctagaacataagctcctctctgggtgtccacctgtagggacctcaaattagaacgtcagctcctcccagagtcttcagctgcatgaccctcaatctttaacatcagctcctctccaggtctgcagctccatgaccctaaaaatacatgagcagctcctccctgaatcttcagctgtacgaccctcaaactacaacatcagctcctgtctgcacctccagctgcagagccctcaaactagaatatcagctcctccccgagtcttcagctgcacgaccctcaaactagaacatcaaaaaatgtacagatttccaactgtagggccctcaaactagaacatcagctcctccccgagtcggcagctgcaagaccctcaaattaccaactcagctcctcccggagtcttcagctgcatgaccctcaatctcgaacatcagatactctctgggtctgcagctgtagggccctcaatctagaacatcagctcctcccgagtcttcagctgcatgactctcaaactagaacctcagctcctccccgagtcttcagctgcacgacccttaatctagaacctcagctcctcccgagtcttcagctgcacgaccctcaatctagaacatcagctcctctccaggtttgcagaagaccctcaaactagaacatcagcttctccctgagtcttcacctgcatgaccctcaatctagaacatcagctcctctgcaggtttgcagctgcaagaccctcaaactacaacatcagctcctctccaggtctgcagctgcaagaccctcaaactggaacatcagctcctctccaggtctgcagctgcaagaccctcaaactagaacatcagctcctccctgagtcttcacctgcatgaccctcaatctagaacatcagctcctctccaggtctgcagctgcaagaccttcaaactagaacatcagctcctctccaggtctgcagctgcaagaccctcaaactagaacatcagctcctgcccgagtcttcagcagcatgaccctcaatctagaacatcagctcctctctggatctgcagctgcaagaccctgaaactagaacatcatcttctctccaggtctccagttccgtgactctaaatctagaacatcagctcctccctgagtctccaactgaaagaccctcaacgcgaaaaacatcatctcctccccaagtctgcagctacaagaccctcaaactagaacatcagctcctccccaggtctgcagctgcacgaccctcaaactagaacatcagctcctctccgggtctgcagctccacgaccctcaatctagaacatcagctcctccccgggtcttcagctgcacgaccctcaaactagaacatcagctcctccctgggtctgcagctggaagatccactaactagaacatcaactcctgtctgggtctccagctccatgaccctcaatcaagattatcagctcctccctgaatcaccagctgaaagaccctcaatgtgaacaacatcagctcctccccgagtcctcaactgcaccaccctcaaactacaacaccagctcctccccgagtcttcagctgcaggaccctcaatctagaacatcagctcctccccgagtcttcagctgcacgaccctcaatctagaacatcagctcctctccgcgtctgcagctagaagatccactaactagaacattagctcctgtccaggtctccagctccatgaccctcaatcaagattatcagctcctccctgagtctctagctgaaaggctctcaatgcaaacaacattagctcctccccaagtcctcaacagtgcgaccctcaaactagaccatcagctcctccccgagtcttcagctgcacgaccctcaatctagaacatcagctcctctccaggtctgcagctgcaagaacctaaaagtagaacatcacctactccctgggtctgcagctggaagatccactaactagaacatcagctcctgtccgggtctccagctccatgaccctcaatcaagattatcagctcctccctgaatctccacctgaaagaccctcaacgagaacaacatcagctcctccctgagtcctcaactgcatgaccctcaaactacaatatgagctcctcgccgagtcttcagctgcacgaccctcaatctagaacatcagctcctctccgtgtctgcagctagaagatccactaactagcacattagctcctgtccgggtctccagctccatgacccacagtcaagattatcagctcctccctgagtctccagctgaaagactctcaacgcaaacaacattagctcctccccgagtcttcaacagcgcgaccctcaaactacaacttcagctcctccccgagttcagctgcacgaccctcaatctagaacatcagctcctctccgcgtctgcagctgcaagaacctaagagtagaacatcagctcctccccgagtctccacctgaaagaccctcaatgagaacaacatcagctcctccccgagtcctccactgcatgaccctaaaactacaacatcagctcctcgccgagtcttcagctacatgaccctcaatctagaacatcagctcctctccaggtctgcagctgcaagaacataaaagtagaacatcatctcctccctgggtctgcaactggaagatccactaactagaatatcagctcctgtccgggactccagctccatgaccctcagtcaagattatcagctcctccctgagtctccacctgaaagaccctcaatgcgaacaacatcagctcctccctgagtcttcagctgttcgaccctcaatctacaacatcagctcctccctgagtcttcagctgcaacaatctaaaactagaacatgagctcctccctgagtctccagctgaaagaccctcaacgtgaacatcagctcctccccgagtcctcaacag

SEQ ID NO: 474174 - DNA, 1476 bp, Homo sapiens
gtcttccataaaaccagtcaaagacgttggggacagctgtttcactatgtcttataagtgttgggcagtgcgaaagggaaatgtggggtcggagcccccacgcagagtccctcccggggcaccacctagtggagctgtgagaagagggccaccatcctccagaccccagaatggtagatccacctacagcttgcactgtgcacctggaaaagctgcagacactcaatgccagcccatgaaagcagccagaagggagactgtgcccttcaaagccacaggagcagagctgcccaagaccatgggaacccaccgcttgcatctgtgtgacctggatgtcagacctggaatcaaaggagatcattttggagctttaaaatttgactgccccattggatttcagactttcatgggccttgaagaatccaggagtagagacgaaactgtaattgaaaacagacctttaatacctgatctgtctgcagaattaaaagattttctgcattaatgtttgcctagacatgatctgaagacatgttttgtttgtttcagtgtatatttattcaacacaaggatattaaaaaatatatcttacagattttgtgatagaaaaaaagttattgaaaaaagaaaagataatcagatctatactcgggtagaataaaaactaaaagatgttccctggacatagacttctttaccttctggaagtcactgaccacttgaagaaatgagtatacatatatgtacctatgtgtacaatatagtgcacacaagatgaggaattcacagaatgcctaactcattaccgtggatccctttgggcttcaggaacacagggtggtgaggggggaaatgtgccacaagactttcttgtccagacaagttgcatttcttacgtgaagaaaatggaaacagtctgagatatacaatggatacccatttactcttaaaggaaaaaggttagctattttattttataagctagcaagataaattcagttgacaaatccttatttataataatggaacccttatttccatttttgtcatacattagtatatttccccattatatactttattccctttattatatttatgttctttatgcatttttctctcattcctcaccattatgatattcttggcatcaatattacagcagaccacatagtcaattctgaagtgtcttattgtcttaatactacttctagaagtatgcaaagggaatgttaaataaaaattttaatgtaaaaattatatgtaatatccagtggtatattacaatgagaaggaacatcttgcatttctgtcccttactagaagcaaaggaaatcataaaggaatttagtcttcctctgaagaaatagagggcaagaggagaaatagaactctactttcttagtttattttgtctgctgtaacagaataccacagatggagtaatttataataaacagaaatttattggcttat

SEQ ID NO: 474175 - DNA, 463 bp, Homo sapiens
tgagtttgactactcttagtatctcatgtcgaaagaacttatactttcaattccactcaaaggtttcaagattcctaatagaagagtgaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactaagtaccaaaaagcagaggctgaagaaggcgtcacaaaaagtcaaaatgtgaaccaaatcttaggagaatttattacgctgacagttggaggaaaggtagtccagatggagaagaagaaagaaaaaagacatggaaatgcaaaaaagtgaatgggcctatcgatg

SEQ ID NO: 474176 - DNA, 707 bp, Homo sapiens
tttcctgccagcagcctaacctgatgtggtggaagaggcccaaaaggcagcagagaattaaagatgtgacctggctttttctgaacaaatacagttatatgtgtacacaaagagatggtctgaaattggaacttatgtttaaaagggaagcagagtgtaaaagtttggaaaatttgaagcctgaccttttggtagaaaagaaaatcccattttgggggaagaaattcaagctaccagctgcagaaatgtgcttaagtaaagagaggtcaaatgttaatcgccaagacaatggggaaaatgtctccagggcatttcagagatcttcatggcagttcttcccaacacaggcctggaggcctaggagtgaaaagtggtttcattggctgggcccagggccccactgctctgtacagcctgaggacttggtgcccagtgtcccagctgtgccagctccagtcatggctaaaagaggccaaggtacagctcgggccattgcttcagagggtgcaagcgtcaggccttggtggcttccatgtgatattgggcctgcaggtgtgcagaagacaagaattgagctttgggggcatctacctagatttcagaggacgtatggaaatgcctggatgtccaggcagaagtctgttgcaggagcagagccttcatggagaacctctactagtgcaatgtagagggaaaatgtggggttg

SEQ ID NO: 474177 - DNA, 880 bp, Homo sapiens
gcgggcacctgcccagatatacctgaacctgtttgtttagccatggtgcctcttgtggggcattcctttttgaacggcgcccattcccttgatttccacagtatcacctttcttatagattcgcatacacgtggccaaaggaacaactccatgttttctaaaaggcctggagaacatgtatcacgtgtctctcctctttcccttggcgttcgtcattttggcaaattactggaagatggcgattccttggtagtcaagctgaactccctaagaggaaacactaggtcagtgaagtatatcaatggcctttataagaacatgatgttgattcatgattgcgagacttgcattagggtttgccttgctcatattgttaccggcagaacatatccgtatctgtacaggtctgcagcaacctcaattcttgcctcctcagaagaaaggatttcactgagggggataatgcagaaggagagactggggcaagtttctgagcaggagtgaaagtttattaaaaagccttagaacaccaacatggcacatgtatacatatgtaacaaacctgcacgttgtgcacatgtaccctaaaacttagagtataataataataaaataaaattaaaaagccttagaacaggaatgaaaggaaggaaagtacacttggaagagggcctggcaggcaacctgaaaggcaagtgtgtggtttgaccttttgacctggggttttatatgttggcatacttctggggtcttgaatttcttctttcatcccacttacctaactcctgagagcttatcaggaaactgctgatcaccagtttcaggtgttacctattatgaggctgcctttcactggtgccggctgtgaccaattattacc

SEQ ID NO: 474178 - DNA, 1397 bp, Homo sapiens
ggttggagcccaccgcagctcaaggaggcctgcctgcctctgtagactccacctctgggggcaaggcatagccaaacaaaaggcagcagaaacctctgcagacttaaatgtccctgtctgacagctttgaagagagtagtggttctcccagcacgcagcttgagatctgagaacaggcagactgcctcctcaagtgggtccctgacccccgagtagcctaactgggaggcaccccccagtaggggcagactgacacctcacacagccgggtactcctctgagacaaaacttccagaggaacaatcaggcagcaatatttgctgttcagcaatattcactgttcttcagcctccgctgctgatacccaggcaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaagtagataaaaccacaaagatggggaaaaaacagagcagagaaactgaaaattctgaaaatcagagagcctctcctcctccaaaggaatgcagctcctcaccagcaatggaacaaagctggacggagaatgactttgacaagttgagagaagaaggcttcagacgatcaaacttctctgagctaaaggagaaagttcgaacccatggcagagaagttaaaaaccttgaaaaaagattagatgaatggctaactagaataataaccaatgcagagaagtccttaaaggacctcatggagctgaaaaccatggcacgagaactacgtgatgaatgcacaagcttcagaagaagtagaatatctctgaatagaccaataacaggcactgaaattgaggcaataattaatagcttagcaaccaaaaaaagtacaggaccagatggattcacagccgaattctaccagaggtacaaggaggagctggtaccattccttctgaaactattccaatcaatagaaaaagagagaatcctcactaactcattttatgaggccagcatcatcctgataccaaagcctggcagacacacaacaaaaaaagagaattttagaccaatatccctgatgaataacaatgcaaaaatcctcaataaaatactggcaaactgaatccagcagcacatcaaaaagcttatccaccatgatcaagtgggcttcatccctgggatgcaacgctggttcaacatatgcaaatcaataaacgtaatccagcatataaacagaaccaatgacaaaaagtacatgattatctcaatagatgcagaaaaggcctttgacaaaattcaacagtccttcatgctaaaaactctcaataaattagatgacatga

SEQ ID NO: 474179 - DNA, 1617 bp, Homo sapiens
tgctgattggtccatgagcagccatggacaggcctggaaaaggcaccacaagttcccactctggtctgtgggagtgggactggaagcccagcccccagccttccggcatacctggcctgaaagttgggcctcaccaggcacccacccccttctgctcaggaacctgtctgcctcctgctgccattgatggcatcaaggcttggccccaactttgttccaaggttgcatgggtgctgacagcaggagaactagaaagagttctcagttctagttctagggaaccctacttgttccctattacagagattattctccttcattacctgataccgtttgtccttcaaaatgttgttttatatattttgttcatttgttttggcaacttcaggccagaggataaatacttccatgtttctttatcttggtctaaagtgacataaattgtattaattcataatactaatctttaataaatgtatattaaaacgtcaaaattcaagcattcatgaacaaggctaaaaaagttaatgaaaatctcaaattacttaaaataataactaatatttagataaaaagaaatttcaaagagcgcatgatgatataattaatgactcttagagtgagagtgaatataattttgttcaactttttactcaatgtaccaatatttactactttatctctgatatgtggctaatcaacttttgcttaaacacttgcaatggctataagcttattattgcacaaggcagatcattccattttgcaaaactccttttaataagtacaaatatgtccacttataacttatgctcactgtatcacatctaacatttggagtacactgaagtctaatcttttctgtctgaacaaatgttctaatatttaaaaataattaccactgaaatcaataataaaaatgcatttgaggggtaacagaaaaatttaatatagcatgttatatttaaatatttttttaaaaattttgtgaatgttaaacatatttttaacaaaatgtctcttttataaagatgcgtggtaaactacttagtgatgagtgtcataatatctaatatttgctttaaaatgatttataaggattatttatatgataattaaataatatggcaattatataagatggcatttaaaacttgcttttgtcaaaggcatttacttctactcttgaacaggaatgtgtctctttttaagtaataactttttaaatctataaacatactaactaactagacaaaataagttctatttcaatacttcatagagggtaaaagacatactctaggttctaacttagttaacatagccgtttcttctcagagaatatcacatgaaacaaatgttaaattgtgcactatgttagcatgaactcagaatgttccactttgcctacattcgccagttgaaaggtatgaatgaatggcatattctataaatttctaatacattttctattcataccacttccatgcattagaaagtatccttaacatgaagagatgttgaattttatcaagtgccttttctggatctattgggatcatcatgtggtttttgtctttagttctgtttatgtgatgaatcacatttattatttgc

SEQ ID NO: 474180 - DNA, 593 bp, Homo sapiens
gctccattatttttcttataccccatgaccaatccatcaataaatcctatgggatttaatttcaaactatatactcaatcaaaaattctctcttctacttatttgaaatacactatgcattattgttattgtcaccatactatgcaagagtaccagaaattattccttctatctcactgtaacattgtacctattgaccaacctcctctaatctccccttaccccactctcctcagctctagaaaccactgttctactctcaacttcaatgagatgaagattttttattccaaatacggggaatgggctaatccacggagtgctcagcagtctgatctttacctgattaagagtattaatgctagcagagaaaaagaatcaatatgtgtcaggaatagcaacgtgcaggataaagcaaagcaacaggtagtcatcctaatgggtgcaaagtgatatctcttcatggttttcatttgcattactctaatgattagtgatgttgcacaagttttcatgtgcttattggacaataaatgtaactaattttcttcagcaatgaggcattggagctatgttcatgatttgttattcaa

SEQ ID NO: 474181 - DNA, 1297 bp, Homo sapiens
tattgcctttctccagatggtgactaaagaccaagtttgtctcagctctcgcaatcaaccagacctttgccaatagggaatggaggaggtcccaaaaagagatcatcagtgtggtagtattggcaaggggcttgtgctcaggagccctgtgtggaatgtacctgctaacatgttctgccacatgtctgccaccttcatcagcaacaacacggctatccatgagctgtttaggtgcatcttggggccattcatggccatgttcagatgcaaggatttcttgcaatggtatttgggtgagggcaaggatgagatagagttcactgaggctgagagcagcatgaacaacctggtgtccaagtatcaagagcaccaggatgccatggccaaggaggaggaaatttgggaggactgggctgagagggaaagacatggaaggttcagaagacaggaagatgtgggaaggtttggaacttgctggagacttgttgatggctttgaccaaaatgctgatagtgatatgggcaatgaagtccaggctgaggtggtctcagatggagatgaggaacttgttgggaactggaatgagactttagacttggacgagactgtggacttggacattttggttaatgctggaatgaactaagactttgggagactgttagattacccaattttgggaatataattattaataagatttcctcaaggttcattttattcctgtctgcaagttgacatgaccctatgtataaaaaaccctaaagacgccactgaagaactgttagaattaataagcaaatttagtaaagtttcaggatataaaataacatacaaaaaataagttagattttttacaccaattaatgatatattcaaaaaagaagtcaagaaaacaattccattcacaatagcatcaagaagaaataaatacttaggaatatatttaaccaaataagtgaaagatccttatactgaaaactatgaaacattcatgaaagcaattgaaaaagacacagtaaatgaaaaaaatctagtttttgcatatcagaagaattaatatattaaaatgtccatactacctaaagtgatatactgattcaatgcaatctttgtcaaaattttactgacattttttacatgaatagaaaaaacaattcttaaatttgtatagaaccacaaaataccccgaggtcaaaatgatattaataaagaaagttaaagttgaagccatcacactccctgatttcaagttatattaaaagcaatggtaatcaaaacaatatggtactgacat

SEQ ID NO: 474182 - DNA, 676 bp, Homo sapiens
agtcaaagctggagctattatctacatgaatgtggggaacaaattacccatttgttgtcccctacttgaagaaggaatcaactctgaagtctggaacttggaaggacaatttggaagggcgaaaactccccatcccgttcaaatcaggctaaaagaccccatcgcttttccttatcaaaggcaatatcccttaaggcctgaagctcacaaaggattacaggatattgttagacatttaaaagctcaaggcttagtaagaagatgtagcagtccttgcaacacctcaatcctaggaatacaaaaaccaaatggtcagtggagactagtgcaagacctcagaatcatcaatgaggcaataattcctttatatcctgctgtacccaacccctatacactgctctctcagataccagaggaagcagaatggttcactgttctggacctcaaagatgccttcttctgcattcccctgcactctgactcccagttcctctttgcctttgaggatcctacagaccacacgtcccagcttatgtggatggtcttgccccaaggatttagagatagccctcatctgaatcactgttttttgccaactgtgaattcctggacacagtgaaatggccaggccaccctatacccagatataggagactcggaaggtgaatactcatct

SEQ ID NO: 474183 - DNA, 1287 bp, Homo sapiens
ggtttttgacaaataaatggggtgggatgcttgcttggccgcccgctgccccagcccgagccctgggctcacttagcagcctgatgccgagtttcagacgcagtcctgctgcgcttacacccgggcttcttcgcccccttgccaaagtctgcagcccgatggatgctgggcgcgggctttccctgagcgctttaacgcagcttaggctaaagccccagagctcccaccttctacctcctgtttatccgcccgcccctctaccaccgccaaaggacgtgccccttcacagccggagtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggagtgttgcagcaggcattctcttctggaaggagtcgttgggagcagtgcggttggacacaagtttgcgtaggagtgttttccttttgtcaataattaatcaccggaattagccaggtagaatttgagttttagcaagagtcctgaggcggggccgaacacctaactccgggaggctcccagcgcccggcgcagtgggaagctcgcagcagctggggaggagccaaagcctcggcgctcacctaagccgcagggagatacacccaactgggagtaagaactgcaaacaattgtgatgcttgaaccacaatatatttccccaccctctccagttgagtgtgatgatgttccactaaggatgggtgcagccactaacgcagggccccctctcaacctagatcctcgtctacagtataccctgagagaagcaggccaccagcattactcatcatccccagctttgtgtttcagagctctattctagataagagcaactgagagctctgaggctctcttcctccaaccatcctccactcttaagacagaaaatgaagaactcaacaacaagaacacaactcatttaaaagtggacaaaaaaatttgaatagacatttctccaaagagcaggtagaaacagccaatttacacatgagaaggtgtttactagccattagtggttggggaaatgaaaatcaaatcaaaaccacagtacaatcccacttcacaccaaccggaatggctatcacaaaaaaaaaaaaa

SEQ ID NO: 474184 - DNA, 739 bp, Homo sapiens
taaacaaagcattctaagaaactattaatcaattcacatcagttcatttgcttaacaaatatttattgaaagctgctctgcgtgctgtgttcagggtgctgggaagaagagtaaacaaaactagcagtttcctgccctcctggcggaggcgagtaaaacaagcaaatacacgctccatggaatttcaggaatggaaagagcatcaaagaaaatgcaaacacagaaacaagaatgacaggatggtggaaacgaagccgaatcaggatgttgaccttggccacatcaatgtcatagagcttcttcacagcctgtttaatctggtgcttgttggctttaacatccacaatgaacacaagtgtgttgttgtcttctatcttcttcatggcagactcagtggatatctgggctgtctccggagtcgcagtgtcttcggccgccggaaggtgggtgacgtgcggatcttcttctttttgtggctgtggacacctttcaacactgccttcttggcctttaaagccttcgctttggcttcagctttaggaggggcaggagcttccttcttcgctttcggcgccatgttgtgaaaagggtccatatgctgtgttttaagaatatctcaaaacctgtaattatttcatttatgtattccttttcttgcttcctgttggcttatcccactgaaatataattttcatgagggcaaggattttgtctatcttagttaccttttgtcttagta

SEQ ID NO: 474185 - DNA, 1759 bp, Homo sapiens
tccctgcaggccagttgcctgaatgttggcaacggggccccagctggtgatgctcttatgcaatgatgttgctcttctcacaagccaggctccagattctccagccacagaggttctgccctgctttggggtacatggtagactcacaggaggtgttggtggcccctcagataaacagaccacccacttcactgccagcaaagagcacctgaccatattcagggcacccaaaggaaaagaggtttcctttgcagtccattatcacactgaattcaactccacaggtcattttggtaatgggctggcctttataccttgtctgtgccaagctgtggacagcatctgtctggttaccacgacccagctatgccatcttgttctccccaaatgtgaacaaggagctggtttctgtcaaggtcagtgtgtggttctgcccacatgctgccggcaggatcacttcatggctaagacctttgatgagtctgggagcttcctctctcttggtgttgtcatgtcccagatgccccttctcttgtccacagcagctccacagcttcccttctatggtgatgaggaggctgtgagcagcacactaaccagaaaccactgcccacacctgggcactaccaggtacccacatatctgaggcccctcacaaattctgactgagattgccgtaagcagcttttgctgtttaggcacttcctttcaaccagtcaagtcccagttgactgcccttcaaatcaaaagttgcccattgtacttcgacccttcaagtttgatgtgttccttggtgtacttaggctgagtgatgaccacagccacgctgcccgcccttgcctgctgctgcatgcctgatcccgtctccactgggggcccagtggagctccagaccgtcctcaaggtcgttgctgctgtccttgccgctgctgctgttgcagtgcttccgccgcgtgtgcctcttgctggaagtgcctgcttcatttcctgggcccagcaaggcagagccgttgccctagggaggcttctgacagacggcagcccccgccttcttcctggatatggtcatggctggagggagaaatctaaactattttgtattaattttctcaaaagaatacatgtaatttaaaatgtcaaataacactaaaggctgacaatgaaaataagagtaaaaacaaacagcaatgatctgatcatgctctatcatgttccatcccaaaagcacatagtcatcacttaggaaacttctcacaatatttacctacatatacttatgctatgaagaaactatatcttttatgttcaatgcttgcaaattacatgaagggaattatatacatgctgctttatgttttgatgtcatctttcttttatttttgtattttctgtatctctatttcttttttccccttaaatttttttttaccacccctaacatcttccacctactccaataaaaacccctgtccttccctccttaacttctccccatcccatgaccaagctctaatccatgctaaagaacgaaggtttgttccttccttttcttcttttgagttatgtaactctctacatgtttgtatgtgtttatatggtatatatatatgtggaatgttttggtcgtgttttgatttttttaaaacatgaagataatatttcacactttaacctgtatctttctattttcactcaataacacctgatggaattactttaaatcatttggaataatcattcttttaaatggcttaataat

SEQ ID NO: 474186 - DNA, 490 bp, Homo sapiens
actgttctaaagcctttttaataaacttccacttctgctctggaacttgcctcagtctctttttccgctttatgcccctcagtggaattctttcttctgaggaggcaaaaattgaagttgttgtagacgcctacagattcgtcaccagtaacttggggcgagccccacacaggatagaaagggctgaactttactattggcatcacgtttggtcatcggctgacatggacagtgtggcagatttgaagatttggcagctgaagactgtcatcagcaacacttttcccaccagcagaacttccatcaatctgggccccaataatgagcaggctcttaccaactcagatcaggccttaagaaactggcagttcctacttcctgtctcttcagacactctggaaaccaccatgctgtttgttacattggtatacatgtgccatgtttgtttgctgcatccatcaactcgtcatttacattaggtatttctcct

SEQ ID NO: 474187 - DNA, 622 bp, Homo sapiens
agcagcatctacaaagattttctatattaggttaaatgaggtcataagagtgcagttctaatatgataaaaattgatgtttttgtaaaagaggaagagacaccagagaaatttgtctccatgcatgcacagaggaaaggttgtatgagatccagggagaaggcagccacttgcaaaccaaggagagaagcctcaccagaaaccaacccttttggcatgttgatcttagacttccgtattccagaacgggttgcccttgtggctacctgcccatggtttggtagcccccatacagtgacagatccagaggccagcccaagtggccacctagttctcttggactgggggctgacgctggtccagtgtcttctggcaaggcgctgcccacccaatgtgcatggacttaattgcaacagagaaatggacttggggagacatcccacaactgtagttccatggagtcatgcagctgaaatctgctagattctgacccttcccaaattgctcctaggataacattgccactgtaaaatctaagatcagggcttaagatattttgcaggccttgcatctgatggatcatctggtatcacccacattgataaactagctcatctgttctt

SEQ ID NO: 474188 - DNA, 489 bp, Homo sapiens
aaggggggcgcgtccggggggactggtggcttgcatgggtgctggtcatggcagtggtgggctgggcatgtggacatgttcttcagccactgggcagctggtgtgatgtggctgatggcagtgggactgttggagcaacctaccggaacccatgcagtccatgctatgttggtggtgactgtgacaggttgggcaggccggtgcttatgggtttcagctgtggtgatattggcaggttgagtcagccagacctcagaccacagcaggagggatcaggtgccaatggtggtagacttagctgggtaatttttaggctcatgggttggatgctcgagtatttgggggatgggaccaggctgataaacttgtcctcaggccccttagtagtgcattcaggtgctggctatggtaggaagaggtggagtggtcccaaggtcactggtggaatgctcaggtgtgagcccctctcagctagctcagcgtaggcag

SEQ ID NO: 474189 - DNA, 846 bp, Homo sapiens
agaaacttctgcagacttaaacatccctgtctgacagctttgaagagagtggtggttctcccagcatggagtttgagatctgagaatggacagactgcctcctcaagtgggtccctgacccccgagtagcctaacttggagacacctcccagtaggggccgagtgacacctcatacacaaactccaacagacctgaagctgagggtcctgactgttagaaggaaaactaacaaacagaaaggaatagcatcaacatcaacaaaaggacatccacaccaaagccccatctgtagatcaccatcatcaaagaccaaaggtagataaaaccacaaagatggggagaaaccagagcagaaaagctgaaaattctaaaaatcagagcgcctcttctcctccaaaggaacgcaactcctcaccagcaacagaacaaagctggatggaggatgactttgacaagttgacagaagtagacttcagaagatcggtaataacaaacttctccaagctaaaggaggatcttcgaacccatcacaaagaagctaaaaaccttgaaaaaagattagacaaacggctaactagaataaacagtgcagagaagaccttaaatgacctgatggagctgaaaaccatggcaagagaactacatgatgcatgcacaagcttcagtagcagattggatcaagtggaagaaagggtgtcagtgaatgaagatcaaatgaatgaaatgaagcgagaaaagaagtttagagaaaaaagaataaaaacaaatgaacaaacctccaagaaatatgggactatgtgaaaagaccaaatctatgtctgattggtgtacctgaaattgacagc

SEQ ID NO: 474190 - DNA, 655 bp, Homo sapiens
accagttactgaaaactattgtgatatggtgattttctttacccattccatcctttacctggaaaacttccagtcagttcaggaccctcagctgcaggtcaagtggactttgctggaggtccactccagacctgtttgcctgggtctcagcagcagaggctgcagaacagtgaatattgtggaacagcaaatgttgctgcctgatcgttcctctggaagcttcgtctcagaggggtacccggccgtgtgtcatctgtcacagcttcccttggctaggaaagggaattccctgaccccttgtgcttcccaggtgaggcaatgccttgccctgcttcaactcatgctcggtgggctgcacccactgtcctgcacccactgtccaacaagccccggttttattttccataatcctttttcccccaatggtgtgtcttctcattcgtaatattttggttttcatttagtcctatcaatcactatatttcttcagtaaggagtcattgcactagctaaggagtcattgcactagcaaagcagtcatcagcttatgtaaattcctgtggtacaaaaaagagatctttaagctgcttattactttattattgctgaaagaaaaaaaaagcaaggcataaagagaaaagggggtgggagaatt

SEQ ID NO: 474191 - DNA, 2294 bp, Homo sapiens
gctgctgctcactctttggctccacactgcctttatgagctttaacactcaccgcgaagtgagaccacgaacccaccagaaagcagaaactccgaacacatccgaacatcagaaggaacaaactccagacacgccgcctttaagaactgtaacactcaccgcgagggtccatggcttcattcttgaagtcagtgagaccaagaacccaccaattccagacacaaaattacctagcgtgtacatctttgacacgtgctacagggcatctttcataccatacctctcagatgcttcatacaattctcatacactcatcctttacccaagagctgctatcccaggttgggcatttgtgcatttcacaaagaatctaagccaaacgggaaacagtgtgccagtgactaaccttgcaccccaggatccactcaaggagattctttttcctaactgatttgtccaccaggagtacctttttctaatttttacaaaagcatcctataggctaattcctgatcactttttgaattctatacaagcttggacattaaagcataagattagctaggtaagaaaacagtgggctgaagtttcataacacgtgcaaatagaaactctcctttattgtattggatccttggttttcttgtagctaagattttctacatcaaacatccctttgatgaaaatgttgagggattttctccagattctcagtgaaggatatggttgaggaaataaaaccaagagtcagattatcttcttggcaaccaagcacagatgacgtattcaagttacattaggacatttgcaatctattgattgaagtaaataaatctggaaggtgtgtcttgtttgctaatcatgcaagaggcttccatgtgatcctgaatttttctttgaaaaggaaaaaaacactaattcctgtcaattattttcacactaaaaaatacattccaatcaagatacagcagcaaacatttcaaatgcataattcaaagattgtgaaagcaattcagcatagtgacctctgaattgagctagaggctgtgtattctcttttggtgtcaggtctcaaaactcgcggcaattaatttgatgtattgatttaatatttcaggaaggaatgtatttacctggcaaaggcactgtgaaagatgttttgaagagaaaagaaatgtttgcaaatgaagacaagctcctttgatgaaaggaaagctgagagtgagtagcattcacagaatcagaccccaaacacttattacttcaaggctcgatttcccaaattagagctaataatgattcagcattgcactgttggatacttcattctgtaaaagaataccatggggtagaaaggaagccatgcaacagatatgatcttgtaggctggcccattaagagagggttatttaaactagagctaaattagaaagaaccatttcaacactatatacctaagccagcagttttggaaaaaagatgccatctctctttttcaatatataaatttactattactttttaaattgtctgttctgattatataaataagaaagtactaaataaaatataaaatgtaaatgtaaaaaaagtataattccattatacaaagaccaccagattttctctcatctttcttatttactcaaaagaagttacagtttatctacaacataccgagcattatgcacaataaggacactacactagtgaatgacacaatcctttcccttggatttgtttggtgtagtggggaacatgcataaataaaaaggaaaacatagtacattttaatcagtgttatcatagaagtatagaggtgtatatgcatattatatattaataaatcaaatttttaagaaaatagttcttctttttcagttaatgtaatatgttcccccaagatagcagatatacatttttaacatcatgttattgattgcaaaatagcccacaccttggatatactatagttactatactatagtaacataattggatatagtatgttagccattttcttatacttatttgttcagattttttaaaatttttcattcatatctaacatgatgatgaacgcattttacatctttcttaaggcaaattcctagaagttaaaagttttgattcaaatggtaaggacatttccaaaactcttggcacatattgcaaatttgcgttccgaagaacgaaagcattgtgccaaattacatgcccaccaggaatggaaccttatgaaagatatacaagtacacactcataaatcacactgtccttgttttcttcagttt

SEQ ID NO: 474192 - DNA, 789 bp, Homo sapiens
tttttttcatgttcgttggctgcatgacacgctgatgcagaaggtgggttcctacggcctttggcagctccacccctgtggctctgcagggtatagtccccatcttagatgctttcatgggctggcactgtctgtgggttttccaggcacacagtgcaagctgtcagtggatctaccattccggggtttggaggatggtggccctcttcttacagctccactagatggtgccccagtagggagtctgtgtggtggctccaatcccacatttcccttctgcactgccctagctgaggttctcatgagggccctgcccctgcaacaaacttgtgcctgggcatccaggcgtttccatatgtcctctgaaatcaaggtggaggttcccaaacctcaattcttgacttctgtgcacttgcaggctcaacactatgtggaagctgccatggctttgggcttgcaccctctgaagccatggcctaagctctattcaggagtaacaggatcagggacccacttagaaaaacagtctggctgctttctagtagtgcagctgtgctgcgttgtgggagacccttccttgtccaggctgtctggactctccagagctggcaggttggaactgctgagttgcctaaaccacagagatgttggccacccctcccactggggactcggtccttctcaggcagactcaagcctgctgctgctgactggctggaatttgccattaggtcttaatttgtgagacactgtggaaggggggcctgcagaacatgctgcttggcttcc

SEQ ID NO: 474193 - DNA, 1239 bp, Homo sapiens
attagaaactaatggaaaggagtggaatggaatggaatggaatggaatggaatggaatggaatggaatggaatctacccgagtggaatggaatggaatggaatttaatggaatggaatggaatggaatggaatggaatggaatggaatggaatcaacccgagtggaatggaatggaatggaaaagaatgaatggaatggaatggaatggaatggaatggaatggaatggaatggattggaacggaacggaatggaatggaatggaatggaatggattggagtggaatggaatggaatcaacacgaatggaatggaacggaatggaatggaatggaatggaaaggaacggaatggaatcaaccggagtggaatggaatggaatggaatggaatccacctgataggaatgaagtggaatgtaatccaatggaacggagtggaatcaactcgagtggaatggagtggaatggaacggaatcgaatccaatggattcaactggaaagcaatgcaatgaatttaaatggaatggaatggaatggaatggaatcatccgagtggaatggaatggaatggaatggaatagaattgaatggaatggaatcaacccgattgaaatggaatggaatggaatggatcggtacggaatggaatagaatggaatggaatagaatggaatggaatcatccgagtggaaaggaatggaatagaaaagaatggaatgtaatagaaacgaatggaatgcaatggaatgcaatggcatggaatgtagtaaacccgagtggaatggaatggaatggaatggaaggtaaaacaggaatggaatggaatcgaatgaaattaaccctagtggaaaagaatggaatggaatggaatgtaatggaatggaatcaactggaatggaaggaaatgcaatgcaatggaatggaatggaatgcaatggaatggaatggaatcaacccgagtggaacgcaatggaaggtaattgaatggaatggaatggaatggaatcaacccaagtggaatggattcgaatggagtggaatggaatggaacagcacggaatgcaatggaatcaaatagaatggaatggaatggaatggaatggaatggaacggaatcaacctgagtggaatggaatggaccggaacggaatggaatgaacacgagtgtaaggcagtggaatggaacggagtagaatggaaaggaacaggaaggaatggaatggaatgcaatgaacac

SEQ ID NO: 474194 - DNA, 4082 bp, Homo sapiens
gcagcagtgttctagaatcccatctgcaggacaaacatttagacactcgcagcagtgttctggaattctatgtgagggacattcaaaccccaacagcagtgttctagaatcctatgtgagggacagacgttcagaccccagcagcagtgttctggaatcctatgtgaggtacaaacattcagataccagcagaagtgttctggaatcctatgtgagggacaaacattcagaccctcgtagcactgttctggaatcctatgtgagtggcaaaaattcagaccacggcaacaatgctcaggaatcctatgtgagggacaaacattcagaccctagtagcagtgttctggaatcttatgtgagggacaaacattcaaaccacagcagcagtgttctggaatcctatgtgaaggacaaactttcagaccacagcaggagagttctggaatcctatgtgagggacaaactttcagaccaaaacaggagtgttctttaatcctatatgaaggacaaacattcagaccccaggagcactgttctgaaatcctatgataagggcaaacattcagaccccaacatgaatgttctggaatcctatgtgagggacaagcattgagaccatagcaggagtattctggaatcctatgcgagggacaaacattcagacccttgtagcagtgttctggaatcctatgtgattaacaaacattgagaccacagcaggagtgctctggaatcctatgtgagggacaaacattcagaccccagaaggagtgttctggaatcctatgtgaaggacaaacattcagaccctcatagcagtgttctggaatcctatgtgagggacaaacattcagactctcccagcagtcttctggaattctatgtgagggacagacattcaaaccccagcagcagtgttctggaatccgatgtgaggtacagacattcagacctcagcagcagtcttctggaatcctatgtgagggacaaactttcagaccctcatagcagtgttctggaatcctatatgaggtacaaacattcagaccctcatagcagtgttctggaatactatgtgagggacaaccattcagaccatggcagttctgaaatgctatgtgaaggacaaacattcagaccctcgtagcagtgttctggaatcctatgtgaaggacagacatttagaccctcgaagcagtgttctgcagtcttaagtgagggacaaaaattcagaccctcgtaacagtgttctggaatgctttttgagggacagacattgagaccccaacagcagtggtctggtatcctatgtgagggacaaacattcactcctcaccaacagtgttctgtaatcgtatgtgagggacaagcattcagaccccagcagcagtgttctggaatcttatgtgagggacaaacattgagaccctcgtagcagtgttctggaatcctacgtgagacacaaacattcgtaccacagcagaagtgttccggaatcttatgtgagggacaaccattcagatcacagcaggagtgttctggaatcctttgtgaggtacaaccattcagaccacagcaggtgtgttctggaatcctatgtgagggacaaatattcagaccctcattgcagtgttctggaatcctttgtgagggacaaacattcagaccccagcaggagggttctggaatcctgtgtgagggaccaacattcagaccctcgtagcagtgttctggaatgctatgtgaaagacaaccattcagaccctcatagcaatgttctggaatcctatgtcagggacattcagaccccagccgcagtgttctggaatcctatgtgacagacaaacattcagaccacagcaggaacgttctggaatcctatgtgacggacaaacgttcagaccatagcagcagtgttctgcaatccaatgtgagggacaaacattcagagcccagcagcagtgttcaggaatcctatgtgagggaccaacaatcagaccctcgtagcagtgttctgaaatcctatgtgagggagaaacattcagaacccagccgcagtgttctgaaatcctatgtgacagaaaaacattccgaccacagcagcagtgctctggaatcctatgtgcggtacaaactttcagaccacagcaggagagttctgggatcctatgtgagggacaaactttcagaccccaggagcagtgttctgaaatcctatgttaagggcaagcatttacatcccagcatgaatgttctcaaatcctaggtaacggacaaacattcagaccacagcaggagtgttctcgaatcctatgtgaggaacaaacattcagaccacagaaggagtgttctggaatactatgtgagggacattcagaccctcttagcagtgttctggagtcctatgtgatgaacaaactttcagaccacagcaggagagttctggaatcctatgtgagggacaaactttcagaccccaggagcagtgttctgaaatcctatgttaaaggcaagcatttacatcccagtgtgaatgttctcgaatcctagaccacagcaggagtgttctggaatcctatgtgagggtcaaacattcagaccacagcaggagtgttctggaatcctatgtgagggcaaacattcagacccacgtggcagtgttctggaatcctatgtgagggacaaatattcagaccacagcaggagtgctgtggaatcctatgtgagggacaaacattcagaacctcgcagcagtgtcctgaaatcttatgtgagggagagacatttaaaccctcgcagcagtgttctggtatcccatgtgagggacaaacattcagaccctcccagccatgttctggaattctatgtgagggaaagacattcaaaccccagcagcagtgttctggaatctgatttgagaggcagacattcagaccccagcagcagtgttctggaatgctatgtgaaggacaaacattcagaccacgggagcagtgttctagaatcctacgtgaaggacaaacattaagactctcatagcagtgtcctggaatcatatctgaggaacaaccattcagacaccagcagaagtgttctggaatcctaggtgtgggaaaaacattcagaacctagtagcagtgttctggaatcctatgtgagggacatacattcagaccacggcagcagtgttctggaatggtatgtgaaggacaaacattcagacccttgtagcagtgttccggaattccatgtgagggacaaacattcagaccacagcagcagtgttctggaatcctatatgacggaccaacattcagacccttgcaacagtgttctggaatactaggtgagggagaaatattcacacccttgtagcagtgttctggaattctatgtgactgacaaacattcagactccagcaacagtgttctgtaatcctatgtgagtgacaaacattcagaccccaagagcagtgttctgaaatcctatgttaagggaaacattgagaccccagcatgaatgttctggaatcctatgtgagggacaaacattcagaccacggcaggagtattctggaatcctatgtgaggagcaaacattcagaccacagcagaagtgttctggaatcctatatgagggataagcattcagaccctcgtggcagtgttctggaatcctatgtgagggagaagcattcagagcacagcaggagtgctctggaatcctacgttagggacaaacattcagaacctcgtaacattgttcgggaaacctgtgtgagggacagacatttagaccctcgcaacagtgttctggaatcccatgtgagggtcaagcattcagatcctcacagcagtgttctggaattctatgtgagtgacaaccattcagactccagcagcagagttctgtattcctatgtgaaggacaaacattcagaatccaggagcagtgttttgaaatcatatgttaagggcaaacatacagaccctagcatcaatgttctagaatcatatgtgagggacagacattcagaccctcgcagcagtgttctggaatcctagatgggggacaaacattc

SEQ ID NO: 474195 - DNA, 5974 bp, Homo sapiens
gggcatggaatggaacggaatcaacccgaatggaatggaacggaatggaatagaatggtatggaatggaattgaatggaaaggaatcaacccgaagggaatggaatggaatggaatggaatggaatggaatggaatggaatggaatcaacccgagtggaatgcaatggaatgaaatggaatggaatggaatggaacggaaaggaacggaattgaatggaatggaatcaacccgagtggaaaggaatggaaagaatggaaaggaatggaatacaatggaatggaatggaatggaatggaatagaatgaaatggaaaggaatggaatggaaacaacccgagtggaatggaatggaatggaatggaatggaatggaatagaatggaatggaatcaacccgagtggaatggaatggagtggaatggaatggaatggaatggaacggaatataatggaatgcaatggaatcatcccgagtggaatggaatggtatggaatgcaatggaatggaatggaacagaacggaatgaaattcaatggaatagattgaatgcgagtggatttgaatggaatggaatgcattggtgtggaatggaatggaatcaacaagaatggaatggaacggaacggaatggaatggaatggaatggaatggaatggaatggaatggaatggaatggaatggaacggaacggaatggaatcaaccggagtggaatggaatggaatggaatggaaaccacccgataggaaagaaatggaatgtaatccaaaggaacggagtggaatcaacacgagtggaatggaatggaatggaacggaatcgaatccaatggattcaactggaatgcaatgcaatgaatttcattggaatggaatggaatggaatggaatcatccgagtggaatggaatgaaatggaatggaatagaattgaatggaatggaatccacccgattgaaatggaatggaatggaatggaattgaatggaatggaatggaatggaatggtacggaatggaatagaaaggaatggaatcaactcgagtggaaaggaatggaatggaaaaaaatggaatgtaatagaaaggaatggaatgcaatggaaagcaatggcatggaatatagtcaaccagagtggaatggaatggaatggaatggaatggaatggaatggaatggaatggaatggaatggaatcaacttggagtgcaatggaaaggaatggaaatgaatggaatggaatggaacggaacggaatggaatgaacacgagtgtgagggaatggaatggaacggaatagaatggaaaggaacgggacagaatggattggaatggaatggaatgaacacgagtggaatggaatggagtggaatggaatggaattgcattcaacggaatggaatgcagtggaatggaatgggatggaaaggaatggaaaggaatcaacctgaatggaatggaatggaatggaatggaatggaatggaatggaatggaacggaacggattggaatcaaccggatggaatggaatggaatggaacggaatagaatggaaaggaacgggacagaatggattggaatggaatggaatgaacacgagtggaatggaatggagtggaatggaatggaattgcattcaacggaatggaatgcagtggaatggaatgggatggaaaggaatggaaaggaatcaacctgaatggaatggaatggaatggaatgcaatggaatggaatggaatggaatggaatggaacggaacggattggaatcaaccggatggaatggaatggaatggaacggaatcgaatccaatggattcaactggaatgcaatgcaatgaatttcaatggaatggaatggaatggaatggaatcatccgtgtggaatggaatgaaatggaatggaatagaattgaatggaatggaatccacccgattgaaatggaatggaatggaatggaatggaatggaatggaatggaatggaatggaatggaatggtacggaatggaatagaaaggaatggaatcaactcgagtggaaaggaatggaatggaaaaaaatggaatgtaatagaaaggaatggaatgcaatggaaagcaatagcatggaatgtagtcaaccagagtggaatggaatggaatggaatgaactgtaatggaaggaagtgcaatggaatcgaatggaatggattgcaatggaatggaatggaatcaacccgaaatggaatggaatgcaatggaatggaacggaatcaacctgagtggaatggaatggaatggaatgaatggaatggaatttattggaaactaatggaatggaaaggaaacaaaccgagtggaatgaaatgcaatgaatttcaatggaatggaatggaatggaatggaatggaatggaatgccattcaactggaatggaatggagtggaatggaatggaattgcattcaacggaatggaatgcagtggaatggaatgggatggaaaggaatggaaaggaatcaacctgaatggaatggaatggaatggaatgcaatggaatggaatggaatggaatggaattaacccgtgtggaatggaaagtgaaatggaatggaaaggaatggaatggaatcaacacgagtggaatggaatggaatggaatggaatggaatggaatggaatcaaccagagtggaatggagtggaatggaatgcaatggaatggaaggcattggaatcaactggaatggaatggaacggaatgcaatggaatagaatggaatcaatctgggtggaatggaatggaatggaatggagtggaatggaatggaatggagtgtaatggaatagaatggaatggaatgaaatggaatggaatggaacggaatcaaccagaacggaatggaatggaatggaatggaatggaatggaaagcaatggaatggaatcaacacgagtggaatggaatggaatggaaaggaataatggaatggaatggaatggaatggagtggaatggaatggattggaatggaaagaaattcaacggaatggaatcaacaagaatggaatggaatggaatggaatggagtggaacggtatggaaaggaatggaatggaaaggaatcaacccgaagggtatggaatggaatatggaatggaatggaatggaatggaatggaatggaatggaaacaacccgagtggaatgcaatggaatgaaatggaatggaatggaatggaatggaatggaatggaatggaatggaatggaacggatcggaacggaacggaatggaacggaattgaatggagtggaatcaacccaagtggaaaggaacggaatggaatggaatggaatggaatggaatggaagagcatgcaatcaactttcgtggaaggtggaatggaatggaaaggaatggaatggaatggaaactaatggaacggaatggaaacaaaccgagtggaatggaatgcaatggaatggaatggaatggaatggaatggaatggaatggaatacaaccaaatggaaacaacccgagtggaatggcatggaatggaaaggactggaatataatagaatggattggaatcaaccgattagaaactaatggaaaggagtggaatggaatggaatggaatggaatggaatggaatctacacgagtggaatggaatggaatggaatttaatggaatggaatggattggaatggaatcaacccgagggtggaatggaatggaatggaatggaatggaatggaatggaatctacacgagtggaatggaatggaatggaatttaatggaatggaatggattggaatggaatcaacccgagtggaatggaatggaatggaaaggaatgaatgcaatggaatggaatgggatggaattgaatggaatggaaaggaacggaacggaatggaatggaatggaatggaatggaccccaatgaaatggaatggaatggaatggaatggattggaatggaatggaacggaattaacccgagtggaatggaatgtaatggaatggagtgggatgaaacggaatggaatggaatcaaaccgagtggaatggaatggaatggaatgcaatggaaaggaatggtatggaatcaaccctagtggaatgaatggaatggaatggaatggaatggaatggaatggaaaggaatggaatggaaacatcacgagtggaatggaatggaatggaatggagtgcaatggaatggaatggaatgcaataacatgcaatcaacattggtggaatggtatggaagggaatggaatggaatggaatggaatggaatggaatggaatggaatggaataaaagggcatggaatggaacggaatcaacgcgattggaatggaacggaatggagtggaatggtatggaatggaatggaatggaaaggaatcaccccgaagggaatggaatggaatggaatggaatggaatggaatggaatggaacggaacggaacggaattgaatggaatggaatcaacccgagaatggaatggaatggaatggaatgcagtggaatggaatgaaatgaaatggaatggaatggaaagtaatggaatggaatgcaacggaatgaacccgaatggaatggaatggaatggattggaatggaatggaaaggaatcaacacgagtggaatggaatggaatggagtggagtggaatggaatggaatgcaatggactggaatggaatggaatggaataaacccgaatggaatggaatagaatggaatggaatggaatggaatggaactgaatggaataaacccgaatggaattgtatggaatggaatggaaaggaatggaatggaatggaaactaacggaacggaatggaaacaacccgtgtggaatcgaatgcaatggaatggaatggaatgcaatagaatggaatggaatggaatggaatggaacggaatgcaatggaatggattggcctggaatggaacggaatcaacccgaatggaatggaatggaatgcagtggaatggtacggaatggaatcgaatggaatggaatcaacccgaagggtatggaatggaatgcaatggaatggaatggaatggaatcaacctgagtggaatgcaatggaatgaaatggaatggaatggaatggtatggaatggaatggaatggaatggaatggaaacaatgcaatgcaatggtatcaaatggaatggaatgcattggaatggaatggaatggaatctccctgagtggaaagaaatggaatggaatggaatggaatggaatggaatggaatcgaatggaaaggaatggaatggaatggaaactaatggatcggaatggaaacaacccgtgtggaatggaatgcaaaggaatgcaatggaatggaatggaatggaatggaatggaatggaatggaatggaatagaatacaaaaaaatggaaagaactcgaaatgaaatggaaaggaatgaaatggaaacaacccgagtggaatggaatggaacgcaatggaatggaatggaatcaaccatagtggaatggaatggaatggaatggaatggaaccgaatataatggaatggaacggaatcatcccgagtggaatggacagatatggaatgcagtggaatggaatggaacaaaacggaatgaaattcaatggaatagattgaattggaatggaatggaatcaacacgaattgaatggaacggaatggaatggaatggaaaggaaagaaatggaatcaacccgagtggaaaggaatggagtggaatgtattggagtggaatggaatggaatcaacacgaattgaatggaacggaatggaatggaacggaatggaatggaatggaatggaaaggaacgaaatggaatcaacccgagtggaatggaatggaatggattggaatggaatggaatggaatgcaatggaatggaatggaatgaacccgaatggaaaggaatgaaatggaatggaatggaatggaatgaaccc

SEQ ID NO: 474196 - DNA, 2672 bp, Homo sapiens
ggaacggaatggaatgaacacgagttggaatggaatggaatggaatggaatgaaatggaatggaatggaacggaatcaacccaaatggaatggaatggaatggaatggaatggaatggaatggaatggaatggaatcaacacgagtggaatggaatggaatggaaaggaacggaatgcaatggaatggaatgttatggaatccacccgagtggaatggtatggaatggaatggaatggaaaggaataaaatggattggaatggaatggtatcaacccgagtggaatggaatggaatggaatggaatggaatggaatggaatggaatcaaccagagtggaacggaatggaatggaatggaatggaatggaatcaacccgatggaatagaatggaatggaatggaatggaattgaatggaatggattggaatagaaagaaattcaagggaatggaatcaaccagaatggaatggaatggaatggaatggaatggaatggaatggagtggaatggtatggaaaggaatggaatggaaaggaatcaacccgaagggtatggaatggaatggaatggaatggaatggaatggaacggaacggaacagaacagaacggaactgaatggaatggaatcaacccaagtggaaaggaatggaatggaatggaatggaatggaatggaatggaatggaatagcatgcaatcaactttggtggaatggtatggaatggaatggaatggaatggaatggaatggaatggaataaaagggaatggaatggaatggaatcaagccgagatgaatggaatggaatggaatggaatggaatggaatggaatggaatggaatggaatggaatggaaatgaataaaaccgagtggaatggaatggaatggaatggaatggaaacaatgcaatgcaatggtatcaactggaatggaaagaattggaatggaaaggaatggaatcaccttgaaatggaatggatcggaacggaacggaatggaatggaatggaatggaatggaccccaatggaatggaatggattggaatggaatggaacggaattaactggagtggaatggaatgtaatggaatgcagtggaatggaatggaacggaatggaatggaatggaatcaacccgagaggaatggaatggaatggaatgcaatggaatggaatggtatggaatcaaccctagtggaatggtatggaatggaatggaacagaatggaacggaatggacttaacccgaatggaatggaacggaatggagtggaatggtatggaatggaatggaatggaaaggaatcaacccgaatggtatggaatagaatggaatggaatggaataaatggtcatggaatggaacggaatcaacccgaatgggatggaacggaatggattggaatggtgtggaatggaatggaatggaaaggaatcaactcgaagggtatggaatggaatggaatggaatgcaatgcaatggaatggaatggaatcaacacgagtggaatgcaatggaatgaaatggaatggaatggaacggaatggaacggaacggaattgaatggaatgaaatcaacccgagtggaaaggaatggaatggaatggaatggaatggaatggaatggaatggaatgggatcaacccgagtggaatggaatggaatggaatgcaatggaatggaatggtatggaatcaaccatagtggaatggtatggaatggaatggaacggaatggaacggaatggaatcaacccgaatggaatggaacggaatggagtggaatggtatggaatggaatggaatggaaaggaatcaacccgaagtgtatggaatagaatggaatggaatggaatggaatcaacccgagtggaatgccatggaatgaaatggaatggaatggaacggaatggaacggaatggaacggaattgaaaggaatggaatcaaccgagtggaaaggaatggaatggaatggaatggaatggaatggaatggaatggaatgaaatggaataacatgcaatcaactttggtggaatggtatggaatggaatggaatgtaatggaatggaataaaaggtcatggaatggaacggaatcaacccgaatggaatggaacggaatggagtggaatggtatggaatggaatggaatggaaaggaatcaactcgaagggtatggaatgcaatggaatggaatggaatggaatcaacacgagtggaaagcaaaggaatgaaatggaatggaatggatcggaatggaacggaatggaaatgagtggaatgaaatcaacccgagtggaatggaatggaatggaatggaatggaatggaatggaatggaatggaatggaatggaataacatgcaatcaactttggtggaatggtatggaagggaatagaatggaatggaaaggaatagaagggcatggaatggaacgcaatcaacccgaatggaatggaacggaatggtgtgaaatggtatggaatggaatggaatggaaaggaatcaacccgaagggaatggaatggaatggaatggaatggaatggaatggaataaacccgagtggaatgcaatggaatgaaatggaattgaatggaatggaacggaaaggaaggaaattgaatggaatggaatcaacccgagggaaaggaaggagggaagg

SEQ ID NO: 474197 - DNA, 901 bp, Homo sapiens
cagaatcaacccgaatggaatggaacggaatggagtggaatggtatggaatggaatggaatggaatggaatcaactcgaagggtacggaatggaatggaatggaatggaatgcaatggaatggaatggaatggaatggaatcaacacgagtggaatgcaatggaataaaatacaatggaatgcaacggaatggaacggagcagaattgaatggaatgaaatcaacacgagtggaaaggaatggaatggaatggaatggaatggaatggaatggaatggaatggaataacatgcaatcaactttggtggaatggtatggaagggaatggaatggaatggaatggaataaaagggcatggaatggaacggaatcatcgcgaatggaatggaacggaatggggtggaatggtatgcaatggaatggaatggaaaggaatcaacctgaagggaatagaatggaatggtatggaatggaatggaatggaacggaatggaatggaatcaacccgagtggaatgcaatggaatgaactggaatggaatggaatggaaaggaacggaacggaattgaatggaatggaatcaacccgagtggaaaggaaaggaatggaatggaatggaatggaattgaatggaatggaataacatgcaatcaactttgatggaatggtatggaatggaatggaatggaatggaaaggaatggaatggaatggaaactaatggaacggaatggaagcaaccccagtggaatggattgcaatggaatggaatgcaatggaatggaatggaatggaatggaatggaatggaatggaatacaacaaaatggaaagaacacgagtggaatggcatggaatggaaaggacttgaatataatgtaatggattggaatcaacccgatt

SEQ ID NO: 474198 - DNA, 886 bp, Homo sapiens
aaacggggtttgagccctgaacgtagaaggaggtaaactgccaagctgcagtaacaaacgtgcttttcagaagctgttcagaaaggccacgctactcatggttatgaataatgctactcccaaccaccggctcctgagccgcggcaactccgtgtcaccttttcaccgccccccacctagccccaaatccccaatccaggcccaaatccccgctccaacccccaatccgcgatccaatcccccatccgcgatcccaaatctgcgatctagcccagaatccgcgatccagccgggtccaccacagccttcagcagcgacactcccagcttccgacctcttagatccactgagcctcgcaagggcattagcagcgcccttgcacggcgggggccgcccacctcccagaagccgctcccaggcggcgcgccggcaggtggggctccagcccggggcagtcgccgctgggctcgcgggttctcctgagctgaaacaaatttgggcacattgagacatgttttcttttcaaaaagtcctagcactttaattactgtgtaaagagatattagtgtataattttcacacatattgactaacatccctgcaaaatgttgaatcaatttatactttcagcaccaatcggcaaattaatgtccattatgctttcgcttcaccaaaactgatacctatattttattttgctagacaaaaatacatattatcttaatttgtgtaactgtatttaatagaaagattaaatttttttcagatgtatcatagggcatcattttttcttgagtctggtgcgtgcttagttcctttaaagcattaatcatgtatacattaattttatgtgcaaaacaatcattaagtacaatttgaaatatgg

SEQ ID NO: 474199 - DNA, 1156 bp, Homo sapiens
attgagttgctggaggccaagcttgtcctaatttaccaactttcctaagctgatcacctccagatgagcactgtttgccaatgcgtctccactgcccaaattaatccaactcaaccaccctcggtcattctggagtgtgcatcctcgtgcccagcagttcacactcactcttcgaatggtctaacccaactcaagccctgccttccccacgaaggagcttctctgcaggctgcggaattggcgtgcttgcagcggcacggtccaggcctccggctctcaggcttcactgtcctgcattgctctcatttcctgtatcccccggggcttcgtacagtcactgcccacctagcagagcaaggacaaaggtcagctgatgacccttacgtgagcacagacagcagctttgcttccacccacctcaccctccatcgcccaggacctggtgctggggactgagcaggacactggaggggatgaccacatgctgttttgaccttagcacccctacaaagacagggtgatgtgtgtatatgtcaataaagtttatttttaaaatgcagatcactcaccaaagggggctagacaccaggatggctgacatagcacagtgatccccctagagagaaagctgccaaggccaggccctccttcccaatcatgacctagaaacagctttcctccactggccttccccagctccacactgtgactgtccacagtggaaactgcgagtcacgccctgctgtaacaggcattcaaaactagttgcctatgtatttataggtctatattaatgtcatcgatatttataaagttggacgtgcaggataaatcactgaggaagtcagaggcagggccaagactaaaattcaagtcacacaacagcactccatggaaaatctacatactcctatgataaagttctactagacagtccagatacatcatcccctaatttgtgggtatgtaagcaaatgtgaagcatgtctctaacctggtcattcactgtgctataaggcccactgccagtgaataagttcagcagttactcttcaaggatatatggtcttttttgaactttaatgctgcctgttttgggtgagaataacatgaagtgagagtcaatgtttcatatttagtaggaattaacttattc

SEQ ID NO: 474200 - DNA, 1144 bp, Homo sapiens
atacaccctgcaggtggctggggcatgagaagcgttgagttgcctctgggtgacagggggcctagagcccttgcatcttggctgtgtgtgtagtgtagggtgtgtgggtgctgcagagtcttgagctaagagtttacgtattccaagacaacgcacatgggacatgggacttcctcccccgtgctcctcctgtcctccgcctccttgatgagctggacgtgcggggagaccccagacctggcgcatggctggttttgctctgtgcctgcacagaccggagatgcccttggtgacgccgtctgctcctcccgtgctttcagacacaggggcctagagcccttgcatcttggctgtgaccgtggccttcgatcgagcacagtgggtgagggccttctgaataagaagggcaccgccacaccctgtggggccgatgagcaaattgacgactctgctttctcttggtccgtgatggaagaggaagcccgaacgcacgcctctatcagcaactctgcagcaccgcacttgccactcggagaaaatgctttgaaagcccagacagccacataccattagaaacagcttgatcttaatccatgttagcatttccatgtgttttctctgtaaaaggagcgactttggagctttgcagattggaaaaataagtagggtgaaggaagggtgagacctgggtgagcccagacccgggggtccaggatccaggccctcagcatggactgcccatcccccaggcagggggcctttgacggcccaggcagacaagtcaatgcagcgtgtgctggtgtgtgcatgtatgtgtgacgcgtatgcacgtgcatgcatcatagtctgtaatttacacatagcgagttgcttctccccttccgctggtcgttgtttccttcattcccttgggcctgatgttgcacagttgcttggtggaattcccgctcatttcccagtgagagagcagaagaagtaatcaattgatctccgtgggatttggtctaagtgaagaaagcacaagtgagaattttacatcaccctttggggaaaggttttggtccaagaattttataatgaccgtgtttgggtgtggatattgtgcccagcaatgggaaaacatgatgttttgatgaggggttac

SEQ ID NO: 474201 - DNA, 1142 bp, Homo sapiens
cagcagtgattaccaaccaggatgtcttctccagctcaggccaccatcagtctcgggaatcccagtgtggacagggcgctgcgtgtccccaaggctgccgcgtgtccccaaggccgccctccctgggggatggtctggcttcaggaccggctgctgacaggggcttgtgctcagaggggcctcagcttggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaaggtaatggctaggctctctcagatggcatgggaatggcttaattcctgtttgccccgggaatactcaccagcagtgcttacagctgcagcattcaccccgagataactctgccatgaaatatcttgcttttattattattttcgcatcactgtggtatattgactttggaaacagaggacacaattctacttatagcattctgcttttagtagtggtatttccatttacaaaatatagtgattctcaatcactgaaaatgtcaaatcctagaaaacagcagtcccacgtgtgttgttaacattgttctcgaacaagttgttggccgacgattcatttgctgaacctgtttttctgaaatagatgattctgatgattcagacagttctgatgttagttctgtttagaagtaattccaagaacagtttttatattttgttttcatattgaaaatcagttagatttgcttcagccccaaagagcttgtttatgtaaaattaaatgagtgccggcagtgagctgccgtttttttcttcgaaacgggaaaagggtgaaggcattttttaaaggctggatggtcttcagaccacagggactcttcttgccaagagggaatggctggctaacc

SEQ ID NO: 474202 - DNA, 1994 bp, Homo sapiens
ctggcaggaggaaccgccttgagacgggcatctgtttcctctcagcgtggggacctcctcacatggcctctttccccgcaggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacaggattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcggtgcctctgtgtcacagcgaacgctcccatgcaggcccttgttcgtctccaaccccacttggccacatggagcacaaaggcttcgtgttcagggccctgcttgggggacaagaggaggggagagccagcaccttccaccagctcagcctggtactggacacaggggcctgggccgcatgggcctgggagtgcagggtggatcagggaagctgcctggaggggccggcggcttcagagggagcccgtgccggctctgggttggggaagtggccttctgggaaggggctcgacctagaaaggaggccagcgtcgttccaaggcttcttagacggccacctggaggccgagcgttggcagcaggggggtgtctgcaagggggatgggcggtgatcagtggctcctgtggcttctcggcagtttccctgaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtggggggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacagcaggcactgccattgcctggccttgctgtgtggccagctctgggctctgcaggatttccaggcgagtgctgtcatggacctgggttttggggaacaaatgaggtgcccggtcctcgacttccacggagcctgtggaatctgcgactgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatctgcttgttcctgctctcatctgagctgttttcctgggtgaccaagctctgagcgtctgcaggacgtggatagagaagcaacacaaggaaggctgattctgttcatgtctgttttgctcaaacactaga

SEQ ID NO: 474203 - DNA, 2038 bp, Homo sapiens
ggtgactcacatggctgggcaggggtgtgtgagagagggagactcacgtggctgggcaggggtgagtgaggaggagactcacaaggctgggcaggggttagtagggggtgactcctatggctgggcagaggtgagtggggagaggctcccatcgctgggcagggatgagtgaggggagactcatggctgtgcaggggtgagtgagaaagggagactcccatggctgggcaggggtgagttgggggagactcatatggctgggtaggggtgagtggggggagactcctatggctgggcaagggtgagtgagaggagactcatagggctgtgcagggatgagttggggggagacttacgtggctgtgcaggggtgagtcgggggagactcgcatagctgtgcaggggtgagtgggaggagactcacgtggctgtgcaggggtgagtgggggaagactcgcatggctgtgcagggataagtgagcaggagactcacatgtctgggcaggagtaagtgaggggtgactcacatggctgggcaggggtgtgtgagagagggagactcacatggctgggtaggggtgagtgaggaggagactcacatgtctgtgcaggggttagtcgggggtgactcctacggctgggcagaggtgagtcgggagagactcccatggctgggcaggggtaagtgagaggagactgacagggctgtgcaggggtgagtgagagagggagactcacatggctggacaggggtgagttgggggagactcacacggctgggtaggggtgagtggggggagactcctatggctgggcaggggtgagtgagaggagactcacagggctgtgcaggggtgtgtgagagagggagactcacatggctgggcaggagctagtgagggtgagactgcatggctgggcaggggtgggtgagggatgaggaatggaggcaaagagcagattgctccttagggacctgggttgctaatggtaagaggctgctgaggaggctcctggttgcagagaagggtttgttttcgccttgtgcaagatgggcaggtttgtgggctggagggcaggaggcgaagacacagcctggatgagggggaggaggaggggcttgggaagcaatggggaatgggtcgctgtgagcagagggccctgccagcttcggatggaggggcagtggtgaaggagggaacgtgagtggacagatgttagggctcagtggggggtgcggggtgcagggttgggcccgctggtggagtggaagtcggtcatgagggatgtgccaggggcccagtcctcagtgcggtcagaggagagagtcctaaagctctgtgactgagagagcttgtaaaatgaaacgatgggcgaagaacggatggacagcctcaaacagaaacgaagctgggtttatatccttaatgtcaggtaaggctgagttcagggagaaacacaccaacgaagaccagaataggttctttagaataataaagaatgcaattgacaacagatatgtcccaactacaaatatttatgtaccaaaaaggtgcttcaccatgcatagggtgaaaattgtgggagatacagtgagaggaaagaggaaatcatggaccatcaaagagtgccttaaagagaatagacttttaaaagtcacaaataggactcaggtggaccctaagtttggctgcctgccaggagctgctgaacgtggccctgttgggtgcgtcattgtgtctggaggccttgggtgtgtctgtattgtgaacaaatgtgactgtggaaggtgtcctgctccatctgacagcaagttctgtctcctttgggcttctgcaaaacatggacatttgatcaaacgctgcttaaatgtcggccatgttttggatgctcgagtggccatgcgtgttcgtgtgtctgagcgttgaaactgcagggacttggcgccagtggagctggcagtggcctccactggccagtagggaccaatcgttaaacccactcttggtccaaaattgaattattttaaaaccaagag

SEQ ID NO: 474204 - DNA, 596 bp, Homo sapiens
ttgccaggttatgggacaagaatgtgcttaatgctagtggatgctatcaaccagttttccaaatttttaccgacttatactcttgcctgcaatgactccagtcacacctgtgttggcattgactatatcaacataatcatatttacaagcattacttcccagtctttggctgctcacttccttctctggagcatggcccctgaacacacagctgtttccagaggggaggagctgctggcattgtctgcaggcatctccatgaagcccatcatcggtgtcatccgcccatgctcctgcagcgcctgcccttggctggctcctgtggcttctccagccggggcagctgaggctgccagcgcctctaacgagtccaaagacagcgaacacagggcccagtgcttcactgctttgccctgaggccggctgtgctgcccttccatattctgatctttggagaacctgcccaggcagtgtgatttagtgagcgggagtggctatgaaccacattgacacgtggctacgagccacagtgatgtgtgaaggcacgcctggaatgtatgcccctctgttttactggacagtgcaggcgaatttgt

SEQ ID NO: 474205 - DNA, 1727 bp, Homo sapiens
gccaagcacaataacctcgcccccacccaccccatgagctctctttccctggctcggaatcgctgcaggcgccacagaccagacgcgcactgttccccactcctgcttatcggccgcgcggcatccccttgtcgcagcactccagcatccatgcagccgcgcggcaccccgtcttcggagcactccagaatccatgcagagcgcagcaccccacatccagagcgctccagaatccatgaagcacgcggcaccccctcgtcagagtgctccagaatccatgaagtgcgcagcaccccttaatcggagcgctctagaacccgtgcagcgagcagcaccccacacccggagcgctccagaatccatgaagccagcagcaccccacacccggagtgctccagaatccacgcagcacgtggcatctcctcgtcatagcgttctagaatccatgcagcgagcagtaccccacaccgggagcgctccagaatccacgcagcaagcctttctggaaccccaagcagaaggatatccaaaatgtaaaaacggtggggcctgcaatcccacggagcaccccccactctcacggtgcccaggtcgtcccactcagcacggacattctgcctccagccctggggcctccaggttatacccaaaagaggtgactcttggggacgtaaggtgcgtggggtgccatgaaccctcccaaggctgcagcctcttgggcaaggagtccacagtgctgttgccagccaaattggctgcacccctgcacgagggggctgatcttccccacaccaccactgtggctggcatcgcagtaggccaacagggacaaagacagctgcacagcgagaagcagcaaatgattcctgtgcctgagtgtggtcttggaatggcagagagaacccttgagcctgggagccacctggaagggaacaaggccgtctggcagccacctggcaggacccatggcattgaagatcagatgtgccagccacaccttggtgctcgcaaccactgaaacactgtctgtctctgtgggtttccctattctgcacatttcatataaatggaatcacacaacacatggctttttgtgatcggcttctttcacttagcataaaacacacttcagttttgaaaacaaaataaaacctaaggaagaaagggagcatgaactctaaatgcagtagaaaactatggccgaccaaggggatgcggctctgacctcacaggggaatgagctttctcagcctgcaccttgcttctgcagctgtcggcaaccctctgatacagccattataattgtcccattttgctgataggaactttgaagccccagggctctctaactctttccaatacatgacagtgcctctcgagcccccaagaaggaggactgaggggagaatttccagcctccacagctgtgtcacagcccagggccctgcagggcctcagagcaaaaacctagtgagcagggaggcttcttggccactggagatgcacctaccactcagctgtccctcagagacgacctgctgcagggacccaggtcaccgacagccccgcatccagcatgacatccacgccaggcccacttccctgaggctgctcccaaccagggcattcccaccagacacagggtccctcgaggggcactctgctttggggactccccatcagcctgcgggaggctcttcctccccagtccttcccccactcatttc

SEQ ID NO: 474206 - DNA, 1599 bp, Homo sapiens
gcctgcctatttcactggcaagggcaggcccccaggggtttctgggagaggagcgagggttccagattcactaagtcagggctggcagcgacttcatagagcttaactacatgaatgccagaaccgagctgaccgaccccgtctcctataattgcttctcaagccatctctgttacctggaccagccaggcagggacctggaggagcgcagggagccaggagggcaggcagttgacttgagggccgcagcggctgtcctggttaggtcgatggccactgggccctcccgccaagcctcaccggctctgccatccatgaggtccctgcctgcactggatagggattattggagcctctgcagggaaagggaacagaagggaagggaaccaggggcaagcagaggagacgagaagcagcaggagaccccaggaggaaggggcagggaggcaatgattgggggagaaaatggaaaagagggcgaagggaaaaggaagccttgttttactcaaggggtgggttcaaatgtcaccagctgttgctccagggcccctggggggaccccccaaaggaggaggaagggggtggcccactctgagctatcttgtggtggcacgtggttaattaactcactcatagtgctggagccagcaggagctgtactatcggtaacagatcagagtggcccacggacccccaagcccaggcccatggcaaacacaacggaagttgcttcagaatgcctgctcaaggatccgaagggcaatgtaggaactggttcagaaactggggccttcatggatcagagaatttctgaaggaggaaatgggattggagtaccagcatgagaagaaagttcccagaaagacaccatgggaaacacaagtgcccacatattaaagacgttcctgcacctagagcctcatgccaagtggcctgcagacaactgcctgagaacaaaagtctgcagaccagaaactgcccgaagaggcatgaaaccagaagctttcacctcatccggcacccaagaaggccccagtgccaactccgggagcagaacctccacactcttcacccgggaggcacagaaaattcacatgcccctggagagcatgccaaccaccctttccaggaatccactggcctgatttggcttttccgccagtgtggccagggctggctgaccctggaacccataaactaagtgtactgggggggacaaacgagagaggacacggcagtctgggaaggataaattcacaaacatgagcatccgtctccgccacctgattatcttgagtgtttctgagaccccgtgttgctaacaagggccactgttcattgagctgatgatatgttgtaggtaagactgagacacagctgagacccaaggcagcatgtggcctcctcgcaaagcaggcatccggagagttgatgtaaggccacatccgttccttgaagaagcacttcctaatactcccatcttccaataggaagctagtggcactggccccaacccaccctggagggcagaggccttggattttctggggtgacaggagtgggctattgggtgacacatttgctaaggcaattggcttc

SEQ ID NO: 474207 - DNA, 574 bp, Homo sapiens
gagggtgagatggacatgaggcctggagatgaagatgcagacgtcctccgggaagagagccgggagtatgaccaggaggagttccgctatgacatggatgaggaggccacagtgcacatggcattcttgctgtcctggagagttgcctttgtcttgctggagcgtgtacgccctttccctgcagtatataagccccaggtctggggagtaacagtgcagagagccacctgtcctgtggccgcccagggccacgcttccatgtcaccgccctgcatcaatgccttcctgagagggggttttgggacctccaccttggagaaacccttcaactccacctgctcttcccccagctgggagctgctgctgctgctatctgaaatcatggtggagccatggttcagggttaagaatagttctggacagaaatatcgttacaattaaacattaatcaggctacactttgacccacttccttgtaagggaaagtcccatagcatgagataccaaccatctgcaccccactgttcctctagacaggaacttccctgctgttagaatcgtaaggcttctgttt

SEQ ID NO: 474208 - DNA, 710 bp, Homo sapiens
cagcctcacagggtgacctgcttcagctcccaaagccatgctgtggctgaccagggtcaggacccagacgaacgaagccactgacgacccgacaggccacgtgacttggcacagcgcagccctcaggatcagggtcctatcagagccctctggggatgctggttactgccgaggaaacgagaaatacatgcctccaaattatatgaaaggcaagaaaaccacccaagtgccagtgactcacaggagctggggtgggttcaatcaggatagggaactcctggagggccttcaactgggcggcaagttgatggcactgctgtcaccctgcaggaaagacccggctctcttccaaagcctccccagccatttgcaagctcagcgtgggaagcaggctgggctgagcacgtccagggctcccaaactacgctggagccaaaatccaggactcccgcctgaattgggatccttggagcggggtgctggagggaatgctgcggcctctcaggtctgtgaccgcgtccacgccaaggcttgctgcatgcaacccgtaagctgagagttgccaccatccagacaccaccctgtgcagcggagtggggcagggcaggactgagagacggtgtctgccctccagaccaccttgcaggcccatgctgtggggctcagtctccctcaccctggggcatggatcaagcaggcctgtcccctct

SEQ ID NO: 474209 - DNA, 2611 bp, Homo sapiens
gagaggccgtggagtggatctagatggtctacaggggatgcccagtgaggctccgggcggcggcaccttccgggcccagcatggctcccatcgcgccttcctctgccgtgtgctgcagggccttggccggcatctccacgtgtatgggcggctcgctggggtgcagcccagatgcctcctgggaccgctgtgccttcaccgggctgcgcttgtgcacttgtctgtttacaagcagagccggccgtgggggaggcgaggtgcccaggggtcacaggactgccaaacacgtcccttcctctacctgcaggcagcagcagcccccatctccgtgtgaccgggacgcccatccctgccagagggcccgtgcccgtgtgaggggttcaaagcgctgctgtcactggcctctatctctgggaccccatcaccctattgttcctatggctgcttgggagcccaggacggcaagagcaccccctccagccccatcccacggaggaccctggcactctcaggtggagcccttcatgggtgcacgtcgaggacatctggaaaaaagcatcaccagtaactgtgataaagacttcggaacagtcgcactatgtgcacacagaggctctttcaaatcaatgaaagagctctgcaagggtggggcggattccacggagctgccagcgagccagcgagcgtggacctcactggaaattccacgcatgcaaatgaaaagaacggtgcaacaccgtctttctctatcaggagcaaagattgaaaagaactttggggcttttcctccgcaggttgcctgaggctccagctttgcctgtaagagggctggtctggggggacatctgaacccaattcaggaacacctcacaggtctgccagcagggctagacccggggtgagatccagggcaacagggtctgcctgggaagctcagctccggcactgcctggggcgtctctgcctacacaggaccattcctctcgcctggactcctcttggagtttgccaaggctggcctctgcagaaataggagactcctggaggaagacagtggacttcagcaagctgcaccaaggagaatccacagcggcagctgccctgccaggcgcgggatctcggtcaaggtggatcaacacagcctcaggtgtgtgctctgccccactgagatggcaagtgcattcttttctattcctacgaggaaagagcatccgaaagagcctgccttcacataggatgaataacagtggaccttggctttgcctcagtgttatgtgctaataaaccatgtattctatgccctaaggaagcccagagagaactggacaagctggatatcccaaagagcatggcactggcccaccacattgattacattgcgctggccgggtgctaaccaagaagcagctaacacactgggagtcttggtaagatgcctgagtgcctgcagctggcagacaaatcctacaaagattctgggaactgccactaataacactcttggtggggaggtcccatatcccataaccaggagcatactgggcctcctgtccacagcaaagagccaattactgcatcttgcatctcccatgaccaagagagacagacaatgccagtacgccttctggaggcagcacgttccacacacatgaagactactccagcctatgtaccattgataggagaagctgtcggccttccctgagcctgcagcaggtcgaggctgcagtgctggcagccctgtgactcaggccctgcagctggtcggaccctgtgttatgagaggtatcagacgtgggaaagcaatgctgtgtgtttatggcaaaccactatgccagaatcacagtgcaggcccctgggattcagaaacaaagccgtgccatctgcggcagaggattctgcgaaaaattctgaaaagtccctgttgatgtgctcctggggcctggggtgatggaatacctgattgtgcatgtggaactgctcagatgagctggattctgtctcacccctgggtcatgaggttggggactcagaaataacccatcacaggtgggagtgtgcgtgtggcagcagcagaagcaggagcaggaggccaagcagcggcagctgcccagtacccccccccaccctccacagcagtccccacagccccagtggaggaaccttctggtgaactgaggagggagggacaagcccggcctcagttcatggaggtgtctgctctgcctgtggggccagcccaaatcgcctggctgccatactccagtctcagcaagctgccctttaaagagggtgatatggtttggctctgtgtccccacccaaatctcatcttgaactgtaatccccaggtgatgagggtgagacctgatgggaagtgattggatcatgggggctgttttccccatgctgttctcgtgatagtgaaggagttctcatgagatctgatggttttataagtgtctggcaattcccctgcttgcacttgtctttctcacccaccaccacgtaagacgtgcctgcttccccttccgccatgattgtaagtttcctgaggcgtccccagccatgcagaactgtgagtcaatgaaacctcttttctttataaatta

SEQ ID NO: 474210 - DNA, 567 bp, Homo sapiens
ggtgtgatcgtagtcatggcggcagttctgaagcacacacagatctaccttatcttccaagggctgttcctgaaaggctggcaaagccaactttccccatttgctggcgagtgccactgtgttcacagcaacttgggtgcttctcagtgggaagcactggccccaccggctaacgcttttgccattgcccgtgagtctgtaaacacgcaattgtactttcagccaaccctactttcgtgtgaagcatttcgtggcattctgcccccaggaggattttccttctgcattgtctttgagggtcacctgctgggtggcagtaccttggcccccacttctcacttgtgtagcctacagccagaccctctgctaactgggcctgccctccccttctccatttgctggccagagaaacccctgtggccacaggtgtggtggagggagggctagtgaaggagcgggacagcttctcttaagtctgagctatgtgtcttccaggtgaatcaggccagctctcccatgtgaaaacttccactctacaatggaattctgttgcacgtatccaagttt

SEQ ID NO: 474211 - DNA, 2122 bp, Homo sapiens
ggctggctggctctccaaacttccatgcacatgaacgttggaaccacacaattcagcaccgcatggcaggtggcttggtcagcttcttcactgctgggggggaggaataggaacctgggctccttggagaaatggctgattctacaattggggcaggaaatatacaagatgagcctggaatgccctgtaagtgccagaataaaaagaagtgctcaaaaacacaggaaggaaaacaggctcacttatggggtgtgtcacagggccacaggatccaaccgaaggagctcccaatggccaatgctggaacactgggagcaacatttagtaaagttgtatggaattgtagcccacagtatgagtccatacagaataaacaaaaatggtggaagagacaaatacgtgggggagaagaaacaaatgtcccatgccagattccaaatgacgtgggcagacgccccctcgaggaggtgctgtggaccccccaccctaagcgtgggctgtgcacagtgactcccttccagagcacacggcctggagatagggagagagagggtgaccttacagtggggaagcctgactcacagcacctcagccaggtggccaaggtcaacgtcaacaggaaggactcctttggaagtgtgtgcctttgacatgatttggccacaatcgccctgctcctttgtggtcttccccctcaaacacccttaaccccagtctaatcaggagaaaaacatcaggaagatactaactaagggacagtctacaaggtacctgactaggcttcctcaacactgtcaagatcatcaaaagcaaggaaaggccaggaaatcgctacagccaaagggagctgaggacacagaacgactaaatgtcatgtggggtcctggatgggatcctgggacagagaaaggacatgtttaacaaaaaggaaatctgaataaacatggacttcagttaataataaagtatcagtattggttcatttattttaacaagtgtaacttcctgaaggaaggtggtaaaactggggtagggtctatgggaactccatgcactatccttgcaagttttctgtagatctaaaatagttctaaaataaaaatttgattttaaaaatataattagtgaattaaacctgccactcctgggtattactgcttagaggggaccccaccatagcactcagggcacccagtccccccactgaaatggctcaccgggggcccagctctgccctcagggttctctccagaacatttctcatgaagttttcgggaagttactctctttctaccaaggttatgaggctggtagggtgtgagctctgggcagccagccaaccctgatactggccatacgggaggggaaggcctttgggggaggggaggggagagagggaaattgagtccctgattctacttggcgtctaaagccagatcaatctctggactatttagttatgagtcaaaacatagcctttgcttaagtttatttgacctgagcttccttcttctgtagctgaaagcattctcacacacctgagatacgagcaagatttgctagtcctgtgttttagacaggaaaagaaaaaagctttggagagccatgtatggtgtcatccaataatgaactgaaatttgtattgggcacctcatcagtgaaaagctcaaatctgtttgtttctgaagcaccgggcttccctgtgcacagtggccaaagctccttgttctttgtttattaggatggttgaggaccggcttgccttaaaataactaacgttttgctggtgggctattagatttgctcctaccactgtgctttgaaagggagtttatctgaaagcagcaatggccacgaccgcccgccccccgcccccccccccgccgtccaccgatgtgtttcagaagcacagtcacagagctactcccgaacaaatgtcaaataaatgtagactgtggttgccaggaagacagccttggaacggtgctcgttctgtgcccacagggcagcccagtgcatgctttggctgtggggtgagcaggacccatgaaggctgcaaggaatgacacggggggagggtgctccaggcctctgcaattcttcggagatttcagctgccccc

SEQ ID NO: 474212 - DNA, 957 bp, Homo sapiens
ctctctggaaaacagcaggtaaccagtttaggcgaccgagctaagggcctttacacctcctccttcttgagccttggactttggtgcccaccttccatggggcagacaaagggtggtgccctgctgggaccggagccctgcctggaagccagagtaaatggcacatccattttggactggtggctgctcttgcaggtgctggagctctttgtcctactggtgcagctctccagcgcctccgtcactctcgccaacaggtttgtcacggtgcaggtgttttcttttcctctcctacaagctgacctagtggagctcgctgggggaggtcaagtgtctttcgtccccgttgcatcacaggacagtctttattattagccaagggagggggtaggtgggggagaagccaatcaagcctttggagggtctgcagctgaatcggcactcagacccccgtggtgtgaaatggggatggggggacgagtgggcgcagccactgggagcattgatggaggtgaagagaggggagcgaagcagctgagcagttccaaaggccgggaaggtgccacctgcccagtgagccgtcgggatgacccagggcaggcactgcagcctctggccaagcaggtgcccaggcagcactggacctgggggtcacccctgggagaactgtcactcatgcccacggctttggatgttgaccagtctggtgtcatgaagtcagacctgagtgtcacgcagagacaggcgacctgggacgaagctcttgggcgcggacacagcgttcctcagtggctctttgatcgcagccctgcgccccactgtgtagcgttgagaggccacttccaccagcctctgtccagctccacttgtgaccaggtgcaagaggttcccgagccagcatcctgaacgacattttgtcccatgtttagagtcgaatcctgtgatgtctttgggtaa

SEQ ID NO: 474213 - DNA, 649 bp, Homo sapiens
tgctttgtgaatgacacagtgggccttcccattcctgtcattggccattcgaccttcaatactaattgcctggggatctccaggccccaagagtgactgcagtgaggtccatgctgttgggggtgacagagcagccctggaggtggccaaagagaagcaggcagaggaagcttctccaagcaggcttggaaagaaatttccgcatatcacttacgtcactcttgccactagaaggacaatttttacggtggaaattttgcgtcttttgaagacatttgccagaattctacttttgaaggctgccccttttgacagtcagttactgaagaaactgtgggacattttcaaagccttttatattaaaaaaagacacaacatactgctgtgggtctgtgtgcagggaccaggaagggcacagctgccacggttctgtgtcgcagatgctgtgggaagtgccttaacacacacagatgtgcttcatgcaaccgggtgaggaacatctctaaaacagtttacagtcaagaaaattcagtgccaagtaggttgaattcgttatccaagatcacacatatgtcctgacagattcggggttcaatgaagaattatgtatcatgaattatagggctgtattttaattttgcattttaaa

SEQ ID NO: 474214 - DNA, 705 bp, Homo sapiens
ggcagaagccccccccgaccccccccaccaggtaccacaggacaggagtcaccaggtagacatcaggccccagatggagctagcaggccaggcctcaccagtgatcccaccagggccacatctgcacattgtccttttccagccggagcctctggagctcattgagacacaggcacatgctcctgcttcaggtgcagaaatacagctatttccagtgccagctgttgagccagtgccagcaccaggggcagattcccctccagggacagcgctggagctagaggaagctccagagccctccttctgctgccctgggactgcccaggaccagcccagtgaggagctgcctgacttcatggcacctcctgtagagccacgggcctcagccctggagctgaaagtgtggctggagctagaggtggtagagaggggtgaccagcacagctccagccagaagctcccacactgctcccagtcctgggcacaagcagcagccctgctgctgaagagcctgctgctactgctgctgggggtatttgcatgcctgcaggaggtgctggagagcaagaaaaggagcctctttgcggaaagagggatcatgtaggttcatttctcaggcagatcagtcaccttttgccatcaaagttttagcatccatttccaaaatttggtgtacaagttggtattttggtgtttttagctaat

SEQ ID NO: 474215 - DNA, 1384 bp, Homo sapiens
gggcagcccggttcccaggggaccctgcgggaacgacgacgttgtgggcaggtcctcacaaagggcatggcccagtttctgggcatagatagggaaacgttccatgaccaccccatcccacactggggacctcgagcccctcctccacagcacccttcacatgcctctgcataagcagtgctgcctgtggccgccacagggccctaggtatgggcagagagtagtatcccccacacagcatgctgttctccctgtacccccaggggctagttagcactctgggtgccctggactctggggcctccctcagcaaattgtggagggtggcctggcatgaatccaggcagatctgggaagggacatggcaagacagcccctggaagctgtgtccccgggtccaccgggatctggcccctgcagtcatgttcatccactcaatcactccctgcagcccgtctctctggaaggtgcaggaggaggggctacagatgtgggggctggcacttgtggcagagggttccaaagtcatgggcatagagaagacaggttggcaggagcaagggcagaatgggagcggggtcctgggggtcctgttgggccctgaggaggactgcagaggtgtcgggacccggcagggcgggggtggaggcggagagtgtgactgtagcttcacagtcatcagagtggacgtggagatgcaggcagagtcctcgaagctggctcaggggtctgtgtggggagggggcacacccagcaggggcctgagggtgcggctgatccaccctgaggtcccggacacactggtggggacaggaaggctcatcttggagctgctcctggaggggccatgtgggtcacggcccctggccctctgctcagaccacagagcacaggacacttgtccagcctttgctgcgactgtgctgcttgctctgggagcagctgctgctgggcctttggaggaggaggaagggtggcctggctgggacccagcccctgtgcccagcctcttagaaggggagtcactttccatgcgctgccccccaccctgctccttgactgtccgatcgcacttgcccatgctgtcttcgaggctgagcccagtctcttacccactgcagaatctcatcgccgtggtcccttatgcctagtgacacggtcctggatagtcttccccctgctccttgacggtccgatcccacttgcccatgctgtatttattgctacaaccttccctcacagcactgattttgctgaatccaaaggcttttggtatatgatgtttccattttcatttgtttgaaaacattttcggattttcattttaatttcttcattgaatcagtgctcattcaggagggtggggtttaattttcatgtatgc

SEQ ID NO: 474216 - DNA, 1254 bp, Homo sapiens
aagccctgtgttccttgctggcgatcctgccttcaatttgaatgcacaggtaccacagcaagccggtgctgtgtgctcccaattccaggatgtcttgcagctcagccagtgcactgagcacaaggactctctgtggggcccaggagcagggagtcacccctttggggcccacaacatccagttgtgccccagactcctgtccagagaagatcgtgttgagggccctcctgaagaggggggcagggatgcctgagcaggacaaggaccccagagtccaagagaatcctgatgatcagagaagggttcctgagggcaccggggatgcacagtctgcatttaggcccctgtgggacaatggaggcctctctcccttcgtgcccaggcctgggcctctgcagagagacctccatgcccagaggcaaggggagcctctgatgctgccacctcccttacagctggggtctggggtcactgctgaagacctggacctggagaagaaggtggcactctggtgcaaaagcgcactgcgggttctgtgagagatgacactggtattttggtaggggttgtattgaatctctagactgctctgggcagtgtggtcattttaatgctatgaattccttccatgagcatgaaatgactgtccatttctttccgtcctcttaaactttgtcatcagtgttttgtagttttccttgtagaaatcgttcacctccttggtaaaatttcctctgtggcatatcatttttcattttgttgctattgtaaatgggattgcctccttaatttctttcctagaccattattggtgtataaaatgctgctgatttttgtatgttgattttgtatcctgcaaatgactgtattaatttatttatcaagtctagagttttctggtggaggctttacatgtttgtaaatccaagatcacatcttcatcagacaaggataatttgatgtcctcttttccagtgtgggtggcttttatttttttctcttgcatatttgtgtgatgtctaataaaagtggaaaccatttcagtgcgtgcctgtctttgtccccgcactggctggcctctctgaaccatgagaacttgggttatgcgaggctctgcctgtcagttgagcatcatgaagcagctctcttctgttccagtgaggccgaccaggctccaacacccctgccacgggtctgaccattctccccctcacccagaagtgacctccaacccgatcctgctccctgtcttct

SEQ ID NO: 474217 - DNA, 704 bp, Homo sapiens
ggctttccctgggatctctgtacccgctgagaaccgggagctgcacacagcctgtccagcatcctgggaactcaccctgttgctgccacttgtcctgggtcatcctgcggctcactccttgccattcagacccctgtgaggagagcactggctagctccaatgtcatgctcatggctgaggagaaacaattatctcgctgggaatgagtgcaagtgggagaatggaaggagtcctgagcggggctgactgcatgtccgcaggggcccggacaggcagcacagcggcctctctaccctcgaaggtctgtttcttgtctgcttcctccttgggagtggcaggccctggtgaccggcccaacctcgggggcgcccagcagctgggtcaccaccacatgcccaagtctggccctctcagctctgcctgtctcctgagctggagaacagaccccacccctctgtccccggcactcaactcccatccagccgatctccctgaggacccccccaccgccaactcccacctggatcctctggccctggcagggcatcattctttcaaaataatccatgactgggcgcagtggctcatgcctgaatcccagcactctgagaggccaaggtaggaggattgcttgagcccaggagtttcagatcaacctgggttgtaggggtgggttgcccctacacacctgtgggtgtttctc

SEQ ID NO: 474218 - DNA, 2154 bp, Homo sapiens
ttgtgaagttaatttgctcagcaactggccaaagtctataaggatggctccccatgaggacaccgtacacaacatcactaacgaggatgcctcacacgatatcactaacgaggacgctgtccacggcatcgctaacgaggccgccgcccagggcatcgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccatggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaacgaggatgctgtacacgacatcgctaatgaggacaccatacaaggcatcggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtatacgacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacgtcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctgtatatgacatcgctaatgacacccacaaggcatgctaacgaggacgctgtagacgacattgcttataaggacaccgtacaagacatcactaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatc

SEQ ID NO: 474219 - DNA, 881 bp, Homo sapiens
gttcctcttctgctctcaccgcttttccttctccctggtgctgcagagcatcccacagtttgtgtgcactgcctccccacactccctcctcatctcactctgcctggctcatgtctccaccatcccctcttgtggctcctcaggaggctgcccctgacctccatcttccccagggcagtgggggctggggtgggaggcgggcagaggctgatccagcagttggaaagggtgcagcccaggttctcctaactcaggaagagaaggggggaaaggaaggccttatccaaggatatagcacgttctctttggagatggatgaaatgagcgtgtgctccttgaaggagtcttcctggctgtgcccaccaacgggcaggcagtggcggcccccgtcggtcaaagctgtgccgctggtcctttggttcggcaagcctgccagcagcacagcctcggggacgtctgctccttttgcagcagagcagatcttcacctgggtttccttcccaccatcactttctgagctgctcagcgtcagaaaaaggactctggctgtcagagaggagaactatgaactcacctactcattcatgctgcccagtccagtgtgctttctgctacaaaaacaacaactcatcccctgctacagcaggctgagcaaatctgcctcctcaggcaaggagccacactgagccctctgccaaatggaaggaacaaccccaagttccagagcctagagggaatgaattcgcttctgtttaggatttctgtgtcttcgcttgagaaagtctaagtacttgtagacatagaggagatgatgtgtcccactggatgtgtgttgaggaatccatttgtgggcataatagtgctaaacagtggttacatac

SEQ ID NO: 474220 - DNA, 737 bp, Homo sapiens
tctagtagtttgtagagccattttattggaagggacttcagaaaggaattagtttacctactcatcagattaccggtgaccgctcgggatgttaagctagtgaagacaatgcaaggtggcctgaagcagcatgaggcagaccatggtcccgacctgcattggctggtgctggctgcagctgctgatggaggctacaaacacagctgtgcaaagcttaaaccatgtgaccctgaaagcacaacactgaaagcctctggctgtgccaagaggagagcccaccgcaacctcatcaatccttacctgaatgcatttaagattccagaaagcagaagaccgattccggaccacacaggaagcccgacgcccgacgagaacgggcacggaggcgctgcctgcgcgcagctggtttacattcccttgctgccgcagaatcacgcggtgcctcgagcaactcctttgaccctcttagaacccattccttttccaaggggattagttccttccgtgcaaaggcagacagaaacgcgttctgcccctgtccatttagggagctcggcaaacaccacgtgccgctcgctgctggaaaggcaggccgaggacaggacttgagttgccttttagggaagcagccttaccagcaattccagtttgaaaaattactttgccagcacagatcaagacttggctccttctgtctggaacagtatgaggacgacgtctttggggttctaccctgc

SEQ ID NO: 474221 - DNA, 751 bp, Homo sapiens
gcaaggctgtgcctctaggagggcctgtgtggcactccctgaggtgctccccttcctcccgaccgccacctcctgcagggctccatgaagaaggagttcccgcagaacctgggaggcagcgacacatgctacttctgccagaagcgggtctacgtgatggagaggctgagtgccgagggcaagttcttccaccggagctgcttcaagtgcgagtactgcgccaccaccctgcgcctctcggcctacgcctacgacatcgaggatggtggtgtgtgcagggtggccctcgtcagtgatgagcctgagactgtctccatccctgcagcagcctccaagccagccatgcatcttccacttggaccactggtctccttgcctctgttacaccccagtctgtttccacagagcaaccggagggattttaaaaggtgtgacttggatctcaccagtgtcctagccgctgccgtgcagacagagcccacaaccttgtcccaggtggagagagcattgcgtgtccaccccagcctctgccgtcagctgcccccagcatgctgcactctttgctccagtgtctttccatcccataagcatgatgaagccactgctcccttaggacgtggctctgctgtgtcctctcctggagcacaccccctggtctccacagggtgagacgcctgtgtttcacatctccatgtggcgctcctcagagaggggtctggctcttttgatagaaggcagctgcccaggcacc

SEQ ID NO: 474222 - DNA, 702 bp, Homo sapiens
cgcgggcacctcgcacccgctcgctccccttccctcctcacccgccactcccggggtatttctcgtaatgctatcccttcccttgccccccaaccccaataggccacattgtgtaatgctcccgtccctgtgcccatatgttctcattgttcagctgccacttatgagtgagaacatggcggtgtttggttttctgttccagtggaatcctttccccattgctagtttttgtcaggggcagggaaaagctgaaaattctgaaaatcagagcgcctcttctcctccgaaggaaagcagctcatctacagcaacggagcaaagctggacagagaatgactttgacgagttgacagaagaaggcttcagacgatcaaactacatgacacatgcacaagcttcagtagccaatttgatcaagaggaagaaggcatcagtgattgaagatcaaatgaatgaaatgaagcgagaagagaagtttagagaaaaaagagtaaaaagaaacaaacaaagcatccaagaaacatgggactatgtgaaaagaccaaatctacgtctgattggtgtacctgaaagtgacgggcagaatggaaccaagttggaaaacactctgcaggatattatccaggagaatttccccaacctagcaaggcaggccaaaattcaaattcaggaaatacagagaatgctgcaaagataatcttc

SEQ ID NO: 474223 - DNA, 481 bp, Homo sapiens
taaaatattatatctttccaggtagtgttggggtgatcagatgcaacaccagaccatgagggctatgaagtctggtggagtgaaaggaatgagaaaagacaagttaagatcagacccctctgctgcagctctactggagtttgctggaggtccactccagactctgtatcaccggcagatatcaccagtggagtatcaccagtggagactacagaacagcaaagatggatgcctgttccttgctctggaagcttcatcccagagcagcacctgccagatgccagctggagctctcctgtatgaggtgtctcagggctcgggcgttgtgctgggagatatgctgctttcttcagagccacaggcagaacgttttgtaagtctgctgaaactgcgcccacagctgccccttcccccaggtgctctgtcccaggcagatggggttttatctataaacccctgactcggactgtagccttttttt

SEQ ID NO: 474224 - DNA, 530 bp, Homo sapiens
ggcctggatttcctcatctgtcagggccaccagaagcaagttgtctccagcaggaaaggccagcaatatgcctttactgacctacctcatggatattccttctaaggtgaagaacaagctgctacatttggctcctcctacaaccaagaaagaggcacaacacctagtccaggctgctgtgcaagccactctgctacttgggacatatgacccaccagatccaatggtgcttgaggtgtccgtggcagatagaaatgctgttctgagcctttggcagacccccatatgtgaatcaccatgggggcctctaggattttggagcaagaccctgccatcttctgcagataactgctctccttttgagagacagctcttggcctgttactgggctttgatggaaactgatcatttgactatgggtcaacaagtcaccatgcgacctgaactgcccatcatgaagtgggtgctttctgacccatctagccatagagtgggtcatgcatagcagtattccgtcatcaaatggaagc

SEQ ID NO: 474225 - DNA, 508 bp, Homo sapiens
tgttacttatgcaaccgctttcatggttctgtcctctgactcactggactccagacttgactctctggtttcctggttctgccctaaacaaggctcacacaatgaatttaagcttcatgggatcggggccattgtctattatttgcattgctgtatcccagtgtattgggagtacctggcaaacactatccaagaaagaaaacagcccttggagtgctccagaatccaattaaagaagtgcaggaacacaacgggagaaaagcgcagagtaaccatgcaggaaggatggctgggagatggcacatctgagagttttgagacagccaggggcaaagaagcaggaggcaagtgttaccagctaggaggcagggccactgcagtccccatggcctgctctgtggaggaccctgcagccttggcagctgaggacctcagtatcccccaaggcagctccactctacagctttcctaatgaaggccccttagtgttcattaataaggatcacaa

SEQ ID NO: 474226 - DNA, 1505 bp, Homo sapiens
tgctctcagctgcctgcagcacatctccagttaactactctccttttgagagacagctcttgtcctatactgggcttttgtggaaactgaacatttgactatgagtcaacaagtcaccatgcgacctgaactgcctatcatgaactgggtgctttctgactcatctagccataacgtgggtcatgcacagcagcattccatcatcacatggaaatggtgtataagtgattgggctcaagcaggtcctggggggcacaacggccatggtggcagggatggaggctatgcatggattcagcaatgtggacttccactcaccaaggctgaactgtctgtggccactgctgagtgcccaatttgccagcagcagcagagactaacagtgaaccctttgtatggcatcattccctggggtgatcgaccagctacccagtggcaggttgattatattggacctcttccaccatggaaaggagagaggtttgtcctcattggaacaggcacttactcaggatatgggtttgcctacctgcatgcaatgcttctgccaagactaccatttatggactcaaggaatgccttatccactatcacggtattccacacagcattacctctgaccaagcactcactttacagcagctggattgatagaatggtgggacggccttttgaggtcgcgattacaacgtcaactaggttacaatactttgccgggccggggcaccatactccagaagaccatgtgtgctctgaatcagcgcccaatgtatggtattgtttctcccatagccaggattcacagatccaggattcaaggggtggatgtgaaagtggaaccactcactatgatgcactagcaaaatgtttgctttctgttcccacgacattaggttctgctttactagtcatcttagctccagagggaagaacgctgctaccaggagacacaataatgattccattaaactggaagttaagatggccacttggacgctttggggtcctcctacctttaagtcaacaagctaagaatggagttacagtgttggcggcagtgattgacccagactatcaagatgaagtcagtccgttactccacaacggaagtgaggaagagtatgcatggaatataggagatccattagggtgtctcttggtattatcatgcactctgattaaggtaaatgggaaactatacccaatccaggtaggactacaaatggtccagatcctctctgggtcacgacctgctgaggtgcttgctgaaggcaaagggaatacagaatgaaaagtggaagaaagtagttatcaataccagctacgaccacctgaccagctgcagaaatgaggactggaactatcatgagtatttccttcttcttttgttaaaaacatgtttgtgcatgtatgcacttgtactaagaaaatatcttcatttcatttcccttttctttatcagaaaaatggacttagacttcccacaagccttccagaaagaactc

SEQ ID NO: 474227 - DNA, 2601 bp, Homo sapiens
tgcttctggggtttgatggacgtgtgatgctatgttgttaattggagatctttctaactttttgataactaaaaaggcggcttcagactcctccaaagaacaagtggccaattcgagggaatcctccccgtcaccaaaagaagtaaacgacagtccgagagccgccaccaagtctcctgaatcccagaatctcatcgatgggacaaaaaaaccatccctaaagcaaccagacagtcccagaaacatctcaagtgacaacagcagcaagggaaccccgtcctctcctgcaggatccacaacagcaatccccaaagtccgcataaaaaccattaagacatcttctggggaaatcaagagaacagagaccagggtattgccagaagtggatcttgactctgggaagaaaccttccgagcagatggtgtctgtgatggcctctgtgacatcccttctgtcatctccagcatcagccgctgccctttcctctccccccagggtgcctctccagtctgcagtggtgaccaatgcagttttccctgcagagcccacccctaaacaggtcacaatcaagcctgtggctactgctttcctcccagtgtctgctgtgaagacagcaggatcccaagtcattaatttgaagcttgctaacaacaccacggtgaaagccacggtcatacctgctgcctctgtccagagtgccagcggcatcatcattaaagctgccaatgctatacaggagcaagctgtcatgatgccagcatccagcctggccaatgccaaacttgtgccaaagactgtggtgtcgtccttgcagaattctgtggtggaaactttcaacaaggtgctgagcagtgtcaatccagtccctgtttacatcctaaacctcagtcctcctgccaatgcagggatcacattactgatgcatgggtacaagtgcttggagtgtagggactcctttgcacttgaagagtctgacccagcactacaacagatggagcatgtgcatcgaagtaacgtgcaaccattgtacaaagaacctcattgtttacaacaaatgcaacctcctttcccaagccccaatagttcttcttcatcttccactcttcagagccctgtgggaactggcatacacactgtcacaaaaattcagtctggcataactgggacagtcatatcggctccttcaagcactcccagcaccacagccatgcccctagatgaagacccctccaaactgtgtagacataatctaaaatgtttgaagtgtaatgaaatcttccaggacaagagatccctggctacacatttccagcaggctgcagatatgagtggacaaaagacttgtactatctgccagatgctgcttcctaaccagtgcagagaatccatcagcacaaatctccctacacctgccctgagtgcagggccatctgcagaaaaaagaggacagcaaatccatgagtgggaaagagaaactggaaaagaaatctccatctcctttgaaaaaaaatcaatggaaaccaagaaagtggccagtcctgggtggacgtgttgggagtgtgaccacctgttcatgcagagagatgtgtacatatcccacctgaggaaggagcatgggaagcaaatgaagaaacacccctgccgccagtgtgacaagcctttcagctcatcccacagactgtgctggcacaaccggatcaagcacaaaggcatcaggaaagtgtatgcctgctcacactgcccagactccacaggtacttttaccaaagggttgatgctggagaagcatgtccagctgatgcatggcatcaaggaccttgacctgaaagaaatgacagacgccaccaatgaggaggaaacagaaataaaagtagacgtcaaggtccgcagtcccaagtggaagttgaaagaaccggttctggagtacaggcctcccagaggagcaataactcaaccactgaaaaagctgaaaatcaatgtttttaaggttcacaagtgtgccttgtgttgcttcaccaccgaaaacctgctgcagcacctctttgttgtacacaagttaaaggaacctcagccagtgcccaagcaaaatggggctggcgaagataaccaacaggagaacaaacccagccacgaggacgaatctcccaatggcgtcatgtcagacagaaagtgcaaagtgtgtgcaaaaacttttgaaactaaagctgccttaaacactcacatgcagacacatggtatggccttcatcaaatccaaaaggatgagctcagacgagaaatattgggatgcacgacgtcaaccaccgacttatcaatgcagccggctgtgtatcgcaattggccgttaccttaagcactgagccacatgggattagttcagccatttcaagaggtatatttaatgttggtagttctgctttactaaaatgcagtagagagggtaatgtaatgaaggctatgaaacaaagttttgaaaaaagcagtttccatggcaatttgatttaaaaaaacccacaaaactcttttcatatatttttttcaccttcagtttcaaatgagtttagggttaaattttcaatttttgcattttagctagaactgg

SEQ ID NO: 474228 - DNA, 685 bp, Homo sapiens
gcacacatgcacgcatacatgcatgcatgcacacatacattcagaacacaggtcacatgaaaggagctgtgaagagttcaaccgcaagggcagcagggcagaggccagggccactgaggcaaatgcaaaacagcggttctcacgttcccaggcagcctggaggggctctgagtggccaccatgtagccccattcccctctcccgcccaccttccaggggtgctgctggctgttggcttggcaactgtgctgttgatgggcctgggcctcctgctgagtccctccctgccccacgcctgccccatgcaggcttggaagactcagtggagaaggctaggacagcctcaggtgcctgctgagtatgtgatcctcagagacagcctcctgttctatgaagaccttggcccttggggatctggggaaggagctgactccaagaaggccatgagccggggcacaggtaccatgctggtgtgcagccaacccctcctcaacaatacttgttattttccctttactagatagtagttataggtctattcagattttctatttcttcatgatttagtcatggtgggtttcgtgtttccaggaacttgtccatttcatctaggttgtcttaattcgttggcatacaattgttcatagtactcttatagtcctattttatttttgtagacttgtcc

SEQ ID NO: 474229 - DNA, 699 bp, Homo sapiens
tggtagattcactgatggcttgcactggcacctcttaagaattatgctaaatctactctacccgtgctctataaatggattcactattgtagacgccactaagaacattcatgattcaccagaggaggtaaaaatagcagcattaatgggagtttggaagaagttgattctaaccctcataaatgactttgaggggttcaagactttagcagaggaagtaaccacagatatggtgaagacagcaagagaactagtattaaaagtggagcatgaagatattgctgcaatcttaacggatgaggagttgcttattatgaatgagcaaagaaagtggtttcttgggatggaatctactcctggtgaagatgccgtgaacattgtggaaagaacaacaaaggacttagaatatgccacgaacttagttgatagaggagtggcaggaaccaaacctgcaatatctccaaggtgtgcctgtacccctgaaagcagagctggagtaaagacttgggtgtggatggtttatttgggaagtgattccaagaagcaagagtgagatgtgggaagagtgagccaggcaagaaaaaaaaagccaaaataatgaaatgccattgaggctgctcccatggactttttttatgcgggacctaccgagaggctctggaaagttatccaggactgtccacctgaaacgtgagcctc

SEQ ID NO: 474230 - DNA, 503 bp, Homo sapiens
tctagcaagtgtggccacacaatggtcaagttggatttagatgatgttctctataaatccattctcctctcccgaaagggagaagagcacggtgtgatagggcaggaagagaagaaaacggaggagaggaggggactttcccataaacaggcagaagaaaaggcagctgtggtgtgtgatggacatggaagcagtggtgtccaatgtggggtcagccctagaggagagacagagagagagacagaaaagtccatcacctcttcctgtactgctatttttgagagtgatgctcctgagccccatgacccagtcaaatttgatgtccccttgagccagattcagtgctgggagtccagtgtgatctgcctggatcttgctgcattgagaacaggccagatcttgaccccaatacaggggctggatatgaacaggcaacagctgggtttctgagtcagaaagacttggttgattgctaattgcttagcatcaagtactacacagcc

SEQ ID NO: 474231 - DNA, 656 bp, Homo sapiens
gcacaggccatgctctgccctgcatgtcccagcctgggcccagcccttgccctaccatattcctgaccccagcctggtcctgccctgccctggcagtgccttggccccagccctgccttctccctggccttgccctttccctgccctggcctgaccccaggcctaccgagtccgtgaagcgaccctggacctgccttgcagtcatctgtcctggccctgtattgtccccaccatgctctggccccacactggccatgcttggccctggcccctcctttggccctgccctggccctgtgctatcttagtcctgccctggccctgaactcgccctggccctaccctcaccctacactggccctgccctaccctggccttgccctgccctggccctgcctttggcctgccctggctctggttctgccctggccttacccttgccctggaccctccctggccatgtttttactgtgtctacagtgattttgtaatatttgtgcacatataaaataatatttccaaaaatgtaatccagtgaggaaatatactttctaaattctagatttataatttagggtttaaattataaaatcattaaataagacaaaagggaaatatagtcaaatatccccttggaaaaaaaattaagtggcctct

SEQ ID NO: 474232 - DNA, 546 bp, Homo sapiens
actaagggggcgggatcgccaccatggaggtgtgcaagcacgtgcctgcgtcccggagacagccagactcaacggagaagctgagttcaagccccacatctccactaacccttgcttccagccaaagtcccaggactgactttcactggatccgtttgcgccacattcccctgcctgagccaatcaccacatccagcctggccagacctggctttcatgaagccccttcaggaagcggttggggtcatctcctccagaaggacatggggaaaaccagaaagtgggaggagggatgcttccttctgaaaaatagggatgcaattaccacaagagccttaatgatagaagccaacattcatgaatcccttaccacatgccagtggttacctatataccctggattgtggccctttcctccatttttaaagcacaccactccaatctctgcacagtgctatggtttgaatgtgtcccccaaagttcatgtgttggaaatttaatctccaatgcaacagtgttgagagatgggacctttaagaggagatt

SEQ ID NO: 474233 - DNA, 512 bp, Homo sapiens
ttgtcatgaaggcatagacacatgatgaacacactgctactgacattaatttctgcttttatctgcatagctggtacctccaggaaaaggagaggaatgagcactggaccttgtcaagaagttgttggtagtggatccaaaggcacgttttatgacagaagaagccttaagacaccgtggcttcaggatgaagacatgaagagaaagtttcaagatcttctgtctgaggaaaatgaatccacagctctatctcaggttctagcccagggccccttggaaagttccagggaaaggagcatagcgaggttgggggtggagtttgtagagactggctggctggctgctgacatcttcatgagaacagcaggtaccttggtgcataataacaggccaggttatattctcatccttgccctcataaagatacaggtctacagtctctgaaacctttgggctagataagttgtgaaatttaattacccaattttaggaaggtgagcattttgtattaa

SEQ ID NO: 474234 - DNA, 763 bp, Homo sapiens
cctccagcaaactccaacagacctgcagctgagggtcctgattgttagaaggaaaactagcaaacagaaaggaacagcatcaacaaaaaggacatccacaccaaaaccacatctgtaggtcatcatcattaaagaccaaaggtagataaaaccacaaagatggggggaaaccagagcagacaagctgaaaattcaaaaaaccagagtgccgcttctcttccaaaggattgcagctccttgccagcaatggaacaaagctggatagagaatgactttgatgagttgacagaagtaggttttagaaggtcagtaataacaaacctctctgagctaaaggaggatgttcgaacccattgcaaggaagctaaaaaccttgaacaaagattagatgaatggctaactagaataaacagcatagagaaaaccttaaatgacctgacggagctgaaaaccatggcacgagaactacatgatgcatgcacaagcttctgtagccgattcaatcaagtggaagaaagggtatcagtgatggaagatcaaatgaatgaaatgaaaagagcaacaccaagacacataattgtcagactcaccaaggttgaaatgaaaggaaaaatattaagggcagccagagagaaagaatttcatatccagccaaactaagcttcataagtgaaggagaaataaactcctttatagacaagcaaatgctgagagattttgtcaccaccaggcctgccttacaagagctcctgaaggaagcact

SEQ ID NO: 474235 - DNA, 580 bp, Homo sapiens
aggggtcagggtcaggggtcggggtcagggtcaggggtcaggaaaggaagccaggttgaagagggatggcaatgagttttgtgtttggtctgcaggacagagatgccgggctgcggggaggacaggtgggaggacaggtaggaggtgtgcatcacagccaggctgtctccatccaagcttcaatgaccactggcctccctgctgacccatgtcccactgaggagccccaagctctgaaccaactgcctacgcaccatcccctcggactgcacctgctccccaggccttccccccctttggagctgcctctgtctaccaagggtgctgtcgctcacctaaccttccaaccagaactcagtggtaccttgctgccccctccactccctgaagaagctgcccccatgcctgtcaagttcttccaactgctcgaaccttctggaactccaggcctcagcatgtcttgtctgggtggctgcaatggctatgcttgcttctctgtctctctccatcaatcagtcaaccaatcaatcgatcaatcatctatcaatcagctatccacctattaatctataatcaataa

SEQ ID NO: 474236 - DNA, 884 bp, Homo sapiens
gccgccccagcaggaagcccgacgtaggtcccagcgtgtctgtcagtcatgccgctgccctgtggagctggagaggcaggacgtgcacccagcctgtggctggcggggcaagggacctgcagctcctccagccatgggggcttccctcagtctgaggacctggacaggggtagatgcgtcctcaaccctgccaggccttattccaggtcacctaaagggactgaattaacccagggcaaggtctctgttgtctacactgtcatctacccaggcagctgggggtcccaggcactgcaggaatatgcccagaactcccacaactccaccatgaagaggaaagggccgattaaacaaggggcctttgaacatttctccagagaagagccacacacggccagtgagctcatgccaggacgccgggcaccggggaaacgtgaacctcaactgagcgagacacggacccgcctcgcgccgacggccactgagagcaaacaccatgagctgctgggtcgaggggaatcagaccctccgcgtcgctggcgggagcgtgtggggtctgagcgctgtccacacacagacctcggcacggacgtccacggcaacacgatcccatcactaacagatggaacgcggaaccagccctcaaccgccggagggagagacaaaaccgggtttacccgtcaacaccgcttcgtacagccaaactctgagacacgctgccccgcgggcaaaccccgaaaacatgcccagccagtcacagagacctgtcgacacaactccgtgcccaggggatgtcgtggaggggcacgccagggctcagggccggtggaaaggtgccacggttagactggtcgcggctgcgcaccgaatgtgctgggaagaac

SEQ ID NO: 474237 - DNA, 800 bp, Homo sapiens
ggtagccaggcacaatcacgccgtcaccaccccagccctcaaccagaccctgcctgctcgccgcgctcggccgccatcttcctgtggacgccacttaccctccggcgtcgccatcggctgcaaattgccttgtttttcatctttggcagggctcaaaatttgatcatgaaagggaattttcttttttctttcttaattagtacttggtaatatcaccaagctgtgagtttatggctttgtagatcttgtgtgtttgacactaattactcacaaaggcttttaaagctgcatttcaactctgcaaccaccatgccagtaattaagctagaggaagcggcaacagatttcatttttcacagacacccttcccacctgtgctcccgctccgtgtggccgcagcccccgtggccctgtggaaacccagcagctccttgcggctccggccctggaggcctgaggtggccttgcctccaggagcccgggctcagccgtcacagccgggcagagacgactaacgagcagctcccctggctgccccagagccccccacaggggccgtggcttctgacccttcagactcagctgttcccaggggccctgcttctgccccgcccgcccccacggctgcactcaagcctgcgctgtgcacaccgaggccagctgaatgccactaagaacaacgcaaagttctggcgcgcagggagggaagtccgtgttgacttgggggcgggtctgcagcaggaaggctgggcacaccctccactggctgctcactaactcccctgctggcagaaccttcc

SEQ ID NO: 474238 - DNA, 580 bp, Homo sapiens
tggcacttctgaaatggctcctgatggtccccacctccaggcatcacccgcatcagcgccagcccttcagcgtgacttacagctgatgcaaagttcacgtcacggcagccgtgacttctgcggctcccaccctggttctcagagctctgacacgccagctgccgtgcgtgagctgcccacatggcgaggagctgccataggaacccagcgcggcagcccaaccacggatgagaagcagaatccttctgacggccacatgggtgtacctggacgtgggaccttccccagcagagccaagaggaccgtggcttgtgaggtctctgagcagagagccagctcagccacacttggattcctgaccccagaagccatgagccactgagttctgcagcgatgttattcaaggactggtcgccagtggtggggacagcaaagagtcttgaaaaagtaatggccccaattttctgaaatgtgtggaaaagtgtaaactgagagatctgagaagttcaaagaaccctaaccacccccccaccaaaaaaaaaaaaaaaaaaaaggcagggggaggaaacaacattaaagt

SEQ ID NO: 474239 - DNA, 951 bp, Homo sapiens
gtagtggccatttcgactcacagcaacctccgcttcctgggttccaggctttgtgctgggcccaggggccacaaagtaagcaagagagccatcgtccctgccctcatggagctccagcccaagggacagcagcttatcctacgccaaggggctcctctcaaaattcccacagcagtagtgatctaaggacctgggcaggggcactggacttcaagtctcagcctctgagggtggaaaacagtcagagaagagagcagaggcccatctgccacaggaagtccttcagaggactgcagtagggactcttagagtggcttcccctctgaccctccggggctcttgcagtcccagcaaggctggcaccagttccttcaagcccttttgggaatttccagtagctgagcttctcccagttcttagtatgatgaactcctatacagccctcaatgccctgctcaggtgcccctcaacctccctagaaggactcgatccctcctccctctggatgccctcctcttcatctgataccctttcctgtcccacactgcgactcgtactgtggaaacctgcaaatgtgcagcttgtgttggaaaagggtccctgccatccggaggccccagagccccgcccaccctactctggttgcagacccttcccgcatctttggcagcctcgccacccctgggcacagcaggagcaaccccagtgcccggggatgaagcacctactgtgcttcaggccttcctggagccccagctcattgactaacagtgacctcctggggcagtcctgtttttatccccacctggtgggtgggaaaacaggctcagaggggccaggtccccaagtgtcacagctcccaggagcatgacaaaaattgcatggggaaggaggaggatttgctaaatgcccattcctggcattcctgcccccccacccccaccccccatc

SEQ ID NO: 474240 - DNA, 1055 bp, Homo sapiens
cctgcagattcggtgtctgatgagggccgtttcctcatagatgccttatagccttgtcctcacgtggtggaaggggctgcttccagactctgccggttgtcgagtgccctggaaacccgctcaccctgcaggagttactcagtgtcctgtgtgcatccagaccttggcattgagctcctggggttgggcaaggaagggagagcaagtggcagggggtgggtgggcagcaggttcccagtcctgcaggcgctgctgggatcaggatgccaccctcgccaccctgggagttgtctgcagcacaggggcagctggaggtggaggtcgtgtgctccatggacaggtcctgctgactggatatggtggggtgttggggagacaggaaggggctaacgccgacacccaggagccccaagaggaagaagaggaggaggaacaaagcacaggatacccagatggcttgggccagactgaaggcacagccgtagccagcaaccagccacctgagccctgctgccttgggccccagtcggcccagccagatcttcagagccgatttgatcagctgccagatctcccaattgtcagctgcaacgttaacctctttaagagagcacccgaggcgatctttaagctaggaggctggagccccatgctaatggagcctgctccgagctcacagctctgcctcctgcctccccagccttggttctgggagcctgtggcccccactcttcaggctggacagcagcaggactattttttgagcctgggtgaagcggggctttgccagctgagatcagtccctacagcagcccccaccagggagccccaggaaggaggggaggggcctaacccagagagggagtggataagtatttgttaactgaatggctgcatgaacctccaaagctgcctaagaggcgagtgctgacggcgctttctgccctgccgtcaccttcagggggagatgctcaggggctttctattccctgtcactgaagggttgaagggctgtcaccttgtctaaagcctccatgttttcccttccaaccctc

SEQ ID NO: 474241 - DNA, 599 bp, Homo sapiens
tgcaaacagttgctgctctggacagggaagccagaggaaaaaggcctctgcagtgaggcccctggactgacctggtacttgctagaacttaactgatgctggcgaccatggcattgctggtggtggtgctggttgttgtagtggtggtgatgatggaggtgatggtggttggtcatggaggtgatgattgtagtcatggagatgacagtgactgccatggtgatggtcctaggcctcagccctggacccctaaaccctgcaggtgctccttgggctgcagtggtcagttcatagtctctctgggggtccggagtctgttctctgcaatggagagcagagttggattgtcaactgaaggagcagagagccactggttgagacctgggtttgtggagggagcggctcagccccaggcctctgggagtttgggatggcacccggtggagacatgggagcccagccgcctcagccaggaaggcgtgcatcggggcgagtggactgtgaggctggagcaggtatgggtgagagagctcttcctgctcctccgcacctgacttttccctgtcatgtgcaagcccttgctatttttttacacagct

SEQ ID NO: 474242 - DNA, 897 bp, Homo sapiens
ttttgaaatgcttttgagaccgggtttggccctgctgcccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtgtgggtaaatggggtcgacacggtagagcatgaagggggctacctcccctttgaggccgacatcagcagcctgttccaggtggagcccctgccctcccacctctgcatcactatcgccatcaacaacacgctcaccccccaaccctgccaccagggaccatctgtacatgaccgacacctccaagtggggaccatcctgcctccactgcacgcacccaccttcccgccccaccctgtggtcttcctgccagggacagggtggccttcgcagagaggaggccctggatctggggaggcatgtgagctgaggtcaaaagacccatggcaagggcccagcgaaccacaattctcccgccctaggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctgctgtgagccaccgcacatggctggaataccctgtctttaagaaaaaaaaatgttttttaatttttttttttttaaatatatctttttccttttgtgagatgaggccttgcactgttgcccaggctggatggcagtggtgcgatgattgacagctgttgtggggccgcagttgtaagtttcaaagaattt

SEQ ID NO: 474243 - DNA, 1174 bp, Homo sapiens
caggaaatgacggtgagaaccggtgtgagggactagctagtggccagtgctaacaaggagagcccggccctgaagcaggtctctgctccacgcttttccttagttggggaatcgagagttgggggatcaaagccccccacatctccctcacccgctgcagctatgtttatcaaggtgatgtttggggctggctgctcggtgctggtgaacacctcttgcaggctggtgaacctcaccgcccacctgaggcagaaagcagggttgcccccagatgcgaccattgctctcctggctgaggatggcaacctagtgagcctggaggaggacctgaaggaaggggcttcccgggcccagaccatgggcaactccctactgaaggagcgagccatatatgtcctcgttcggatcatcagtaagagggagaggacatggcctccacccgctatgagtccctattggagaacctggatgaccattacccagagctggcagaggaactgcgcaggctgtcaggcctctcctctgtgggccacaactggaggaagcgtatgggcactcggcgaggccgccatgagcaaagccccacttcaaggcccagaaagggccctgattaaggggatggattgcacactgtagtgagacatccatcctgaccccacctcatcagccagggagctccctgaagacaggccatcgagagaggcacacaacaggctgtggtctaaaataaacttttaattgcacatttgtgtcttgggttatctgtggggtgagaaacctcctcacttccaatcccagctatctgggtacaatctggtgttgtggtctggctgtcggcgaggggtagaggtgggtgcaggactggcccccgagtctgcaccgacctcttcagggcagggagctcagacctgggaagggaggggcagcacaggctggtggtcagcctgcaggtgcaagaggagggttggcctctccccctcccggcctgagtcggggtccactcactcaccatggtagtacttgcactgcttcagggcctcgctgaagccctcacacagggacaggtcactctgagtggtggaacagtccaggaactgcctgatctcataggcgcagggccccatctgcaggggctggggggcagcgggggtgggggcctgggggtacagtgcaa

SEQ ID NO: 474244 - DNA, 729 bp, Homo sapiens
gtcctgtgcagtgctaggtgcaaccacccatatgtggatgtcagcctcatttacgaggggagtccctgaggctctggaggcagggcccagcgttggggacatcccagggattccgtctcctggtggagactttcccagccctcggggaatgaatgggctcaccgcgcccgggtcccgcccccgttcagcttcttccccgcaggcttttcgggatttccccgacgccgcccagaccggctccggccgcgagggggcgacagagcccgggctctgcggaacccagcaccagcgattgccgccgactcgcgaaggttcagtggtggcggtgacacaaaggaggcctgcgcccaggcgccgctgggagctctcctgccccacggctgccctggaccactcaccagtgcatttccactccctgcttgccctgcaggcctctctggctgttcctgaccataggcccatgaaggctcctggctgagaggagacagcgaggaacagatccggcagagaggactggcaggggccctccagcttcctctgttgttacctcagggcctttgcacaggcccttcccctatcctggcctagctagtgcaacccatcctctgccccattctgcttcctccctccccatcccacccagagaccagcttattcctggaaagtccagattctgctaccaggttcagagggccaggcccaggccgctccctctgcagcctgacacaa

SEQ ID NO: 474245 - DNA, 678 bp, Homo sapiens
tgcggcggtgaacccggaagatggccccttacccttccagagatgaagcccagttcattccactgcacgcactgagcccctgtacctcctgtctttgggccacatgtcctcaagggctccagtcccgcatgcgatgctgggaggcaccgaagggaaggaggcgaggtccagagcaggttcagtggttcaaacgtgctcagctccccttctctgggcctctgggcaacttcagctcctcagggaagccacaccctagtcaggtccaccgtgtatggcctctcatagagcccttggtgaatttcttaaatgtcttttccactaatgtctacactacctgcatcccctttggcctggaccactgtgacttccctatggtggactgctgctcctcaagggaggagtctgtttccagccccaggcagcagagcagaagactgaagagccagggcctggttgacctgtgccctgtgaacctgaatgacaaggtgcagcctcgccagcaagcacatgagctgcccctggagccgcctaaatccagcccgaaaatatcagcctaatagctaatgtcagcataaccagaaacattccaaccctaagataaacccttctctgaccagaaacatgccaacccggagacagcctcccttctgaccagagacattccatccccgcaataaa

SEQ ID NO: 474246 - DNA, 2838 bp, Homo sapiens
cctgctgtccgacaatccccagtgagatgaacccggaatgaagctgcggacctttgcacccccaccagattcaggagtccagctggcttcacctcgtggatcccacaccagggccacacgggcggagctgcccgccagtcctgtgcgtgtgcatgcacccctcagcccttgggcagtcgatgggactgggcaccgcagagcagggggcgtcgcctgtcggggaagcttgggccgtgagggagcccacagtgctggggagcatgccttgggcatggtgggctgcaggtcccgagccctgccctgtggggaggtggctgaggcctggcaagaatttgagtgtgctggcctgggtgctaagcccctcactgccactctgagtgtcggacccactgagcccacgcccacccagaacgcatgctggcctgtgagcaccgcgagcagctctggttcccgcccgcgcctctccctccacacctccccgcaagcagagggagtcagttccagcctcggccagcccagagaggggctcacacagtgcagcagtgggctgaagggttcctcaagcgtggtcagagtgggcgccaaggccaaggaggtgccgagagtgagcgagggctgccagcacgctgtcatctctcaatgtgaccgttttttaaattaaactttttattttgagattattgtagcttctcatgcagctgtgaggaataatacagaggaatcctaggtactctggccagttccctcaagggtaggaccttgcagctacagtaatggatcagagccaggatactgacattgatacagcaagaagggaatgcttccctcccaaacatccctcatgttgccctttcacaggaacactcacttcccactgtcccaaacccctccttagcccctggcaactactaatttggtctccacttgtataattttgttatttcaagaatgttctgcacatggaatcatacagtatgtgacctctggggactggctttctcccactcagcatagttttctgggtgttcctccaggtggctcaattgcaacgtagttttttcctttttaatgctgactaggagtctaagtatgtaaccttctgagcctggcttcctgagttcagtgtaacaatgttgcaattcatcccagttgccttatggatcaatagtttgttcccctattattgccgagcctgattccatttatgaaggtatgacactttgtttagccattcaccagttgaatgacaattgggttgtttccacgtgtgtgcatatgtgtgtgtggtgggtcaaaccagatgtttctgcttcttgccagtggtgaataaaaccagtataaatatttgcattcaaatttttgtttgaacataagttttcattccatttggataaaaacccaggagtagggtttgcttgatatgcataagcgtgtatttattagaaattgccaaatggttttcagaggggaagcctcctatgggggtggggacataggagtaggggagggttcagttaatgcagcctctgccagcccagctgggaagtgggcctgtgtcccagcaccaaggtgctcaagccccatgcccagacctgagctagatagggtctcaagatcacagtcaagggacagaagcagcatcttctgctccagaagcttctgttcatgcaggccctgcctccgcctcagggctctgcaggaactgttcaaaatgctgggtgcagagctgtggccaactgtggggcacagccaagacactcacagctcagagggacccagggtgggctggccgaagctggaagtgggtccctgcagttcatacccccccccaacccccaccccactgcctccagaccctggacatttcagtggggctgggccagttacagggaggtaaagggaaatggggacccttccaattgctgccctggttaccctaaggtcttgagtagtgacaaggaacttggcagcacagctgcccccaagaggccttccagggtccctcctctgtggacaggacttcagactggacagttactcatctgtttttatcagtctgtccatccatatatctgtccatacacacacccccatccttccacaagccccctgaggcctcctgggtcctgacctatatagaccctcagctcctgatgtcccaggcaaggcaggatcggcctagcccagccccaggtgagacctggcctagcccagccccaggtgagacctggcctagcccagccccaggtgagacctggcctagcccagccccaggtgagacctggcctagcccagccccaggtgagacctggcctagcccagccccaggtgagacctgaagtgtgcctgctcatgcaccatgggagaagggggctgtggcactggggtcccctgggagtacttgtccctgctctgaccccatttcagggatgcagaaaagaggcctcagagcagagtaaggccgagtcagggctacagagcccgatggccacccctcccctgaacggctaggaggagggagggcagctggcaaaggcctgcaggagcccagagcgtgttcttccaagtggagcctctgctgtgggagccccagccacagggtcagacaaagtgtcctgcccaagctcagccctcatcagcccttgaacttgggaaatttgattcccttcagtgggcctcagtttcctcatctgtacggggggtgataacagtctctcttcttgtcttttgatttgtcttccctggaaagagtcctcctggctgtcaggagggctttccccttcagatacattcattgccagaggagctatccaaagtgcctttatttttccgtttttc

SEQ ID NO: 474247 - DNA, 558 bp, Homo sapiens
gcctcagccttctattggaaaataacctaaagggagggggaaaattactacttaaaaccacaagtgccactcaagggatgcctcctatgaaaggaggagtgctaactgccaggtccccactggtccttctccatgcagtgggtgccaagcctggaggtggggtggtctggaaatcattccggaacaggaaatctgttcttctgtcttctgtgcctattggggtgatcagaaccaacaccaggtcgtggggggcaacgaagtccagaggagacaaaggaatgagaaaaagacagtttgagagacagagtgggaccagagggcgtcacgagggtggaggctgcgaaggccttgagctctgggaatccactctatttattggtgttcaaacaaacaaacaggtggaggcaagttactgtgaccagccaaatgatcaggagggtcaaagaaatggctacagaaacagggatggacaatgactgtcagaaggaggagagaagtggaggatgacagctgagccagagccctaagcaggccccacccacttgagtccaagctgct

SEQ ID NO: 474248 - DNA, 2244 bp, Homo sapiens
acttaacgatggcccgaaactgcaggagtactagaatttgcggggcagagtttacagaaaggggagctgcaactaagagagctccagacatttgcacagggctctcctcaggtctttgacgagtatgaataggtgcatgtatgacaggaaacttcctgaggctagggaagaggaatcagaaagcaataggccaaacaattggagcaggagcattgccatcttggacaagcaccgccattctaaagttccccttgatcaaaaaccacctaaatccaaagggcttcagcctaatggctccatggtaaccttgcaaaccagaagcttcgtagtctcagtatttgtaaaaaccagtagcctagcagccactggagggaatagaccagggtctcaggctctgggagaccctggttctgtccctgagcctctggctggagttattgaagttcctgcagggaagccctgcccgggcagcttttgtgatacaacagtagaactcaatagttgtgatagaaattatatggtctgcaaaacttaaaatattactctctgaccttttatggaaaaagtttgctgacgcctatgctacttagtaatgattgcactttttcattttctttgtttatgtaatttattaaaatttcagttcaaaatattttaaaatttcttttgaaatttacttgaaccattaattatttatctaagtgtggtgcttaactttgcagcatttggagattttctgttaatttttttggtaattgatttttatcttaattctggtatggccaagagaacataagtaaataaattctaatctttaaaatgtattgaaatgtgttttatggaatgatatgtggtcaattacagtaaattccctacatatgctttaaaagaatgcatattctgcagtttttaggatcaatgttctatatatgcttgagggtcgatttcttaattgcactattaacattttctgtattcttactgatttttgtttatcagtttttgaaaaagttctttgtacgtatttaagctaggttgttaagtttatgcaaatgttcaattgtttaatcttcttggtgaattaaaactttatatatgaaatgtgtctcctcacctccagtaatgacttttgcgttaaagtctgctgaactgactgatttggggatatattaatgtataagatatatcaattttggggctcacatttttgcatggcatttattttttcatacttgtactttcattgtttctatattcttatgtataagatgtgcctttgtaagtagtttatgtttttgtccatttctgcttctataacaaaatatctcacactgggcaacttagagagaacagaaatttattttcttatgatactggaggctggaaagtcgaaggtcaaggcaccggtagatttatttctgaagaaagggagagtcttcaatattaagtttttactgtttaaaataactctttactatttaaaaatgattttgttaagcttatgattaattcatagcccctaaatccaacctttgaccaccttctttgtaacatacatataaacctataggatggcctatataatagtatgtatatgtttaacatcacacaagatagcttcaagggggactgagattcattttatattgatacaatctgtaagagaactattttacaattacttgcttaataggaaaaaatctgtaaataaggaaataattttaattttggttctgaaatgtaaacaaagtttctgtgagttgtatgcagttgtaacaggattctgagtattgcagagttgtaggatacctttagagctagaagtaaactcagagatcacctaagccaatcatctcatttttcgtaatataaattttggctgtgattaatatctttctaaataccggtaagaaaacaaacccaaaatgaacatatggctcataagttcaatcgtataatttctctgaaatattcacctgttagagtaaattgaacactgagtagtatttagtatttatcatatattctataatgttagctattttaaaatctcatgcccatatttgcctttgcctactgggtgtcttcacttggaatttgcacatgcatctttgaattgttatgtctgagacatttcttatcaccaaggagttttccagcggatattctgattataatgatttattttttagtttcttgtttggattgtgctctgtacacttcctccttcttctttaaactatc

SEQ ID NO: 474249 - DNA, 483 bp, Homo sapiens
tccaacatcacagagctagtagatggtagagctggtatgcctgatacacaatcatgcagactttgaattacaatttccagtgacagccaatacttttatacataatactttgagcagaagacaggaacacccacttaaaacagctgacctgaacttacaagtacagaagtgttatagtgacaaagacggtgggctggacaagaagatgacacacatgcttcctgatttagcccatcaaaacctcacagagccaacagtttttcagtgtgtggctgcctatgcaccagctccacctgactcctttcttacctggtgcacgacccttcagttgaaaattccagcagcgtgcaacttgtctttggcaaatgaattatgccaggggctggccctcaatgtctatcctgtacaaagtcttcttcaaaaccttttgatgaactaaatgattagatctttgttgggttaaagtctgttttgtcagagact

SEQ ID NO: 474250 - DNA, 624 bp, Homo sapiens
tggtggatcccactgacagcttgcgctatgtacctggaaaagctgcagacactcaatgccagcccatgaaagcagctgggagggaggctgtaccctgcagagccacaggagcagagctgcccaagaccatgggaacccacctcttgcatcagcgtgacccagatgcgagatatagagtcaaaggagatcattttggaccttttagatttgactgccctgctggattttggacttgcatggggactttagcccctttttctgtgaagaatgatggtggtattttgatgggaattgggaaaacagtatggagattccctaaagaactaaaagaaggactaccatttgattcaggagtcccactactgtgtatctacccagaggaaaagaagtcattacatgaaaaagacacttgcacatgcatgtttatagcagcacaatttgcaattgcaaaaatgcagaaccagcccaaatgcccatcaatcaatgggtggataaagaaactgtggtatatatacatgatggaatactactcagtcataaaaatgaatgaattaatggcatttctagctacctggatgggattggagattattattctaagtgaaggaactcaggattgaaaaa

SEQ ID NO: 474251 - DNA, 581 bp, Homo sapiens
ggtacaggtggtgtttggttacatgaagtaagcaccttgcaaatgacaaagctggtcttaaactcaggcttagttcaacccaggctgcttagctctagcaggtccttactagaaatttccaatatgcatgcatttattttcacatacgatttttccagagttttggaaaataataataaagaaagaagtcaccctgattatcacttgacccataacttgctgaaccatgttttctttttcaagtattactattccggactcactagtaactcacagtatttttcttctaacaagtgttactccaattatgtctgcacctttggtcagctactgtgtgaaataaatattcggtacaagctacatttactcatttgtattcttagtgccactacccttaccttatctctttcatgttctacctgccccaggccttggatcattcaaattcatagcaggccaagcgattatcaaaactgaaaatctgacctgactctcctcctgaaaacccctccatgtttcttcctgcattttataaccttttgggtctcctgaatgctaaatctaatctcccctctcctgaa

SEQ ID NO: 474252 - DNA, 556 bp, Homo sapiens
agggtcagcagcctcaaagaccgaaactagacaaactcacaaagatgagaaagaatcaacaacaaaaaaatgctgaaaacccaaaaggccagagtgcctcttcttctccaagtgatagcaacatctcttcatcaagggtgcagaactggatggaggatcagatggatgaattgacagaagtaggcttcagaagatgggtaataaaaaactctgctgagctaaaggagcatgttctaacccaatgcaaagaagataagaaccttgataaaagtttagaggaattactaactagaatgaccaattcagagaggaacacacgtgacctaatggagctgaaaaatacagcacaagaactttgtgaagtatacacaagtatcaacagccaaatcgataagacaggccaacatgcaaattcaagaaatgcagagaacactattaagatacgccacaagaagatcaactcctaaacacataataatcagattctgcaaggtcaaaatgaaagaaaaactattaagggcagccagtgagaaaggccaggtcacctgaaaaggga

SEQ ID NO: 474253 - DNA, 3237 bp, Homo sapiens
ctatcggggggctgcactgtcaccctggcagcaggcagcagaggtgtcagtgacagcagtggtcagaggagcagtcctcctctccctgactcaggctccagagggccatctcctcctgctcgagtttctgggggaatcctgagcagggcccagcccccagccccgagatggttcccaggcctgcgccctcttgctacgtgttgcagagaccacctgggacccccgcacatagagtagcggataccacggggtgaccaggccctgtgggtggaggcgtcaggaatgggaaccggcacttgggtggggagggctggctggggttgagtttctgctgctcctgcttcccaggaaatgcagccagggtgggcccagcagttcctatggagtaggaagcctggacgctgtggtgtctccagtccccaccccagggcccagtcactggccagcttgggccaaaaggagaggctggactttagagggtgggtgtgagtgtcttcactgaaactgacacctgccacccagtggccagcatggcaaggtgaggctctaatgctaccactctctgcatcccgttctaggcttttctggctttgcctgcccagttgctccgcgcgaagaggagggactacctgctgcttgctggaggctagagcctgcgacactgtggctcgcctcgctgtggttggtggcagcgatggggactgcagagtgccaaagcggtaggagagcagtgatggagactgcagagcgacagagcggtaggagggtggctggctgctgtcagggcacagttgactgaattatttccctagtctgtcttgtcgccactcttgatggccacatgagaggagctaaggtaatttctggcagcctgggagtccttgggaaaaacagaaggtgccacagactccattttaggaggagcctctgttttcctcatggacccccaagaagtgtgcccccaactagtcctcagtgccctccgtgggagtccaatgaaaagagcctgtggggacagcgcttgcccatctactcatgtggacgaggactgggtgctttgtgaggagtgaagaagacagtatggaggagttcacggagtccgagggactggacattatcatattgcatggctcagagcagcacgcatggacattcagcatctgtaaggggaccatgcagcagaggctgacagtggagagtgcagtgcacataaagacacgccagtgtttgcggtgtgcaaatggcgactatgggatagcaatggccgatgtcaggctgctggcagagagcgcaagacatgatggaaacaccattggccacaagtctacagaggtcttggcgctgacctggatgcttcctttgaagctggtggtggccaacgcagtggcagcgctctcagaaatcgccgagtctcacccgagcaacaacctgctccatctgaacccacagttcatcaacaagctgctgacagccctgattgagtgcaccgagtggggccagatcttcatcctggactgcctcaccaactatacgcccaaggacgaccgcgaggcccagagctatgggcatacgcatggcctggcctgggagctaacagaagcccagggcacctctgttgagttcagggagatctttgagctgaaggcagagctcaatagtgacaagaaggagaaggaggaggaggcagtgaagaaagtgattgcatcaatgaccgtgggcaaagatgtcaggtgtgcaggaggtgtctagggacccatgtctcccctcatacagctcccttcataaaactttattcccagtagaaaattttgtttactcaggaatcacaagcccagatgccgacaggtcaggtggtgatggaattttaaaatctcaaaggcagagactggattttacaacagtttaatatttgcacaatatttgagagtctgcacagaacattttgagatttgttttctcagtagttccttacaattcccatattgtaggtaatgacagttttaatgccactgaaataaaaacataaagtgactgcctaagagtcacatggtttatggcagaactaggactcaagcccagttcttctgaaatccaaatccaggccactttcacccatgccctcgtggtgcccagccctgtgcctcataacccgggtgctgaggtggagcagctcccatccaggtcccaagataggctcccactgctccagacgtccccatggattgcccccagcaaaggacctcctgccagcagctccgggaaggagctctgcagagagccctttggaagccagagcagaaagggagcaggcacctgctggacaactgggcctccatccaagtcagattccttccaggacaaagctgctctccttcacccagaacaccactgtcacctcctcacagaggagaaacatctttgttcttccatctcaaaagagctggctttgctgatatgacaggccccaaagagcaagtcagcctcatcagcagtttttcctcctccctcctccgcattcttcctgactgggctggaggaactctaagaaacagacttcctgctgaccctcctgcgccgacttctaggcatgtctttggtccaaatgtgggctcctcttcctccctcatgcaaatgaactcttaaagattagtccaccaagtcttctagagaggtctacacaagtctgaattttaaggtaaaagtggctgagatttaagttgagagtcagtgtggcagattcctggctcttaaaggtttttactttgaagaagataaaatgcacgaatcctactagggcagaaagagttcacaatagatgttttggtgacaaagcacttgttctacatagcccaagggtaaatgccaatacctattcagaatggagcagggaaattgaaaataaatttgaacccttctaatgtaaagcttctgtttcatatcctggctcttagcagctgagtgaccttgggcaagtaatataacatttctgagcctttattttctcaccctaaaatggagataacatcaatattgtctccatcactccgaaacccccttacagtttggtaagaattacatgagataaaatatgtaactagcacagtactagcacaaaataaggagtcagttaatattagttcttcttcctccaccagctcagctcctttgctcttccttatccaggaaatacagaaatatatggattcactgtagaagctggacccagctcttcagatg

SEQ ID NO: 474254 - DNA, 588 bp, Homo sapiens
acagcagcagacagacgaaaacagagggtaaacagcctgtaatgacatggtttggctgtgtcctaacccaaatctcatcttgaattcccatatgttgtgggagacacgctgtaggagagatttgttgaatggctttgaccaaaatgctaaaaatgatatggacaatgaaatccaggttgaggtggtctcagatggagatgaggaacttcttgggaactggagcaaaggaggcccctgttatgttttaataaagagactggagtcattttgcccctgccctagagatttgtggaactttgaactggagagagatgatttagggtatctggctgaaaaaacttctaagcagcaaagcattaaagaaatgacttgggtgctattaaaagcattcagttttaaaagggaaacggagcataaaagtttggaaaatttgcagcttgacaatgcaatagaaaagaaaatctcattttctgaggagaaattcaagcctgttgcagaaatttgcgtaagtaaagaggagctgaatgttaatcaccaagacagtgactaacatgtctccagggcatgtcagagacctttgcagcaaca

SEQ ID NO: 474255 - DNA, 766 bp, Homo sapiens
gacgtctgtgtgattcacaagcacttgagaaaatgatccaggcaggagatgaaaatgcaaaaagccatcgtgccagcacggcacacccacgtgaaagactcagaaacggtgaagaggaggcacagaggcaggaacgcggaggaaggtggccaacgcgaccaagagaccaccgaaaacagaatgaccaacgcttcagccgtgatacagacggaggaggagagttggctttgcaagaagcagatgataaggtgctctctctggacacgcggcaagtcaggggctcctgggacacccaaatgggatcagaacagaaacctaagcagaaagacaagtgtaacaagaacagaggtggaaactgaggccattcgaggagtggaggccctcagggacagcacttgtggctggtttagcacctccaagagcctccgagcttctatgatggtcaactctttggtgaaacctggagtgccttttccaaatctctagatgaaatgctacctgatttatgaatcactaataaaagccaatttaatctttacattggttgaaattttgtttgtgaacagacctcaccatgaaagtaataggaagccaatagctgtttttaaacggacacgacgcatgctggtacttgctgtgttagtgaacattgttctaagtacagtggtgtgtcacttaacaatggggatgcattatgagaaatgcactgttagcttcatcattgtgggaacatctcagagtgcacttacacaaacctagatgggac

SEQ ID NO: 474256 - DNA, 2217 bp, Homo sapiens
ctggtgttcacgtcactagctctgggactcgggaggagactgaggcacacagatgatcagttgtaatcacatggactcaggggagaccaggtatccctgtccatgaaaattcctcctagtggcataaatgccctctgataaactcatccccatgactacatgatggttggtgggaaaaccaaacccaagacgccgatgtcctccagggatcctgctgctggtcacaggatgtcacttgtccccttatctgtgggggtgcttgcctggaagtgcagcggcggcgagtggggcaagtcttccctcaagccctgggacagtatctgggtgggctggttcccagacacaatgaaggtacgtgcaattttgtgtcagccctgctgctgggggtgggatgtggggttgctgtcagtggcagcagccacaggcagatggctctcaggctcatgcacttgggtttcctttgtcatggagctggcctccttggtgcactgcattgcccattccctggggtgtaggactcttgtgtgggctagagtgctggagacgcggtcaaaccgctggtctagccggcatcatgctgctgtagccctctaagtggataaggggagatgtcaggggggctctagggatgtggagatgcagggctgttgggccccagggcaagaggcaatcctcatggggtctgggctctcaaaatggcacgtgctggagcttcttggatctaaagtgtgtgtgtggtacccagcacgactccctctggaacaatgccattgcgtggacaagtacaggcagcatcctatgctgtctcagggcccacaagagctgaggggctctcccatggccagggttgcaggaatctgtggtgggaatgtggacccctgggaatctctcacttaccttttcccctgcactggggagctcatctggtcttgcttttctctccttccatatctcggatggttctgtcacttccccgctgaattccagcattctctgttagatgctctatttgacatgtgattatctgttttgctccttctttgtggaggagacgaatgttgggcacctctagtcagtcaccttgaagctcttctccaagtgtcatttttttttttgagttttaaagttggcctgttggtctttttattccggatacaactcctttgtcagacgtgtgcgtactctaagtattttcagttattttgtgggttgtttggtcatttcctttaaggtgacttttgttggctagaagttttcaattttgatgtagttcaatatattgcttttttctcctatgattggtaatttttgtgtcctctgtatgaagacattgtctattccaaggaggttatattatatatatacacacacacacacacacacacacacactatatatatatatacacacactatatatacacactatatatacacacactatatatatacacactatatatgtatgtgtgtatatatatacatatatgtatacatatatatctatatatgtatacatatatgtatacatatatatctatacatatatgtatatatctatatatgtatacatatatatctatacatatatgtatatatctatatatgtatacatatatatctatacatatatatggatatatatctatatatgtatacatatatatctatacatatatatggatatatatatctatatatgtatacatatatatctatatatatagcagggaagcccaagtctgtttcttcctatccaaatgcagttcaacagttaggcttacttgtctctttctcatttatttatgggagctctttttttcctgttttgtaatatcttttggactccacattttcaatttcatttgcactgccttttgatatacaaaatgtgtttattatttttaggtttcctgttttaagaatgttcctcaccttaaaccacttgatagaaaaataggaaaaggttataaataggcaactaattgaagttaaaataactgattagttagcactcctgtgagatttttcaccaagggaattagcaagatatatatattttttgaaaaagcaacaacttttgttgctactgagcctgcaggggaaacggtcctcctgcttgttccctgttgatgggaatgtgaattgcttcaactttttggaaagtaactaatcagtatctattaaaagtgtaagtaaacatagctatggctaagtt

SEQ ID NO: 474257 - DNA, 640 bp, Homo sapiens
ctatacatagcacagtatgtatattaaacaaatatatatgtatattaaacaaatatttactgaacatgtactagacccctggcccagtgccaagcacagctctgatgctgatcccagcagccgcagccctgagtccacccagagagccccttttccatcttggaggccaaccagccagtccaagcagaaggtgacaaggaatgctgctggaactcagcatccagtctcacagagcctgaagaaaggccagtcagctggtcctcctctcatgcctgttctgctcgacacaaaggactggaagcatcagtgtgtctctggagtccagcatggagccagcagtgagaactgctgccaaggtgttttcatggatgttcccactggacttagtcttctctctgccttgctgcagctgctccctgctataaaatgaggataataatacctccttaacaagatcggcatatgggtatataaagcatttagcagtgcctggtacataacatgtgttgagtaaatggtagctatgattataataatctataaactgtgaatactatctattctgcctacttcgcaggagtgcatatgaaatgagggaatttatatgaaagtactttgaaaaactacaaaatttacatac

SEQ ID NO: 474258 - DNA, 581 bp, Homo sapiens
catctctctattgcctgtcagcagtaacctataaaataggcgcagtcatgggctatgtcaaggtggtcgccaacattgtccacccaatgggcttcagtgatcgtggacacaagctgcaatacagctccttctgcagctgcaataccactccagctgcaatatggcggttcctgctcatagccatccttggccacagcatgtttatttctcatatggatgccattcctcataatacccacatttgcacagctctgaaacagctcaaattcaaaaccaaagtggtacacactagggatggtacaggtgaatccttcaccagagaaatggaaatggaactgagtattataaagggcttccttgaagacaatgggctagaagggcactgggagggtggtgatatcaaagagaaaatgacaagttgtggcgaggatgtggagaagtcaaaaccctcgtacgtcgctggtgggaatgtaaaatggggcagccactttggaaactattttggcagttcctcagaaagttcagcagggagttactatgtgatccagcaattccactcctaggcatatacccaaaagatc

SEQ ID NO: 474259 - DNA, 639 bp, Homo sapiens
gagcctgtaatggaagggatgctggacactgaggagtcctcctgggcattgttgcttccctcatactccctgtcaacacatcttatgtgcagtcacactatcttccaagggactctcaggacttccccttctttccatatctatgggaaccatgcttgccagctacgctcccgcttagccttctgggatagtctcctaactgctctgctcaaatccatctttgcccccatccgatctattctccatcagccagaagccagaaagaggatctttcttgaatctcgtaaacttgggaaggttcctggaggtaaagttcacaaatgtggcagaccctgtaagaatgtggctcctaggagtttctcactcacggctgtctacactcaagctccagcaatttgccaaaactcccacttgagtcttcctaccagtttatgattccagaggtttctgctctagtagtagtctttgaatatttttacttatgaaacctaaaaataattgcggacaataatatgtcccccaaaaggttttgaattgacacctacaatgtgtatcttaagtttaaatagttgccaaggaagaaattttctgtgaattataaatagtaacattttaaaataaaactgccatattgtgctt

SEQ ID NO: 474260 - DNA, 648 bp, Homo sapiens
gcacctgtgagcagcccattcacattgcctgcctccagaactatgagaaataaaagtatcacttacgttatccaatgtgtggtattctgctctagcagcctgagtagacttagacaagctgcaaaagccaactggattgtgggctccatgaggttgacttccaacattaacctaaaaagcttccgcacagcaaatgaaaaaatcaacagagtgaacagaaaacctgcagaatgggaaaaaatatttgcaaactatgtaaccagcaggggactaatactgggaatttataaggaattcagacaactcaacaacaacaacaaaatcaatctcattaaaaagattcatgtgctgaacgtgcaggtttgttacataggtatacatgtgccgtggtggtttgctgcacccataaacctgtcatctacattgggtatttgtcctaatgctatccctcccctggccccccaccccctctaacatatatactcacttgctaaactcacaactttgctttaaaagtaaagttttgtgattggcagataatgaaatgcctaagatataataactataataatgataataatgataataatgacacttcctgaagacaggccccttatgcatcttattcatagctccgtcccttcacct

SEQ ID NO: 474261 - DNA, 654 bp, Homo sapiens
agaaagtcttctctcctctttccggtccaggtctttgctcttggccacatgagctcaactgagatggccaaggaatgcaatggcttgagacataagacccccattccagggaaggccctgccctatagccagaaagatgcaatgcatggtcagcaaagccaaggagaatctagacagacaggcctttctggctctgattcctccaagcttaccttccacaaccatcaccctgctcagcaaacagagaaccctgtattcaccagattttgtctttctcagactgcaaaatgtggttttagaagtcctaaaatggcttcgacacaggctgctgttgaagtgcagagaaagtcagtgcagaagtgggtgcagggagggtttggcttggaggtcaagaaagtggactcttacacagtctgcaagaagaagctgggaatagagaaagttccagattggctcccatcagcttgtccgccattgtcaatggctccagccatgagcccctgtgctaaatgatggactctctaccgtaatcagcagcatatttacagcaagagggcaattatctgaggtccaaactcttagtcttgggctgaaaatagcactggctgtatagatttctatgagaacagccaatgagttgccatctccaaaatc

SEQ ID NO: 474262 - DNA, 673 bp, Homo sapiens
agacttaggactgaattatttagcaaaaaaagagaaagaaaagagagtggggttactaagaacttgcatgatgtttctggatgacttagctccagagttcagctttgctgctgctcattccaaagcagaggcagcagctgagcccaggggcaggatctgggaagacttacagcgtggggtgacaggtaaggtggacctgggagaggaagtagatgagaatataccagaggaggtggcactgggcatctcaggctttgagacaaaagacgaagggtcatacaagcaagaatgcaacatgcatgataaagagtggccaagccagttgcagctggaggtaggcattcaggatgcaagagcccaggaaggcagtggtggcactattggggccttaagtgcctctctctttctggagcctgttgccttcaggactgcccttagactgctgaagttgctgggcacaatagacaaaatcctaaatatggagataggaaattaactaataaaaaaatgacaagaaaatatttttacaaaagataatttaagaggaaagtaaaagctacttccctctttgtcttgtagcttccttttctatgaaacatgaagcccagggcttcttggactaagtgagagagtgaagaaaatgtaggtattaaaattaacagccagagatggc

SEQ ID NO: 474263 - DNA, 650 bp, Homo sapiens
agcacctgtcttccctttagcctcatcagcatggcttttactgtccatatttctattggattttggtcacgagcacttaatcattctctaacaagtttcaaacattccttcgtcttcctgtcttcttctgagccctccaaattcttccaattgctgctcattacccagttccaaagccacttccacatcttcagccacacccaagtcacaggaatagcctccagacaaccatttaaaagggagagacttgatcaaaatatagacttcagatcctttgtctttctctcttcttcctctgtggatgttggacatgaattcctaaggtacagatgccttcttgaagccatgagacaactcgaagatgctgagagccacgagaacgcagaaacacaatccagacatccttgtattttttactctacaccagcaaccacctactgcagatttcttgctttgcaaggaaaattaacttttcagtgtgtatattcctaagtattttaattttttgcagctattgtaaaaggggctgagttcttgatttgattctcagcttggtcactattggtgtatagcagaggtactgatttgtgtacactaattttgtatcctgaaactttgctgaatttatttatcagttctaggagcttttt

SEQ ID NO: 474264 - DNA, 1017 bp, Homo sapiens
catctacaacaaccatatttccaaaagccagagctcctgagggtggccatgtgcattctcatcaaggccgtgccaagcaccaagcgccccaagagctctggcaattcgaaaccctcacctgcccttactgcttcccgccagctggtgagaaaggagtgtgacttgggagctctgggacctgtggctgctgtccaaagtgaggacagttttgtggagggcagtgcagagggcactgccggccctgaaccactcgatctccgtctcgttgaaggtgtggttcaggaggttgatttcctggggtgcttgacgatgtacttcaggggcttgccagcgtcaagtccttcaggctctgaatggtcagcttgtccacaaggtgaatcttgttgtcagctggggaaggggccaaactcgtgggtgacagcatcgtgcacagagttggccttgccattttcaatgttgatggcaccactgagcaagttgttggagatggtgtccaagtgcccacggaacttgagtcaggggccggcagctgagatgtggtcagtggtaccccatgcgggggtgctggtaggtgtcctgccctgggccaaactctgcttggggaagctcatctgcatccggagcctccagcttgaacttcttgccatccttgcctgtcaggtagttggtctctgggttgaacttgagggttcccacaatggccagggctgtgacagtctctggggatgtgatgaaggcatgggtctcggggttcgtgtcattgtggcccatgaagttcctgttgtaggaggtgacaattatgttcttctcctgcttgttgatgtcctttctgtgcaactgaccaatgcaggggccacaagcattggccaggacgatgccacccacatccctcaaggtctgtgcatagccatcctgctcaatggaggcacggatctgctcggagcatggagtaatagtgaactgggacttgcacttgaggccatgggccagtgcctgcttggccacacctgctgagca

SEQ ID NO: 474265 - DNA, 580 bp, Homo sapiens
aggcacagataggttgtataatggacatgcgctcagataccagggtgaaggctatgccagtaaaattaaataaaatgaaaacttcatatccccagttatatgagcccatttctagtgctcagcagtcccatgtgggcagtagctactatatggggcaatgcagatataaaacatttccatcatcacagaaagtcctttcagatagcattactctagagctactgcagggtgtgaaagaaatcagagaagagaaggaatttttaagaagtattgcttcgcattataaatcagattttctttatccttctaagagagatgcagataaaaaactatttttttcagtgataaagatacttttgacagttgatctctattgttttttgtatggaaccagccatgtttcagtaaggcagcagaaagatggtgcattgccatcctgcatgtctaaccgcctgcccagcccagggcttcaatgcactgaagtgtgattttttttttccttcagttttatgacttagagtgcaggataggaacaaaagtcaatctttcagacttaaagagcagagtgccccttgctgac

SEQ ID NO: 474266 - DNA, 571 bp, Homo sapiens
attgtcattaattccctcctgacaatgaaactttttcttaaatgtgactttgttcagggactgggccactgggagcactgggatttatatagtttagagcaatgtttgctgacattgcttgtgactacttatggcaacctccccccagactctagatccgtctgcctcccaccccttgtacatcagaggatgtctgctgtctctgtttcagcccttcccaggctgctcaacgagcccccacaactgggagatttggatgggccctgcctcttcactggctgcaaagcaaaacaggatgctggctgtgtcgatgaggagcccccagaaacccttcctcacgatctgggattgtactcagacagccacggctcggttttcccttgggtcctcgacaaagcagttgtatctctccacctcacggccacagaccactcggagatcaaggcttctgcatgccccccctgtcttgaatggaggagaagagaaggtttcagtggttctccaaatgtgtcctgaggatgacgcttcaaaactaactaagcatctccaagcctctaccccaagttagctc

SEQ ID NO: 474267 - DNA, 1058 bp, Homo sapiens
gagcacagacatgagagacttaaagtggccgaatggaagtcttgacttccagtttaatcaaatcatcactgtgtcccaatggcagaacctatccctccctaagacctctagaccaaagttgcaaggatgaaaagcaaaaatatcactggtggattgctagctgtcctggatcccagcccgctactactctccccaagtcccaaccatttctgggcaatggtcattggcccagggctcctaccgaaagtttaatgatacagacaggcaatttgggctttgagcagagttacctgcttctcccagagagacgaggacagattgcctccagcaggggcacagcagacaaaaggcacagactgacctgggcagcccttgctaggcaaccaagctatgaaatcacagctcactggcaccagcccaagcctctctcttcccctgggctcatgaccagaggttggtttccagtgggcaactgattacctgctgtgccaattctctttgcattgtgatctgaagatgggcctggggtctactatgatatgaaaatgtcctacagtacctggcattggaggtgtatgggtagtgggagaaaaacaaggtttgaaatctacagagtctgaaagtaggtcatggggcattcctcccatcattagagggtgtacatttgttggtgaaggattgattcatctcccatcaacaccttgtcagcctgaagttcctttgtcagaaatatacttgataatgcgggtccaaattgtatatgtgtcatatcctataaagcatggatccatcccatcctctattgtggccacaaatgccttccacagtaacctgcagccgacctactactgacaaatcccagcaaatgtgtggtagtcacttctcttcctcgggtctgcagggactcagggtgcagcactgttctcagatttgggctggagctcagtatgactgttggggtctcctgctacccctggagcctccatgtgctccactcgggttgggatccagcagtgcagaggtgaactctgggcgcttggaaggcagcagcctctcct

SEQ ID NO: 474268 - DNA, 683 bp, Homo sapiens
ttgacatgtggaaaactatacacaattaatgtatacaacttgatgagtctggagtttaatgtaatactacttgtctatttttgcttttgctgcccaagctttttgtgtcatatccaaaaatttattgccaagaccaatatccagaagcttttttcctatggtttttctagaagatttatggtttcaggtcctatgtttaaatatttaatcaattttgagggttttttgtatggtatgagagcccgggtcttcatgggaaaacctggagcctggatctatgagggcagacccacaacaagtcttgagaggcagcagcagcaaaaggaggaggagaaggaggaggaggaggaggaggaggaggaagaggaggagatggaggaggaggagatggaggaggaggaggaggaagagggggaggaggaggaggaagaggaggaggaggaggaagaagaggaggaggaagagaaagaggagggagagaaggagaagtaggaggagaagaaggaggaggaggaagagaatgaggaggaagagaatgaggaggaggaggaggaagagaatgaggaggaggaggaagagaatgaggaggaggaggaagagaatgaggaggaggaggaagaggaggaggagaggaagaaagacatagcaaggcacagaatagagtagaacagaaagcaatgggg

SEQ ID NO: 474269 - DNA, 636 bp, Homo sapiens
gcagccagaggaggaagagcaagtggaagcggttatgaaaagatgggataccactgcaggaacgtgaagcactgtctcttttctgccaagtccaagcttcatcctttcttccctgaaccagagcaatattctcctcactggccttggcacatccagtttgcctcttttccgttcgattccaacacagtgaggttttacaaatgtcaaccccatgatggtgcttctttgctccgagctctttactggtcctcattgtctatatttctgaccatcacatatagggccctacttttatctctctccactgttgcccttgctgtcttgactccagccacactggcctttaggagcatgctccttcctgcctctgggccttcctcacgtactcttccctcttcctggaactcctactcaacttcagctctcaactcaccatacttcctcaggaaagccttctctgcccttccagagcagggatgggcagtgattgaaagctggcaacaagcccatatttctctgcctcttattttctcacgtatctcctaggaaatactattcgatctgaagaagtacttaaggaaatattaatttttttctaacagttatttatctgtcagcatgtttctccacttctgc

SEQ ID NO: 474270 - DNA, 588 bp, Homo sapiens
ccgccggtttacactgtttctccaagccatcacagctgatatctcctggccatcaccaataattctaaatgacaaatgtttcttctaacaaccccacaatatcaccctttaccacaaaatcttccttcagcttaatctctcccactctaggttcccatgccgcccctaatcccgctcgaagcagccctgagaaacatcgcccattatctctccacaccacccccaaaaacttacgccatcccaacactttactactatttcattttatttttcttaatataagaagacaggaatgtcaggcctctgagcccaagctaagccatcatatcccctgtgacctgcacgtacacatccagatggctgcccgcctgcacccaggtgaaataaacagccatgttgctcagacaaagcctatttggtggtctcttcacacggacgtgcatgaaagtaataatacaagaagtagggatttcaaaatctccagagtgtttagagtctttggaggggcagtggagagacacacatcccaaacttagcccacctattcaatgcattggatggcaatcttcatagttacaaatggtagag

SEQ ID NO: 474271 - DNA, 1576 bp, Homo sapiens
cagcggacgctcactgagcacctgctatgtgcgagctactgtaccaacctctgcccaaagagaggccgaagggatacctgtggagatccggtgagaatacctgtgtgaatacccatggggataccagtgaaaaaacccatgagaatacctctgtgaataccaatgagaatacctgtggggatgcctgtgagaatgcctttgggaatgcctatggaaatgcctgtagaaatacgtttggaaagacctatgggaatacctctggaaatacctgtaggaatgcctgtggaaatatctgtgagaaagcctgtggggataccagtgagaatacctgtggggatacttgtgggaaagcctgtagaagtacctttggaaatacctatgggaatacctatggaaatatctgtaggaatacctgtggaaatatcaagaatacctgtgtgaataccagtaagaatacctgtgggaatacctgtggggatacttgtgggaaagcctatagaaatacctttggaaatacctacaggaatacctatggaaatatctgtgggaatgcctatgggaatgctgagaatacctgtgtgaataccagtaagaatacctgtgggaatacttgtgcggatacttgtgggaaagcctgcagaaatacctttggaaatacctatgggaatacctatggaaatatctgtaagaatacctgtggaaatatcggtgggaatgcctgtgagaatacctgtgcgatcaccaagaatgcttgtgagaatgcccgtgtgattaccagtgagaatacctatgagaatgcatgtggggataccagtgagaatacctgtgagaatgcctgtggggatacttgtgggaaagcctatagaaatacctttggaaatacctatgggaatacctatggaaatatctgtaggaatacctgtggaaatacctgtgggaatgccagtgagaatacctgtgtgaataccaagaatgcttgtgagaatgcccgtgggattacccgtgagtatacctacgagaatgcatgtggggataccagtgagaatacctgtgagaatgcctgtgagaacccctgtggggatacctgtgagaataccatgggaatgcccgtggcaatacctatgggatgcctgtggaaagctgttttcctagagaagatggctatggatctgctcccacacaagaaaaaaatgtcctagccgatcaagctaagccatgatcattttagcttcaatgtttttcaaagtaccttttactaatctcccaagaaggacttagaaaattcctaatactgcacccataagatgcctaatgttaagcaaatataacctcctggtgagtccctcgaatggcttagtgggaaaatggaaccctaagtgactaaacgagtgaatgcaattcacaggttgttgaataaaagccaactcaatgttggaggacatctgccaaaaatgacaattggggggtgggagtagctcatcctgagccacttttttctgacagtaatgaggctattcctggttcatgacaataaaaccatgtcatctgcatagaaaagacttgtaactttctgttc

SEQ ID NO: 474272 - DNA, 4776 bp, Homo sapiens
cagctcccagtcagagagaaagggcctcttcagtctgtctcaggagactgggagaaacagcataaaggaccccacaaggaagggagaggtaccctgggtcaggcgcttgtggagagagggcttcgcatgtaaagtgacgtcagggaaaatagaacagaaaaaaagccagggccagcccagaggcacctgagaagaatcagacccacagctcagcccagccctggcacagagaagagacaggcctggcagcacccagggaccccctttcctcagcctccacctgcaggacagcaggagcactgatgcgctgaaggtacgttctggagtctggaagcagcagaactgaaggaagtaaacacgggtgtctgggaagacccctcaagctgcagtaaagcccaggactgaattggccacctgaggccaagggtggcactccaacctcctcctaaaggctggctagagccacaggaaagggccagaagccagagaaagggcaaaggtggacccctgcctccaaacctcctctggagactgacctcctctttcctgtgccttattgtttctccctcttctctttgttcgccactgggcggtgacctcagggatcctggcctaacctggtgattgtgcaggcaactgtgtccgagaagacccttctctggaagattgaaccccaattcagccatggtgactcctttgatgtcaaactggtaagggctgagccgtgggcacaggataccactccttccagctcttctgctgtgacctgcccatggaagtccctgtggacacgaaatcctgtttggatcatctaactggaggctctctgttcttcacctccacgcgccctcttgaccccaggaggttcaggggaggaagtacgccactctccactggcaccctccttggcctacacagagtcacccctgagcccctcaatgtgtgctgaggtgggccctgctctctgcaggggtatggagagaaatagcttggggtgctgtgaggccccgaagaagctgagcctgtccttctccattgaggcgatcctaaagaggcctgccaggaggagtgatatggacagaccagaagggccaggtgaagagggccccggagaagctgcggcctcaggctctgggctagaaaagcctccaaaggaccagccccaggaaggaaggaagagcaagcggagggttcgtaccaccttcaccactgagcagctgcatgagctggagaagatcttccactttacccactacccagacgttcacatccgcagccagctggcagccaggatcaacctcccagaagctcgggtgcagatctggttccagaatcagcgagccaagtggcggaagcaggagaagattggcaacctgggggctccacagcagctgagtgaagccagtgtggccctgcccacaaatctggatgtggctgggcccacgtggacatccactgctctgcgcaggctggctcctcccacgagctgttgtccatcggctcaagatcagctggcctctgcctggttccctgcctggatcaccctcctcccagcgcacccatgggaaacacagcctgtcccaggtcttcccatccatcaaacttgcatccctgtgctatgcatccttccacctccacaccccaaatggggcagcatctgtgctacttcaacatagagattggacatgctctccccaaatgagccactttcctctccaggtgaaggcaggtagcagatgtgccctgggcctctggggaaatcgatttcacaatccaaaaatggcccacagcccaggaagctaccctgaacatgccagttggaaggctgcaccagactcaaaagcaaactaaacaataaaggacagctctcttctctcctggctaaagctgctctcctggttcagaagacaggctggatgagatctcaggccgagctctgaaatagggaggtaatcctccagcacctgtgtttcctctaacttgctgtgtgacctccagccggtcactcaccctctctggacctcatctgtaagaggagccagctggataagatgatttctgaagacgcttccatggtgggcactgaggcacagaggaggccaaggagaggttgtttgttcatgcatgcattcatccgtgacacatgagtacctactgaggactccataaacagaacgggatacagagataaacaatttgggttctgtccacgtttgtcaaaaggtggtgctggcccacctctgaaagcagaacacttgctcaacaaccttgctgttggcccaagtctaacacattctttatgactgtgagcatctcagagtgagagaaaaatgtagaaagttttttaaattctaaacaggatttagtgtctttagttatcttgctggatgggaaagggatgttgtcatttctggcacaaatgaaaagtaggacggaaagctcctttcattcagtttatctttccaggatatatgaaaagggaccagctggaagactagcctcactctgtcctcgaaagcctgagctttcattcaactccctatttccatgcaaagacgctgggcaaaccacatgttctgtctgagcctcagttttcctatccataaaatgaaggtagccaggcctgcctcaaagagcattcaggaggctctgagaggacatgagagtattttgcaaagtgagggcaaggcccagtgtggagtgatattgttattccaagattccactgcaaaagtggctgctttggatgccagcccaggatgagtagttcctgttctcagggaggtcatccgctgagcatcccttctgcacagatgtctctgattcttgtccttgcaggtggaggacagggcctgctcccctaagctgggaagcctggaatgacctcttgcacaagcctaaattccaggaatcttccccaaatcccagatcctctgcaatctacctgcacccctgacccacccaggagttggaccgggagttgggaagcctaggtcttagtcctacactccttctaatttgctgtgtaaccttaccattaatctctctgggtctcagttttctcatctgtattggaggtagcagtgctagctctgccttcaggcatgcaatatgccagaactacagacaacagcccacaggatgcaaaagtgctttgccatcttaaaaatgccagatcactcagagcctatgaatgtggatatcaacaccaggtctctagcaccgctggatgaaaggagaaggctagaggctgagggaggaaagagcagttaacaaacaaaggcagtagctcatcacttgggtagcaggtacccattttaggaccctacactcaaatgtgcaaaataaaatttctatcattttgctataactggatttactttctatgttgtttgcaggaaatgtattctggtaacttctaggttactgatgcctcaggcacttcaggtttaaaggcagtcacttgagatcgttgccctctgttccccttcttcccacaggggtctttgctaggctgaggggcagggttggagaagtgtttatgcaaatgccacctccagcctcccagaggggatgtttgcttcccagctttctcagtctcctactagtgtcttatctagcctggccttgggcatgacccctctgccctagagatgtatcaccccattcaactccctattgggggttcactccacatcctccgctgtagcctctcaccacagttgtgaatcctcgctggcttcctctctttctcatgagcaagaggaaaagctgacaactatcccacacacttctagggccatgggagccctgggccaggcagcaggtctcattcattctagacctcctacagccatttctcatgccctggtgataggaaggtcatggatgagacttgcagatctccaaacttgtaagaggaatggaaaagatgcaggtcccctctgctctggggtcccactcccctttctcagcaacatactccttccccaggctcctcttgaaacaggattttctcaaccatagagattcagatgatcagatgtctcagcttcactactgaggtaaacattgattttgtgaggccacttctttccccccaggaattttctccccaataactatttttattccctttaccttatgtgtgtgggataaaggaatcactttagaactcttgccaggtgtgtgaccttgggcaagtggcatgtcccctctctgtacctgttccctggataacaacaatttcttgcctcttagagtttctgtgacaattaaatgagttaatacattttggcacatggtggacactcaagccatattaagaaaaactcattttcccaaatacaccttctacctctttctacttctgagcttgagcatccattctgatctcaagctctattccaggagttcttaaaccagtctccaggaagtcaaggagctcccaagagactatgcaaaattgtgtgtatctgtgtgtttattttttctagggaaagggttcattgctttcatcagcttttcaaagagctctggggcataaaaaataataataataaagaatctctgtcagacatatctgagtcagatcttgacagcttcatattctagctgtgaggactacagacttgagagaagatgaaggataactattttagaaaggtaaaataaaaaaatattgctatggtttgaatgtgtcccccaaaaaatgtgtgtcagaaacctaatcaccgttgtaacagtgttaagaggtagaacttttaagaggtgatt

SEQ ID NO: 474273 - DNA, 1594 bp, Homo sapiens
gcctaagtaccaggaaattaacaccacagcagcagccctccatgatgactggtctccttctggggaacccaaacgatgccatagccctaatctttgcaaatgactttcttgaagttggcttgggtgggagccagggccgtacagcaggaaacgaaaagacacagcgctctccccatatttcaaatactcccttgtctacagatggcatcggggaagtccttactgaagaactgacacttgctgaactgaattttcgaggtggaactggtagatggcatgaaagaagttgttggaagacattcccagttccacgtgactggggaagcctcacaatcatggtggagggcaaggaggagcaagtcccatcttacatggatggcagcagcaggcaaagagaacatgaagaagacgcaaaagtggagacccctgataaaaccatcagatctcctgagacttactcactaccaagagaagagtatgggggaaactgccccatgattcaattatctcccactgggtccctcccacaacacatgggaattatgggagtacaattcaagatgagatttgggtggggacacagccaaaccatatcacttactaaaatggcaatttcatatgatttaatctaatgtttttccactgaaaagtaggttttgtgtcccctgccccaccccataactagagtactctgctcctttcatcaaattatcagatgttcttaatgcttctgtatgtgtgtgtgtgtgtatatatatatgtgtatatatatacaccacatatatacatacatatatgtatatatacacatatatacatgtacatatatacgtatatatacacacatatgtacgtatatacacatatatacatatatgtgtgtatgtgtatatacacatatgtgtatatatgtatatatacctacatatgtgtatatatgtatatatatctacatatatgtatatatatccatatgtatgtgtatatatacacatatacgtatatgtgtgtatatatatacccatatacgtatatatgtgtatatatacgtatacacgtatatatgtgtatacgtatacatgtgtatatatacgtatacatgtgtatatatgcgtatacatgtgtatatatacgtgtatatacgtatatatacgtgtatacatatcatatacacgtatatatacgtataatcatatatgtatatatgtgtataatcatatatatacgtatatatgtgtataatcatatgtatacatatatatgtatatacacatatatacgtgtatatacacgtatatatgtggtgtgtatatatacatatatgcatatatgtgtatatacatacacactatatatatgtattttaatctcctgtctgcataacttggtgccaaggttgctgtaacccctgctccacaggtcttcctgcctctcgtctcttccatatcagcttgcttagctttgcaggagacagagtctcctgaaaaagggtttctttgtctcattccacttcttaaaggagcctaccatgggtttttttttccagcgctcttcaagggtacccgaagcgaatttgcaccaaagcagcagctgc

SEQ ID NO: 474274 - DNA, 1077 bp, Homo sapiens
gattttttctgagcagtctgggagcctggagcagccccaggatgtgctccctgccccagatgtgctccctgccccggatgtgccccctgccccggatgtgtcccctgccccggatgtgctccctgccccggatgtgctccctgccccggatgtgtcccctgccccggatgtgctccctgccccggatgtgtcccctgccccggatgtgctccctgccccggatgtgctccctgccccggatgtgtcccctgccccggatgtgctccctgccccggatgtgtcccctgccccggatgtgctccctgccccggatgtgtcccctgccccggatgtgctccctgccccggatgtgctccctgccccggatgtgtcccctgccccggatgtgtcccctgccccggatgtgtcccctgccccagatgtgtcccctgccccggatgtgctccctgccccggatgtgttccctgccccggatgtgctccctgccccagaggtgctccctgtctcaagtgtgctccttgtcctagtgtgctccctgccccaggtgtgctccctgtcctagtgtgctcccagtctcaggtatgctccctgcctcaagtgtactccctgtcctagaatgctccctgccccaggtgtgctccctgcctcaggtgtgctccctgtcccaggtgtgctccctcccccagatgtgctccctgcctcaggtgtgccccctcccccaggtgtactccctccctcaggtgtgctccctgtctcaggtgtgctccctcccccaggtgtgctctttgtctcaggtgtgctccctaccccaggtgtgttccctgcctcaggtgtgctccctcccccaggtgtgctccctgtgtctggtgtgctccctgctccaggtgtattctctgctcccaccactgctcaaaagctcactctggcccctgggtctttgtacatgcaattcctttgccagggtgcctgctctgctctagccaattgtcccaccatttttaggaaccagcaggagtccccacctcctccaggaggtcttttgagtctaccctgtggttgagtctgccagccttgact

SEQ ID NO: 474275 - DNA, 572 bp, Homo sapiens
tcccacaggcctggatagatgtggcgcaggtagtaggtttgcgctgcagctgaggagcactgagcttaggggatccacctcttttataacaggtactgaatgcttacaatgcaccaggcaaatggagatacagcagccaacagaacaaagtctttgacctccaggtgcctgcattttagtacagaaagacagacaccaaataaactaccaggggagcacattgtacagggccttgtagaccaaaataaggacttggaactggctacgggatgggaagccaaagaagtttgcacaaaagcacgtcacaatccgattgaacaggctgtcgagagaacaaacttcggcgatggagagctgacgtgccagcttggagtgggtggtggtggtgaggtactcgctcactttggcctgtcacagtccaacacacaagggaagcagccttgggaacactcagcagtcaagcaggtgaacagaggagcatccgttcactgtcatcctcaggggctgcttccaggtactggaggtagaaggcaggcagccacagggtgaagatcaagtaattggagtcagcc

SEQ ID NO: 474276 - DNA, 948 bp, Homo sapiens
aggtagccacatggcagcctcccacaatgggctccagcaaaccatgggaacatgcttaagggcgcctgcctcctgatttccaggagacagcttaggactatgtgcatcaacatggtacaccataagatgcacatcattcttttgtcacctgacgtggatattctgccacatggacaggccctcaaaggggcctgccccaaacctcccaactgtaagcagcccattgactgctttgtcgttacccccattctatccatatggtgtcagtatccatttgcaccgtcagcactgaccatcacaggggacggcttaaaggaaacccatccccaggactgttggatcccatccagactgacaccaattcctgggacccataatgacccagagtgccactgtgattgttcacgtagacccacggatgatgactatttcagtgacagacgccggtggaagccgttggttttacatacctgcctaaatattttaatcagagtcaacagcaaattcatggaggagttagagagattgctgccatcatcaaggtttaaagggagcagaagcagtgattcctgtgactcacctgttcacctcttcaatgcagccagtcgtcagcagggaaacaactgtttgtcttccaacagcagaacaaagcaggaagctcatcagtagaagctgccattcctaaggtgttcttgttaatgaagcaaataaacacagcctgcagctctcagtctctatcaatcaggcttcttggtcaagcagaggtaccatctctggtttttaagggcagaaaacaacatgaaattcactggaatcatatcagaagagccccacctgcagaggaggctggagtttggcttggaagataaaaagaagccaagacagtgacacggtatcaaggctgcgagcacaagagccctgctttgtgaggagtgacacggccacagc

SEQ ID NO: 474277 - DNA, 2677 bp, Homo sapiens
ttaggaaggctgcctggaggaggcaggccttgaagagccttgacctgtacacctgagaaatgggcgtggtgactcctgctggcagcagcagtggtgcgcgtggggacacgcgtgcggggagtcaggcgcccccgggtgctcgcggcaggaaggagtgaagcctgcgggcgggtgtgggggcaagaactgaagccgggggaaccagacgggctccgggtgcgggggctccgctggggccacgccagtccgcctgcagcagccggcagctccggaggcggccaccgggcggcgctgtggagcagggaccccggggcccgcaggggcccgcggaggagtgagaataattagtaacagcccctgtctggggtgcacttcccgggggaggggagaatgaggtcactctggtccttctgtgacaggagggaaaacaggcgaagaagcccatccccccaaccaaccccccctaattcaagtcggccaacactgcggccatgggaggatccgggtttggagtcgggggctctgggtgaggtcctgattctgacctctgagggacctcgggctgctcggcctggtctcccacctgtagacggggacacctgtgcctccctgcagatgccggctgcaaaggggcgttgccaactgtctggtgccgagccagagtcagtgcgtgcctgggattgagaggcgaactttgagagatgaggataaaaataacagctgccgatgctgagctaaatgcctactcttctttatactctcttaacagccggtgaggttggaggctgcagcctcgccccttctcacagacaggcctgaagccaagaaggcaggcctgggaagctccagcctcaggctgcgggctccaggccccacccttctgccgccaccttcatgatgccacaaagtcgaagtctgatttcattacccccctgaccccaagctggtctttggctgccaggaggtggcaaggccatttgcggccccctccgcacccagtccttccctgcagtgactgggctgtgaatagcctggcccatcctctccacggccccacctttgccgtccccatgctcaattgcccatatcctccctcctctcacctgccatttcccagtcattccattgtctcgcgctctcctgcccactgaggtgcctctggcagcttcccaggtcctccctgactggttttggaaccccaaaagtggcccccctattcctgctgccccattcaatgtcccacagcagccccagacacctggagactggcagaggctgcgagaaggctggccccgtccaggctgccactctgcccacccgggcctgctggcttcccatccctgcccagcccctgctccaggccactcagctgccacgtgcagctcctgaatgccacctccgtcacccactcctctgctcccagcctgcccagagctccccactgcctacaggaaaaggtcccaggtcattagtgtgtcgtcctcacctgctcacctggcccagcccccaggcagatggggggtgtcaaatgggaaatcagagagtaaggggctccatcacctggaaagtgcaccattcactgtgacccttaccgtaggggattgctcagattcccctccagcggtgataagagactgggggtgggcctgacagggtaggagtcaggggcggtggaggagatctcacagccaggacagagtcgccgcctgctccagcccacagggcagacatcggggtccccatctgcagagaagaagataggaggcttggggcacacagctgccaagcggaactggcattggcaacaggcctgtcctttgcccccaacacgcacgcagcggggcttctctgtctcttcttggcctccttctcactgtgggcactgtgagagcggaaagcaacctccacccagcaggggctctggcttacttgccccattatcaaagcccctgcaaccgcagtggacggctccagcgaccatgaccaagaagccctggctgctgtcccaagcctgagcagaagctggtgggaaggaagccatggtgaatctacaaggattaggcctgaaccgtggaattccaggcaggcaggcagcgccgcaggagccggagtggagtgagggatcagaggagcggcacgaggagggaggcaggtgggagggctgtgaaaggggaacaggtgggagagggaaggtgagtcagccccgagcagagctgagccagcaggagtttgcagcgcagccaggcctgggagcctccctgcagctgcgggctttcggcaccgcgtggccccctcccccagtgcccacactggcactgccctttggcactccagaagtcctggctttgggctttcacttgcctcttctgtgtgaccctgccacaggaaagaggcctcaagtttccttctgcagcagcgcagcatacggggtgcacagtgatccacccaaacggcagctatgctgccggggctggtgagacgtggtcattcacaaggcagctcgctgtgctgcacagcaggttgctgcccggagtcgccatgaaggaatgtgatgcagcctattggaggagaaccaaaccccaccaccaccccagaaagccataccagctgccgacatgtacatgggctcatcgggggttttccaggcccactgatgttccagctgagcacagctgcc

SEQ ID NO: 474278 - DNA, 5926 bp, Homo sapiens
gcctgtagactcaggaggccaaggcaggtgtccagataggcaacgcccgctgggaactgtactgccttgaacttgcaattcagcctgacggtcaaatgccaagtgacaaaaccatcggtggtggggatgactccttcaacatgttcttcagtgagattggggctggcaagcacgtgcccagagcagtgtttgtggacctggagcccactgtggttgataggtcctcgggcactggatggcagctttcctgggagagtgggagagcattggtaaaaccccacgtgcgctcctgtgaagtgcacacagggacctacaggcagctcttccacccagagcagctgatcagtgggaaggaagatgcagccaataattactccagaggccattataccatcggcaaggagaccttgtcctggaccggatccacaaactgctttgggggcggcaccgtctctgggttcatgtctctgctcatggagcggctctcggtggactacgggaagaagtccaagctggagtttgccatttgcccagccccccatgtctccatggctgtgatggagccctgcaactccatcctgaccacctacacgaccctggaacattctgactgtgccttcatggtcgacatgtcagtgcaacctggacatcgaaaggcctaccacgagcagctgtccgtggccgagatcgccagtgcccacttcgagccagccaatcagatggtcaagtgtgaccctcaccatggcaagtacatagcctgctgcatgttgtaccgaggggatgtggtcccgaaagatgtcagtggggccatcgccaccatcaagagcaagcgcaccatctacttcacggaccgctttcttgcccttctctggcaggtgggcattaactaccagcccctgacggtggtccctgggggaaacctgaccaagttgcaatgggccatgtggatgctaagcaacatcacagccatcaccaaggcctgggcctgcctggaccataagtttgatctcatgtatgccaagcaggcctttgtgcaatggtacatgggggaaggcatggaggagggggagtcctctgaggctcgcaaggacctggcagctctggagaaggattatgaagaggtgggcatggattctgtggaagcggaggctgaagaaggcaaagaatactgaggggagggtgtggtgggctctcctgccgcccccagcatggctgctttcaggttgtttgcaattaaagtttctctataaaaccaagacctctgtgtgtcatgctgcttggctctgcctacaggagcaggtgggaccccagagcctgcatggacagtcagtggggtcccagcctgccctgctggcatgcggttggggtgcagcaggagtgtatgtacttaaggagctgccatggaagtgacttgacccaggagaaacaagccaagcgttgagtggataggtttcctaaattctaggaaagctaagtcagggtttcaactgaatttgcaatttttggggcttttctattgatgggatgtactggctaaaaagaagagcctagaagcagagtgtttaaatctgaggtctatgaatggggcgtgtccatgaaatccctaaagctgtaggtcaaatgtgtaaggtcaggacattttagaagggggaaagtgttactgagttctccacagtatttgtgacccacagaaggtcacaacacacccatcctgaccccccactgctccatggtaacctggaaggcagcatttaccctccacgcacacacacggtcaccttgcccctcagcattgtcaactgtcttggtagaaaaccttgcacctttcacttcaagtgaagtgtgttaacatctgtttgtaaaagacctgggaatccagatatcttttctcagaaccaaagtcagctccaggaagttgactcaaggtgaagtgacctggttagttcagctgtggcacaaccaggacctgcataaaaacctcattctatgtttgtgccataatatcatcaaaaaacagtagagaacatatgacccggaccctctgcatctcagaaagacttattatcaactgaaggagacaacacgtagcctttgctggggacagtggtgtgacaagtctctggcccatcctaggtgctgccccgcacctgctgccttcttccaggcccaccccacttgggcagcctggtagcgctgggctggcggggtgtcctctggctggatcctttgcggccgctgcattccaacagggccggcactctcccgagggaggtgctgtctttgtttctccctgaggagacacaaagcgcagccaataggaacggacgagccccgtaactgcagcacctactgaagtgtgctccttgagcaacatttgtgtctgcacatttccctcaaagccacttcaagctgaaagccctgtatcagtcctgagtcctgaggctcagaactgccaaaggcaggtcatgccccagaagcccttggccacgggtccatttagggaaggaaaagcagatattcatagctctgggaatggaatgcaacccttgtggagagcctataaacggatgcatggggggcgcctgtccatatggataagatacggctataaacgccctcatcttgccacagctcttctaggcctctttagggtgaaggcatactcccttctgagaatttctggtctaaccagttgtctagcttcacgtcctgtttccatggattgtttgtaaccagcttttgttgcaattgttactgctgattaatatcttgctaatcataggttatggaaagactgtgtttctgttctaagactctgttagaaattactgatgcacacactatattgtaaattcttatctttgtataccgtacttctacatacaaatgtactgtacttctacatacaaatgctatgttaaagaattacttcatccccatgtgaccatctcacctcataatcaaatgaccctaaatccctcactaacctacccccgccctcactaaacttaatagtaaatgctggtatatccagtgcattgttggcaccatgggaccagaaggcagtgaccccctggacccagctttcactatcttgtgtgtgtctattatttctcaacctgccaatccacctaggagcaaagagagagccccattgcattgcgggctgctggccagatccctcaataaagcctctcactctggagtttagctactggattccatgactgggttcctcccgtggtctgaatgcttgagactttccttctgaccaccagagaatcccagatgaagaccactggttcagatttccctcgatttgtaatttgcttactcctttttgtgaagatagaaagatctgcaaccacacttgggccagagctttattttaacgggatggatttccctggacttggtgttgtcagcatcagcaagaccgagaggaccctctagaggacaaatgtgcttgggtagaaggcttgcccatggggtcacagccccccatgtggagtaccttggccagggctctcctttgctctggcctggtagagtctgccccatgggctctaaccagggcatgtgtcccctgcttgactcacagtgttgggtctcccattttgtccccccagctttgtcctgaccaagagtgtgccttgactgctctgtgacctggtcagctgtatgttccccctgcaggctcaaaccctagctggggccttgcttcttaccagacactgataaacatgttgtttgttgcctgaaacagtaaaagatctgacatgttgctaagcatgtggaaactggccccgccccagccaaattccttgcacccttatataaactccacactccaccccctcactgcagcatgcctaggcagaacctccatccttgccgtccctcgtgaggccatactgcagccttgtgtgtatggaagttcccctaacacatgctttggactgaccaccctcacattaagtgcttcttcctttggaattccaactggctctcatcccaactggctctcagtcacccaagtggaaggtctggggcagtcccttgcgggagctctcctgccaccacttttggggtgagaccagatgacggttcagccaacagaacactcagcctcaatcctggttcttccctggcctcttaccaagtttagtcaaatcacctgcaattggaaactgcgctcttgaaaaaaagatgcaaccaggtgttttagggatccatgaggacatttccgtttcaccatttgtcatcttgaacaagtggaggctcctgtgtctgagacgccatggatcttggctactccagaggccactccagctccctttccatgccaatactgaaaagaaaattctccccaaatccctgcagggataggatggccctccttgtgagagtttctggggagttcttcctcagagaatgagatctttgctgctcggtgggtggtgaaggaaaccgctactgtaccttctgcttgaaggtaaagttttttggattccatataagtgagatcacatagtgtttgcctttctctacctagtcgatttcatttaatgtaatgtcttccaggttcgtctgtgtttttgcaaatgacatgttgtcatgaatttttatgcatgaggcatatttcatcatgtctgtatgctgaagtcccttcatcctttcattggttggtggacaggtaggttgatttcataccttggttactcattgttagtgagtagtaggtcactaaacctcagaaggcagctgttgcttcaacagaccgatctcattttctttaagctcacaaccacggttagaattactagatgaaacagttcttgcatttttaatttctgagggtgctccaagtggttttctcagtgcgtttcatcattgaaatttctcccaatagtgtataagaggatctctatatctaacagcaccctgaacttttatttttaaattatttctgttttggtattattcattttacttagcgttagatagtatctgagtgtggtctttatttacagttttgtgatgaccagtgatgttgagaaacaccttttttaccttttaatcaatatcataccttcttttcagaaatgtctgttattcaggtttttttgcccagtttttttgggggtattgggtcttgtatgttttgtccctctgtagcgttagtttctgctgttgtcagataacactccctttcagatatatgattcctcataatttcctttttttgatgtgtaaaaagataaacctattgtggcaacagccaagaacggtaataatcaaatgcaggaattaggtgccatttatatttccccactcagagtataagacttcctgcctcacagaagtaaatgagatttttctgtgcatatagtaaaattttacttttcatattttaatttttcgtgtcctaaaaagttaacacaatttaattaaaaattaaagccactaaaacatttatgtaacaatttctttttaaattttactttaagtcctgggatacatgtgcagaatgtgcaggtttgttacataggtatacatgtgccatggtggtttgctgcatctatcaacccgtcatctaggtttcaagcctggtatgcattaggtatgtgccctaatgctctccctccccttgcccccaaccccctgacatgccatggtgtgtgatgttcccctctctgtgtccatgtgttctcattgtaacaatttctttaattaccacataaggtactatgttatctgacaaatctatgttttacagagaaattgtagaaaagtcattcacaagtttcttcttgatttcaaactgtaacacaatgttgtaagtaatgcaactagacagaattcggctggatattgaaattcaacataataaaaaatatatatgctggtttatccatactactca

SEQ ID NO: 474279 - DNA, 997 bp, Homo sapiens
catgagtcagcagcggccggcgaggagattacccagtctcctcctgcacccgacggaggagaccccatcaacgtggagggcctgctgccatcaaaaataaggattaatttagaagataatgtacaatatagtgtatgacatcaccgatgtcttagatggaatcgacctcgttgaaaagaaatccaagaaccatattagatggataggatctgatcttagcaattttggagcagttccccaacaaaagaagctacaggaggaacttgctgacttaccagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtggagcagggtcagaccagtaacaaaaggtctgaaggtgtcaggacctcttcatctgagagcactcatccagaaggccctgaggaagaagaaaatcctcagcaaagtgaagaattgcttgaaccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagatcggtggcatgcccagtggctttgggggcaaggatagaaatgtcatcaggaaatagctgaattcattgtgaaacatgaattcagt

SEQ ID NO: 474280 - DNA, 3327 bp, Homo sapiens
gtgactatatacttacctttcccttgtggattgtgccttcaccctggaatgtttatgccctatcaccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtgactcgaagaagccttccaaaaagcatgtgaaaaggaagccctactctactaccaaggtgacttcagggagcacattcaatgagaatacaagaagatatgctgtgcacaccaaccagtgtaggagacctcatggctcccgggtaaagaagaagaggtacccacaagaagatgacttccatcatacagtcttcagcaaccttgaaagattggacaagcttcagcccactcttgaagcctctgaggagtctctagttcacaaggacagaggagatggagagaggccagtcaacgcgagggtggtgcaggtggcccctctgaggcttgaatctactccccatgaggacaccgtacacgacatcactaacgaggacgccacacacgacatcgctaacgaggatactgtacacgacatcgctaacgaggccgccgacaagggcatcgccaacgaggatgccgcccacggcatcgccaacgagtacgccgcccacggcatcgccagcgaggacgccgcccacggcatcgccagcgaggacgccgcccagggcatcgccagcgaggacgccgcccagggcatcgccaacgaggacaccatccagggcatcgccaaggagtacgccgtccacggcatcgccaacgaggacgccgcccagggcatcgccaacgaggacgccgcccagggcatcgccaacgaggacgccgcccagggcatcgccaaggaggacgccgcccagggcatcgccaacgagggcgccgcccagggcatcgccaaagaggacgccgcccagggcatcgctaacgaggccgccgacaagggcatcgccaacgaggatgccgcccacggcatcgccaacgaggacgccgcccacggcatcgccagcgaggacgccgcccacggcatcgccagcgaggacgccgcccacggcatcgccagcgaggacgccgcccagggcatcgccaacgaggacgccatccagggcatcgccaaggagtacgccgtccacggcatcgccaacgaggacgccgcccagggcatcgccaacgaggacgccgcccagggcatcgccaacgaggacgccgcccagggcatcgccaaggaggacgccgcccagggcatcgccaaggaggacgccgcccagggcatcgccaacgagggcgccgcccagggcatcgccaaagaggacgccgcccacggcatcgccaacgaggacgccgcccagggcatcgccaacgaggacgccgcccacggaatcgccagtgaggacgccgcccacggcatcgccagcgaggacgccgtccagggcatcgacaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggttggggggggagggatagcatcgggagatatacctaatgctagatgatgagttagtgggtgcagcgcaccagcacggcacatgtatacatatgtaactaacctgcacaatgtgcacatgtaccctaaaacttaaagtatatatataaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacaaggcacgctaacgaggatgctgtacacgacatcactaatgaggacagtgtacaagccatcactaatgaggacactgtatatggcatcgctaacgaggacactgtacaagccattgctaacgaggacgctgtacacaacatcgctaatgaggacaccatataagacatcaccaatgaggatgctgtatatgacatcgctaatggcacccacaaggcatgctaacgaggacgctgtagacgacattgcttataaggacaccgtacaagacatcgctaacgaggacgctgtatacgacatcgctaatgaggacgttgtatatgacatcgctaatgaggatgctttacaagacatagctaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcagcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggacttcgacctttgactcaatcactataccccttcctattttctctctcaagttgtc

SEQ ID NO: 474281 - DNA, 2804 bp, Homo sapiens
caatccacactgtgaggtccaactgctgccatgcagacagggtgaaggcacaatccacactgtgaggtccaactgctgccatgcagacaggacacgaaccggtgctggtccatggcttgggtgttggggaccattggcctactgtattcagcacagtgacatgctgcacagagaatctgcaatctccccaagcccacaaaattcagccgtcacagtacttttcaagcatgccagcagccctccccaacaaacgaatccttaatttcttacagaaacatcttctgggcttcctgtgggacacagtgcggaactgtcggcaccgcagcattattatcactgcagctaccactggagatggctacagacaccagaaacggaagagcacctctcccctcctccggcagtgtgactttcagtcggctcctctcgtagccagatgtgatacaccgttaaacaatgggaaaaaatggaagcaccaagaaatagatccatagatatgctgaatacattggacttgtaataaaagatatgatactaaaagtcagtagaaaaattatactattcaataaatgatgtcagaaaaaacatataaatttttatccatatagaaataaaaatctgtatattacagcatatcacaaaatcctgtatctatttaggttaaagactcaaatcttaaactacttgtgaaattacttatgaatattacatgtttaagatatttaaaagtatatacagagaactaatgacgttgggcaacaaatggcttattaatcaaatgccagaatgcatgaagaagaaaagaaaagaaaaataaattagactgtattaaaatgaaaaatcctaggcatcctaaataaaggttaaatgcaagccagaaaattgggtaaaatatttacaaaatatataattgaaaagtataatatccattatataaagaggatttctacaaattaatgatataaaataaataatatagtagaaaaaatgattaagaactactacacaatattcacaacagatgataaatagtgaattattgtgaaaagacaactgaaaagagcaaggtacaattcaacagcaataagactttatgcccttttctataaaaacacaaaactatgccaagggctttaggaaccgtgaatttatatacggcgaaggggagtttaaatctgccactttgaagagttttttggaaatatatagtaaagttgaaaatatatacatatgtgtatatatatatacccacacacatacacatacacactagaaattccacaaggtaaaccttctccaggagaatacacacacatttgcagaagagatgtccaaaggtgtttgttgaaacattattggtaatagctaaaaattggaaataatcttaaagctcattactaggaaaatggaaaagtgaatcgtggtatgtgcatataatgtaaaactatacatcagttaaaattaattgtctgaatttatatggatcaatttttatatattgaaacatcgttgcattccaggaataaatcccacttggtcatggtgtataatccttttaatatgatgctgaattcagtgttgttcaagtgctgtatttccttacttatgtctggtctggttgttttattcatttgtgaaatgaagacaagggacaaaatcctaagacatcccccttaaaacggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcggccattcatggacaaaactgcctttgcaagagttttaatatccaggcaggaggtggcaaaactctagcaaagcccaaaaccaaggagagctgctttgagaaggcaggtccacacaccagtgacaggttcccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcgtgcctgcccaggaattcagtgatgcctttacatacccttggtaacaggcctgctgatctcagtctcagctatggacagtaaagtagccctgtgactccattccagtcttgctttgccacagtctgggcacagtccagcccatcctgggacctggtgaaagacataccatccattctcctaataagaggaccaccaatcttgaacccaaatgtggtcaccaaagctgtcctgtgacttggctctagccctgctctactgtggtctggaggcagtcctgtcttcccatggacctacctagtaaaccagcaggagctcaatctgggacccacagggagctataccagtccatgcccttggtaataggcctgatatctgaagacttgactgtagaactagaagtggccccatgacctggctccagtcctgttcaatcagggtatcagaggcag

SEQ ID NO: 474282 - DNA, 3884 bp, Homo sapiens
tgccacgacgccaggcctgctgccaagcccaccatgcacaaggagctgcctgcgttggctgcctgtggtcttgttgctgactttgaccccgtgggggaggaggaaactgcagactttggcccattggtgctagattcagacagtgacgattccgtggaccgggacattgaggaggccatccaggagtacctgaagcggggcccagccatgcacagccttccagggctgcaggcggaggcagtagatgtaagcgggaactggctcacagcagtgcccaactgccctgtgttccccaaaacttgtacctggctcaggtggtgtggccctggcagccaggtgggatccagcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggaacgccagcaccgcaaggaggggaaagcgagtcacgagcgccgtacaggcgcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggggatctggacgctgaccattcccccaagatcccaaaggaaaccaaagctccacctccaacgagcccggcttccaggagcaagtttgtggaatggtcctcttgccaggcagacacctccgctgagctgatcccactcttctactcccccaacgtgccttcccgctctgatggtgacagtagctccgtggacagcgacgacagcattgagcaggaaatctggacgtttttggccctcaaggtgcagtctagaagtttgctggccagaggtgagagctgccctcaggctgcccagggcccactttcaccacctggcctcagcagccagaccggcagccccaaggcccctctctctaaaacactggacccactcctggctgcaaaaggaagcatagaggcggctgccaaggcacagccagcgaggccccgggatgggagggcgccgctagggtgggacctttccatccagggcacagccagcgaggccccgggaggagagggcgccgctagggtgcccggtgacactcgcacgtcacagggccagggacctggacacagccatcaaggacttgttaaggtccaagtgaaagctcaagaagaggtccagggagcccagggctgtgtgcaggaagaaggtcaggttcagcacctcccagacgcacttccaggagcagctgggcaggctcctgagagagtggaaaaacaggcacctgcaggtgctgaagagctgcctaagtccaagagagacagctgcgagggctccaggaagaaaccccccagtgtctttggcagcagggccgagaggacgaagccccggccttcctgccttggctccttgtctgacaacagcagttcagtggacagcgacgatagcatcgaactggagattaggaagtttttggtggaaaaggccaaggagtcggggtccgagggccccacccggggcctgcccagcctgccccttgcgggcttctccccgctgctgtccacccagctcttccactttggaaagggtgtctcctgggggggcagggagaccggcctcttcagcccctacctggggctgcctctgcagggcctgtccttctcggccttcagggagtcccaggccaggcccagccctgtctttggaagcccacacttgctggcgaagaaggactgcggtcaccggccaagcaggaaggaccaggacaccttgggcagggacaccagtgatttcagcaacacctccgcagaggtgttgctgctgcagtggcggcagctcagtagtgaaggtataagacctcgagctgtgggttcgcgtcctgggttccatgcattcgtggaaagcggcatagccgacgtgactggaagtcctagccagaacaattaagcaagtaaagaaataagaatggaagtaaaatggtctccatagatgacatatttttatgtatagaaaactgtaaagacttcactaaaagactgttagaagtaataaattcaataaagtagcaagatacagagtcaacatccaaaaatcagttgcatttctatgcatagatggactggagggcattatgttaagtaaaataagccagacacagaaagtgaaatattgtacaatctcacttatgtgtggaacctaaagacgtcaaactcagaagaagagaacagaatggtggttgctgggagctggggaagagaaggaaatgggaagttgatggttaaagtgtacaaatttcagttatgcaagataaaaccctctcttgtaatagttttttacttaaaatctattttgtctatactttttttccatatatttactttttattgaatttgttaacgttacagagttcttgcactgccaaaccatgcctgagaattcaaacaaatggtacaatggacagcctcatccacccatcatacagtatattaaaacttgattcatctatattttgatattttcacaatcttttaaaaagttataataagagctggaatttaaatctgctgcaggtcttcagattttgagtacagtatgcctttacataacacctccacttactcatctctgttcattcttcagtaacataaaccccaacaacttgtacagccataacttgtacagccattcctgatctgttttggttactttttgcacggaatattctccattctctcatttttcaacccatttgtattggatttcaaatgagtctcttgtagacagcatatatagttgaatcccgtttttttaaatccaatcagccgatttatgtctttttattgggagtttaacctatgtacatttaatgaaattattgattaggaaggacttactaccaccattttggtcattgttttctgtatgtttagagcctttttgtccttctttcctcccttattgtcttcctttgtgttatagttgattttttgtagtgctatgctctgatttccttctcatttccttttgcatatattctgtagcttttatttatctgggaatgtcttaatttctccttcacttttgaaggacagttttgtcaaatatagtattctcagttggcaggctttactctttcagtactttcaatgtatcatcccaccaccttctggcctgcagggtttctgctgaaatatccactgataatcttctagaggctcccttgcacatgagaagtcacttttctcttgctgcttttaagattctctctatacttactaccactaaattctacacttaaaaatggtataatctgttatgtatattttgccacaataaaaacattggaaagaggtaccatagaagagtatattacatgcaccataggctggaaaacattttcagagatt

SEQ ID NO: 474283 - DNA, 606 bp, Homo sapiens
cagaggtgagatggcaccggatatatcggggaacctttcaaatacagagtggctgatgtggaatggggcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggttgggaaagtcccccttttattaaagggctaatagataattcatcaccgtgggttctgagtccttggttgaatataagatctgagcaattttggtgcagaccaaattagaaggaactagtgtgaaacttttttgatactgaatagcct

SEQ ID NO: 474284 - DNA, 471 bp, Homo sapiens
gggtgaagactcacaacatgagggaatgcacagatgccagctatgatggacagggcaagataatccccaggcccctaggtggtgtgtctgggccctggaggtcactggtgctaggccacgcaggcttgttctcaggccctctggttttatactcaggcactggctgtagtggggtgatctccaggctccctgcagtggagtgctcaggtggctacagcagtggtggcagtggatggtgggagcctgtccctaattctatccctcctctgcttcttatgttcctgctgtcttcggaactcagtctaaatctccccacaagacttccgctgcccacatgccattgcccctgcctgtctttctctgatctctcacaccaccatcccctcgtttgctacgttctagccacaacggcctccttgcaattctagaagcaaactaaccttttctccataactgaatctctcgatttgc

SEQ ID NO: 474285 - DNA, 624 bp, Homo sapiens
tgtgagcacattgtgagcgttcaatgaagagtagctgtttactccagggaacagttatatggtaccctcaattctggctgctgagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaagctattgcactgaacatgggagtttgtcgagtgtttttatcatgaaagaagttgtctttttatgcatttgtaccttttatatgtataagataaggtatacatgaatgtgtttaaattgactatcataaagatctttcagattccctaacaattgatcttagcaccaaaaaaaagcaccaggggatttttctccagtatttactgc

SEQ ID NO: 474286 - DNA, 1114 bp, Homo sapiens
atttgttttgctgggaattatttaggagagaaagctccttaactgaatggtaagttttaatgtgaggttcatgttttatatttctccacaaagctatacaaatggtaggagacaagtgaaaaactttgtgaaaaattactcagatgctgaaataaaagtcagggaagcaacttctaacgacccttggggtccctctagttctctgatgttagatatcagtgacttgactttcaacacaatttctctctcagagattatgaatatgctgtggcacagactcaatgaccatgggaagaactggcgccacgtgtataaatcccttaccctaatggattatctcatcaagaatggatcaaagaaagttattcagcattgcagagaggggttctgtaaccttcaaacactaaaagattttcagcacatagatgaagctggaaaagaccaagggcagttttaggtttacaggaaaattatgcagaaagttacgcagagttcccacatacccttccccactcagacacaatttctcttaataacatcttgcattagtgtggtccatttgttacagtttatcaacaaatgctgatacattattgttaatgaaagttcatatcttacattaggagtcactctttgtgttctacagttctgtgggttttgaaaaatgcatggtgtcatgtgtccaccattccactatcatacagagtagatatgtcctgtgttccacctattcatccttttcctctcctcttgaatccctggctaccactggtctttttatcatctctatagttttgtcttttcagatgtcgtatagttggaatcttaaagtatgtagctttttcagactggtttctttcacttggcaatatgtacttaagattcctccatgttctttcatagcttgagagtttatttttttcttccctttttttaaaaaaaaaaactttattgagatataattcacataccacacaattcacccatttaaggtgtacagttatatggattttggtgtattacagtataattttttagaattgtaactataacataaaatttgcctttgtaagtgtgcaattcagttgcattaattacattcacagtgttgtgc

SEQ ID NO: 474287 - DNA, 1115 bp, Homo sapiens
ggagacgtgctttcaggttcctacacatcaccctgtgtttggccatgggtaaattggtactggaggaggtggcaggggtccagctcaccatggatgatgatattgctgcgctcgttgttgacaacagctctggcatgtgcaaggccggcttcgcgggtgacgatgtcccctgggccatcttcccttccatcgtggggtgcaccaggcaccagctgcatgtggctcccgaggagcaccctgtgctgctgaccgaggcccccctgaaccccaaagccaactgtgagaagatgacccagatcatgtttgagaccttcaacaccccagccatgtatgtggccatccaggccatgctgtccctgtacgcctccgtccgtaccgcccatgtacaagggcttcacaccacggccgagcgggaaatcgtgcgtgacatcaagaagctgtgctacgtcgccctggacttcgagcgggagatggccatggtggcctccagctcctccctggagaagagctacaagctgctcgatggccaggtcatcaccatcggcaacgagcggttccactgccccgaggcgctcttccagccttccttcctgggcatggaatcctgtggcatccacaaaactaccttcaactacatcatgaagtgtgacgtggacatctgcaaagacctgtacaccaacacagtgctgtctggcggcaccaccatgtaccctggcatcaccaacaggatgcagaagaagatcaccgccctagcacccagcatgatgaagatcaagatcattgctcctcccgagcgcaagtactccgtgtggatcagcggctccatcctggcctcgctgtctaccttccagcagatgtggatcagcaagcagaagtatgaccagtccggcccctccatcgtgcatgccaccaagcctagctaggttttccatttttgttctattagaaacacttctgctctaaacgataatttataagactcctggaacacatagggaaggcttcgtcaaggaaatttgtcctatggatatactcacgtgtgaaatgacacgttcaaggatattcagggtaacattgtttataatagcaaaattttgaaaagaacttgaccaggc

SEQ ID NO: 474288 - DNA, 2398 bp, Homo sapiens
gaggaggcagggacagcacagtgtgaaaaatgccacagtgggtgatgcccagggcactggagaggaaggcttcctggaggaggtgtcaggggtcggatgaagagaaatatgggaaaggtgacaggagaaaagagtgttccggggaagaagcagcacttgcaaaggcggggtccctgcctggctcagccccactttctcctcgctgtccccagctgacccagcggctggacctgcagggcaatttgctgaaggtgatccccgcagccgccttccagggcgtgcctcacctcacacacctggacctgcgccactgcgaggtggagctggtggccgagggcgccttccgtggcctgggccgcctgctcctgctcaacctggcctccaaccacctgcgtgagctgccccaggaggcgctggacgggctgggctcgttgcggcggctggagctggaggggaacgcactggaggagctgcggccggggacgttcggggcactgggtgcgctggccacgctaaacctggcccacaacgccctggtttacctgcccgccatggccttccaggggctactgcgcgtccgctggctgcggctgtcgcacaacgcgctcagcgtgctggcccccgaggccctggctggcctgcccgccctgagacggctcagcctacaccacaacgagctccaggctctgcccgggcctgtcttgtcccaggcccgcggcctggcccgtctggagctgggccacaacccgctcacctacgcgggcgaggaggacgggctggcgctgcccggcctgcgggagctgctgctggacggcggggccctgcaggccctgggtcccagggccttcgcacactgtccgcgcctgcacaccctcgacctccgcgggaaccagctagacaccctgcccccgctgcagggcccgggccagctgcgccggctgcggctgcaggggaatccgctgtggtgcggctgccaggcgcggcccctactcgagtggctggcgcgggcgcgcgtgcgctcggacggcgcgtgccaggggccgcggcgcctgcggggcgaggctctggacgccctgcggccctgggacctgcgctgccctggggacgcggcgcaggaagaggaagagctggaagagcgggctgtggccgggccccgcgcccctccgcgcggccctccgcgcggccccggggaggagcgggcagtcgcgccttgccctcgcgcctgcgtgtgcgtccccgagtcccggcacagcagctgcgagggctgcggcctgcaggcggtgccccgcggcttccccagcgacacccagctcctggacctgaggcggaaccacttcccctcggtgccccgagcggccttccccggcctgggccacctggtgtcgctgcacctgcagcactgcggcatcgcggagctggaagcgggcgccctggccgggctgggccgcctgatctacctgtacctctccgacaaccagctcgcaggcctcagcgctgctgcccttgaaggggctccccgcctcggctacctgtacctagaacgcaaccgtttcctgcaggtgccaggggctgccctgcgcgccctgcccagcctcttctccctgcacctgcaggacaacgctgtggaccgcctggcacctggggacctggggagaacacgggccttgcgctgggtctacctgagtggaaaccgcatcaccgaagtgtcccttggggcgctgggcccagctcgggagctggagaagctgcacctggacaggaatcagctgcgagaggtgcccactggggccttggaggggctgcctgccctcctggagctgcagctctcgggcaacccactcagggccttgcgtgacggagccttccagcctgtgggcaggtcgctgcagcacctcttcctgaacagcagtggcctggagcaggagctcacattggggcctggcaactccttgcagatttgtcctggggccttttcaggcctggggcccgggctccagagcctgcacctgcagaagaaccagcttcgggccctgcctgccctgcccagtctcagccagctggagctcatcgacctcagcagcaatcccttccactgtgactgccagctgcttccgctgcacaggtggcttactgggctgaacctgcgggtgggggccacctgcgccacccctcccaatgcccgtggccagagggtgaaggctgcagctgctgtctttgaagactgcccgggctgggctgccagaaaggccaagcggacaccagcctccaggcccagtgccaggagaacccccatcaaaggaagacagtgtggagcagataaggttggccatggggcaggagggacccggaactatcgttgatgagagcaatactaatctcagttggcagtcacgtgcgc

SEQ ID NO: 474289 - DNA, 959 bp, Homo sapiens
agagggaggggaggggtatggacatgagattggcaagtggggcgcctgggctcctggtaaggtctgagcaggctggatttgggtcctgggagcctttggccaagtctctggaggacagggctcgagggcacagtgagggaggggactcagtgctcatcttcggtcgaggacagtcagtgacccacaccggcctgcccatcatggcctccctggccaacacagctatctccttcagctgcaggatcacctatccatacactccccaattcaaggttttcacagtcagctactttcatgaagatctccagggacagaggagccctaagaagccaacaaactgccaccctggactgggcacagagaaccagagccacaccctggactgccaggtcacccttgtgctgccgggagcatcggccactggcacctactactgctctgtccactggccacactccacggtgagaggcagcggcaccttcatcctggtcagagacgcagggtaccgagagcccccgcagagtccacagaagctcctgctctttggcttcaccggcctcctgagtgtcctgagtgtagtgggcacggccctgctgctctggaacaaggtacgggatcagtgctcacagccatgcagcccctccacccgacacgccaccggctgcccgcctgccctctgcagggcgtttggtgggccctggctactgctccaccctccggggaccttcggggccaagcctgggggcagctgagtcagcaacagccctgggtgtgaggcgtgaacactggcaccatcattggggtctccctgggtcaaaaaaggctcagcccctgcatctgaaggccaagaccctacccacacccagagaagagctctcttccacgggaatttatgtgttcattcattcaacaaacactgaaaacctacattccaggccctgttctaggcaccagggata

SEQ ID NO: 474290 - DNA, 528 bp, Homo sapiens
cctacacagatgttttcatcagccaggtggcaagcacagtacctgacgggtagcttttccatcctcaccctgctcccaccctccaccctcaagagtcatatggccaagattcatgacgtccccaatggctcctatagacaatgtcactattgtagaaacggagattggttttttgagatgtttttcacacttttgcattctgacaacctactgaccccacctggatctatgacgactcatgactcaaccagtccgtgtcccccacccaggggtggactcagagcacaaggattgttcccacccacttctgagtgcatccccaaccaatcagcagcacccattccctactacaccctcctcaccccccttcactcccaccccccaactgcaaaccaaattatccattaaaagcctagcctctgagttcctggggaggctgatcagagcaatcataaactcctgtccttccagttggccagccttgcattaattaaactttctcatcttttttggggggtggggtggggg

SEQ ID NO: 474291 - DNA, 794 bp, Homo sapiens
agccagagaaagtccttttctgctcttacagctcatgggactggaccagacccactatcccagccatgtctaggataatttccctccctattttaaggaaccaggagtttggcccgaacgagggcccaggcagccacgacgtggggtccaagacacgagtgggactgactccaactgcatttgaccccaacagaagtaaacacctcagccccaggggtgcgggcagtcccctccggccacgggccttcccaagccaggctcagccaaaagctacggccctagtcattgggagcagggctgggcctcagatcagagaaggtcccagtgtccccaggaacactgcacagcccctctgggaagtgtcccagtctgacgtgactgctacatggtacccggacggcctcccactcgatcttcagcgagtatgtgtcttccggccagagcgcgagggccagcagacccagggggaccaatccgagtccagatcggggattttgctaccttgcacccagctgattggctcaaggagaaccaatcagaacccagagttgggattttgcaaacaaaatgcagaagagaactttgtcttcccagtcccacggagagccagtctgtcaagaacagagatgaggagtggacaggaagagagtagtgggggcattggagcactaggcttggggagttcctgcttgtccgaatattcggtttggaatcttggcaattccacaagccagtgaatcttctttgtgggagagggcaggaggaactcagctcttggaggggcaacaggacct

SEQ ID NO: 474292 - DNA, 1188 bp, Homo sapiens
tttctggcacagacagcctgccactgctgcagcggggaggtgctacccgggctacacgttccatggagctggcaggagccctgccccttctgagttgcaagtctgtaacttctgcagccacccaagttgtggctgcagatctgagccttcctgtgctcttgcggggcaagcagggcgccaaaaactttattgccagtggtagttctggcaagacctgcatccatacagcaggtgaaggcacctggctgaccatcagtactttccacattgtatttatcgccagtcacctccacttggccgtcatagatcttgtccatgccaaacctatcaagaagcctgcgggccagcagcaggccagtacaatatgcagcagcataatttgtcgggccaaccttcacaccgtattttggcagttcgtgtgcatatgccgcgcagactatcatatccccctctatacgggcataagcaatctgacaaatgatatctctgtcatcaacaacatctgtcaaaggggagggcctgcatcgtctgctaacctgaaggatctggagaaccacgagctggaggagcagctggccgagctgcagagcggcttcaaggagctggtgctcagccccacctggggagcctccccttctccctagccctctgggtctttgtttccccacctgtgaaatgggcgttgtagccctcaacgtgaaatggtacttctgaaggcacctgtgagccagagccctgctcggatggctgttggggaggggggatggtttttctctaacctgcctccacccttcctggggccatgggagacaaaaggcagacaccaagttctggggtctccagctgcagtgggtggccactgattgcttctctctgtccggaacaaggagaacatggagatagccagtccgttgcagtcggagctgcatggcaagaaggagctgcaggagaagctgggctgaaggagacggtaaccctgccccatacaaaaagggctaggaggtgggtaccagcccctggggaggggaggtatgaggtcagaggcagctccagcgtgggggacagtgaccccagcgccctccagggcagtcctgtgactgtttcttgcttcctgccctctgacttttagaggcgggtagccccgggtctggacatcatcatactgaatagaggcatggagctgtccag

SEQ ID NO: 474293 - DNA, 883 bp, Homo sapiens
tgtccgaccatgagcgtccgggtcgcacgggtagcgtgggtcaggggcttgggcgccagctaccgccgcggcgcctcgagcttcccggtgcctccgccgggcgcccagggtgtagcggagctgctgcgagatgcgaccggggcggaggaggaggcgccctgggcggcgacggagcggcgaatgccgggccagtgctccgtgctgctcttcccgggccagggcagccaggtggtgggcatgggccgcggtctgctcaactacccgcgcgtccgcgaactctacgccgccgcccgccgcgtgctgggctacgacctgctggaactgagcctgcacgggccgcaggagaccctggaccgcaccgtgcactgtcagcccgcgatcttcgtggcatcgctggccgctgtcgagaaactacatcacctgcagccctcgggccatggcaagggaatccagagccctgggttggcgtcagtgtgaccatggacggagttgatggactgtaactaaccaggaaagctcctcctaaataaaggggcaggactcaatgattgtcaaggtcacttttgtgtgtcctcttccagctggtgcaccaagttcgtagaacctggctcactgagatgctgaacaccccgccagctctcaggtgatgggaagggagcacatggacaggggtgacattggcacatgaggacagggctttgctgtgattccttttcaagactgaaggattcattagggatttcccttatttttgtaatctcatgaaatctgcttgctgaactgtctaacccgctatcctgtgcactcatacctgcagcacctgcaacacgagagtatgtgttcagtagatattcgttgaattaaagagtaaataaatattgga

SEQ ID NO: 474294 - DNA, 632 bp, Homo sapiens
aagctgggatccccagagaagggcgacctgggtgccttggcccggaagagggaagggctccggcggttcgatggcacaatcacagatacagttgtacatcaaaagaggctgtggaccagtgccttccagcctcaaccacgccggctcaggtcacacctctctgctgtcctcaaagcagcttgtacttcgcctcttccaggaagcctcccatctctgtgctctggcccagtgccctggagcttggtgtccctggcagctcaggggtagtgtggcacagagtaggtgcttggtgttcacggaagatgctggtcatggcctcaagccacccaagagatttggcagccatgatttcctcccctcctcgggggccggggatgtggacgagtgtcaggacaataatggtggctgccagcagatctgcgtcaatgccatgggcagctacgagtgtcagtgccacagtggcttcttccttagtgacaaccagcatacctgcatccaccgctccaatgccggaccctgtgtgaatccagctcctcctctcccacgctggaagccttcccatgggcggctctactgactgctccccagattcctcgcctgcaaaatggggaagtggtgttacccggcagggc

SEQ ID NO: 474295 - DNA, 2525 bp, Homo sapiens
gaggtctggtatgggtggcgtagggtctattcctggtgggtcagtcgacgtggatgagtgctcagagggcacagatgactgccacatcgatgccatctgtcagaacacgcccaagtcctacaaatgcctctgcaagccaggctacaagggggaaggcaagcagtgtgaagaggcttctgggcttccctccatcatcacacttctgactctaggtcataattacttgtcttggtcccccacagaactatggcaaagtcttcaccatgatcctgtcattatcatcatctgcattatcaccatcatcattatcatcatcatcaccatcatcatcatcaccatcatcattatcatcttcatcaccatcatcatcaccaccatcatcaccatcatcattatcatcaccaccaacatcaccatcaccatcatcaccatcaccatcatcaccaccatcatcattatcatcatcaccatcatcatcaccatcatcatcatcatcaccatcatcatcaccatcaccatcaccatcatcatcaccatcatcatcatcatcatcatcatcacctgttctcactagctgtcaaagtagtttcaggctcaaatgagactatgaatggtgaagacctttgaaaattgctcagttctgcatacctgggaggtgatagttatggtgcaacatagtccttggtctccagaagcttgtggtctggtggggctgcatgagctggaaattcctgataacagacttagggtagcatgggtcatgaatcagtgtctgttgagttgccatgttaacagtatgagaacaattgttaggaaccaaaaggaggacatcgtttggttatgggcttcctaaaccctcaatagtgtgagaattaaatgagttaatgtatttaaagcctttgaacatagcttggcacatatgatgctgtatataagcactagctgcccttactgtgatgatgatgacggtgctattgatgatgagggtgatgggggtgatgataatgttgatggcgatgataatgttgatggtggtgatgataatgttgatggtggtgatgataatgttgatggtggtgatgataatgttgatggtgctgttatggtgctgttgatgagggtgatgatgatggtgatattgatgatgatggtgctgaagaagatgatgatgatgtatctgatcatcatcatcgtcactatgttgatgtcaatgatcacagtgttgttcaagatgtgaaagaactaaagctttgtcttttccaacaattcctgggacctaaaatggttgggaaatgaggtattctggttcatcgactgttcatataaaccatatgcatatacttatatccccacagaggtgaacagtcaggtgtgtcattcacagatggctgcttatcaagaacatacaataagaaacacttaggaaagaagactttcctttgttcaactaagcctacttcggggatggcaaatatgccatcaccttctgccatagcagacattaataatcaattaccgcaccctccagtcatttttgcagtagatgaaacttgctttccctccctgggttcctgcatctgcaggtcctgagctggagtagggttctgccaaggctggggttggagtcttggaggcagtgagccccctgtcctgcagatctcactgactgtgctctttgctgtgataagaataaaggatggactctcagcagagcatgccccgaggacatggctgccacattctccccagttcttcaccaccatgttgagtgtttgcttccagacaccctgctacatgttccacgtccatgatctcatttaatcctctcaagaaccctaccagatagggactatgccttccatttttcaagtgaggaaactgaggcatggagaggtaaagtgactggccaaaggttacacagttgatagaggagagctagaatttaagccccaaaccggcagttccgaaggtctctcctcttgaccgctgggtgatactgcctgcttttaactggctgtcccatagggactgtaagatttgtctttaccaactaatcagtgcccgaaatgtactttctctatcattttcacaacccgagcctggattgtgggaagcccgatgtgaggctgaccgagcctcttacccacttcaccaggtcaccttgaaacttctgctgcttgagaaatccctgttagcaaatccagccctggaggccacctgccccccattctgggaacagtttctcttcccaccttcaagggcaacttgtcttatggccagtggacatgtgtgatgatggcatagcctccacatgtggagacatgttgcatctgtgtccaggagtggcctggggccccctgcggtcagcctaatgccggtagagggcttgctgtagccagacaggtgagtgcctcagacagccgggaaaggctctgagcagggctggagataaagcactgttttcttgattgaatctgaagtgccttgaggcaaagtcctggctgtgtggagttggaagaaacttc

SEQ ID NO: 474296 - DNA, 996 bp, Homo sapiens
gctcctggctgcattcagagcttggggaagggtcccccactcaatcctcttaggcctgacaaagtcggacctggagatggtctgtccgagcggccggcattctatgtcgggatggaagggcaatgggctgtttaaattgctacttaggtttccagctggggcttcttcctaagagcttattttggggggaatgtctgcctgctgcctctgagcattcctccaacacattaacaacaaatgatgatgataatggtaggacctgggtactgagagcctactatgtgccaggccttggatacagcacttttcttaactcatactgtttccttctcacccaggtctacaaaggaggtggcttctgccatgatggccattttacagatggggaaactgaggcacagaagaaggggccacttggccaagttcacataggggcatacagcagggtcagggatggtctgaattccagagtctgggctcttgaccactaccctgctgccggatggctgtgggagcttgggccacctaaaacaggccaggggaggagactccagggatctggggttctagcttcattcttctgacaacgtgtatgagagccagctgttgggcccagttttcaggaaaaactgcaggggtgtagggagggggcagcagagaaagggggtcaagaaacttaggaacctcatctggaaggtgggaggagtctgaccttagccatctctatccagaacccacctttcattgcacgaaaataattctccatccatcatgatttaaccctaatatgctaaaaagcaacacatttttcttatgacaaaagttaaacacgtaaattacagagagcttgaaatatataaaattaggtaaagagagcatataaaatgtttggcgttgtccttggcatggcgtgtttaacatgagtaagctatcatcatcagcattatcaatgtttttttgagtcggagtttctctcttattgcccaggttggaggg

SEQ ID NO: 474297 - DNA, 809 bp, Homo sapiens
gaagacttcccattcctcctgagatctgccctctgccgccccagcttcttttttggagcacgggtctcagatgaggggctggctgagcagctgtgggaggacccctcatttgcaactgacatcgataggtcaagcccagcagcccctgaatgagcaggaagattggtgcagctggggtcttccacaggcaggcgattccctccctgctgggatcgtcaaccaatctggggccgtaactcacacggggaaccacccccaacccccaaccaccgtgcttggtgttggagggccagagggtgtctcccaagtcaaagacaaagtctccagggcaaacaggaaaagccatggctaccccgtccccggggcctcacctggcagccctggcttgcaggctctgtctaggatccgggaacagtgtttatttcttctctttatttttagcttttattttcatgaaacttatacaggcaaatagctctacaagggcctcaagatttggatggtgcctgcccacattggggagggccatctgctttactcaggctactgagtcaaatgttgatctcctcagggaggaccctcaacagacacattctagaataatgtttagcaaaatatgtgggcaccccacgatccagccaaattgatgcataaaattaatcatcataccttctgttttgcatctctgtccttttgtttgaattcctgctacttgtgtggtttaaaaaaactcaagttgaaaattgaaactggcccctgcttgatagtacccgcagtcagcttgcagaagcaaaccttaaaccttcctc

SEQ ID NO: 474298 - DNA, 905 bp, Homo sapiens
gcagagccacggcccaggactgcagagccatggttggcctggtcctgctggggctggggctggcgctggctgtcattgtgctggctgtggtcctctctcgacaccaggccccatttgacccccggcctttgcccacgccgctgttgctgctgactccaaggtctgctcggatattggacatctctgtggcctcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctcacagtgacacaggcagatggagaaatgagacacaaaccccttgccatctgtgtcaccttcttcctccagccccaggaggactgtggacaaagccacgaacaggtctggcccagtacacccagatcagagactctgaggcctccttccttccagatctctacggaggccctacagaaggtggatcaataataaattcggggttggcaggtccagtaggtcctggtgttttctgggctggagtgtgacttggggaaaaatgacttgaatggaagtacagtcagtgggagacatctattgagtggtgatggtcccagtatttccttgtgtggtgactgaacctagggcagtgccactactctgtggcccaaatgccctgggttattcctctgagttccccgtgtattattgagatgctccagcccccactct

SEQ ID NO: 474299 - DNA, 1138 bp, Homo sapiens
agacaaagtagttctgctgggacacatcctggtgatgtttctcaggatggttcaggtccctgcaattgcaggcccagagaacaggactgaaggctggaagatgtgctccctttctcctgtacacaaaacagtgccatgtgtgcatgccacagccctgaccccggacctgtccatgctcagtgacaggacaataaccaggaacctggctggagtaaccagggaccacccatcctctggagctcacatgctgtgcagagaccatgaccctgggaccctgggaccctgggaccctgggaccctggaaccgtgctgtccccaggccctgctccaggccctgctccagtcttattccccacagatcccaagctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtgaccacgcacatgatcttgtctgattattctgaatccttgcatgctcagctatgcattatggtaaccaagccacagtgtctttggcaataaaatgccactacttggcccccacctaacctgggatcccctcaaccacatcttgctacccaaaacaggtttcacctccactgagagaaatttatttttatattgagaagatgaaagattaattatttcaattgtgaaaattttataggacagtaatgtgaaaatattttaaaagacactttacgaagagtgaaagaccttccattaaaccactcaatatatgacactgtaattggcctacccaaaccctaagttcagctccgggttgggaccttctgggaatggacccttcatcctcacgccctcctctcctctcctctcctctcctctcctctcctctcctctcctctcctctcctctcctctcctctcctctcctctcctctcctcttctgt

SEQ ID NO: 474300 - DNA, 1732 bp, Homo sapiens
cccagtgctgggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttccacagaggtccaagttcctggggaactgagaccaaaacctgccctgggctctcaggccccctccttgctctgaagatgcttcctcgcccagtgcaagcggcttcctgcagctttgtggcttcccgtaagctgactccagagccagcagtgtctgtggacagtcagcaagggtaacctgccagggagaaaacctaagaagccatggtacaaactggtaccagcagaaccctgccagatgcctgtgcaggtcatacatggtaacaacaaccagccctcagggatcccagaccgattctctggctccaagtcaggaacacagccaccctgaccatcactggggctcaggttgaacatgaagctgactattaccgtcactcatgggacaacagtggtactcatctcacagtgacacagacagattggaaagtgagatctaaagaccttcactgtctgtatcaccctctttctccagccatagcaggactgagcagggctggcccgggtcacctggatcgaagcccttcaggctgcccttccctccagccctcccggcagactgcagagagtaggtcaggataggatttggggctggcagaaccaggctgtcctgctgttatttggaatggatgtaccttggctcaagatgacctgagtggaaggacagtaagagggagacagctactgagtgctcatggtcactgaatttcctcctgtgtgttgactgaacccaagacagtgcctctactctgtggcccaaataccctggattatttctctgaactgcccatgtttaactgagaccctcaagccccagctttgtgcatcctgatgttctgaacatggaagcctttcataatgtgcactgtgacatccttcagattcccatttcaggacttatgcacccaccatccacccagggctgcagggagttcctggcttctcacagctcttccccaccagaaactgccatgcagtacagagaatagctttgctcaaagaattgcccatttcaaaatgtgtttcatgggcagtgactccctgattgccttaatctgaaagtcatgctttaatttaagaccctgaatatcaaattgaagtgccttctagctgaacgctcaattgtaaaacattcccagtcacacactccacacttctttcctgagaatgtatcctgaaaccctactgcatggaatcctccctctcagagtaggattgcagggaactcaaaaattaaaaacaaacaaacaaaaaacagtctagagggaaaagtattgaagaggagagagagagtgcacaaggagacaactctgaagtctgcaaatattcatgca

SEQ ID NO: 474301 - DNA, 1023 bp, Homo sapiens
gaaagcctgagagggaataagagaggcctgcggagcccaactgttctgtgggtccaggaggcacagctctgggaatctcaccatggcctggatccctctcctgctccccctcctcactctctgcacaggctctgaggcctcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcagggatccctgagcgattctctggctccagctcagggacaatagtcacattgaccatcagtggagtccaggcagaagacgaggctgactattactgtctatcagcagacagcagtgagacagctgctctcagtcttggtggccctgagactgacaaccatgatcacatgctctggagataaactcaggataaacatacacttaggaaccagcagatgccaggccaggcctcggtgcttgtaatctggtaggtcagtcctgactggatgtgcccccagcgccctgatagtttggagtttatctttgggctctgggctgctttctgaggagctcactaagaaacccttgatgccaggcccaggacctgcgcctctgctgcatgtcccagggctgcaggtgtgaagggagggtcctgctgggatgtctcagtctttttatttccttctttaaaagtacaactggtttagggtgacctgctcgggtccccttccacattgtagaagctttgttatttcactcttcacaaaaaatctcgctgctgctcactctttgggtccatgccaccttaaaaaaaaagtacaactggtttaatcatgaaatcatgtgtacacactgaagtttacagattattgccatcagcatatatatatatatatatatatatatatatatatatatactgtttctggttgggacaactgtggacaaggccatactgggg

SEQ ID NO: 474302 - DNA, 797 bp, Homo sapiens
ggggtttgaggactcagctgtgacttagggaaatggggcctgattgaatcatcagactgagggaaacccgggacaggaggagaagcctcaccccatgcagggaccacagatgcacccacagggtgagctgcaggatggacactgcccacagggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttccacagtggtccaagttcctggggaactgagaccaaaacccaccctgggctctcaggctcccttttgctctgaagatgcttcctcaccctgtgcaaggggcttcctgcagcacggccttgagaattcttctctctcagctcctctcctttcccaccatgaaatccaacaggaaacctgccctgtggtttctcatcccggacagggacagcttcctggtgcttgtgtgctgtggtccctgaatgtgcagctcttcccagctcttcaaatgcagggacagtgacaagcagctgcctgattggtgcagtcactgcttttttttcagagatgtcttcaccct

SEQ ID NO: 474303 - DNA, 1594 bp, Homo sapiens
agagggccttgttttgaggaccccagtgacttccctggtcagaacatcccagggaattcagggaaatgttttcactgctattttcccatgagcaccagtcctcaggggcattctttccagttcttctgtgcattcagcatcattcatgacattctgtttacaggtctctgtgctctgcctgtgctgactcagcccccgtctgcatctgccttgctgggagcctcgatcaagctcacctgcaccctaagcagtgagcacagcacctacaccatcgaatggtatcaacagagaccagggaggtccccccagtatataatgaaggttaagagtgatggcagccacagcaagggggacgggatccccgatcgcttcatgggctccagttctggggctgaccgctacctcaccttctccaacctccagtctgacgatgaggctgagtatcactgtggagagagccacacgattgatggccaactaataattgcaatgtctgtcaactttaaaaacatactggatgtgattaacaacagattagattatgtaaaacaaaagattagcaaacttgatcatgtagcactagaaaatattcaaaatgcagcacataaagaaaaaacaatgacaaaaatgaaaaagcattatcggatattcataaagaaaatgaagtatgtataattgacatccatggaatgtaaaaggtatgggtgggtagaaaagaatatttgaataaataatagtcaaatgtgctccacatttggtaaaaaccaaaaactggtatatccaagaagttcaacaaaactgaagcacaggaatcatgaagcaaatgactccaaatgacataatagtcaaattagtaaaatctggtgatgaagagccacttaaaagtatgattctaagagtacatttctcattagaagcaatgtaagcaagaagacagtggagcaataattttaaaatactgaaagaaaacagctgtcaaccttaaattctttatccaacaataataactttcaaaagtggaggataaatataatgttttcagacatataaaaacttacagaattgattactatcactcttgtcattagaaatgacaaaagacacccctagacagggggaaaatcataccaaattgaaatatgaattcacacaaatatcagataatgcaactccatttgaatatataatcacatttgaagacagattttaataagtgatatatgtatcacaaagcctaaagtaaacattaaacttttttataaaagaattatgactagtaagctgtattaggattctccacagaaacaacataaatcagatatgcatgtatgttatacgtgtgtgtatatatatacatatgtgtatagtatatatatgtgtgtatatatatacatgtgtatagtatacatatgtgtgtatatatacatgtgtatagtatacatatgtgtgtatatatacatatgtgtatagtatatatatgtgtgtatatatacatatgtgtatagtatatatatgtgtgtatatatacatatgtgtatagtatatatatgtgtgtatatatacatatgtgtatagtatatatatgtgtgtatat

SEQ ID NO: 474304 - DNA, 1493 bp, Homo sapiens
gagtcagctccaccagggagaccatttatccctgaccatgggagttcactcctagtgacacagtgccctccaataaactcatccccatggctgcatgatggttggtgggaaaaccaaatccactgtcctccaggaaccaggatttctagggatcctgctggtcacaggatgtcacctgtccccttctctctgtgggggtggacaccaggactctgacctcctgcccctcatccattctgcaggtccgctcaaggccacccccttggtcactctgttcccgccctcctctgaggagctccaagccaacaaggccatgctgaaggaaaatggcaccctagtcaccaagggcatagagacaaccacaccctccacacagagcaacaacaactatgcggccagcagctacctgagcctgacgcccgagcagtggaagtcccacagaagctacagctgccaggggcctggagctgcaggatcccagggcagaggtgttccctcccaccccaagtcatccagtccttctgccgacacccaataaaccctcaataaatgtcctccttgtcaatcagaaaacatgctgtctgctcatttttgtttatccactttccatcctaaatttttttatctccaaagatcaacagaatcctttggacttgtgacaatgcagcctgggaccatcttcgtgtttctctgagccgtactttttccatcaccttatccccatagaatgttccagaacaaggaaatagtcttcagaaggaaccagacatcttcattcttacccacgtctctgttgtgcttcctgctgccctgtgagcacgtccacctctggctgcccggggacacaccctccttacatccctatggccccgggagaacatctcagctcccttctttgttgtcctcggccctcactgtccagatgccatccctctctcaaggtgtttgtccatccccctccaaggccatgtggtcaccccacctgtatttcccctcatcaaagcctagagcatctccccttctccatgggcacactctgttcccgtcatcccagggaccctgccctcagcccccacaggccctccctataataatcactgatgggatgcttaccccctggaccctggtcactcaccccacatccccctctgggtgcctctcatcccacatgtgtcaccggatgccccagctgtattcaacattcctaggggacaagggtcggctctgctcctcactgacaccattatgaatgcctaatgtcctgctgtgcacaagttgtcaattgactgggtagaggtctcaatctctctggggtctgccaccattgccttttttcctggccccaatttcctccagcctgtcccttcttaggcacctggtggggcatgatgggaagatcccagtgacctcttaatgctccctgctcaggcctgaacctgccgctgtcactcagggggcattctcccctgggctctgggatgttctgctccctc

SEQ ID NO: 474305 - DNA, 592 bp, Homo sapiens
agtaggcagaagtactaagatgatgagtactcgggaggtctgcacggtgattcttctgctgcttgccagatgctccgtgtggcacccccagtctctccacagatactggatttcactgaatgtgccagattataaggtccaagtggaagagacacctgcactggagcttaggcttgctgcagagacttctcattgtctgttcccattcagcactggccaccttgtgtgtgacttgggagatgcccataaaggcccaccaggctttgtgttcatggctggtggtgtgacttgcagccactcatctttcacaggctgcacatctgtggccatagtgattgtccctagccattaccccgaaaggtgttacatatctttccaaatatccctggtggaaatgattggacctgaaattggaccaaggtggggagacccttacaccagaggccttggacctggttcctgctgcatctccccagagttctgccaagaagattggtatagttatgttgacatcaaattttaaaactttatggccaagaagcattacctgaaataacttgaagaagatatcagaagattagaagacttaatc

SEQ ID NO: 474306 - DNA, 1178 bp, Homo sapiens
gttactgctcactctttgggtccacactgcctttatgagctatgacactcaccgcgaaggtctgcagccagcgagaccacgaacccagccggaggaacaacaactgcagacgtgccaccttaagagctgtaacgctcaccgccaaggtctgcagcttcactcctgagccagcgagaccacgaacccaccagaaggaagaaactccaaacacatctgaacatcagaaggaacaacctgcggacacgccacttttaagaactgtaacactcgctgcgagggtccacggcttcattcttgaagtcagtgagaccaagaacccaccaattccagacacatcagacataagagctgaaacagcattggttgtaacatgcttggacgacgctactcggcccgcacagaacctgctcctagcagagaggagtgattggcggttccagcatttgttcattctggttcctgcacactctcgcttgcatgctgtctcctgtgaggagtggccaacgccgggctgagtgaaatgagccactccagtttctgcccatgaaggggatcaagggaactatcccatctcatctgaaggcttgtcctggatacgtcagacaaatgaactgggaaagaagagttttttatttatgtaactggttacagggagaaggcctggaaattatcaaaatttggactaactcaaaattacagttttctagaacttatgtgccttctaagctatatgtctacgtgtaagtgtgcatttatctaaagacataagtgctaacttttattctgtaactgagatctgagtcctgaagaccttcctctggagccttagtaaattttcttaatctaaatgggcccaggtgctggggcaattacccttatcttgtctcctgctaaatcatggaggtttgatgagttcttgcagacctccaataaacttgtttgtggagacctggggggtttcttcagacccccaatgaaacttgcttaattctaaatgggtccttttaagaattccttttttatctcatcatgcttcaaggcccaggaaaggcctggacaaaactcttggtgagcctttgttacattccagcatttgtattagagcactggctctatcagcttttaatatttaacttaaccactcagtcagtgctgaaacagttgttacagaggcctgc

SEQ ID NO: 474307 - DNA, 838 bp, Homo sapiens
gttcagttcgtgtttgtgcgaagatcatgttattgtaatcatcatgacattgacactgaatgtcatcatgactgcactcaggattggtcctgaatgcaggggccagtcgactgaggaggtatttgcagacataacacgaggcttctgcagatcgtggctcttttccaggcagatccacagggcctatcctaatgtcgtgtgcgtctgtgagcccaataaatatcctgggtgctccctgcagatccacagggcctatcctaatgtcatgtgtgtctgtgcacccaataaatatcatttgctgaatttggagaagtcgctacaaaactttcctgtgatatctttaaaaaatttagaggggttgaaatatacagtcatattttccagctcctattaaaaatagtttgcatatggctgtgaaaaataaaaattgtacaagtccagccatgccagaactgtagtttttaagtatcaattaacaaaaaagattttttcatatggccctagaagggaatgaattgtgtatgagacttactgctttacatgagaaagagattttttttaaattactaagaccatttacagagaaaattgccttgaaaacattcaataaatgcaaagtgttctttttccgtagacatgtcatttttgccatgcctaccactgattcacgtgttgttgctgtgctccccgttggctctgcatcctgatacaataatggagacttaattttcctttgaggaccgttgttgctgaggtggaggggtgtgcggcaggagggtggggtgtgcggcaggagggtggggtgtgcggcaggagggtgacgaacagcagaacattt

SEQ ID NO: 474308 - DNA, 1398 bp, Homo sapiens
ggaggcagactgagcctccctggaacagtggaccaccagtctagctgtgggtcctgggtacgatgctctgggcctgagtttcctcatccatagaagaggggtaatagtaccacggatctcacggagttactatgatgagcatgacacaaaatccaggtgcacctcctgccctcagtgcctacgacgtagcgtgctgtcacagtacacgccgttataattctgtgaggacacagcaagtgggccctcaccagacaccagatgctggtgccttgatccgtgtgaggacacagcaagagggccctcaccagacaccagatgctggcgccttgatccgtgtgagggcacagcaagagggccctcaccagacaccagattctggtgccttgatccatgtgagggcgcagcaagagggccctcaccagacaccagatgctggcgccttgatccgtgtgagggcgcagcaagaaggccctcaccagacaccagatgctagtgccttgatcctggactttccagcatccagactggtccatacatacagcggaatattattcagccctaaaaaggaaggaaattctgacccctgctacaacatgggtgaacctcgaggacatgatgctccgtgaaataagccagacacaaaaggacaaatactgtatgattccactcacagggagcccctagagtagtcagattcatagagacaggatggtggtttccaggggctgggggaaggggcatggggagttagtgtttaacgggggttgttgcagtttggaaagataagaaagttgcagggatggatgctggtgatgtttgcacatgacgtgaatgtacttaatgcaactgaactatacgtttaaaatggttaaaatggcaaattttatgtcatgtatattttaccagaactttaaaaggaaaaaagagagcactgcaaccagagccaggacactgggccaaggatggaggcgcagaggtgaggcaaggctggcactgggcccatcagtgttccctacctgttgctgccagcgtgggttgggaaatgtcgggccagagcctggccctcctgtcattagtcctaagactggtcatgcaatgcaggagggatggatgggtacaggaggctagaggttctgaccccagctgtcccctccagaagcctcagttccgccgcagccctgagcgtgaggtgggggtggagggcagttagggcaggactgtaggcaaggcaaaagcaaggactgcagcagaatggggaagctcagttgaacatgaaccacccaaccaatccaggtgcttctcaggtgacatttggaatcctgacagcaatgtcacctgttttacaacaccaccagtcattctgcagttgaggacactgagccacaaagagggcagagg

SEQ ID NO: 474309 - DNA, 938 bp, Homo sapiens
ctccataggaccgacaatcctctctccaacagaagattatggcagtggatgcccttctgaagagggaagtgtccagaatggttgaatggagggtgtccccatttccgcagcgactgtccctgcacctggacatcgactatctgcctgaccgctgcacctggctgtctaagaggcgtctccagctcggtgtagccaagcagaacattaatgtgaggacacagcaagtgggccctcaccagacaccagatgctggtgccttgatccgtgtgaggacacagcaagagggccctcaccagacaccagatgctggcgccttgatccgtgtgagggcacagcaagagggccctcaccagacaccagattctggtgccttgatccatgtgagggcgcagcaagagggccctcaccagacaccagatgctggcgccttgatccgtgtgagggcgcagcaagaaggccctcaccagacaccagatgctagtgccttgatcctggactttccagcatccagacttggggagggcccccagctgctgtctacatgcagtgacgaagagggggtgagtcctcagccctgctcctgtcctgcccacatctgggtcacactggggatgacagatgtccagtgtggctggccaagaatgaatgccggtggacaggaagagaatatgaatgcctgtggctggtggcagggtgactcatctcgggccttcggtcacagcctcaaattcctgtgccagagcctggccctcctgtcattagtcctaagactggtcatgcaatgcaggagggatggatgggtacaggaggctagaggttctgaccccagctgtcccctccagaagcctcagttccgccgcagccctgagcgtgaggtgggggtggagggcagttagggcaggactgtaggtaatgcccctctccagcaaagccaacac

SEQ ID NO: 474310 - DNA, 592 bp, Homo sapiens
atctgaggtgcacacattcatggccagcatggtcatcttggttatgtgttttactctatccacgcttattgctctgatgtttaggctacatgattggatattgcaacacaatgtagcaacaaagaagcaggatgatgaattttcacaaattgaacataatcataaaactaaaatccagattaagaaacagaatactgccagcatttcagaatccaactttatccacttttggtcacttgcaaaaatcaaacaatgcttctgtgcaaggtgcaagttgtcagtggatccaccattctgggatctggagaaaggtgtctctcttctcacggccccactaagaagtgccccagtggggaatctgtgtggaggctcagaccccacaattcccttctgcactgccctagcagaggttctcccaaacatattgggcacttatattggtcacatattccaggagaagggagttgaaaaatagaaaacttatatttaaattttatttaatatttcttgaaattgttttcattggaatgatgtgcatcacatatagaaggaaaaaaaaccaacgaagttatatttaaagatgtgtaaagac

SEQ ID NO: 474311 - DNA, 5277 bp, Homo sapiens
tgcagtgacatgagacagagctttctaatgggcaagaatggcatccatggccttagaggcagtgagtccccatccagaggggtgtcagcagagggaggaaccgccttttgaggagtctgcacagggttctggcctccagtgtgcagggcagaatggggtgctcctaatgggttgggttccacaccctggaccagtgccttgttcaggccaccctgggcacagaccctatgccctgtcctgtctgctctggctatcaaaatctgggctgtggtggtcagacagggcccaccagctgatgtccattcaccatttaggagaccctggggaccggcaggatgtcattgggaccaaggattatgctgctcctctgcccaaaccttgccgaggctcctccttttcacctgaaatgcaagccagcgtccttcccggactctgcaaagccccagataatttgactggctccctgcaccttctctaacatccccttctattacccctcctgcattccaccccccttcactttctcctgttcactgggctccagccacactgccctccttcccattcctccaacctgccaggcatacacctgccccagggcctttgcacttgtggttccttctgctcagatgctcttgtctcagatattcgctgggctcacaccctcacctcctttacctctgtgcttaccttctccatgcaacctctctcaaccaacatttttaataattcaaacacctcacctgtccctgctccacaatgcaatagctacagatgtgacacactttaaagttgaatttgcatcattaacattttctccatcacttgcttaagtctagacaatcaacagaacaatcagtcaggccctgatgtgcattgtttgccaattcccatggtgtatatagttccaccaaggccaattctaaactacctatgtgacgcccctgaacacagtcttggagagggatgcacagaagcacgccattatatagtattttgtaataaatataagtcaccctaggagcatcaataatagtaaaatgaggtaagataattaggacgtgattactctgagtatgcattacctttgtttttaataaaatgtacttaattggaagtttgtgtaatttaatttttttattggctacatttaacaactgactcgcaaaaattcctgaaaaattaacagtagactttcaccagccagtatatgctggctccagcatacccctgagaatggttgattaatatggaatggccatgctgtggaattttatgcaactatttaaaataatgaattggagctctataggggatttggaggaattttcacaaagaattgtcaaataagaaagcaaaatatatagaaccacagagtcatttttataacacagtgatcctctcctcaataaaaccctctctatatgtgtctgtacacattaataaataattgcataagtatccagaatcaacttgatttgggggcataggatgtgatgtgtgggaaggagaaaaggaagccaaccaaaataggaaaacagaaccaaaaagactgccaggaaagcaaattatacagatggtaacacattttggcatttaagcataatatatgtatttgttcctatcattaaaatacatttttaaaccaagtcctcatttggacagttgttcaggttatctattgccttataacaaaccaccctaaaactcagtaactcagtagttcaaattgccaacaaccatttattatgacaagccttgttaataaattttataataaaagtagacgtgtgtatatatgatatatatgtgtatatgcatttttcccctgtagcacacctctaagtcttcctctgctgataagcatcattttgtttctattctaccatggaattccattttactcatgctgggttcaaagggaagtctgaaggtcttttcttatgttgggtgacatttggcttccttctgtgacttgcctcttggtttttctgtttttctattgggttgtttattccttccctgtcaatttgtgcatgttctctgtatattaaatttcagccttacaagtggctctgtgttccaaatctcaattatatattgactttacatcatcttttgtcatacaaaaattaatttttgcattaccaaatgtttatcattccttctatagctcctgggtatctggtcttggttaggaacctgtccctttgttgagagtgttgatataacctttcagaatttcttgctgaatttttattgttctgtttaagcctttaatataaatcttattttcatatatggctaaaacaggagtccaattttattttttttctggataagtagcctgttatgccagttaaatctttgtggtttagtgaaaaacaaaataattatgtattaaataataattccccactgcattgaaatgctacttttgttatattaagttattatatatactcacatatattttatattctaatctgtcattcttatgccaatgacatattggtttggtcatagtatttttgtagtatgttttaatttgggggattttaggcaggcaatatataacactatttctgggataaaaacaataattatgtattaaataataattccccactgtattgaaatgctacttttgttaaattattatctatactcacatatattttatattctaatctgtcattcttatgccaatgacatatcgatctggtcatagtgtttttgtagtatgttttaatttgggcggttttaggcaggcaatatataacactatttctgggatgaggtcatgaagagtgcctcttttattctgtttccctttccatgacattcactgctgggaggctctgtgttgaaattgtggagacacaagatgaaagcaattggatccctgcgtcactttatggaggagagtttcttccctggagctttgcctgattacatcatctttgtgtgagtgataaacaaccctttgttttttacttcagcatagcctatcctgtcccaactaatcattggtgctgctgtgtcaaaaagccaaaatatacagcattagcttagtggctggtggtgtgtgccaaggacactgctactggaggctggggcatgacaatctgtactattaatggtaacacacttgttaaatggcacacttgcattaagaaggctaagaaagaaggctattgtaagcgtatcttggctgttgattttattcaacaaagtcttacaagaaataagtgtctagtttgtgagcagcaataaaggaaatagagaaattccagaaagttagggctttgcaaaattaaaaagccgactgcttccagatgccaactaacttgaaacaggattgacaacaccattgagcaacaaaggcccaaactacctcagggcaaaaggcagattaaaaagatccagatagactcaagaccccacatctgccagtgccttgatcttggacttcccagccttcagaactgtgagaaatatagtagaaaattcctatatatatctattttatagaattctatcttaatggcattgtggtcaaataatgtcctctgaagttcactgatacttgcttaattatacagtataaggtaactttttgtaaaagttctgtgtctgcatgaggaaaatgtgtattggcatgtgtcgaatgcattgttctagatatctccattaggtagatttcttaatcacattcagttcttcatattcttacttgtctttcatctgattgtttgacctgttatagagagaagtatgctaaaatttcccagtataattgtgattttgtctacttcttatagttctatcagttttggtacatgtattttgaggttatgtgtcagcaggtgcctaccaatttaagatagttatattttcttgtagaattggcttttatcattatgaaatgttatcctatatctttgtaatacttctcatctttaagtatactttatctaatattattacagatacaccagtttttctgtttattgtttgtttgagttggtgcttgcacagtatatcttttcccatccttttacttgcacttactttctgtgacctaatgttgtaaatgtcttttataaataacatatagttggtgttttttggtttttttaaaaatccaatctgatagtgtttgtgttttaaatggtgcatttcattcccctatatttgatgtaattactaaaatatttggttttaaatattttaattatgtgattttttttttggtctcacctgttttatattctttcttctcaattgttattttcttcttttggataagtgcattttgtcattccatgttttcctttatattagcttggaagttatattttcttttactgttattgcaacggttaccctggagattacaaaatgcatccttaacataatattgtaaatattgtttggtattcctggacaatccgaggacctaacagtactttaacttataccccttctgtgttctttgcagttgttgtgtattttatgtctgtatattttaaaactcacgagacatttttacaaccatcaaatcagccattctttatttagatttgccccagatatatccttcctgttgctctttattcctttctgtgtcatcaacctctgcctgggatcatttgttttactgcctaaagaatacactttggtatgttttttaaagttagggtctattagttattagttatatattttaaaaattttaatcttttctaagaagtcttattttatcttcactcttgaaagatatttttgctaggtttagaattctagtttggcactttcttttaacatatatgctgtttgatataatagtataaaataatattatattgtcctttagtttccagtacttttattgtagtttgcaagtctaattgtgcttcttggaagttaatctccactcccacccccaccccttttctgactgcttttaaggttttctctttgtcttctacttcagtttagtagagcttcttgaacttgtggcttgatgtctttcagtagttgcagaaaattcttagccttttatctcttcaaatagtatttctcctccaatccctttcaccttgcctactggaacaattatatctcagttatatatctcctttcagtatatatatcatatacatatatatacatatatatatgtgtatatatatgactgctaagtacttttctgtgtttttcatccttttatcccctgatcttcattctggatgttttcttgtgacatatctt

SEQ ID NO: 474312 - DNA, 584 bp, Homo sapiens
accacagacaggaaaacagtcagttggcataataaataaactgtgtatagatggatggaaggaaggaaggaaagaataaaggggggaggggtgagcaggaagagaagggaggaaatgaagaagggaaaagaaagagatgaaaaaaaggaaaggagaggagaggagaagaaaggagaagaggagaggagaggagaggacaggacaggaaaggaaaggaaaggaaaggaaaggaaaggaaaaagggagggaaggaaaggaggaaagggaaagaagaaggaaagaaagaaaatgaaagaaagaaaagaaagaaagaaagaaagaaagaaaaagaaaaagaaagaaagaaaaagaaagaaagaaagaaaaagaatttctatctcagattcttatattactcccagcccaagggaaagtataaatggttcttccttaaaaaagaaattaattatgatatgcgacttggctgaaacagcttagtaacgtctatttcatcctgcactgtgaagactttgatgtcactcttcaaagggagcagtctagctccctttgaagcaacctgggatgacaattgttttgtcagggct

SEQ ID NO: 474313 - DNA, 611 bp, Homo sapiens
gtgttctcattgttcaactcccacttatgagcctgcgccccagccagaccacattccacagccttgaagtccaggcagataattgtgaacacagccttcaggtcttcactagcataagagtggcacccacaaatcccagttccagatttccccgtgcagccctagataccacacatgccccagcttccagattgccctctacaccctcacatcagtaccaggccagccttcccaaggatttcagcaacaagcctgcctgcaaaccctaccagacaggccacagacaatcacttgatgagctgactggtgaagagctttgctgcagagaccattctgtaaacgctggaatagtacctgctacttcaaatgcacagacactaataaatggccacaaggattatgaataattagggaagcataataacatcaaaagaacaaaataaataccagtaactgattccaaaaatggagatttatgaactgtctgacaaagaactcaaaagaaatgtcttgaagctcagtgagctacagagacacagacacagaacacagaacagagatgaaataaaatcaggaaactaatatatgaacaaaacgagaagttcaacaaa

SEQ ID NO: 474314 - DNA, 1444 bp, Homo sapiens
gtcagcctggtgttcacatgcatggcacagctccccccagcccacctgcccaggggccccaaaggtctcagcctcgcacgagatcccccgactttccaaacttgtcagctttccaggtttgtcttcctggacgtgtttctgcccaggggtttctgctgtgcctgagaggtggcccagggtcatgtgacgggggtagaaactagcccagcaggcctgggtttgcctgccactgtgcttctcacttgctgtgtgacctgaggagtaggcccagggctggtaccccctcacgatggccccacacccagtcacagccagtggagaccacagtagaggggaggggactcctctgggcttggtcctcattggtcactacctgtggcccaggtgccctgggtacttgggcctcaggagaggaccgctttggccaccacgtccaccgcactgccacagctcccctcactgtcctcacccccctcctcagtttcctcttgatggtcagctggcccgccccctcctttcttgcagaagaggaaacacaacacagccctgtgactcttcagggctcccagttttctctgtctccgccaggctggtggggcttgctgctgggcccattggggtgagatgtgtgggccccacagccttcttcctgcctgccccgggctctgaggctcagggacctggagacccctcttttctatccgcctctaacaggatgagttgagcatggaggtttctagactgggcctcctggcagtgtctcttcccagccccagggtgctattgaagggatgcgaggcaaggagaaggattcgagccaggagccccgaggagggagctgcttgagggacctattgcttgcagagagttctgctgtccccagagatgcccgtggctgcctcgccttcctccatgcctctgctgacaggtcgttttccaagcatcctcacctcctgatgcttcccactccccttctcagctcttcccctgaggcattcattgccatctgttagattatacacgtgcttgcttatgtgcaaggagtgaacggattctgttctttagaagatggggagggaggctcgaatctgcaggccaaggaatgcagaggggcaaggacatcctaggtttctgatttgaggatctagctgggggtggagccatttgcttcaatggggcactgaggcgacacttccctgagaagcttctggtctccccacttgcattgctgcccacagtggcccccatcggccccctctgtagcagctaacccattgccagtaccaagcagtgcttggccgggccccactgattctgtggctggctcagctcacttgcagccccctggatactgccctgaacttactattaggggctgaactgtgcccccacccttcatatgttgatgttctaaacccccatccctcagaatgtgactttattt

SEQ ID NO: 474315 - DNA, 715 bp, Homo sapiens
tgtgtgactgcagaggaagttggggcagcttatggaggctgtgaagggcgtgataaagagtgtagacttaagcccgtgggtgatgggggcctgaggaactcaaaaatccaggcacaggctggaccctcagaattctccttcgcggtttgggagtcggagcagcacactgcaaggccggctgcatgagctcaccttgctctggtgaactcagtgaccaggtgtgggtggccccttgtgcaagcttactccagggccacagaacactcatgggtcccactgggccactgccacctgctgagggactggctgaggaccctgtgacccctctctgcctgtgtgatgggggacaaggacgtgagctggacaccaggctggccgccttcaaggccagctgtgctatacgttgcaggtggctttggacttgtgccctggcctcccagagcctcactgtcctcttagagagtggcaatgccagtgccctaccaggctgctgcagggaagggggagatgggctctgcagaggcccagagctcagagggactggtaccaccatcagctgcattcccatcacctgggtgatgagaccccccaggaccccaggggatggcagtgggagggacagttgctgcccagtcccgctgaggcctgggggacccaaagtgcaggtgtaggtgcctccagcacagagtggattggattagtgtgaatggtggca

SEQ ID NO: 474316 - DNA, 1673 bp, Homo sapiens
gccctccgttcctgcttcctggtcacaggaatgaatctcctaaaaagggttaagcgaatcgtggctgtcacacgatgccatgcctcctagaatcagcatttctccaaggagtccttgtttctttatttgagaaggatattaggaactcagacttcagtattcagtgtgctcatttccactggggtattatcacctccaggacctctaagctgacggggattggtgatgaatttttaaatacaacaccttgctctggcaagaatacagagcaacaggtgttcacattccttgctggtgggaatgcaaaatggcacagccacttgggaagacagtttggcagtttcttacaaagccaaacacaagcttaccataccatccagcaattgccctcctgggcacactcaagggatttgaaaacttatgtcaatgtaaaaacctgcatgcaacaatttatagcagcattattgataattgtcaaaaacatgaaacaataggcaaatggctaaactgtggcatgtccttacaatggaatattattcagcaatagaaagaaatgaattatcaagttataaaaaaacatggtgaatgtctttgacatggacagagcaaagagatatatttgtatatactgacctatgtatatacgtatagctatagtttgaataatttttatggatcttttctcatggtccctgtcttttttgtttctgtcatctctaatatattgtgaagcccatcgagtgaatttttcatcaaaattattgtactttttagttctagaatttgcatttttaatagtttttattcttctgctgagtttcctacttgttcattcattaatacaatatcctttagtttctcaaagactttttttctttaattctttggacatatttataatggttattttagagtctttgtctactaagcacaatatcagagccatctcaagtttagtttctattgactgcttttttccttgactgtcaatcacatgtttctgtttctttttgttccacgtgattttgttccaagtgattttttttattgagtggttggcattgtgtataacctattgtagagatcctggattttgttatcttcctctaaaaagtgtttcttattttatcaggcagttaaattactagctgaccactttgaacttatataggcttgtcttcacactttggtcgtgtggatggtagaaagactatgtgtttccttgacccctttggtttggcaggagttctctcttaattctgttttccctgcagatcttttcaaaaagccccttaggttttgctgggggaggtttagtataaataagtatactaggctgttgtccttactcctaaggcatagccttttttttctaacattagaataccatttattatgatgctggcttgctatactatttatgtttttttaaatttttttatttctgtaggatggttggaatgacaggcccagctatgaggccatgcttttggcccctgacagcttcaggaaataggtggatgccctcccctctactctacctaaaatctgcccactaggcagaagcaggacatacccttgcttttgtggctatggagctttctttattttcctgtccttgtcatctggttcttggatgatggggagagcagtgagaaggagtcgccttgtga

SEQ ID NO: 474317 - DNA, 1091 bp, Homo sapiens
tctgcagctgagggtcctgactattaggaggaaaactaacaaacagaaaggacatccacaccaaaaccccatctgtacatcaccatcatcaaagaccaaaggtagataaaaccacaaagatggggagaaaccagagaagaaaagctgaaaatttgaaaaaccagagctcctcttctcctccaaaggaatgcagctcctcaccagcaacagaacaaagctggaaggagaatgactttgatgagttgagagaagaaggcttcagacgattggtaataacaaacttctctgtgctaaaggacgatgtacgaacccatcacaaagaagctaaaaaccttgaagaaagattagatgaatggctaactagaataaatagcgtagagaagcccttaaatgacctgatggagctgaaaaccatggtacaagaactgcatgatgcatgcacaagcttcagtagcccatttgatcaagtggaagaaagggtatcagtgattgaagatcaaatgaatgaaatgaagcaagaagagaagtttagagaaaaaagagtaaaaagaaatgaacaaagcctccaagaaatatgcgactatgtgaaaagaccaaatctacatctgattggtgtacctgaaagtgacggggtgaatggaaccaagctggaaaacactcttcaggatattatccaggagaatttccccaacctagcaaggcaggccagcattcaaattcagaaaatacagagaatgccacaaagatactcctcaagaagagcaactccaagatacataattttcagattcaccaaagttgaaatgaaggaaaaatatccagggcagccagagagaaaggtcaggttacctaaaaagggaagcccatcagacctacagtggatctctcggcagaaattctacaagccagcagagagtgggggccaatattcaacattcttaagagaaagagaattttcaacccagaatttcatatccacccaaactaagcttcataagtgaaggagaaataaaatactttacagacaagcaaatgctgagagattttgtcaccaccaggcctgcctcacaagagctcctgaaggaagcact

SEQ ID NO: 474318 - DNA, 1696 bp, Homo sapiens
cctgcataatggctggtctatttttaaagccaccaaagggatgaattgcaccctgaagttctccttcaacacagcatgctccttgattctgggacattcctagagaaagggacagtttcatatggagggaaaactgggctggaaaaaggtctatgcctgggccaccacccacctgggcccctgcgtgtggagccctggaggcagacagaagctgccccaagaagctcagagagtatcagactgggatgggacgccaattctgtgccccttcagcctgtagaaaacaaagccattcacatcttcctgaacactaatgacagctgcagaaactccaagatgaaaaatgtttgtgcttcaaaggacaccatcaagaaagtggaaagacaactcacagaatcggagaaaatttttgcacaccatctatatgataagagatttgtatctagaacatataaaaaaactcttgcaactcaataatacaaagacaaaccaactaaaaaagaggttgtgtattagaagtgttatttgcagggcaggattctctggtgaagccatctggacttggagttttctttgtgggaaggtttttagttaaaagtcaatggttataagattatccagattttctttttcttgtgccaattttggagcatgtgtttttctagaagtttatccattttatgtaaagtttcaattaaattgctacagtttttcctgatagcctctatttagtttcctatagctgctacaaccatttatcaccaacttggtggcttaaaacaacacatatttattattttacaatctggaggccagaagaccaaaatgggttacactgggctgaatcagggtgtcagcggggccatgctccctccagaggctctagaaatgcacccatttctttgcttttcacagcttccagaggccacctatactccttagcttgtgcgtagccacttctcttatcttcaaagatgccatttaaatactatgaacaatcatatgccaataaattagatgacttagatgaaatggataatttcttagaaagacacaaactaccaaaactgactcaaggaaaaatagaaaatctgagcaaataaataaagagattaaattgactgactttgttctggttagtgtttgcagggtatgtgtttttccatccttttacttttcacttttccgcattcttaagttttacatgtatctcctgaaaacagcatgtagagttttgaaaacccatcctgacaagctttgtctttcaactggagaaactgcccatgtagtttcagtctaattgctgataaatttccctttttcaatcctactttgtatatctatctaacctcttctatgttatttttcactctgttcttgccctttgggattgattatatattttattattccatttttgtcctgtcttagtttgacaattctattgcggcttacctagaaatttcaatacccttccttttcttgttagcatgaaatattaattgctacttttccacttccccaggaaatgcaaggatctacgatctgtctaattccattaccccctttccaagttatacgctcttgtgtttctatatgttccatatattttaatataatatactccatatattttaagctccataagaatgtatatacagtttgttctcatttcggttttttaaacaactttatc

SEQ ID NO: 474319 - DNA, 790 bp, Homo sapiens
ttaagaacaagtttgtcttgatatggggaaaaaaacccccacacagcttttggagtcagaaaggactggcgaaagcagaggaggtgaagtggctgctgaggaggtagtgaaagcaacccccaaattagtgccaaatgtgatgctcggggagaaaactaaaggaccagcagaatcctctatcaagtggcactctggcatattgtctgacagcacggacgtagaatgtggaagagcaattcctggatatgtgcctgtcagcggtcacttctctttacccaggaaaacgtctgctgcaaagagggtgaatcaggtcctgacagctccaagtctgggttatatgatgcaaaagaaaactcgaggaactcaccacagtgttattccttaggtcctgaggtgccttctctccacctactgcatcttgtggtttttttttttcaaagctgtttttcgatacgttttctgcaaagaataggcatgagtgcatctactccatctcactggaaatggaaatcaactacattttcttttaaaaggtactttttcacagggccacactttcacataaactgtcacaccccacccccatgaaatgactgaatccaatttttcagactttttttctgacacaggggtgactcctctctcctccatcccctggattcaaataggaagcctggctgtgttcccagccttgggtccctattatgtctcaggtccagagcccggcaggcccacgtcaatactcagaagtttgtgtttctggaccattgtgaagtttatcttgtttatc

SEQ ID NO: 474320 - DNA, 667 bp, Homo sapiens
tattatttacaaatggctttttaatcatgcctgaaagtctcactcttttattgggtagagatattcttgttcacacaggggcaagcatccttatagccccaggacaaactctttgtcccctcctgatggaagctaatattaatccagaaatgtgggcaactcaaggaagaataggtcaagctataactgctagaccagtccagatccatcttaagaatcctacttcttttcctaatcagaggcagtatccccttaagccagagctaggaaaggacactttcctccgcaaggaaactcgggaacctgaatatgattgtgaacaagtcataatacggacctatgcagccagggaagatctcagagaaactcccctggagaacccagactggaccctcttcacagatgagagctcttttgtagaacaaggaatccataaggcaggatatgcagttctctaaatgacgtcattgaaagtacatctctccctccaagcacaagcactcaattagttgagctaatagctctgacaataacacttaaattaaacaatggaaaggtagctaacatttacactgactccaagtatgctttcctggttttccatgctcatgctgtcatctggaagggaagacattttcttaccactaatggatctcctgtaaaatat

SEQ ID NO: 474321 - DNA, 637 bp, Homo sapiens
ataacatcccatgaggttggttttagtatcttcacttacagaggaagaaaccaaagcacagagaaatcgagtgatttctggaaggcggaggttctcatgggggatttggcaatgtctggggaacactttgggttgtctctgggtgaaggccagagatgctactgcacatcctgcagtacacaggacagtccctgccaccaagagtgatgtggctccaaatgtccacagtgccgtcctaggaaaccctggcccaagatctcaccgcctttcctcgcagagtttggacttgaatcttgagctctcagccactctgttctgcgatcactatcctcgtttcacgtgtgagagaaaacggaggctccaacaggcacccatccccccagacaaggcagagtactgggggtcattctagaccgttccctctcacccctcatcctgtcaatcactgcatcccatcgtttctgctttttgaccaccttgatccgaatccatctgtttccacccctgctgtcatggcccatctgggataccctaatctcctgcgtgggcagtcaccctagaaattaatcttttatttcagtaaagtggcccatgggtgggacaacctggccgcccaggggaacgggtgctggccgcc

SEQ ID NO: 474322 - DNA, 763 bp, Homo sapiens
gcttaatagatagagggcctgtctcagccactagaaatgcctgctgaccatggggaagcactcgcctctgcgagcgtgggcagccatcatcagaagggcaagcccttgaagaaggtccccacgttctgcaggatctgtgaccttctcaggttcaggcctgagacggagcctccacagctgacccacatcagcagaggaatcaagggctgggccctgggaatcagactgtccaaggacaatgaacatagtccccggctggtggcgtctttcagtttggtggcctggggctgcttacaagtcaacctggagcctgacattcagcccagctctgcacctcggtggcccaggcgcctccacacagagctcgctgtgctgacggggagttgggaccctgtgctggacacctgctggtggtccaggcattgcgcctgggatgtacgagggcagcaacccaggacttctggctcctgcaggctggcaggagagggttgggggcattttgatgaagtgaaatgtgaaatggataagatgctgaggcgcatgagagagcagccccgatgcccccaggctgtcgggcaccctgctggaatccggaggtcacccaagcaggaacctgctgtttctgggttcatgcccccatgtgagagccacaccgtgcagggaccaggaagagcctggaagttgtctgacctggctacctctggccagacccatctgggccccccgcatgcatgagcacatctggaaggggagcaacaaaaac

SEQ ID NO: 474323 - DNA, 2048 bp, Homo sapiens
ttgaacttggggctttcagaattcattctcttctccttcctgccctcacagatgtgaggtttccccatttgagaactccgtgtaaatgaaattatccagcatttgtcctttggtatctggcgtctgtcgttccacatcatgtttgtgagaagccagtgtctggaattcctcatcgtccacaccctcgcatttgctgctgtcagctatcttaattttggtctttccaagtgggtctttccaagtgggtatgaagtgatggtcatcgccatttttgtaggcatctgcctgacacttactgatcaaggcttgcaagcttatcaacctaatgcttccacactcatcaacctaatgcttccatatcactcactttccgcctgtgaccctcttcatcgtgtgttcgacgtgctggctgcgtgtgaatttcttggatggcagttggcctttggcatgtggacgtcctgtctgtttctttgggctttctcatctctggagagaattagtgatatgagtggaagcaacaatgctatttatgacccagactcagaagctatatcctgtcatttccacaacatccagttggccacatgtgccatcactcttgctatgggaggtgggtccacagaggacaccagtgataatggcttaggacccaccctactccattctgacctcgtcttaactaatgacactgtcagcagtgaccagtttctcacgtggttggtgtttgcggccaagaacttccacagggacagttcagtcggctgcctcactggggacttccatcctggcagtgcctgggctcctcaggaagacagtgagatccataataataaactctcaggaatatggcctggtcccgatgttggcagctggctgacttccccggactctggctttacatgggttggggaagggcgagcccctggaaatgcagagatggtggccactgaagtgaaggccccctgggtcatccctggacctcctccaggcatttgtaaagactccagaccactgtggctttcagggcccttgttacttccttagacttcagtgttaaaatctttcacttccaagaagctgagtaagccctgacttgacttatttagttggctaatctatgttaaagccaccagaaatgatttatcgatttgtttaaaagagaaatcccagaaggaagataactttcacatttttttcggcagatcccacattcagcctgataatgcagactctttcaagaagcaactctacttgcagtttcttatggatcttggaaagtgaaccctgcacaaacaagcttatttatacatggttaattttagcttttacacaagtaaatgcttttcctaagaatggtaacatgtacatactgttttgctttattcacttgacaatatatcttagaaatgggaccatagctgacatacagaactgcctcattgttttcagtgcatgcctagcattccattatatgcatgcatcgtaactgactttgccagtcctatattaatggacatttatggggtcagagcctggaaacaatgttccttcaatcctttgccagcagggatcttctttagtttctgccaataagggccactggtgtaaaatttggaaaccagacaaagagaagctgacttttggcaatggcgtgagacatgggcatcaataaaggctgggtcgtcactgaattcacaatgcagcctctctcctctgtgtgaccccttataaaactgcttcctgcaaatatggctcctctgtagctcctggttcagccccacctttcctctctggacgctgcagactcggtccatggttgcttttgtcgcacatctgtgtaccatttctctggtcttaatcagagattgtcagttttcattctggttttgtctctttccccttgacgtctgcaccacgggcatggtcccgtggcccctttcacacctttttctggcttttattttgtatggtagccattcctcatacattgatgttcagggctatggatacctttcttgttattttcttttctgcttttagttaatgtc

SEQ ID NO: 474324 - DNA, 1478 bp, Homo sapiens
cctggaatgtgatgttagagggacacaaggtgcttgtagatgtaattgagatggtgaagcctctgcaggcaccgtggcttcagccttctggcctctagaacagtgagataatgcgtctctgttgttttacaccacccagttggtggtcattgggagtgggagaaaagatacatccacagatcacactgagcttcaattattttaaatttcagaatgagtttgtattccttttggaaatttttgaaactacaaacatccagttttcaccaaatatcccaacaagtttctctatagcaaaagcaagcccagccatgtgccgcacttcagtctctcctaatctggaaaagtatctcagtctgtgtttgtctttcatgacactgactttttcattagaattttgtagaatgcctctctttttaagtttatttgatgtttcctcagtattcaattcggattatgcgattttggtagagatacccaaaagtcatgctgtgttcttctcagtgcctcatgggaggaggcccatggcgtccacttgccccgttgtgaagctactgcggatcactcggtgaagggggtgtcttctaggtttccgcactgtgaagctacaatttccactctataactatcaaatatcacatgaaggaggtaatttcagtttatggaaaaggtctgtcattcctcaaactttccgccattagttttagcatcctttgatgactcttgcctgaatcagttattataatggttaccaaatggtaattttctaattccatacatattccttctacatttattagttggctttctactgtttggagccttcttgtgcatgtatgagtgtgtatgcatgtgtgtgtatgtgtgtatgcatgcatgtgatatgcttatgtatgcatgtatgtatatatgtgtatggatgtatgtatatatgtgtgtacacatgtttatgtatgtttatacgtgtatgtgtgtatgcatgtatgtgcatatgcatatgtgtgtatgtatgtatatatgtgtgtatggatgtgtatgtatgcctttatatgtatatgtgtacatattcctgtatatgtatgtgtgtgtatgtgtgtatgtgtgttcgtgtatgtatgtgcatatgtgtgtttgtatgtgtgtatgtaggtgtatgtgtatgtatgtatgtgtatgtgtatgtattgatgtgtgtatgtgtgtatgcatgtatgtgcatatgtgtatgtatgtgttcgtgtgtgtgtatgtatgcatgtgaatgtatgtatatatgtgtatgtgtgtatggatgcctttatatatatgtgtgtatgcatgcctgtatatgtttgtgtgtgtatgtgtgtatatgtgtgcatgtgtgtgtgtttgtgtgtgtgtgtatgtatgtatatgtgtagtgtgtgtatgaatatgtatgtatatttgtaagtgtgtatgtaggtgtgtgtatgagtgtgtatgtatgtatgtat

SEQ ID NO: 474325 - DNA, 1287 bp, Homo sapiens
ccacatgagctgccaacagcccgggctgctctctctgaagtgcggctcagagcaccctggggacggggtttgtccctgcattctccacgcgactggcacagggctccacacgctcccagaccagcagaattccaagtgattggaaggcagctgaccttgttcagcaggaatgtcctggctgccgtggcttctgctgtgtgattagcggttgtcatccaccctgcctgccccgtggagaggccaggccactctctcgtcagagaacctgaggcccctcctcaatcctccatgcatttgacaccaaacacatgctaagctcctgttatcccactgcacaccagtggcaaggttttaaaaaaggttttgctgtgtgtgtcgattagtggacaatgaggttcaacattcttcatgctctcatcaaaccggtaacttcctggttcttgccatgcagcctacaaatgtgtctccagccctcgctgctgtgtgggtttgccatctcaatcagagaactgcagatcctcctgggtatgcagcgaaagcttgcgcagcagagtctgctccccagccctccatcctgggctgcttcccagcttgcttgggccaagagcacgtgcagaagcgactttgtccaagttccaggcctgagcctaccggtgtcttatccccattcctgccttcctcagctgctcctgccactgaagacacagagtcagcctcgctaccaaagacgtgagggtcacgggcaggacaccgtctctctccacacagtacatggattcttgtggagagacaggaagaagatgctcacacatgcgaggccattccagacagtggcgcaggctccaggcctgtgctgtcccccgcagggccacccaccatgcatggctcaagtgcctgaaatgtggccagtctgaactgagatgtgttgtcaatggaaaccacacacaggattttaaagacttgttaaaaaagtcaaatatctcattaaaatttttctatattcatcacacattgaaatggtaatatttcggacatgctggggtaaataaaatatatcattaaaattaatttcacctagttgtttttactgactaaaaaatctttttaatgttagagtagattaacagagaagttgtgaaggtgatagagtcttctgtaccccacacctgatttcccctattgctaacatattccattccagtggtagattttccacaactaacgaattaacaatattttaataataatctgtattgttaaacttaaataatattcataactttatat

SEQ ID NO: 474326 - DNA, 572 bp, Homo sapiens
actcagattttggaggccaggactctgcttctctcagtctgcgtctgccaggcacaacatcataagccaagcacctttgtgaagagacagaagttcagagagagtctaaatgcaatgtccttcctggtcgctggtggaggaggtgatcctacaggagctgcttccgcaggggacacgtcctgatgcatgcacctgcgcccacacctgctcatcagccccacaccctcctgagggaggctgcccacaagcccgtggcctacactcctgtgccgacaggccccctacatcgtgggaccggggctcctcaccaggcatctccaggcctcctgatttgacccagtccggcccacacagccccctctggcttcccaccttatgcctgcgctctgttggacctatgtgcccctccagaaccctccattcctggggctctactcacgacacttcacagccccttcagggcatctgctatgggctgagtgtgtgtgtcctgcagtttcacatgttgaaacctaatccttaatgcaatggtattaaatagtattaaaaggtggggcccttgggaggtgatt

SEQ ID NO: 474327 - DNA, 3130 bp, Homo sapiens
ttgggacaaatctctgatgggtctaagcataatttttttgaagaaaaactctttaaacaaatgaaaatcaaatttatgtactttaataagatactgaaagtagagctcttagcagactccctggcacataataaaaactcattgatattagctatcatcatcaacatcaccaacaccatcatcatcaccatcatcaccatcaccaccatcatcaccaccatgatcaccatcaccatcgtcatcaccaccatcatcaccaccaccaccatcatcatcaccaccatgatcatcaccaccatcaccatcatcaccatcaccatcatcattaccaaaatcatcatcaccatcatcgctatcatcactatcaccatcatcatcatcaccaccatcattgtcgccatcatcaccaccatcaccatcatcatcaccaccatcattgtcaccatcatcaccaacatcaccatcattgtcaccatcatcacaatcatcactatcaccatcatcatcaccatcaccaccatcaccatcatcattataatcactatcatcaccaccatcatgatcaccatcatcatcaccaacatcatgatcatcaccaccctcactatcatcactatcatcagctgaagggaatcgttagctgatgcacacagcacagaaacgcccagaatggctggaaaggtgccctgtggaaaacactcatgaatgcttattctcagcttgtgctagagctgagtgtaattttttgtgcgtgctggaccctttgctctgtcctctcttcgtgaacatcctgaaattgaggacagagtgtgcagccacgactctgagatgggacatccagtgagggtgtggtgaccaccccagttagggtaggctgtaggcagttagaagttttacaaaagtagtgattggaaatgaactcttctcttaatcccctgccttcttcatcaccttcatctcttcctcatctatatcttcatttttctcctcttcctccttcttcttcatcaccatctcttcctccccttaatcttcatcttcaccttcttcatcgccttcatctcctcctcctcctccttcatcttcatcacttttatctcctcattgttatcaccttcatcaccttcatctcctcctcttctttcctcttcctccttcttcatcttcatcaccttcatttccttctactcttcctccttcatcttcttcatcactttcatcacttctattattcatcttctttatcaccttaatctccttgtcctccttcctcttcaacttcaccaccttcaactcctcctcctcttccttcttcaacttcattgccatcatctcctcctcctctttctcttcttcaccttcatcacaatcatctccccctcctcttcctccttcttcattaccttcatctcttcctcttcctcctttttcatcttcttcttcatccccttcaactcctcctcttcctcctgcttcctcaccctcatcttctttattgccttaattttctgcttcttcatatcttttccctcctctctctggcaatacacactagaatatttcagtaagatagcttttagttcatttgattaaactggcaaaataattattatgaggaagatgctgagatctggtggcagtggttgagagtcagagccccactttccctcttgtgcagccccagccgcatcctaagggcacttccattcttgcaagtttctccacctggcctgacctgtatctttctgttaagaacggaacaaatctatcaactcccattcatcaagggcaaactattttacaataaatagaagctagactaacaggcacaggaaggggtgaggccttttgtctttagattagagttttattttatttcagaaaaattttcttgaatcaggtctgtgtactatttctctcctttctttaggaacacaattatgctctggcctggtccttttttgtttttattatctattatttcctccctaatcatcttaaattcttggcttagtgcagtttcacttcatgttgctttctcggccatatccactgtgtgcctcaaacctattcccgggagtgtctgtttgtttttgtgctgcgtccaaattggcattcattttggtgatggaaacattttccccctcaactacctctctgagttctacgagccacagtttcattcaccttttcgtgctcctccatgggtttcctgagcaacctgagctctgacttagctctttattcatcacgttctctgaattcatggtcattggtcaggtaatgattctcaggccctcggcaacacttctgtgacagcatttcatcttccatttgcttcccttattccctccttttttcttcttcttctgctctgtctacaccctgctcaattcccgttgtgaaaaacgaatcatctttttatgaggagttagtcagattccatggacagctctgcctatagctttgtgtggttacctgccagagccaggatggccgggctccccacagttggctgcttttcttggattgaatgtactgatctccctcttgttctgagtctcagttgacatccaggcagtgtctccacccagccgaattgtctcatcagcaaatgaacaccctggtagggtttgcatccggcaacctctgagcaggcctcactctccctatgggttggtccctcactgtgtcgtacctgtgtattcacccaagattcagtgagaacttgggcccagtactctgcgttcctgaccttcaagggccttctgttacttcagataacgggaagctgccgtttctgtgaaaactccttatcacttaagagagcatttttctgttttcctagaagagtcttcaaaacccagtttccatctcccactcacttctctttctctaagagactttgacacacaggagctttgaagaagaaagctgcctgtttctcagggatggaatttcttaatctgagctccatgtacatcttctgtgagatattcttacacattttttatcactgcagtgatgttaagtattcagtctagtgaaccctctgatttttattaacttttcttctttttattttgaagtaggtgtcagattgggcatggagtaggaggggggtgctttt

SEQ ID NO: 474328 - DNA, 804 bp, Homo sapiens
tggggtctttgcagaagtcgggagagcctctgaagggttccaagtcgacagaaggactgggtttgagagagagcatgcctgaaggggagaatgcagggagaagggaggccaggaagaggctcttctccacgtgggatggtgagggccggtctagcagcacgaggctgcgtgagggacacaggtggcccaatggatccccgagaagccacatcagctgtcaggagctttgtggacgaggtagaatgctttctgaatcctgagcactgtgcaggacatgggtcctttgtcaactaccatcgaagaataagtggtaattttcggagatgcaaaatgttgggtgcagaatgcgagtccccctcccctgcgggccgtgggctgcttggctgcgggaaattcatcgccaggaaaaatgacctggtcaaagtaggatctgggcattcagggcaccttggacataatgctgttgcggctgcgtttggggagtcttatgacccacggtgggtctcctgtcctactgcgtggcatgccgggtcccaagggtttgcagagggactgaggagagcgtgactacataattgtacaataaaattgttatagacaccgaggagtagtgaaagtaaaacagaacaaaacattgactcagaagtcagaagacgggtgacaaagctgtgtcacctcccacctcttgagttcttggaaacttttctgccagaggctcagttttcatgtccgcacaaagtggagattgtgggaggtagtttttcaggcctggtgtgacattcctttagaacggatgctggggcc

SEQ ID NO: 474329 - DNA, 4222 bp, Homo sapiens
cctccagctgctttctgctaagatctgggcttatgtcctctgtaccaagactttcccaccactgtcatcctgaaaagggagaccacagcactgatgtaaagcagagagagatgccctgcgtggggaagaaggcacagtgggcagaagctgggaggtgggtgcggggcagcgagtgtcatgggggcagcgagggtcacaggggcatcctgtcccagcgagggcaggccaggagccacggccttgaagcgtttcggggacagccacttccagtggtcctgctcgccgggggccatgccctggggctgtccttccaaattctcatacctgccaaggacccctggctgctgctaattgaagagcaccaaagcgtgggtatttatcagttcacctacaagtggggggcaggggtgacttacttcaaccctgtgaactggctttccccgacagccactgctgtaacgacgatgaagttgccctggaacgcgcgtgcgtccacattcattgcaccccttcccagtaaagtggatgaacagtactctgactgcggccctgaccacccccaggctcctctccatctgtctgcacatgccagggccttgtcctccttcagccccggtcacctccagaagcctcagctagcacagccctcccctgcacacggctatcacagccccgtgtgcctgcctcacaacatctccccaaaccccagaggccttttcctggttgtcctggcttccttgaatgtcagttctgctggagctgccagaggcggctggagccctgacttgtctccctgtctcgccactgtgcccgggccctggaagagtccctggtgattccaggcaggcagtctttatctccccaggaacaaggatgaagggatgagcgtggatgtggtagcgtgcacctgctttctgctttattccgggacaatgggaagtggatggcaacctcctcataatggatgcctgtgagcccattgggggccggatggaatctcttccttagatgtgtgccttgggaatgtttgccccaactctgcatgtgtgagacagagagaaggaggggtgggtttaaaatgaaaaattatatatcctacctattaggtcacgagaatatgacaaagaaaagtaaagcagactcaggcatagtgacaggagtactgttttgaatttactgggaaggtgatattttatcaagggttcagttgaggacaggagtgtgacatgaaggtatcttggagatgaagagtccaggtcaggggagtgactcatgcaaaggccctggggtgggagtgtagcagagagatgggagcagagagaggagggctgagtggctgcaagtggctaaaggggcgacagcaaggggatggatgggagaggggctgtggccatggcaagaatggggactctattctgggtgaggggcagccatgaggggccaagccagtgaggcagggtgggacacactttgcaggggttcccctggctgccggctgcatggagagcagtccatgaggcaccatgttgctggcctggccatgggttgctctaacagaggcatgcctgagtgactgcccagatattttacctcttttgattcgatgtgttaatttatattttcttactaaactgttgaatcacacagagtctattaaagatgtctcttacatcctttttactttcccttcatctattgtcataaccctcttctgtgactttttctctttttctgagttaggctggagagttgttgattaaaaaatatcagtctatagatttgcttcatttcagtgttattgttttgctattatctatttagttttgctctgacctgtgttaatttggttttgtttatgctacacttctttgtttctcttttattaatttgttgagttgaatctttattttttatttattcctgaaatggagtcatttctcagagctctatcgacgtatttactttgtctggtatgtgagattccttcccacttgccaaggtcaagcagatttcctcttattgagcttctttacagggttcctgctgccattgatatgttgcctcttcaaccccatcagtttcctgcccctgagaatcacactgtcccctctttgttttcgtgttcttcctgaggtctttcttcattgtgccctttcctcttcattctgtgaaatgttctcgaatctgcctttgatagcattatttttattttcttcaggatcagttctcatcttattaaacttgaatggatattatgtctgtgaattaccttttttaaaaatgtcttaatcattaattcatctcagaatatcctttgaccatgataacatttgtcttatttgatagacactgtattttctttcatatcctaggaggtcaactgcagaggctgctcacagttacatgcgtgtgtgctgtcagtcagcagcaacagactcagggcctcccgtgggttcaggggacacagcagagaaaagagaggctggccctgctctcctggagcccccttctcaggaagagacagacatgcatgcacaagggagatgtgatttaagatttaaggtggaaataaatgcaaccaggggaggtggaccgtgtgacaggggcctcgctggcttctgtgctggtcagggcagacttcctggaagtgtcaggggtgcagaacatgaaccacacaaaagatccaccctgaaaaccagctgaggaggaggattctgggcaaagggatagatgggtaagctcccaggcttgtgggaaaaagcatagccagtgtgaaagtctgagaaatacaagtagggatgatgccaaacaaaactaatattcatttaatcagttgagcacaaaattccctacctgagcaacaacactgggaggtggaagggggaaagaggtaggaggcaaaaacaggacaattctcattgtgctttgcataggaaggggccagtaaatatgattttattcttgagattgatctacaagaagagggtcaactgagtggcttactggagaggtaagcactagtagaataaaaatgagcataaagaagagtatttttcatctatctgtcgtatggaattcacttaagctgcatcatattttcatgtttttagttttctcctctgttcacttatccttgaatgagggccagatctactgaggcctgcagctggctgtgaacactgtgtgtgaatcctctgggggcctctctttgttcaaaatattcatagtacttaacatttcaaattcaatattcaggagcccaagcagagaggagggaaccaggtctgtgtgcctgggctgcagagccagctctccacctgttttccatttggtgtgggttcccagcatgcatgaaacataacgtggtgacattccgccttcttaatggagtcctgtcattagtcagtgctttttcaatttcagagagcgttttctaacgtatggtccaatatgctacttggagagagctgggtcaccagcaaacaagcaaacatcaaaaacactttcctcttgggttttcattcaattgaattacatttagtgaatatttactgagtttctgcttatgtgtctggaagtgacccaatctcagatctctttaagttgaaaaagagtcttagtgctaagctcttgatggtagggcgggcagccccgggggcctggcatcgtgaggcactctgcaagtcaaaatgggggagcagaaaagccagtggcaaagggagaagctctgtctacagcaaagcggaagaacggacaggagtcctggagggaagaaaaccaaggagacgatttctccttcagacagaggtcattgcctttatctatgtgtgtgccatgtcagtctggctcagctgctgcagtgcgtggtcccggaaacgtgctttcagaatcaagagggactggtcatcgtgatgaagtatgggttgtgtgggatgtctgggatgagtgcgtctaggcaccctgaatgctgctgcctctggatggtccaggcagtcactgcaaagaacaaaatactcatgacatgcttaagggcttcgatgctaagtgcatcacttacatcatccccttatcacatttcttcctgataatatgcctatgaatcacatttattaccgcattccggggaggcacctctggcttgagagctctggcgggtcttggttgtgtggctctgaaggctgccccactttaagactccaggtctttcccatgtcgataactc

SEQ ID NO: 474330 - DNA, 3102 bp, Homo sapiens
gaggtgagtgtagggacagggtcatgaatgtagggctgagtttaatgcacacatcctcgcccttgaagaaacaagtctcagaagaagcctgttccagtccagctgcaaatgaaagccaagctgggtgccagccccagaggtgaaggagtgggtgttgacttcagcttggtgcaggtgcagctctctggattccccccgccaagctgggtgccgaccgcagaggtgaaggaggtggctgttgacttcagctgggtgcaggtgcagctctctggattcccccctgccaagctgggtaccagccccagaggtgaaggaggcagctgggtgctgaccccagaggcgaaggaggcaggttttgacctcagctgggtgcaggtgcagctctccggggccctacctgcccccaggacactcacaggccagcccgctgtgagcttctcatccgtgtcctgtgtgccgacttccccaggagactcccatctctttgggaatgcccgtccactaattagtcatgtctttgtgcttgggtgccagtacacactgattaaacactcacggagggctgccggcatccaggagccacctctccctataccttgtgcaaggaccgtccctacctcctgtgaacagaggtgggtaactgaggcttccctgcatgactttcagcctcgcttcttcatctgcaatgtggtaacagtgccaggcagtgtcatcatccatgcaggtgctcggagaactgtgagacaacaaaagaaaggctcaaggtatcatcaacagccatctgagcaggtcctgaagaggtcgggcactctgacctctctcagcaaggatgcagacatgttttcataactttaactggccacccagttgcttcaacggccgaccggctttaagaaaagtttttggtggttgtaaatatggctgcagtaaacacttgcatgagtatttcttgtttgtttgtttgtagaaataaattttcaaatcagttgggtaaatatcaggagcatatttgctggatcagacggtaagattgtgtttagttttggaagaaacttccaaactgtcttccaaagtggctcgaagaaacttccaaactgtcttccaaagtggctccatcattttacattgtaactagcacaattactcacattaatgtgtgagtttgtgttactcccatctttgcccgcaatgggtattgtcctttttttaaaattttagccattctgatataaatgtgtcgtggttcacattgttgttttagtttgcagctttctaatgatagatggtctagggcatctttttctttgcttatttgccgtggcccaatttatttcatgatgtgtctgcttagatgttttaccgatttttgaattgggtttcttgttttcttattgctgagttcgaagcatattttatacaaattttggtacacatcctttatcaaattgtgttttgcaaatattttctcctagtctgtggcttctcttaacattgggtttaataaagtagaagttttccgttttaataagatccaacttattatttttttctaaattgtgttttttggtgttgtatctaaaaacacatcaccaaacgcaaggtctcatataattttcctaggcccgtttctcctcctcctcctcttccatgtctttctatgtatttttcttcttcctatgtctagagttttgaattttacacttagatctatcatccttttttagttaatttttgtgaaagttttaaagtctgtgtctaagtttattttattttaatatggacttccaattgttacagcacaattagttgaagagatgatcttttctatattaaattgcctttgctcttttgtcaaagatcaattgactatatttctgtgaactctttgttctattccattgatcgaggagtctattcttttgccaataaaacacttttttttgattattgtagctttaaagtaagttttgaaatcaagtagaagccctccaactttgttcttcagtattgtattgacgattttatccctttttcctttccatataaactttatcagtttgtcaacatctacaaaataatttcctgggattttgataaggattgtgttgaatctttaggtcaatttgagaaaaattgttatcttaacaacattgagtcttgcaatccacgaacacaaagtatttattcctttatttagataattgatttattcatctgtgttatgtagtttttctcatacagatcctatatatattttgtgagttatatacttatatatttctatttaactatatattgggctattgtaaatgctattattttaaaatttcaaattacagctgtttattgttggtatattggaaagcaactgacttttgtgtattagtcttttatcctgtggccttgctataattgcttattagttccaagagtatttttgtttattctttcggattttctacatgaataatgtcatgtcatctgtgaataaaggcagttttatgttttcctttcaaatgtatatactcactttttatttccttttctcatcttactgcactagctaggattttcaggatgatgttgaataagagtgtaaagagaagacattctcttatttttgccttatttccaatcatatggagaaagcattcaatttctcaccactgtgtcatattagccaaaatttttaaaaaatatgttctttattaagttgaggaagttctctctattcctagtttgctgagagtttttgtcatgaaaggatgtgggaatttgtcaagtttagcactaataaatatcacatgaattttcttgtatagacagttgatataatcagttgcactgactgatttttaaatgttgacacagtcttgcatacctgggataaatcccactcagtcacattgcacaattattttatgcattgttgaatttgccttgctactattttgttaagtagtttggttataagagattttgctctgcagtttttcttgttacatctttttctggttttgatattactgtaagactggcctcagagaattaattaagagttcttccctctgttctggaagagtaatattttgtagccatatt

SEQ ID NO: 474331 - DNA, 1666 bp, Homo sapiens
ttgatttgagcagtttgtcgaaatgtccgttgaggtacccccaccagtgtgtagctgctgtggcgtctgttccaacggaactctccaggatacgtctgatttatatgatgccctctctgggtcagcagcttcagtcatgaaaacctgcaaaactgaagcgccctttggccagctgctggttctgcgacatcacagggagtctggcatccacacaccaattctaggcaaggaagcaaaggagcttgctcttcagcttctgtgggcccatttgtcatttcgcaggaataatgcctgtgtggaatcctctttgaaaaacactggcttcaattcctgggataccatggcgaagttcaatgacctgctgatattggacatgatggtgaggggagaaggcagagaaggaccaggacctgctgatattggaggtgatggaatcaaaggtcagagtatttggttacactggaggctcttcgaagagattaggcatgtgactcccggattcccctcagccatctcagccaaagccagaaatagagatgattatctggggaagatctgcagaggagcccattgtctaatggagttaatccccatggagagctacaagggccttaaaaatattctactggcaggaaagctgcctgccagcttgtaccaaagggtcaaaagaaagaaggctattggaccccagagattccacaggcataaaactagctctaagtgctacccggctgcaaacatatgcttccttttgtttaaaaagaaggatggtttctgagggtgaagctgcatgcccagaggacaaagttgtgagtcacggaaatcattcccatgccgtttgaaactcaaatggagttcttggattgcaaaattgcttgggaccagggacttctgtcttcctttccatttttttttcctttttgaatggaaatatctatagctgtgactctatccttgtctcactattttatttagagcacaagaacatgtttcttgactttcacagatcaggaataattttgacacaagatgggtgtatgcagaccttcatcttaaatgttaaattttttatatgcaaggatttaggacttgtgcactgatgagatttagatacaattttgaactttgagttaatgctgtaatgagatgaggctttggtgatcctaagatagaatagacgtgttttcccggtggaacacatgtgaatctttagaggccagagggcagattgtgtcaggcaggacagtgcctccctcctgcaaaagatgcccacattcaatccatgaatatgtgatgttacatttaaaaaatcatatgataataaatttgtgttgttttaaaccactgagtttgtcgtaatttattacaacagcaatcggaaactattaaaaatggaaattgttaaattgtagaattaacaactgaaattaagaactcagtaagttagcttaacagccaattcttctcagtagaagaaagggttagtgagctggatcatagctcagtagaaaatatccagactaaagcacagagagcaagaagaatgaaacatacagaagagcattgctgccagatattaaaaggtaagaaagaagatattattaattattttataataaaagtgataaattaggtagtatggatacttcttagaaaaatatgaatt

SEQ ID NO: 474332 - DNA, 1077 bp, Homo sapiens
ctgacgttcaaagcccgcgttctccaggtttctgatgtcctgttctccttctcttcatgtgtttgcttttcaagctggcttgatgctgccttcaaagcggcaggcgtcccttgccatttcttctgccccaggtccaggccagccataggcaggtctttctgggtgttcccaggcaagagcccacctgaggctgtccatggttccccacacgctagcccaggatgaggctccctcacccaattctcagatgtccagatccctttcaaataagtctactcccaattctctgctcttacagatcctgcatctggcttttgcctcagtccaccaaagtgaggacctccacatgaccatcatgaggcattctcatgaagaagatccaggcaaattctgggagagaccaagagacgtaattagatctgcagaggagcgcttctgtgtcagtggggttaggacctccaaaaacctacacctccataaaagcaatgagaacactggaaaaatctgccaaaatcaactttgttttcagaactctacacatgaaacaaagccccaaagcaacccaagaagcatctttgtgtttttttcagaaaaaaaatggctgactctcagtaataacagggagctctgtggtgttttgactcacactatttccacctccccctctgcatttccaccaacagctttaattgtgaggctttaaaaaccaacagcctcacatcaaggtgcattaatcagggttttccagaggaacagaaacaatagaaacaacatttcctattgtttatgtatgtacataaatatatatctcctatttataaatattttatacctataaatatatatctcctatatattaacaatctcctatatatctcttatttatttatattataaatgtagattaatgtatatctcttatttatatttatatactaaatatataaatatattttaaaaaatatatacatatatatttcctatttatatatttatatataatttataatattttataccattaaatatatttatagtattacatacataatattatatgtatattgtacatatgta

SEQ ID NO: 474333 - DNA, 915 bp, Homo sapiens
gtgcaggtttgttacatagtgtccagcagctctcagaagctcccctgtgtcctctgacaggggtacaggccaggaccccacataccatgcacagtgaataagtaaatgaacgcacaaggagggggttgtaatgtggagctgtgttcctccatatctcaagccagagtggatttgatgaatggttttgaaaagatgcagaatttcctgtacgagagtacttacatccttacaccttttgcacagcctgatgtgccagtgagaactcaatttggaaagcccacactcaggcattcaggcctaggaggactcatcgactcctgtcacaacctcttccctggagcctccctgtccttgcagcccttagagttgtcagggatgctcaaggtttacaaccctggggaggtcatccctaagcagtggatggtgcacaaatccagggcaccatccatgcacactagtgggagaggcaagagggctcagtcatcctaccattggacaaatatgatggcctgactgcttttgggatactcttatttattggtttgtcactggagaaaggttttatcttctcgcccaaaccatgctatctcacatttctgagttgctttgcctcaagtattaatataagatgctttattcattcacataacattcctgagaaagcattttatggcaaatcctaatcaatatatattttgggggatggagaggacagtgttccttggcatcaaagaaatacaatactagttggccacagagacctttgggatctggaggactctggggcaggcacttgttccggggatgaacctggattgacagtggtcctggtggggctggactttactggcaagttgttgagaactggaaatgtggactgaaatggaggttggagagacctggcagaagagtgga

SEQ ID NO: 474334 - DNA, 2051 bp, Homo sapiens
ggggttgccatttcaaagggagccaaaaaggcaatatgcatttggacatcaaagaagcgtcagaagccaaacttctaagttttcacttaatcgacaacagtcatcgtgctggaattatcccaggccttgccttgtttttgaatctaatatcgtctccatccttaacctcaacggcttacgtgcatgtgcttggacagccttcctctaccaagcagcaccctccctctatttggaatttgatgaaagtggcagctcacagctttgcagtgcttaagaaccacctaggagcacctgacaaaacctttacgctgtgggcactcactggaaccatgggatgtgagcccgaaagcacaagccctcagaggaaaaatgatccactgaacctcatcaaaattaaaaatgtttgctttatgaacaaaactgttaatggtgataaaacaagctgaagcattggacgaaatatttgcaaatcacatatacaacaaaggactggcatcctaaatgtattttagctggaggtgccctgttgacgtccagcccacgagccaggacacacttaacttggtcgtggtatattatacgtgtttatttatctctatgtaaatatagcttatatgtatataatacaaatatataacataaatgtatatttatatgtatatatttttatatacaacattcatatatttgcattttatatatattgccgggtttatttagttcctattttgtggaatatgtctgtgttcatgcattttgttcctgagggatgttctgtattaatgtttgtctgtttttttccactgtctttgcctagtttcagtgtcatggaaatgccaacctcataaaatgagttgggaaatgtttccttttctgttttctagaatagattgtgcggtgtctcctttaactgtttcagagattttatcatgaaaattctttcacctggagatttatttgctaaggggatttaattgggaatctatactgtattaggtatagcatgtgtttggttacctatttcatattcaatgtaacttggtactttgtggttttcaagggaattagacatttcatctgcttgtcaagtgtgtgtgtaaagtatttgcagtattctcttgttagccctttaatgtctgtgaggtctgtagtgatttctcttattagccttttaatgtctgtgagttaatactttttaattttagtttaagtttattttttatttttagttattatagttagttaataaaccacaaagataatttgtggtttcaagttgttgaaagtcacaagacatacctatatattattttatcaataagtgactctaaaaattgttcaaaatccttttttgtagttgagaaaactgttaactggtctgtcctatttctcagaagttcatatgaatgcagtgaaatctgagaagccaaaccgtaaaatccaaggaagcatgtctacacagagttcatagatatgtgtttacaggatgttatatgaaaaaacaattttgaacaaaaaattagtagtaataatttaaaattatgcttgtgtgctgattttaatggtaataacattgctaattttacttttctaaaatgaggtgaaaacttaaattattgatttttgcccattcttatgtaatgtcagctttcagtgctatacattttactctaagccactgctttggctgcttcccacacagttttatgtgttgcattttaattcatgtgttgcatttaatttttttatgtgttgcattttaattttcattcagttcacaatttttttaatttctcaaaagttttcctctgtgactcatggtttctttaataatacgtgctttaatttttatgtgtttgatgagtttcatattaccttacgttattcatttctagcctaattccattatggatacagaagatgctttgtgataaataaaatctattttgtgataaattaaaaatacatttattttttctgatccaggatttggcttattttgcaccttgtgccctttaaagtatgtttattctgccaccagtagtgaagta

SEQ ID NO: 474335 - DNA, 611 bp, Homo sapiens
gctagctttgtccggtttgagtatcaagattagaataggcttgtaggatgagttggagatattgcctcttttcttcgtgtctgacaaatgtgtataggacatctgccacggggtttagagcccatcagaaacctcggaggccttcactcaattacatctgccaagacccctttccagataaggacactcgccatgaacagatctgtctcaccagacccaccttgatgcggatccccggctcctgctctgggaaggctgaattggatctgctggagccagggctggcccctgaggaggtggagaggtgcgtgtgctcccacactgagcccaacttatcagagcccagaaaatgggcagaggaacaggaaaggaggttcttcaagccaacaatccctaaacctctgagccacggatacttctccagggcagcccctcctgaagcccatggggctggcgatgaagtgctaactccttccaagaagctcatgaaggttgcaggagagtcgtctggagccaagagctaaaagaggttggctggccagatgaggacaccaagaccctgggatagtagagtcacaagaagagagacacctggatcctcgagtgtcttc

SEQ ID NO: 474336 - DNA, 1264 bp, Homo sapiens
tgcccaggcactgtcccaggcaaggaggacatggctgctgatgcccaggcactgtcccaggcaagggggacatggctgctgatggaacgggtctctgcccaggcactgtcccaggcaaagaggacatggctgctgatggagcgggtctctgctcaggcactgtcccaggcaaggaggacgcagctgctgatggagcgggtctctgcccaggcactgtcccaggcaaggaggacatggctgctgatggagcaggtctctgcccaggcactgtcccaggcaaggaggacatggctgctgatggagcgggtctctgctcaggcaagggggacatggctgctgatggaacgggtctctgcccaggcactgtcccaggcaaagaggacatggctgctgatggagcgggtctctgctcaggcactgtcccaggcaaggaggacgcagctgctgatggagcgggtctctgcccaggcactgtcccaggcaaggaggacatggctgctgatggagcaggtctctgctcaggtgctgtcccaggcaaggaggacatggctgctgatgcccaggcactgtcccaggcaaggaggacgcagctgctgatggagcaggtctctgccctcctgggtggagtacacatccccacgaggggtccggtgtcaattatcaacaaggaagacacaaatcagattgatctccctgcttgcaacaagagccagagaatgggttttcacttggtaaatgtaggtggggagtgggaaaggagaaccatctggatcacagccttcccttcagccttggtgaggaagggcattttgagtacagcatttggaaataagcacacctgtcacctccaggtgaaatcagccacagatgtggtctttcctgggtctggaggggaagaagacttggacagtggatttattctgtggacaacggagttctgcaagtttgttgactgggaggaactgggtcatatttgctttgcaaaggacagaggagggaggctgggcgagaagcagctgtctgtggactggccgggcagtgtcggcggctggaggcaggggtgccagcggccgtgtcggttcccgtgggaaatatgcatggccctcgccctgctccctgttcctctgattcccccttgaagagaaattaggggtcttttggggagcacagaaggggcacctgatgtagcctggggggtggctcttggtaaatgccacttaagatgcaacgtgaagtgggcagagaaggctgcgtgggggacatc

SEQ ID NO: 474337 - DNA, 796 bp, Homo sapiens
atcccttgatgtgactgggaacatgtcagcaggcaggggaggaagagaggacagacagccttggagagggtcttccacacttgaggacaaccatgaggatgatgatggtgatgaagatgaagatgatggtggtgatggagaggatgataataatgatgacgatgatgatgattatgataatgatggggaggaggacgaggagaatgatggtgatagtggtgatgatgaaaatgataatgaggagaatgaggatgatatggtggtaatggatggtgatggtaatgatggtgatgatgatgatggtgatgaaaatgatgatgacggtgatgatggagaggatgataatgatgatgacaatgatgatgattatgataatgatgatgaggaggatgaggagaatgaggatgatatggtgacaatggatggcgatgatggtgatgaagatgatgatgttggcgatgaagatgacgatgatgaagaggaggttggtgatggtgatgatggtgttaatggtgatggtagtgatggtgatgaagatgatgatgttggcgatgaagatgacgatgatgaagaggaggttggcgatggtgatgatggtgataatggcgatggtagtgatggtaatgatgataacgaggaagaggatggtgatgatggtgatgatgaggaggttgactctctctatgttactgggtctgaaaacatttctgaaaatgcagacaagatggtccatggctgcccctgaacagcagcccagtgcatccatcctgacaaagcattttggattttcatgagc

SEQ ID NO: 474338 - DNA, 668 bp, Homo sapiens
gcagctaccaccttcacagcagccatcctgctcccagcctagctgtgggtctccaggacctcagaagcctggctgcagggagacgtgcacacactcagcatctgccctgcagcctgcagcacccacaggccagagcccgcacagtgcatgctgctatgctgcaggtgttggggctgtggggcacagcggggtgcctaatcctgccgggaaagtcagagaggagactggaaagctcttggaacttggaaaaacattttccattttcatctatagtacatctcccccgggtatcagaagaaccattactatttgttctaagtggcaagcgaatcttcttccacatccacgttcattttattaccgtcttgggaacactcaagggtgataagggacactgggacattgagaccagtatctgggaagtgaaattaaaaggattcaatgaaaccattgaatatccatatccaaccattaaatatccatatctaaccattaaatatccatatccaactgtcgaatatccatattcaaccattgattatgtatgtcctggggacatccacaacagcagtgaccagttgaattcttgccaggtgtcattcatgagaatttcatgttgactttgcaataaggctgtggggtgggtactaatgtctcctttatgtaga

SEQ ID NO: 474339 - DNA, 949 bp, Homo sapiens
cacactggagcctcgcagtagccaaggagagacgccaatgagggaatcatttttccacttggtgaaatacatttttgccccgtgaaagcacgaggagggcctgtcttggataggtggagtggtcctaggtcctactagatggaaacctcaggactcggaagaggttcaccttcggagcgagtccccctaaggccagccgtaggatctgcattgagttcagcaagcggaggcgacttccccagggccacacagccatggagggctgcggctcagttgctgactgctccagctcaccctcacgtccatgaggtttctgctccaaaatgctattgctaagaaaaatgttccaaacacgacccattggctgaccacagggttcagggctcgtggtgggctcagcgggatcacaaacattggcatggccagcccagtctggggaagctgcaagggcctggggggttgtggccttgggcatcacagcatcagacttggggagcctggtgacgagagcctgtctgagaaatgtgacttgtttccaggagcagtgggagccccttccctccctgatgaagggggagacagacaggaggagcaggacggacaggaggagcaggacagacagaaggagcaggatggacagaaggagcaggatggacagaaggagcaggatggacagaaggagcaggacggacgggaggagcaggacagacagaaggagcaggaccaacaggaggagcaggacagagagaaggagcaggacagccagacaggaggagcagccttctgggacccaaacaaacagtcatgccccaaatacccccagggctcttgaaagggacagcggaaggcacaggccagcttcctctccaagcagacccatgtccatgaaccctgcaatcccaggccaggagacaatcttgaaacatgctgtgaccctctcttccctggc

SEQ ID NO: 474340 - DNA, 542 bp, Homo sapiens
gtttgtggccagcaccatgggaacctccctttggcggatctttgagaacaatttatctaagatttcaggatgtgagcacacggctgagacacccttcgacctcaccttctgcaactgtggcacaaccttgggctcccaacaagagtggccctcggatccctggggtcagtgtgagctcttccctcggcaggttttctacagacccctccagctggccctggagacttccggctgtgcgcgaaggaataaaaaacacaatcgaccccagctcctcggtggttctggccaaatccatgaaaaaccagcagggaagacctggctttctgtggcactgcggctgccggcgggcagcccacagcggcttctccagcaccgtcctccagccattcccatcttagccaatttttcactgtgtccttcggtatcagcctgcaattaggaggacagcttctcgttgcttcctgtaatcattaaggtgatgccttgaccgaaatagttatcctttctgagcctcattttcctcactaaaaaaagtaataatc

SEQ ID NO: 474341 - DNA, 1050 bp, Homo sapiens
gcaggcagcgttgtctgagaagctcccaacacatctggggtggggcaagtccagctggctgagggtgtcatgcaccaactacgcaggaatgctcgctgtggcgagggacaaaacaagccccagacagagctgaccaatagaagcggcatggcccgtgccgctgaaaaggccggaggcggccgtgtccttcctggtgtgctcagctctctagctgggctctgctctcccttgaagggggagccgctgcaggctgagaaggagcagctgccgccggcccctgcagtgagtctgcagggctggccaaggctttacagggactgtcagagcctggctgctgctaactcgaggccagggagctcctggagcccagaagatgccctgaaaaccgtggcactggctccagtcctcagaggcttaggctccaaagccaactgtgccctgtactgcccgcaaggtacagtgcagcccctataccccatctcttgatccacaggctgtgtgtatatctgtgtgtatatccgtttgctcctattataaatccaggtttcagtgagagaatgtgttctgcgcaattttgcttttgaaaatttgtggagatttgtgtagcatagatgcagatagagtgtaatgtttatgaattactgaaaatgataaagactttctctctttctggtattattttatttagtaattgaattatttcaattgttttaagctttgtcactgttcttatttctatacccataagattgtgaggtatccaaaaatcgtttattaagcatccaatgtgtttctttcgttttcttcatatatttccaggcgttttggacttgtattttcatgttaccttggtcagcgcacgtgggattctactttatcttcattgtagaattaagatattaacaacatacattggcattttattccatttaattccatttatattgaaatacacaatgttagaaattaacattgtcaagtctgtttttagtttgcttttgtccaatagctcttgggtgatactttaattttaacattccaacattgttt

SEQ ID NO: 474342 - DNA, 1176 bp, Homo sapiens
caccgggtctatggagcgtcctggatctgtggtacttcccgggggcttgggccccttcttctctgagtctgttggattccggccttattttccttccttccagatttgtctccatttggtattccatgcagtcagtgccctccaaggctggaaggccagtggaagtcttcctgtaggatctaataggtacatagagggccaaagccacagtgggcggaggcctttccagttaagtggcaagagagccaagctgccccactacatcctcaaggcagagtgctgtgctgctgccactgactttatgctaaacgctggaatgcggaggccttcacaagggacccccagtcttttaccagctcctctttcgagtgtgtgctttggagagctgctcttcaccaacaccacttggcttctgggacccgggaggctgatcccgctgttctgggacttcaggatggccaacggcagcctggatgggtgcaaaacagaggggccaggtgggaggcctctcctgcatcgaaagccctccaaatataatgagccaagggttgcatcagtgaaacataacgctggcatcttaggagctaacagcctggtgctcggcggtggcccacacatgctggctgaaggaatgaatgagcagatgaatgagtgagtgagaggttacgacatgtgagatggggcctgggcaaaagaagaagcgtctgtgcaggtaaaatgagactgagtctggggagagatacaggaaagggatatcggtcctgttccaggaatgttttcctgtcctggcattagtagctttatttctatagttttgggatacggtttggtatctgataaacttagggatgatttttaccacattttaagaacaatcttcatgaaaatcttgattggaattaaattaaatagcaaattaatttagcaaaaacaatattcaatattttctttttattcagcaaaaagtactgtgctccatttattcaaattatcttttattcctttcaatgaagatttattctttctttcagttaagaaccatatgtttcttattagtgtatgtttctcattgcttttttgaatatttcgttttttctggccttgatctaacttcattagaatgctcgctgtggcgagggacaaaacaagccccagacagagctgaccaatagaagc

SEQ ID NO: 474343 - DNA, 1228 bp, Homo sapiens
agagccagccgtcctgggtttgcaccctggctctgctcctgaccaggcttagtgcccccgtgttcccagtgcaaggctgttggatggacaggagaggatcgacccaggggacaatcgacccaggggacaatcgacccagggtacagcagactcaggatgcaatagacccagggtacaacagacccaggacacaagagacccaggggacaaccaacccaggagacaatcgacccagggtacaacagactcaggatgcgatagacccagggtacaacagacccaggacacaagagacccaggggacaaccaacccaggagacaatcgacccagggtacaacacactcaggatgcgatagacccagggtacaacagacccaggacacaagagacccaggggacaaccaacccaggagacaatcgacccacggtacaacagactcaggatgcaatagacccagggtacaacagacccaggacacaagagacccaggggacaaccaacccaggagacaatcaacccagggtaccacagacccaggagacaacagacctgggacacagcagaaccaggatgcaatagacccaaggttcaacagacctaggaggccaccaacccaggactcaattgacccaggtgtccttagattttcaaggacccaaaaatacaaccatgttacatcaaactgttctccagcctcagagaaacaaggcatcaaccacaagtccagaaatagaccaaagagctaaagccattgaatttgggttaaaatcctgaagaatgctgcaaggtgggcaaacaagttattcataatgttgcctaatcttcaacatgtgaaagaaggagactctggtttggaatggtgctgatgcagatggggtgggaaagatgtgaagggcaagggagcggctcgcaaaactcccctttcagctgcctgcaggcccttcacagccctcaacctgcgcccccctcgcctttgggatgccatttgatcattgatcatttcctttatttacgaatgtttttgttaattgaaaactatgactgagcatccactgggactcatcgcaggatctgaggaatacttagccctaaattgagccctgttctggacctgcctaacaaaagcaagaaccaaaaggaataaatagcttccaactaactgaactgaacctcaaacaaatttaagaatatttatagcaatacaatatatccagaaccttaggaga

SEQ ID NO: 474344 - DNA, 1439 bp, Homo sapiens
cgcctggaaagcaagctcccagcaacaaggaacaatcacacagcctccgttcctatggtgtccgcgcatcactgtcggcaacaatatgcatgcgcgggactgatggaccgtgaaggagaggcgtggaaggcagagccaggatctggagcctggaggctgggagatgatattaatgggcaatggaagatgcggctggagaaagacgacattcggggcaagataacaaccctgcgctggagccagggtccacagggagaaggggaagcacagggcaccccaagcatgtcgctggatactcaggcttcagagccctctaactttctcagagacaggaaatgggactcggagaagtcccagtgccacctttggccacctccccggcagctgtacagcttcttcgttctccagttggagagcacaagggcatgctcagacatgcacacgtctatgccatctatgccgaacaccttgatcatttccgaaaatcatctacagtcctctccatatttgatagttctaccctctctcacactcgttattttacagacagttggttcaccaaacccagatgaggttcacacatttggtttctatgcctcttaagttctttcgatctgcagaggacatcttctgtgtgtgtgtggttttgtttgttttttagtttttgttgaagaaagttcatttgtcctatagacattcccacacactctcaagattctgccaaattttacccctgtggaagggtatcagaaataaccagccgttggcctgatgtgcctatcacacagttccctctgcctctcactgggtcattttagcagctgttgttgaaaattgtgtagatgtgtcatttcattaaagagagtgggtgtgtgtgagagtgacagagagagaggaggaaggaagagaccggctgggctctgtcttcccagctgggtcatggtctcgttttttgggatatcatcctcctttgctcagtgtccagagcccaatggtggctccatgaacgtcccctgaagaaggaacaaaggcgtctgataagggctcaaagaaaaccaaacacacaatgaatcctctctaaatcacaaatagtcacttaaaatgccatctgcagtgttttgccatttatttatgagtattcaaattctgcctcttggacgacattgacagaaagcacatttcatctttgtccagtgaggagaaacagcagtgaatctctttaagaatccagtgtgaggagtaaaaactgggggcagcgaagggtggcattcagtgcttctgtgtcctggaaaagcacaattccaccattcaagaggggctggggcctgtggcctccgtaggtacctctgaaacctcaagcagagttgtcttcgagagcccctagcaggaattgataacataaacaatttgcatgaaattcccttgggatcagaaaataa

SEQ ID NO: 474345 - DNA, 1358 bp, Homo sapiens
tcccaagaggcccctgaagccccaagagctcccctgattgttccaaagcaacattcccctccatgaacaactcagggaccccctcgatccacggcgtgaggcccaccagcagaggaagaggagcttccagtcctgactcccactaggcgcaggggagccgaggtgagctcccaggcccgccgcatcttcccctcctctttgggtggattaaaacagacttggacagagtctggaaaaacaaactcttttaaaacaagacaaagattgagtctggccaactggctattttcaatccttgctgaacggagtcaagacagtcggtagtaacagcttgtggccatccgcaatcgtcctccccgcacgagagggtggagcctcctggaagtgaccagagccggtgacttcgggaatcaaccctcctgaaacagcggatggcctagtgagcctttccagaactgcagaggggcatttgagtgtggaacatgagtgctgggcacctggaggaatggaggattccccaaagctcgctggatgcacatcccttgctcagcagtccacatcatccgtatctctcatcccacagccgcgggctgcccagccagggccttgcggcaggaggtgggacagatgcagacttcagccccgagtctggcttacttcaggatccctcagggctctctcacctcagaggcagcgtgggaccccaggccacaccttgtttgcaggcctcgcctagatcgtggtaacagccagaactcaacaatttctccaagtcagcctccccgcagcccggagtggggactgagaccaacatgcaccctcatctgcgggcacgcagggacacagcaagtccagagtccacagctctgcagaggtcctggaccccactctgccagtgtggcgggtatcagagctgggtggggctctgtgaagttagggtcatggagatgactgcggtcagcagcgggcctgaggtgtcctgctctgtcatggcgggagggttccatgagcagcagcgagggtccccccagatcctcattttcaacagggctggaggagacaaacgacccccggctccccaggagatgttcagagacgcagatgccaggggaggacgtggagggctccaggtgggctggggaatgtgcctgggctcctcacacctgggacaaggaaaacagcagccggccgaggctgaactaggttttccaggcttccacccaggggatccacctccccccaccgccctggtcctggggagcaggcttcagcccacgggtcccttctatttcccacctgcaccggtgctgcagtgggaaatgaattcaaacacacctttgtgacctacacgggtctaa

SEQ ID NO: 474346 - DNA, 1132 bp, Homo sapiens
gagcctcttcaagctgtgtcctcgggagtccctgggcgggggcccagggtggcaatgtagcccctgaggctggggctctgagatctccgatggtggagacaagagaaggctgttccagtggctgtcatggcagcaggagaccgtgtcctgcgagggatttccggggagggcggctgctccctgatggaggacgtgggctcccagctcattcctgtggcttttcctgactctcactctgacaacgtagtggacttggaggctgccaaggacatggggagtgtggccgctacaatcaaggcccacggggtgcatagcattcctgtgagcaccatggtccctcctcaccagagcaacctcagcgctcccgaccttggctgtgtgcatggtgcccgtggaagccactgtgcgttgccatgggcccagtctgctgtcgttgcattgctgatcctggctgacacgggggccgggctcgtcaagtgggccctcccatgctgcatctgccctgccttccggtccacactggatggattctgcctattggtcaaggccaacatcatgacctcctccctgcctcgtggtctgtgattgttagaggcacagaacttctaataaatgaaagttggatgtttaatgtttaggatataccctctaggtctcaaattttccatactttttcacctttctatgtgctctccactcttataaacatatttgattttactttccacagcccagtcttcattcattcccattttaccattcagtgtataccctagaccttaaaatggtccactcacattaatttccaggagtttttttccttgttctcttgtttgccttttctcccccttgggagcctggttttctcttattgataccatattatttcaaattttttgagaatgatactatttagaataatcacaattacggttatgattattttccctgaattatttctgtcccctaaggttcaagtgtagagtatgcacagctgagcctgacttctctttcatgcctctagctttctgcaaacacctagtgatctctgcctgctaggtcctgtctgtataggaataaaggttgaagtgtgtgtagtgaccggtcagtgtgaatcacctctaccctgtgt

SEQ ID NO: 474347 - DNA, 1547 bp, Homo sapiens
gtgacacagccctgcccccccaggtgggatgccaggtctgctaaggagggcatagacgggtttgctccctgtgcagccccaggggccttcgccaccccctccaggagaggcgatgcttggacctgggtgtttctccttaagacaaatagccactgctgcaaacagctccgcggccaccaacagttatgggaagtatcagacacatcggcgtgtttgccaatccttacgtgtgccagcctcctgcaaggtggaagacctgagtaaagaggagaggagtaaagaggagtgtgagggccacagcacactcgcagctgccgggcagaggggaagccctggcccctccgcaggccctgccggcggcctcctgaaggaagggacccaccagacgggtgctctggggccccagcggctcccctcgagtttcacccaaaataaaagcggtaataatagtaacatcctaattgatgtgcggagccagcgttatcggcagcaaagtgcctttacccctgtggtcatgaggcggccttgccagcctgagctctgccgttatccctgctggtctcgtatctgtaatgaaatcccgcaccctcgctcaggtcagctggccgccggcacctgtgagattgtgaccttggaccgggacagcagccagcctcggaggacgatcgcccggcagaccgcccgctgtgcgtgtagaaaggggcagatcgccggcaccacgagagcccggcccgcctgtgtggacggggcatggacatgtcggcttccttctgggggctcagggagatcccagcatttctggaggcttcccgaggccatgggcgactgggtgtacagccacatcctcagccaggttgtgggtcctggccaccctggacccctcatggcttgggggagcacagctcagggtgaaggagaggagaccccagcattcacgggcactacccctgcccagaccccctggctgctcctggagcaaaccgtgtctgaaggggctggcaggatgcagagtggacagcagccctcactcttctgcgggaaaagcttttgtgtgcttcagtcattagaaaagtgaatgtaagtccttaagtacttggatatttctgtcttggtccactttgtgatgttgagactgggtaatttgtaaagaaaagaaatttattttacactgttctgggggctgggaagtccaaaatcaaggcactagcgtgttcagttgtgtggtgagggctgcattctccagagaggcagaacgctccatcctcacgtggtggaaggtggaagggcagaagggggccaggctcccgcagtcaagtccttttacagcattatctctccaggatggtggagctttcatgacctgaacatcggtcaaagtgcccatctcccaacactgctgcattgggggttaagtttccaacacgtgaatttagggaacacttttagaccacggcaatttagaaatacgtgaatgttcttaacgcagctgtggcctcaagcaggtcccctgagcgctctgagctgtgggcagagaagcagaggaggga

SEQ ID NO: 474348 - DNA, 805 bp, Homo sapiens
acacggacccgtctatgccacacatcttcctcagaaggaaaatgaaggaggctggcgaacgacggccaggggagaaaaaccagaattgtcgcttattcctcggccctgccggccccgcctgcgcctctgcccggcgcgactttctggacctagtgacacgaagacagaggacttctcagaacgcggggacacaggcgtggggagaagggccgtcaactggcctcaagtctggggcacgggaggaggccgcttctgtgcctgacagtcccctggggcaggcgtcgtgtctcaggcgggctgggctgcagccttctgtggctgccggagctgcctcctcctcctcctcctctgaggacagcagggccaacgccacggtcggcgggggctgggcgcggccgggctcccacagactgcgtattgctgatgccaggtgccgccccccgcctatgtgtctgagtccggcctcctcgggtcggctggacagaccgaagctcaggatgccaaggcctgaggccgtccttcacggaccacagggaaacggagtgggcgggcggcagagaacgggtgaagtccgaggcgagtggagaactgtggctgagacgtgggctctccagggagccaaggccactcccggggcccctcaggggctgtgtttgtcaggagacctgaggagcaaagagagagagaggcctcgtctacccaacggggctgtgggattagaacccacactcaacaggacctgaggctcagggccagccctctctgcctgtggacacttgtggcctgggtcacagctggtgtgtct

SEQ ID NO: 474349 - DNA, 1113 bp, Homo sapiens
ccgtcgagtgtgggttaaattccatcccccaaaagatacatgtgatgaagtgaagatgcattcattctggattagggtggttcctaaatccaaggactggtgtcgttacacgaagaggaaaatttggaaaatcagcctcctagaaggaggcgtgatgacggagacagagattggagtggtgcagccacatgccaagaaaggcctgcagccaccaggagctgtgagaggaagaaagatcctgcccacagccttcagcgagagcaaggccctgcccgtcgccggacacaggacctctggtgtcaggtcttccggtctgtggaaagcggaagcttttgacaagcccaccagctggagaggagagtgcccaactattcccacactggtacccaaatcagggattatcgttctttttaatctttgccaatttgctaaacagagaaagacaggcctccctctggggtacacagtcctcaggatgcaggatggcggctcggcaagatctcagctccaggaaatttgcatttcaaaagggaactctgctccagatcaaataattaaagactgcaacctgaacagctgggagctcagcgccggagcctttaaagctaagccaaccatcaacaaatacggtggccaacagcttggctaaatcattctactttatacgttttattttctgattagtcacacagagctcattaaatggaagacagagcttttcataaaatatgtagaggaatcttggattcttaatttcaaaattaaaaaaataataatcccggcaatgaaatgcactgtctgttcataaaactcgccaagtgtccaaggatgaaaggtttgaaacagaggggacccagaggacaagtctctctggaactgacagcggccgtcttgctgagcccttgggccgtcctggggctggggcgtggccggcttgtggaccttgctccagataagggaacttgaaggttccagaagccttatagtttgatataatcccatttgtctatttttgttgttgttatgttttgttttggcagcattatttacaatagacaagttatggagtcaacctaagagtttctcaatgaatgaatggattaagaaacgttt

SEQ ID NO: 474350 - DNA, 1133 bp, Homo sapiens
cattgtgaggatcacagggagcaggggtggaaggacccaggacagcaccaggtacatcagcccaggcggctttgtcttcaagggtgccattgcggctcagacaggtgggacccagctggcggctgaccacggagccccagcagactgaggcagcggcccagggctccgtctggagggggcaggtctgagcaggtggagcagggacaggaggccgagggctgcatcagaatctccgggagcgtgggggcttccactgctctttccggtcctgggggcttggatggggcccagagctgggtccttctctgacttccccggtgacgctgcctcataaccagtgccgctgccagaggctcctgacctgtgtctggatgctccttctgccctgtctgccccgtatgagggatggttgtccctaagatcctcctgacagccctcgggccgagtcagcacccccatcctaagggagaaaccaaagccactcatcctgttccttgtgtagccccctcaccaggctccccaccatggccatctccctcaaaggggaaaagtctggaggtgggtagaccagatgaacaagtgttggcaaaggcctgggaagagatggtgtccccagattatgaccagaacctccaggtgggtggaactgccagacaattgatcattgcactgacctgcagagatgaggaggaggggagagctgctgggtacaagttgatctccttcgcccctcaacagctccaaataatacctggagcctcagcacagatcccaagcctgggcctcatgatgccggtgttagatacccaggtccctgttgccacttgtggaacccgccacaaagagtggaccctgaatcacaatgaatgcaaggggcaacggcacctgacgctgcacccagctaggatcctctggtggccttgggtgctccttggcttgtagatggttgtcttctccctgtgtctcttctcatcactgttcctccatgcacgtctgtctgttttgccaaagttttaatgaggataacagtaactggcttaggacccacctgctgacctcgtccaaacctgatcatctgcagagacgctcctcccaaatgaggtcacactcacaggccctggggttctgccttt

SEQ ID NO: 474351 - DNA, 1583 bp, Homo sapiens
gcagggacaggaggtccaagatgagacagctgagtgggctcaaggacgtgaacatcccaaatcaggtctgcagggaggggctccggactccaggctccagggacagtaggtccgagaagacacaggtgagtgggctcggggacgtgaacaacccaaatcaggtctgcagggaggggctctggactcctggcgcagggacaggaggtctaagaagagacagggaggggctccggactccaggccccagggacaggaggtccgagaagagacaggtgagtgggctcggggatgtgaacatcccaaatcaggtctgcagtcaggggctccggactccagaccacagggacaggaggtctgagatgggacaggtgagtgggcttaaggacgtgaacatcccaaatcaggtctgcagggaggggctccggactccagaccccagggacaggaggtccgagcagagacacgtgcgtgggctcaaggacgtgaacatcccaaatcaggtctgcagggaggggctccggactccaggccccagggacaggaggtccgagaagagacaggtgagtgggctcggggacgtgaacatcccaaatcaggtctgcagggaggggctgcggactcctggccccagggacaggagttccgagaagagacaggtgagtgggctcggggacgtgaacatcccaaatcaggtctgcagggaggggctccggactccaggccccagggacaggaggtccaagatgagacaggtgagtgggcttggggacgtgaacatcccaaatcaggtctgcagggaggggctccagactccagaccgcagggacaggaggtctgagaagagacaggccccaggctccagggacaccaggtccgagaagagagaggtgagtgggcttaaggacgtgaacatcccaaatcaggtctgcagggaggggctctggactccaggccccagggacaggaggttcaataagagacaggcctgtccctgcggctcccgctttctggatctcatggcacggctgcttcttgcggaccttgtgttgggaactcctgaggttcaggaggcggccaggcaccgtgggggatgctcctcgcacggggctggctggagggcctggggctgggctgtgtccacaggtgcagagctgcacacaggtggcccggagcctcacctgtgggtttccttctgcgtgtccctgggcagcactgactctgcagtctcaccaagagacattggcaaaggcagtatttccagctggggtcccattcacaggttccaggcaacggtcatgggcataggcagccggcatggaggaatggccccaacattagcagtgtctccctgagaacctgctcttgacgctccctgggaggaccagttacaggatgttctgtgaaatgcatttcaaggaaaggtcagactttacacacgaataccctgaatttgtgtttcaaattcatgtgctgtgttccctgcagtaaaactttcagctgagcagaaaatatttttccaatgaaccatttcctaaaacaagcccgtaagtgtagtctaaatgcctctgcaacggccactgtgg

SEQ ID NO: 474352 - DNA, 944 bp, Homo sapiens
gaaggaagcagcttgctgacggtgcaggtgccacttgacctgtgcgtagcataaaccccgcaaatggcagctgcaagtttaaataaatgcctcctgctgtctggaaatgcctcctccttctgggactgtggtcctctctggtgcttttacggcagagtccccaaccattttggctctagggattggtttcctggaagacgatatttccacggacggaagacccaggttatgctgtgcccatgagtttcccggggatgccacgaccaagtacaacaaactggggtgggcacaggcaggagtgaaatccattctctccctgtcctggggcctgaagcctgagaccaaggtgggctgcactccctgcaggggctctagggaggacctttcctgccccctcgctcttctggcggtggccgtgacccttggtgccaacctctctacctccatcttcactgtccctcgctgccttcttctctgtgtccacaggtcttctaaagacaccagtcattggacttagggcacatctgattaatccaggatgacctcatctcaagatccgtaacttgattacatttgcaaagacccttgttccaagaaaggcacagtcccaggttcacagtgagcctgttgtgggggcccccattcagcccattacacagcttgtgggctgtgctaagagtgaatcaggcctgccttcccagtctcccctgcttccttctctggaaattggcatgaaccgtgtgccaggccggcttgtaggcttgcagggagggtgggtggattcgcgcctggttgccagcagcccccggcaagggactggtgaattcttgaactgtgggtcattcccagaggcttttgtactccatcctgtgtaccccatcctgcttggaatgtcccttgtccccagcaagatttggggttcggttaggagggacatttgtgct

SEQ ID NO: 474353 - DNA, 1017 bp, Homo sapiens
tttcaaaatgttattgcagccggagactgaggccagaggcaacgtgtttgctcatctcccgcagctgcctggggctgatctccgccaaagctcgaggctcctggtggcagatggagaccaagtgtcggccctgtcactgagagacttgctgagtacatgcgaggcccgcacaggcaacctgggagtgccggtcattttccgctttgaacctgagtcccagctggcagagcagagccccaggcccacctatcagcagcaaagccaggttggtgggaaggccaaggccaaggctgcagacccagaggcactggtaccaagcatccacgctgtcaacaggcagccagcctctggggcacccacgctgtcaacaggcagccagcctctggggcacccacactgtcaacaggcagccagcctctggggcactggccgagaggcagtgggagcacctgcctgtgctccaccgtggcaggccccagaggggacacattgcaccccaggttggaggaagggcaccctgggaaagccaatgtccccagctgtgtctgggtctctgagccccgtgtacttccccatcctctgtggagctcagagaaagacacaagtaaaagcctcagcgacctggcaggacacagctgagctggtgccgacagtcggccgggattggcacaacacgtcccccctgtgccgagtccctatggagcaccctcaccatcgtagaaaatctcctttgttcagccctcggggcaaggtggaaaacagcagcagccccaccggcctctccctgtctgggcaactccagcacccccaatctgggagggctcagctcttccctgcacatcgcctgcaccccaccgtctgccagcagacgccctcgtgctgaaggctgccctttggagcctgcagaattccctggaagattctaaaaagcctccctaacaatttctaagctcagtcgcagaagcagccacaggaagatggcattcgccaaagccttcggaatctagaagcccctcc

SEQ ID NO: 474354 - DNA, 2063 bp, Homo sapiens
gggaaacgtcaagcaagcagcactctgagcccatgcatccctctgttgaagccctaatcgcagtgtaacgctatttgtggatggggcctttggaaggtgatgagctccctattcttgcatactttttcctggggaacccaaggacccagcaggttagaaacacagggtggtcagcttgatgctccaggaggcagcctccaggggggctgctgtgggcagttcctccacagctcacactctgcagaagccgggattgggtgagtgctcctcgtcaacgctccagaatagggcgctcctgcccctgactatggcatcatggccctaggatcagcctttcactcaatcttggacaacgagtttttcttccaatgtggtttagccttggtggtgaatgttgttgctccagcagccaaaactgaaggtgcaaatgcaggaacaaggaagcagggtggccgtcctgggagccggccaccgtcctgtgagtcatctgaggacagccgtttctttccactccatatttctcaggacctggccaagggcagtgagtggaaaacagggaaatgccacattggtcgaatgagtgatatgggaataagtccttctttgggtaaagtcgccaacgtcacaatcctgcacataggggaaaaatgcaggttctgtggagctgacggtgccgtaaacagcggcaggtgcagagtgaccacagaattccgcaacacagatggtgacggggtgagggccatggagaaccagctcatgggagctcgtctttcagtgacctctgcaggcaatgggaagtgggaaaagggctccgccttccacctggccccaggtgcagatggcagctgtggttctccagcacccagctgtggagggagaatccttcctggaaataataaaatgcagccagatctgattccccagcccaacattaaggctccagcgaggaagcactaccaagaaatccggggggaaactctgggctctggacacttctccttccagggtacctgaaaaggctgctctcagggaagggtgtgcagagcccctggggtggggaactgctgtcagggaggggagttcagagcacctggggagggagctgctctcaggccagggtgtgcagagcccctggggagggagctgctctcagggcggggtgtgcagagcccctggggagggagctgctctcagggaggggtgtgcagagcccgtggggagggagctgctctcagggaggggtgtgccgggcacctggggaggagagctgggatgcaatcctgcatctcgtaacatgaccaacactgagacacaggaccaaggaagggaaaggtggaggaaagaaccaggggggagcattgctgatatttttctgtgttcatttgtaacttttcttctgttggatttatttgtctctgatagtaacgcccaggaggggtgcagacagggtggactctgtccagaggggctcccaggccaaggcacctcctctgtcccaggtaaaccaccaaggaatgcgatgtctgatcataaatcagagtgtacatctatgagacataagacgcaacaactgtgccatgtgcttgggcagtttaatgcaaataaaacatttaaaaaagagagccttaacattaaataaatcaatcccaggtatagttaataatgagagaagcgtgtgagtaatacaaaactcaaaattccttaacttacctagggatgttacaataaataccaccttatttgtgaatttacaaagggaaacattacctgcagattccagaaccataaatgtggccccaaacagaaattttaaattgattgtaaataatcaaaatcattgcagtagattaaaataaaactttttatgtataaaatggagaaaacaaaagaagaaagtcaaaagccataaaaacgtaagagcagttgtcagcaggagtgtgaaagacagcagttatgcccaaaatataatgctccaaccacacccctcccactgagaaatattgatgctgacagatttttttaaagaaagcctttttggagtagagtttagaaaagataacatt

SEQ ID NO: 474355 - DNA, 1087 bp, Homo sapiens
cagacacaaggaaggacttgatgaagattgagctgtctatggctattaaaggctggctcagtactattactgctatactatcattaccatcatcatcaccatcatcatcgtcattaccaccaccgtcattaccatcaccgtgattactaacaccaccatcaccatgctcaccatcaccatcaccattatcatcaccatccctaccataatcaccaccatcatcaccatgattaccattatcatcgccatcattaccatcaccattatcaccatatcattaccatcaccatcatcaccattgccatcattaccatcaccattatcaccatcaacaccaccatcaacaccgtgatcaccattatcatcaccaccatcatcaccgttatcactatcaacatcaacatcaacatgatctccatcatcatcaccatcatcatcatcaccaccactatcatcattaccgtcaccatgattactatcaccaccaccatcatcaccatgattaccattaccatcaccattatcatcaccatcatcatccttaccatgatcatcaccatcatcaccgtgatcaccatcatcatcaccatcaccatcaccatgatcactatcactatcaccatcatcattaccaccatcagcagcagcaccatcatcaccatgatcaccatcattatcactataatcaccgtcatcattaccatcaccatcacctttatcactgtcaccaccaccatcatcaccatcaccatcaacaccaacaacatcattattgtctttcaactaggtagcagtgaccattaattttatgtgtcaacttgactgggccctggagtgctcagatgactggtgaaacatcatttctgggtgtgtctgtgagcgggtttctgatgagattaatgtttgattagatggacttagtaaagcaatggcagtccccagtgtggggaggcatcgcctaatactttgggggcctgaatagaatacaaagcataggaggagagattttgctcctctgcctgactgcttgacctgggacatcagtctcttcctgccctcagactagaactcacaccaccagctcccc

SEQ ID NO: 474356 - DNA, 1542 bp, Homo sapiens
gaggctggcgtatgcacgggatgaaggggaggtacgcagcccggcccccgccagcactgtcctccctacatctatttcagaggacaatgtgctcagctgtgtgccagagctggcaaaggactctcctgttatgcaaaccccccaacccagagcccacagtccacctgcctcctgtagcagagcctacaccaggtccctgccctcatcaccagggccaggaagccacaggaaaggttctgccgcagctcccccagctccctctgcccgtggccaccccggagcctcccgacgtggccctgcctggtgtgggtgcctcattctctggatctggctctgtaggacgaggcttccctggactgctcacctctggttccagcgtggtggatattacatgggggctcaggcccagatgtgcggtgatgctggcactgccaggggacacagggatgtccctgcccctccaggcttcacctccaggcagcgttcttcttggctgtggcccagacaccccccaccccgcccctgagctgagtgggaagcctggcggtctaagaacagggtccgctgtggccgaacatcgccaagtgtccaaactacccgtgggactcacccggacactgcctggctcaggtccacacgtggctccctgtgctccgtccttgggcagcaaagcctggacaaccgacgcagaacagttcgactgcctgatcatgccacgggcctccatttccccagcagcggacatgaccacctctgctcagtatttctctgagaaggggaaactgaagccaaaacctggctttgtggtaagcctgacgcaccccactcgagggctgcctggtaagcctgatgccttcgtcagtctggggagaggggaagatttctcctcaatggtgactgaagatgagtgtctttgctacgaggtgctgggcacctgcacgaacagtggcagtgaactctcccctcctggtcctcacggccaggctggcccttggtgaccatcactggtgccccttgatgaccatcacacactgctgtccccacggccaggctgacccttggtgaccatcagtgctgcccctcggtgaccatcacgcactgctgtccccacggccaggctgcccctcggtaaccatcacacactgctgtccccacggccaggctgcccctcggtgaccaccacacactgctgtccccacggccaggctgaccctcggtgaccatcagtgctgcccctcagtgaccatcacacgctgccatccccatcatcactccgtccactccagggtctgccccagcagaggctcctatgatgtcacactcctgggtctggcaccaaggcctccacaccctcgaccccacctgtctgtgcaaagagagcccctgtgcctctgcccaggccccggactcccccagggtgggcccagcacagccctctgtgaccaccatgctgctgtgaaggggcctccttgggctgcatcacgtctggcctggataaggtgcagcctgggacgtgggcttgctcggagcctccctgcgcgg

SEQ ID NO: 474357 - DNA, 555 bp, Homo sapiens
tgggggtgcccaacacgaagtgcatgtgggtgccacagcccatctggtcctcagagcgaggccggcgccgggatgtgtgcagtcgtctgcgtgaaaaaggcaagacacaagcaggggcttctggaaactgtgacacccctgcccgggcctgtgggcggccctgcacggatgctgttagtgtgaagtttgagtgtgagtcctggggaccacctcaccaggccagcatccgggtggcgggggctgcggccctgcgaggcatcgtccgagtggacagagggaagcagcactccctgcgtggtccctctaggctggaggacgccaaggtgacaaccacatcaggggagacagctacagcagtgggagctgcaaagagaggggctggtgaccgccgggtgccctgagccccagcaccccaggctggtctgctctcgggcaccccagcctcactctgcagcacctcatgcagccagcctcattctgcagcaccttcatccccagcctcactctgcagcaccttcatgcagagatgcccagtgcccagtggacttggccacc

SEQ ID NO: 474358 - DNA, 798 bp, Homo sapiens
gagaatggattagggagcgaggagggcgtaactatgaagggtgatgtcagggagacgttcgtggcgacggaagggcttccctgcatcctgatggtctggttgcttaagactcataaccgtacatacatgaaaaaagcagcagcttgtgaccatggagggaaaaagtgctgggaaaagccctcatctgtggccaggggaggcacggggatggaatggatggcactgaagggtggacaggatgcctggtactgtagtatggacgggatggatggcactggggtgtgtatgggatggatggaactggggtgtggacgggatggattgcactggggtgtggatgggatggatggaactggagtgtggacgagatggatggaactggagtgtggacgagaaggatggaactggaatgtggacgaagggatggaactggagtgtgggcgggatggattgcactggggtgtggacggaatggacagaactggattgtggaagggatggattgcactggagtgtggacggaatggatggaactggagtgcagatgggatggatggaactggaatgtggacgaatggatggaactggagtgtggacaggatggattgcactggggtgtggatgggatggatggaactggggtgtggacgggatggatggaactggagtgtggacagcatggatggcactggagccttaccctggatgatgaggaacctgagcagatacagagggtgaacggatattgaaggtgggggatacactcattgagcagggctcttgctaaacctggatttc

SEQ ID NO: 474359 - DNA, 667 bp, Homo sapiens
cccagctctggtgtgtgacgtcagctgtccctcagcagccatgaagatatccttcaagttcaacaagaacttgtcatcccccagtgaaagcgtgcaggaggtgtggatgcccacactccatggactcccatgtgtaaggtcacaggcgggactatggctgcagggccccctgctcatcacccagatgtctccaaaccagttctctgtggctcctcagatggggccttggagtccagctttgtccagaggcccagcaagcccgaccctcagccctgcaaggcaccaggagtcctggaaagccactcatccccaaatcatggcagccacagccatgagagccgtgggtttccctggtcttgaagagacaatgcccctccaggctctggctcacaagccacagtcagaggaggagcccatggatttcacgacatccggctccccgggcctcatgtccaccaccaccgacactgaatggcagatggcgtccatggaagctcagccacaggacccaactggcgacagctggactctggtgtgagggcttgcccagctgtcattcatgtcgggactggcattccattccaggcctggggagctgcatagtgtttctattcttgactctcacggatgacaggagttaggatactgtggccctcccctccattgg

SEQ ID NO: 474360 - DNA, 1844 bp, Homo sapiens
tgagcagcgaaaatagcagtattttttaagaaggaagagagggattcctgttcatctcgggagctgtccaaggccagggtgctgaagaggtgaatgtaatgggccagggctgccttctgcctagagccccttcctggaatcctgccctggcttccccgaggtggagcattgctgcaccactttggccacccctcactctcattggacacccccaccctgccatcctccttccaaggtgtcttgccaggataggggacctataccagaacctggacaagagggtcctatggtccttgctcccgtggccctggggtctcactcacacatccatcctcctcactcaaagatgctgctctcttaactcctcctactgcatgccaggtgctgcctggctgttgaacaaagcaacgaacaggagggatgaggagtggaattgctggtcacattttaatgctatgtttaacattttgaagacttgcaggattgttttccaaagtggcttcacccttttacacctcaccaacagtgtccgagggttcccatttctctacatcctcaccaagaggtattaacatcagtgtttattatgtcagccatcctcatggaaatgatgcacttgcttattctggccttaatttgcatttctctggtggcaaaagatgttgagcatcgtctcgtgtcattggacatttgcacatcttctgtgaagaagtttctattcgaatcacttgcccatttttaatttgtgttgtcttttttattcttgagttgcaagggtccttttaatattctagacagaagttcactaccagatatgtaacttttcaaaacttatctgccaatctctggctcacctttttaattcatggaatggcaataaaatgccatttagtgcttcaaaagacactttctcgatggtgttttctggagcacaaaggtttgaagtttgaagatgtcaaattcatctactctttttttgttattgcttatgattttggtgtgtcacatctcagaaatgactacctaatcaaggtcgtaacaacttacggctgtttcttctgagagttttatcatgttgtctctacatttaactatttgttccattttgagttaactttgtgtatcatgtgaggtgggggttcagatgaattcttttgtaccatttgtggaaaagactctgatttcccacattgaattgtcttggcatcagcatcaaaattcaattgaccgtgaacgtctgggtttatttcaacatttccaattttatctcgctgatctgggtgtttctccttatgtctgcgccacattgtcttgaatactgtagctttggcacaagtttcgaagtggggaactgtgagccccctaattttgctcttctttttcaagattatcttggctattttagatcccttgatttttccacttaaagtttaggatcagtttatgaatttctgcaaagaagtcagcttggcttttgttaggtatcacattcaatctatacctcagtgtggggattattgccatctaaccaattttaagttttaattcttatccataaatataggaaagctttacattcatttagatcgttttgaatttttaagcaatattttgtagttttcagagtatcagtttatacatcttttgttaaatttattcctaaatatgctattctttttgacggtattgcaaatgaaattgtttttctaaatttcagttttggattctttattataagagtatagaaatacagttatttttcataatgagtgtgtttcccaaaacttgctgaatttgttacttctaatagttattttgtggattgtttaggaatttttgtatat

SEQ ID NO: 474361 - DNA, 1915 bp, Homo sapiens
ttcttcattgacgttctgctttctttcagctgatcattgggccatagcgtcgtgtactggagacaaccactccgtgttgatggagaagtcgcccaggtcttgcctggtggtgtcccatgttccctgtgctcaggcctcaaggatattcgtcctcatggtctcctgtcagcttaacgttatgccttgtgcattcaggcctgaatccacctgggatccatgttaacgtgttggatcagttggcttttacacccatcccccagccccagctgaagtgtgtgcatcagatccctgggaaagcctggctggactgggctcagagcggcactgagccggggggactgcagacggggctggcgccctgcacacattatatccacccatccagggtcttccttcaggtcccaggatatatatgtgctgctgccgtctcgggaccacccccatcctgcctggcatcacccctgtgtgcctgtgcccatggcctgagccgagaccgggattcacagcctgacttcctggagtccacgtccctcctggatttcctggagggccaggtgttggcccttgtagcctgtatgctgcctggcccaggatcttctgaagctggggagcagttggagtacaagctgaacccagagtgttcaggaaaccgaggggaattccaagcagccgtgaccctccagcccaggctcctctgtgtgagcaggacctttcacacaagctgtgtccttggctgccacctgcgctgggaaccccggaaacctgggagcgtgtaccgctgccccttccatggggccctgagctgccgcagggttcgagttaaacagccacaatccatcactgtttatgagattgaatagtctcaattgtcccaccttcaagtttgtaaggtctttctcctgcctattccaacccactgttgagttcctctagtgaattttcacttgaggcattgtatttttcaactccagaaatttatttttttatagcttctatgtctttactgatattgcctcactggtgagacatggttctcatacttttctttagtttttagacatggtttccttttgttaaatcaccatatttaaaattaggtgattttaagtctttgtcctctaagtccaatgcctgggctttctcagggatagttttaactgactgcttctcttatatgtataaaaccataactttctgttgctttatatgccaccgatattttgttgaaaactggacattttaaatactatgatgtggcatctctggaaatcagattcctaccctcagattccaaatcagattccaaaccggggtttgttgctcttgctttttgtttttgcttttgttgtcatcgttgtttggtgactcttgttaactagttctgtaaagtatgtcttctctgtcatgtttggccactaacatctctgcttgattagctctgtggccagccagtgattggatggagacgtcttaaacacctgcaatctgtccgtcccccagactgtttggaagggatattctgtgtgcatgaggggtgtgcccgccacactcagcaagtgtacaattctgcatagctttacttcctgtgtgtgcataagctcaaagtcatctagggtggaagctcaggaacaacttctcagatctttcctgagcattcacatagctctatgcacacaggtagctttctagattcccaagaatatgtcagagattttccgaactgcagaggatatctcattccccagattttcctttgaaatattttgtgagcctaatgtttgtgtcaactctcatccaccacctcaggtaggtgcaaagttcaacaatttcctccagtaattttcaacaaacacctccagggagaaggctttttgtattgtgcgagttctgagtcaggtcaaataaaaacaccctc

SEQ ID NO: 474362 - DNA, 569 bp, Homo sapiens
caccaacatgaacagctgtgctgatggctatccccactctgcagggcattggccatcacagcaaccatggccttttctgccacttccctggtagaggtattgccaaaggcagcttctgtgtcagacttctggaatgggggatacctggaaagaaaatccactgtgttacagcaccaggaggagcagaaatccagtttaatcatcatgtcatggagactgaatatgaaacttgatgaaaatcagtcctggggagtggtggtctcctctaatacagagaggggaaaacactccaggggaaaaagcctgctccagctgagaaaagccagcgtggtagagacgtgccttctcatgaggaaactcataccagaagaagcccagtgcagagcacctagacacagaggaacccagactgacaagcagatggttagagacaaacctggaggaaacagctggatcaaggagatgctggcccctgggggctcgtgagtttgtggtaaatccagagtcaatgcaagaggttccaccccatgtcctgtcctccccatcaggcctgttctacagaaggaggg

SEQ ID NO: 474363 - DNA, 577 bp, Homo sapiens
acctgttcttggatgtgttcaggcctgacccagggagctagccccactgttccacccttgctcatatcctgggcttctttctggttctttggaacctggactttagcgtctctacctgtttccaccctgcagccgcagtcccagccctgctccctgcctctcgcctctctctgccttcatcgaagtcccatggattggttctgcttcctgtgtgcttcccccagcgtaggcaagggtgtcctgccacaaagggagctgggaaccaagtggacatggagaaggacctcgttcacagaggccactttcctgtccccagaaggagcccaacacaggcattctgggtcttatatcttgggggttggatccaaggactttacggataggacaccactgagtaaccaagcgaggatgctcaggtggtcccatgccatcaccctcacaccatatttgtatttttaaacttttatgttagggttaaaaaacatttatgtaccatcattagagtgctacattattctgtgtttgtatgtatagttactttgaccagtgagatttatgcttttatatgtgttcacat

SEQ ID NO: 474364 - DNA, 983 bp, Homo sapiens
acaccagcgtttcctggaattgttcttagccttgagtgacaatgtcagcagtgctggaaaagtgggctgagcaggcaaaggggacaggagagggagactcagggtcagcagatgcctccagggtgcagagagggccctgtgagctcctccattataccgatgcctccagggttcagagagggccctgtgaactcctccattatactgatgcctccagggtacagagagcgccctgcaagctcctccattataccaatgcctccagggtgcagagagcgccctgtgagatcctccattatatcaatgcctccagggtacagagaaggccctgcgagctcctccattataccgatgcctccagggtgcagagagggccctgtgagatcctctatgataccaatgcctccagggtacagagagggctctgtgagatcctccattacaccaatgcctccagggtgcagagagagccctgtgagatcctccattataccggatgcagacaggttccctgtgagctcctctatgataccaatgcctccagggtgcagagagggctctgtgagatcctccattacaccaatgcctccaggatgcagagaaggccctggagcttctccattatactgatgcctccagggcccagagagggccctgcaatttcctccataataccaatgcctccaggagtgtcgctcagcatgtggtctggagaggactcgaggggacgcattgctgaaaccctttatcattcctgacagccacccctccctgcgttgctgcttgtagcccctggtcttgttcaacttgtccacccccctcaccttcatcagctcatccccagctccagccccacccacctctcttgaactggaggcctgggctcctcctccctctgccagccaggccccaccagccacccccgcctgtgggcccccacccagagctgcattctcaactctctgaccacggctcccagaaac

SEQ ID NO: 474365 - DNA, 515 bp, Homo sapiens
gtctttatgctctgctgaggatgtggcagatgctgcaccagatacatcgctggtgggtctgcgccggcttcacagccagcgccatcggccgagtttttctcttgctggtgtctctctgcttccacgggaaacaggccaaagaggcagcaataacgtggccaggagggtccgagtgccaggaaggggagggaggagagggtctgatgacgtggccaggagggtccgagagccaggaaggggagggaggagagggtcggaacagagcattgtccccaaaccatccctttgaggaacaggttgtggaaagcaccaaggtgcgtgtggactctgctccccccaaaaccttcaggctttggcacttgagtcctgcccacgactcacaggtccccgttcacgggctgaggcctcttcgggaagctcctctgcagcaggcttcagacgtgcccctttcttgagcagggctatcctcagacctggatgagaagctgagagcactgacacagctgcctctgccc

SEQ ID NO: 474366 - DNA, 1635 bp, Homo sapiens
ggctcttgggttgggtccttcttccctgcgcactccgaggtcctccctgcagccttccagtcagcaggacctggctggggggacagcatcaggggcactggctgagggaggtgaatgagcctctccctggaatgaccagccattgggtggccctgctggaggccgcccccgcctatgaccagacagcctctgctctggagggctcctgtcctgagtgccgactgccaggccgtcctcgggctggaaagggcagagctgtggggagggtgcagaagagccagacccagcccaaggagggaggcccagagtgcctcagtgatgaccacgtgggcatagccaggaggaacacccagggcggcggaagctggcaagtgggctctggagacggcagttttatctgcaggcagagggagcgaccaggtgcccgaagcccctccaccccgggactgcagcgtcctgggaccctcaagacaggatcccacgaggagggttaccagctccccggccgaggcgttctctttccctacggcctgcctttttcataagatcaatgccgtggaatcctacggtgggaggtcttttgtccatttcctcaatataaaactaacaggcaaaaagttactcttaatatcctctttgtgccctgttaatatctattgacctttaatgaatattcctattttattgctaacagtcataacttgtgttttctttctggttttttaaaatattattcctaggaaatgaattattagctaatacttccaaagaacgaacctgtcaaaggtaaatctgctttctatttcattgatttttggtcttatctttattttccttcttcagtttttgggggttttatatactgttcttttcatagttccttgaattgaaagtttacatcattgattttcaaattttgttctttttaacataggcatttaaagctataatctccctctaagttttgctttggctgtttcccacaagtttagatctgttctatatatgtcacatattatatgttatatacatatatatatatatatatatatatatatatatatatatatatacacacatacacatctagttcttattttattcagtttaaatattttctaattttgctatgatttcttcttcaattcatgggaaatctaaaatgtgtttcacaatttctaaatatttggggcttttttcataatctttttgtaactgacttccagtttaattacattatgataagaatatataatgtgcatgattccaataatttgaaatgtattaagccttgttttttggcctagcatatggtctattttcataaatcttgcactaaaacttaaaaacttggaaagcatgtgtgttctgtaggttttagatgtggttgcagtgatcaagtatttttattattttatatcctttatattatcagttatgcatgttagtgttattttcttcctgaacgcatgaaggtttaaatgtgtatccttaatttacagtttatcttacttatccttacagtttatcttacttatccttacagtttatcttaaattaattttttatcacttattaaagaatgcaagaatctatcattatttaagtatatttacttctcatctgtcctttggc

SEQ ID NO: 474367 - DNA, 3246 bp, Homo sapiens
gccttgtaagggatccgatgagctccactcctgcatctgcacacctcccctcagtatgcaaatatccctgcaagcaacacacacaggatgcacctgaccttctccactcagtatgcaaagatccctgcaagcgacatgcacaggatgcacctgaccttctccattcggtatgcaaagatccctgcaagcgacatgcacaggatgcacctgaccttctccattcggtatgcaaagatccctgcaagcaacacacacaggatgcacctgaccttctccactcagtatgcaaagattcttgcaagcaacacgcacaggatgcacctggcctttgcctcctcagagagccttggcgtgtcttccccatccctggaaagctccctgcacctggtgaaatctgagtcacctttgacacccccaccttcaacctcactttatccaacctggagtcagagcaagatctgcagccacttcaggaagcccaatcatctggacacttggggagtggatggtgatgatctgcaaggtgttgactcgccaggcaggctgagggcagtcctcagtcaacaccaaatgcagcaggctccaaggtctgagcttggttatggttctgctctgtaattaaaagatcatgtgtcctacttagcacacaaaattctataaaaattgcatgaaacagagccactcagtctagaaagcagctgatatttactcaggattcctctgaccactccattccaggaagcagtggggctctggactggcactctccttgtacctcacatgtaattaaatacatccctgaaagcccctgctgtactggtcgccttccgtaaatgcctgcgagtgaaattgctaagtcacgagacagaggtggacccgtgatcacctcgctagtgtaattcatcacgtctaagagattttctatgtgcacagtcatactgactcacatctaagagactttctgtgtgcacagtcatactgactcacgtctaagagattttctatgtccagtcatactgactcatatctaagagattttctgtgtgcacagtcatactgactcacgtctaagagattttttctatgtacacagtcatactgactcatgtctaagagattttctatgtccagtcatactgactcatatctaagagattttctatgtgcacagtcatactgactcacgtctaagagattttctatgtccagtcatactgactcatatctgagattttctgtgtgcacagtcatactgactcacgtctaagagattttctgtgtgcacagtcatactgactcacgtctaagagattttctgtgtgcacagtcatactgactcacatctaagagattttttctatgtgcagagtcatactaactcacgtctaagagattttctatgtgcacagtcatactgactcatgtctaagagattttctgtgtgcacagtcatactgactcacgtctaagagattttctgtgtgcacagtcatactgactcacgtctaagagattttctgtgtgcacagtcatactgactcacatctaagagattttttctatgtgcacagtcatactgactcacatctaagatattttttctctgtgtacagtcatactgactcacgtctaagagattttttctatgtgcacagtcatactgactcacatctaagagattttctatgtgcagtcatactgactcacgtctaagagattttctgtgtgcacagtcatactgactcacgtctaagagattttttctatgtgcacagtcatactgacttacgtctaagagattttttctgtgtgcacagtcatactgactcacgtctaagagattttttctatgtacacagtcatactgactcatgtctaagagattttctgtgtgcacagtcatactgattcacatctaagagattttctgtgtgcacagtcatactgattcacgtctaagagattttctgtgtgcacagtcatactgattcacgtctaagagattttctgtgtgcacagtcatactgattcatgtctaagagattttctgtgtgcagagtcatattgactcacgtctaagagattttctgtgtgcacagtcatactgactcacatctaagagattttttctatgtgcacagtcatactgacttacgtctaagagatttttttctgtgtgcacagtcatactgactcacgtctaagagattttttctatgtgcagagtcatactgactcacgtctaagagattttctatgtccagtcatactgactcatatctaagagattttctgtgtgcacagtcatactgactcacgtctaagagatttttttctatgtgcacagtcatactgactcacgtctaagagattttctgtgtccagtcatactgactcacgtctaagagattttctgtgtgcacagtcatactgactcacgtctaagagattttctgtgtgcacagtcatactgactcacatctaagagattttctgtgtgcacagtcatactgactcacgtctaagagattttctgtgtgcacagtcatactgactcacgtctaagagattttctgtgtgcacagtcatactgactcatatctaagagattttctgtgtgcacagtcatactgactcacgtctaagagatttttttctatgtgcacagtcatactgactcacgtctaagagattttctgtgtccagtcatactgactcacgtctaagagattttctgtgtgcacagtcatactgactcacgtctaagagattttctgtgtgcacagtcatactgactcacatctaagagattttctgtgtgcacagtcatactgactcacgtctaagagattttctgtgtgcacagtcatactgactcacgtctaagagattttctgtgtgcacagtcatactgactcatatctaagagattttctgtgtgcacagtcatactgactcacgtctaagagatttttttctatgtgcacagtcatactgactcacgtctaagagattttctgtgtgcacagtcatactgactcatatctaagagattttctgtgtgcacagtcatactgactcacgtctaagagattttctgtgtccagtcatactgactcacgtctaagagattttctgtgtgcacagtcatactgactcacgtctaagagattttctgtgtgcacagtcatactgactcacgtctaagagattttctatgtgcagagtcatactgactctgcagct

SEQ ID NO: 474368 - DNA, 877 bp, Homo sapiens
ggcagctgtttgtagctcaggatgatacacagctgtgaagacgctatactcgatccacctttcctaccactgctgcccatttcagtgggaacatttttaggtttagctgttaggcatgttgcatctattggcaccgggcaccgtctgctctcacacgctggcctctctggggagtgcgacacggttttcactcccatgaccgtgaagactagtggggctgaagatctcttctgtgctcggtgcacatcagacaccctttctgtgaagtgcctatttcagatttcacagttttcagtcgacccgtctttctttgtctcactggtttgtatgtctcttctgtgtgttggctgcaatcttttggatgaacaagtacttttcattattctgttttcctccacttcaaccgttggttataaatggcatagggaggaccgattcagcagaggctttgtccctggcaggtgccacgggtcggagacagcacggaaggagagacaagccttacagagacaacgtccagcgccggacaggacgtgggaggaaggagcgcagacgcggtgctggtgggagaaggagacggtactagcacggtggaaaacctgtggaagttacccagcgacgttgacatacgtgctctacgattccgcccaatcatggggagcacagcccacagaaaggcctgcacactccctgaaagatgctcacagggatgtcacggctctgctcttcctcacgacggaaaagggaaacggccgcaatacccgtctatggtaaaaaagatcgataacttggaaacgggtaagtattcaggatgaaatgttatctggcaacccaaatgaaccctctgcaactactctcaacaatgcagatgaacctc

SEQ ID NO: 474369 - DNA, 805 bp, Homo sapiens
gaatgccctgtttctcctccaaggcccctgcccttcggaggccggggtgccaggaatcgcacatgtgttctctgcactggatgtggcactccacccctgctcctccgtgtgctggggtgggtgggagttctctgcacctgggcatgacgctcccaccttactccgtgtgctgcggcagtgagaggtggaaggagccccggcttctcctggccagcattcttgctgtggcctcagcagttcccatatcagcctctggctttgggcgtgtccagggccagggctcggcccaccatgtcctggctggtctgggtcttccctggcgcagtgaggggatggagcttgcagctgtggtcagtagcctcgcctcagagcctctgctccccgaaccagtgaaggcaacgtggcttctgcagccagcaaattcacaaggggcttccagtgtgccacgcttcctgactggtgggccactctggattgttctggaaatcactggcagagggcttggagccccctcttccagcccctgtgcttttgtcatccttggacactctgttttacgttctgtccccatggaaataacaagtggtttctgttgcctgtggctgaatcctggctgatacagtcacgggtggaactacgggctccagagtttaatgtcctcggttgtggggcggtttcacaagacagaacagcctctgcttttctgcagcttagcagaagctcagcagaaagcctgcttttgccagcaggcagaggggcctacagtttcaaagctgtattctgttatttcgtgattaactcatgc

SEQ ID NO: 474370 - DNA, 646 bp, Homo sapiens
gaatgggggaatcagggcactgagaaccagaacctagtctatgaggtctgatttgtgataagaatggtgtccaattcgggggaagggaccggttcccctccctctcccgcgtggcaggtttgcaggcgagcacgtgcacacatttccctctggtgtcctgggcgcctttcctcggcgtcacctgcatttcctcttcgtccaccttctcttttgaatctcagccggagacacatagaactgagaggcccatggaagctgctcggtttatgttctgtttgctactaccttgaaacatttcacaaccggcttctcctgaataagcaggaggacttggccatcttccacccacattctcacagggacacagggctgaagctgagctgcagccgctcctctggacaggggcacgcagaggaaaacgtctttcaagtaccaagcacatcttacaaataaacctagggcatgactcatgtggtttataggtggaattacacagatgatcgggaagttgccttagaaacaaaatgttaaaaacaatgaaaaataaaatagaaacactatgttgcatttggagtttggagatttgcatatttatgaagttctgcaatttgaaaaaatatttctcttctttcctgggtgtctattc

SEQ ID NO: 474371 - DNA, 996 bp, Homo sapiens
gtgggtgctgtggggacggactaaatcaccatcaccataataatcaccaccatcatcatcaccatcaccttaatcaccatcaccatcatcatcaccatcatcactctcattatcactaccatcaccattatcattattccctcattatcatcaacaccatcaccattgttatcaccatcatcatcactatcatcactaccatcactatcactatcactatcaccatgatcactatcatcatcaccatcatcacccatcatcactattatcaccatcactatcaccaaaaccatgatcatcaccaccatcatgaccatcaccaccatcatcttcaccattaccaccatcatcatcaccatcatcactctcattatcactaccatcaccattattatccccatcaccatcatcaccaccatcgccagtgttatcaccatcatcatcatcactatcatcactagtatcatcactctcaccatcatcactatcatcatcaccaccatcactatcatcaccatcactatcaccatcaccatgattatcaccatcactatcaccataaccacaatgaaccaccatcaccatgaccatcaccataatcatatcaccatcatcatcaccattatcaccatcaccatcatcaccatcattatcactatcatcaccattatcatcatcaccttcattatcatcatcactgttatcatcactaccatcacgatcaccattatcattatccccatcatcatcaccaccatcaccattgttatcatcatcactatcactataattatcactatcaccatcatcatcatcaccatcaccatgactatcatcactgtcatgatcatcaccatcatctatcatcactatcatcagataatgaattatcttttactgtctgtggacaattatcataggacaagatttctctatcttggcactattgacatctgaggtctggataattctttgttgtgggaagttgccctgtgc

SEQ ID NO: 474372 - DNA, 904 bp, Homo sapiens
ccacagcagacaacagcagcctatgtcacgcatccttgggctgcagagacttcaattatggggacagtgtcagccaccttatgtggctgcacacatcggccacagcagaggcatcatatttgtaacacatctacaggcagagatccacgtggctgttctgaagagcagaacatcctgaatggtgaagcaaaggcctgagaaaactctccacaaaagcaatgagaacattgacaaaatatgcccaagccagctttttcagaacattggaggctcaccaaaggcttgcagctgttcagggagtattcaggaaaaacagctgaatcttgagaactgtcacagcgtgacatgtccagcagctctgtgggagggccttgctggcagggcctgtcctgactccatctgctcagagctcgttgtccccagggcctgtgctgacgatgggatgaggccacactgggaactgctgggcattggcggcgtgcccattcacaaccacacatcgatagggcctagtatccagaatatgtcaagagccctcatagaccctgtcatgtatgtggaatctacatccaggaagctgttttgcaaatatgattcctctgctgtggccgatgtgtgcagccacatggggtggctgacactgtccccataattgaaaagctctcttcacccgatcattggcagccctgggtgactgcatgcccgtgtgggaagctgccctgtaaacccttctgtgaggaggagctgtgcaggcctacaccacacgcaccagggtgggctccccagtcctcacaaggctgggtctgtgggtgccccatgcatgcccactctccttcagggctttccccgcatcgcagtggagggacggcaatcctggttatcatggagtgattcataataaaaa

SEQ ID NO: 474373 - DNA, 655 bp, Homo sapiens
atatctacacattattacattatgaccaagtggggtttctctcaggaaaacgaggctcccaggacgtgtcgggtggggtacatgttcctgcaggcaggtctcccccaaagctgctccgtggggtacatgttcctgcaggcaggtctcccccaaagctgctccgtgaggtacatgttcctgcaggcaggtctcccccaaagctgctccgtggggtacatgttcctgcaggcaggtctcccccaaagctgctccgtggggtacatgttcctgcaggcaggtctcccccaaagctgctccgtggggtacatgttcctgcaggcaggtctcccccaaagctgctccgtggggtacatgttcctgcaggcaggtctcccccaaagctgctccgtggagcccttgcagggcttggtaccaaacgcagttgtcgaaactgagagcctgcaccccgtgaggtgatactgcagcctctgccagcagggggagtcactctccctaccccttgggactgggggcctgtggccactttggccaacagcaaagaggaaggacagggtgcacattggaggtctcatccctctgcttctctctgccttgtgtatggggataaccagctgggggtgcaagtccgtgtgaaccacagcaaaggccagaagaa

SEQ ID NO: 474374 - DNA, 659 bp, Homo sapiens
gtggagagggagagaccgcggtttcgccctggaacggggccggcggtcggcaggtgcagggcacggactcccgtcatttctgacggtctcaactcccgcttctccttctccaaaatgccctgcatgtttttctgttctggagttcctctggaaaatgctggttctgtttatgtccaagtctcctttttcctggtcaccggggtcccgaggttgcggcgcctgacgacatgcgtgttgcagaagctgctctgtggggacagtgaccaacggcgttgccacagtgacccggccatgatgcttcaggacaggacgcacggggcaaacgcctgggcaccggggacggggcagcgccctcaggcagggtgtccacggggtgccccagggctgccggaacaaagaccccagtgtcctcagcagccgctgcatcgctccggtctctgcatctgtctgcacaaggccatcttcccgggcacctgtttcctttctgtgtcccctccgcttcctatatggacacgagtcataggactgagggcctaccctgctcctgtgtgacctcatctaaacttaatcactcatatctgccaagaatctatgtccagctacagtcacagtctgaggttctggatgaacattttggaaactattcaacccactgcatt

SEQ ID NO: 474375 - DNA, 1073 bp, Homo sapiens
cctgtggcagttgggttaaaaagaatgaggaggaacttatgctcccccttctgagggatggctctgagagggactcagagtgtcttcctgtctacctggagatgagagccggtgaggacagccaggttctggggctcagcaaccggcctcccatggcgcccccacgggcgagccagtgtcctgagccccagcagtgccccagtgactcccgcctggtggcctgtccccacctgggtgggggcctgccagggctccctcgggcaccacccatggagcagctccggcatccggcctgtgacccccgaagctcggccttcctcgagctttccgtcgggccccggggctggagactgcggccggctgcccccacgttgctcacagccctgcacggagagccccttgcatacctgggagatgcccagccctcaggcccaggggtgcgcacggcagcgctcactgagaagtggatcccggaagaggcctgcaagggtccttggggtgttggggtccagcccctggcaacactgattggctttgagtgtgtggagctgcccgttctggacatttcctgtgagtggaatcataccgtaccggtcctcttgtacctgacttcccacacctggtgcaatggtttacagcgcgttggctgtatcaggtgtcagagcttcacgtctccccgtggctgaacgacactgcgttgcatggggcttccacagtttgcttgtccattcatcagcattgcttatgcccgtatagagggggatatgatagtctgtgtagcatatgcacacgaactgccaaaatatagtgtgaaggttggcctgacaaatgacactgcagtgtattgtcctggcctgctgctggcccgcaggcttctcaataggtttggcctggacaagatctaagaaggccaagtggaggtgactggcgatgaatacagtgtggagagcatagatggtcagctgggtgcctttgtctactctttggatgcagagcttgccagaactgccgctggcaataaagtttttggtgccctaaagggagctgtggatggaggctggtctgtccctcac

SEQ ID NO: 474376 - DNA, 621 bp, Homo sapiens
aaagtttgtttacaccagcatcgctgcaaacaaaaagatagtgcagcaggatgcagcggaacccccctgacttgctgacaagcgcagaccagtctagaagtggccctgtacatgtttctgcggaaccctgacactgaagctgttctggttgccatgtcctgtttccgccacctctgtgaggaagcagatacccggtgtggggtggacgaagtgtcgaggcgaatgtcccatgtgagtggaggaggacccatagatttgtctgacacagactccctacaggcatggatcaacatgactagcttcctttgtgcccttgggggagtgtgcctccagcagagaaggaattctggcctggcaacctatagcccacccatgggtccggtcagtgaacataagggttccatgatttcagtgatgtcctcagagggaaacgcagatacacctgtcagcaaatatatggatcagctgttgtcgttaatggtgtgtaagcttgagaaagtgggacttcaaatacggaccaatggtaaggacctggtgggtctagaattgagtcctgctctttatctgatgctatttaacaaattgaagagacgcatcagcaagttttttgactcctaagga

SEQ ID NO: 474377 - DNA, 543 bp, Homo sapiens
tctaaatctttttaaagccttcaaggagattatgatgcctacggacttctccaagctctgtctgggttctgctgtcaatggtgttgtccacttttggactcttggacctacaccaggggtttgccaggggctctcaggcctttggcctcagactgaaggctgcccgtataatgggttcatatttgattggctgcacttagctataaatcctgaggaggaggaagaggaggaagaggaggaggaggaggaggaagaggggaaggggaagaggaagaagatgaagaaagaagaaggagaaggaggacaagggggagaaacgacatcagaaagtaattgggctagaagaactttaatttggaagcaaaacacagaatccagcttgggtgtgatctcgtcaataacagcgtcgtctaaccacgtaaaaagtagtcagagtgaaaagaattctagcagcatatgttagacaatagaccaaaaggaaaatgtgacacgcaaatagtcaaacaaaacttccaccttttagccttggttctggaatttagt

SEQ ID NO: 474378 - DNA, 9075 bp, Homo sapiens
ctttaggaaaagatactcggaaacaattgaaagtgggagaaaggctatttatttgtaataatgctggaactgcaggcatgaaacagacggtcctggacataccctactcaaaaggctccaaactaactcagcagccgtgttctggaatccgatgtgagggacaaacactcagaaatcagcagcagcgttctggaatactagaaaatagcagcagtgttatggaatcctctgtgcgggacaaacactcagaacccagcagcagtgttctagaatcctttgtgatagacaaacattcagagactcgtagcagtgttgtggaatcgtatgtgagggacagacagaatgtggcagcagtgttctccaatcccattagcagtgatctggaatcgtatatgaaggacaaacactctgaaaccagcagcacagttttggaatcccacgtgagggaaaaacattcacaatccagcagcagtgttctggaatcctatgtgagggacaaacactcagaacccatcagcagtgttctagaatcctttctgaggcacaaacattcagaaattagtagcagtgttgtggaatcgtacgtgagggacaaacactctgaacccagcagcagtgttttggaatcccatgtgaggaacaaacactcagaagccagaagcagtgttctggaatcctatgtgagtgacaaacactcagaacccagcagcagtgttctagaatcctttgtgaggcacaaacattcagaaactagtagcagtgttctggaatcgtatgtgagggacaaacactctgaacccagcagcagtgttttggaatcccatgtaaggaacaaacactctgaacccagcagcagtgttttggaatcccatgtgagggacaaacactcagaagccagaagcagtgttgcggaatcctatgtgagtgacaaacactcaaaatccaaaagcagtgttctagaatcctttgtgagggacaaaccttcagaccctcaaagcactgttctggaatactatgtgagggaaaaacactcagaaaccagcgggaaacccagcagcagtgttttggaataccatgtgaggtacaaacacgcagaacccagcagcagggttcgcgaatcctttgtgagggacaaaccttctgaccctcaaagaagtgatctggaatcgcatatgagggccaaacacttcgaacccagtcgcagggttctgcaatgcattgtgatggagaaacattcagaccaatcctttgtgagggacaaagactcagaacccatcagcagtgttctggaatcctgtgtgcgggacaaacactcagaacccagccactgtgttctggaatcccatctgagggacaagcattcagacactcgtagaagtgttctcgaatactacgtgagggacaaacatacagaacacagtagcagtcttctggaatcccatgtgagggacaaacacgcagaacccagcagcagggttctcaaatcctatgtgagtgaaaaacaatcagaacccagaagcagttttctagaatcctttgagagggacaaaccttctgaccctcgaagaagtgatctggaatctgagggacaaaacctcagaacccagcagcagtgttctggaatcccacgtgagagaaaaacactcacaacccagcaacagtgttctggaagcctatatgagggacaaatactcaaactcaccaaaagtgttctcgaatactatgtcatggaaaagcactcagaatccagcaacagtgttctggaatcccttgtgatgggcagacattcagaccctcgtagcagagttctggattcctatgagcagtgttgtggagtcctatgtgaggacaaacattcagaacccagtggcagtgatctggaaatctatgtgagggacaaacactcagaaaccagccactgtgttctggtttcctatatgagggacaaacattcagacactcgtagaggtgttctggaatcctatgtgagggacaaagactcagaaaccaatagctgtgctctggaaacctttgtgagggacaaacacacagacctcagcagcagtattctggaatcctttgtgagggaaaaacattgcgaccctcctagcagtgttctggaatcctacgtgagggacaaaaactcaggacccagcagcagtgttccggactcctatgtgagggataaacactcagaaaccagcagcagtgctcaggaatcctttgtgaggaacaaacatacagaactgagcagcagtgttttggaatcctacgtgagggacaaacattcagtacatcttaagagtattctgaaatcgtatgtgagggacaaacactcgcaacccagcaacagttttctggaatcctatgtgagtgacatacactcagaccccagcagctctgttctagaatcctatgtgaggaacaaacactcagaacccagcagtagtgttctagaatactttgtgagggacaaatgctcagaacccagcagcagtgttctagaatcctttgtgagggacaaacgctcagaacccagcagcagtgttctagaatcctttgtgagagacaaacacacagaagccatcagcagtgttctagaatcctttgtgagggacaaacactctgaacccagcagcagtgttttggaatctcatgtgagggacaaacactcagaacccagcagcagagttctggaatcttatgtgggtgaaaaacaatcagatcccaaacccaacagcagggttctggaatcctatgtgagggacaaacactcagaacccaggaatagtgttccggaatcctctgtgagggaaaaacattcagaacccagcagcagtgttctggaaacctatgtgagtgacaagaatttggaacacagcagtagtgttctagaatcctttggaaaaacactaagacccagcaacagtgttttggaatcctgtgtgagggacaaacactcagaaccctgcagcagtgttctggaaacccatgtgacggacaaacactcaggacccagcagcagtgttccagaatcctttgtgaggaacaaacacacagaaaccagcagcagtgttctggaaccctgggtaagggacaaacactcagaacgtaggagcagtgttctagaatccttcgtgagggaaaaactctcagaatccagcagcagtgtcctagaatactttttgagggacaaacactcagaagtccgcagcagtgttctggaatcctataagtgttgcggaatcgtatgtgagggacaacactcagaacccagcagcagtgttctggaaacctatgtgagtgacaagcatttggaacacagcagtagtgttctagaatccttttttgagggacaaacattcgtaccctcgaagcagtgttctggaatcctaagtgagggacacacactgagaaacgaggagcagtcttctggaatcccatgtgagggacaaacactcagaacccagcagaagcaggtttctggaatcctatgtgagggacaaacaccaagacccagcagcagtgttttggaatcctatgtgagggacaaacactcagaacccagcagcagtgccctggaatcctatgtgagtgacaaacactcagaacccagcagcagtgttctaaaatcctttgtgagggacaaacactcagaacccaacatcagcgttctggaatcctatgtgagggagaaacactcagaacccagcagcagtgttctagaatcctttgtgagggacaaacactcagaactcagcagcagtgttctagaatcctttgtgagggacaaacactcagaacccaacagcagtattctggaatcctatggacaacactcagaacccaacagcagtgttctagaatccttagtgagggacaaacattcagaacctcggagctttgttctggtatcccaagtgagggacaaacactcacatcccagtagcagtgttctggaatccttggtgatggacaaacattcagaacctcgaaggagtgttctggagtcctatgtgcgatacaaaccttcagacccccgtagcagtgttctcgaatgctatgtgacggacaaacaatcagaacccagcagtcgtgttctgtatgttatggaatcctatgtgagggaccaaccctcagaacccagcagcagtgtgctggattcctttctgaggcacaaacattcagagcctcgtagcagtgttctcgaatcctatatgagggacaaacaccccgaacccagcagcggtgttttggaatcctttgtgagagaaaaactttctgaccctcaaagcagtgttctggaatcctatgtgacagagaaacactcaaaacccagcagccgtgttctggtatcctacatgaggggcaagcattcagaccatcatagcagtgttctggaatcatatgtgagagacaaacattcagaccctcgtagctgtgttctgcaatcctatgagagggaaaaacattcagaacccagcagcagtgttctggagtcctttgtgacggacaagcattcagacccttgtagcagtgttctggaatcctatgtgagagacaaatattcaaaccttcatatcagtgttctggatttctatgtgagggtcatacactcagaacccagcagcagtgttctggaatcctatctgagggatgttctggaatcctatgagagggacaaacaatcagaacccagtagcagtattccggaatactttttgagggacaaacactcggaacccagcagcagtgttctggaatcctatgtgtgggacaaactctcatatcccagcagcagtgttccagattgctatcagtgttctggaataagatgtgaggctcactcagaacccagaaaaattgtcctagaatcctatgtgagtgacagaaactcagaacccagcagcagtgttctggaatcctttgtgagggacaaacattcagaaccacggagaagttttctggaatactatgtgagggtaaacaccaagaacccaggagcagacaaacactcagaacccagcagcagtgttctggaatcctatttgattggcaaagacacagaacccatcagcagtgttctggaaaaccagcagcagagttctggaatcctatgtgagggagaaatcctcagaatccaccagtgtgttttggaatccattgtgaaggacacacattcagaccctcctagaagtgttctggaatcctatggacaaacagaaaccaaccgaagtgttctagaatcctttgtgaaggacaaacatgcagaacctcgtagcagtgttctggaattctatgtgagggacaaacactcagtatccagccacagtgtactggaatcctatctgagagcaaacattccgaacctcgtcacagtgttctggaatcctatagaaaaacattcagaacctcgtagcagtgttctggaatcctatgtgagggaaaaacattcagaccctcgaagctgtgatctggaatcctatctcagggacaaacactcagaacccagcagcagtgttctggaatcctttaggagggaaaatattcacaccctcataacagtgttctggaatcctatggacaaacactcagaacccagcagcagtgttctggaatcctatgagagtgacaaacactcagaacccatcagcagtgttctagaatcctttgtgagggacaaacactcagaacccagcatcattgttctagaatcctttgtgagagtcaaacattcagaacctggtaacagtgttctggaatcctataacgctgcagcagtgttctggaatcctatgtgtgtgacaaactttcagaacatcgtagcagtgttgtggatttctatgtcatggacaaacactcagatggcagtgagggacaaacactcagaaaccaacagcagtgttctggaatcctatgtgatggacaaacacacagaatccagcagcagtgttctagaatcctttgtgagggacaaacactcagaactcagcagaagtgttctagaatactttgtgagggacaaacattcagaacctcgtaacactgttctggaatcctatgtgaggggcaaacactcaaaatccaaccactgtgtactggaatgctatctgaggctaaacattcagaacctcggagaagtgttctggaatcctaatgttctacaatgctttgtgagggaaaaacattcagactctcgtagcagtgttctggaatcctttttgaggaacaaacactcacaacctagcagcagtgttccggtatcctttggttgggaaaaacattcacaagctcataacagtgttctggaatcctatttgaggaacaaaaactcagaacccagcagcagtgctctggaatcctatatgggggacagacactcagaatccaacagcagtttggtggaatctcatgtgagagacaaactttcagaacttcatagcagtgttctggaattctatgtgaccgacaaacactcagaatccagcagcagtgttctggagtccaatgtgagggacaaacactcagaacccagcagcagtgttctagaatcctttaagcagtgttctggagtcatttggaaaggaaaaatttcacaccctcgtaaccatgttctggaatcacatgcgagggaaaaacattcagaccctcgtagtattgttctggaatccaatatgagggagaaacactcagaacccagcagcagtgttctggaagcctttgtgagggataaactctcagaccctcgtagcactgttctggaatcccatgtaagggacaaacactcagaacccagcagcagtgatctggaatcctatatgagggaaaaccactcagaacacagcagcagtgttctggaatcttatgtcagcgacaaactttcagaacttcgtagcagtattctggaattctatgtgagggacaaacactcagaagccagcagcaaacacagcagcagtgttctggaatcttatgtcagcgacaaactttcagaacttcgtagcagtattctggaattctatgtgagggacaaacactcagaagccagcagcagtgttctagaatactatgtgtgttataaacactcagaacccaccagcagtgttctggaatcctatatgagggacacaccctcagaacccagcagcagtattctagaatcctttgtgagggacaagcactcagaacccagcagcagcgttctggaatccttttgttctggaatcccatgtgagggacaagtgctcagaacccagcagcagtgttctggaatcctatgtgaggtacaacagtcagaacccagcagctgtgctctggaatcctatgtgagggacaaacactcaaaacccagcagcagggttctggtatcccatgtgcgggacaaacactcagaatccagcagtagtgttctggaatcctttgtgatagacaaacattcagactctcgtaggtgtgttctggactcgtatgtgagggacaaaccctcagaaaccagcagcagtgttctggaatcctatgtgagtgaaaaacaatcagaacccagcagcagtgttctagtttcctttatgaggaacaaaatttcagaccctcgaagaagtgttctggaatcatatgtgagggagaaacactcagatcccagcagcagtgttctacaatccttttgggttctggaatgctatctgagggacaaactttcagataatcgtagacgtgttctggaatcctatgtgtgggacaaaaactcagaacccaacagcagtgctcgggaatcctttgtgagagacaaacatacagaaccgagaagcaggcttttggaatcctatgtgagtgacaaactctcagaaaccagcaacagtgttctggaatgctatgtgacggacaaacactcagacccagcagctgtgttttggaatcctgtggacaaacctgcagaccctcgaagcagtgttctggaatcatatgtgagggacaatcactcagaacacagtggctgggttcgggaatccaatgttagggacaaatcctcaaaacccagcagtagtgttccggaatcctgtgtgagggacaaacattcagaacccagccactgtgttctggaatactacctgaggaacaaatttcagacactcgtagaagtgttttggaatcctataagtgttctgaaatcctatgtgagggacaaacactcagaacccagcagcagtgttctggaatcctttgtgatggacaaacattcagaccgtcctagaagtgttctgaaatcctatgtgagggacaaacactcagaacccagcagcagtgttctggaatcctttgtgatggacaaacattcagaccgtcctagaagtgttctggaatcatatgtgagggacaaactctcagaacccagcagcagtgttctggaatcctatgtgagggacaaacactcagaaaatggcagcagtgttttggaatcctgtgtgatcgagaaagattcagaaattcgtaacagtgttctggaatcccatgtgagggctaaacactcagaaccctgcagcagtgttctggaatcctatgtgagggaaaaacactcacaacccagcagcagtgttctcaaatccagtgttctggattcgtatgtgagggagaaacactccgaacccaacatcagtattttggaattccatgtgagtgacaaacactcagaacccagcatctctgttctggaatcctatgtcggggacaaacactcagaacccagcagcagtgttctggaaccctatatgagaattcgtagcagtgttctggaatcccatgtgagggacaaacactcagaacccagccgcagtgttctggaatcctatgtgagggacaaacaatcagaaaccagcagcagtgttctggaatcctatgtgagagacaaacattcagacactcatagaattgttctggaatcctacgtgattgaaaaacacgcagaagccagcagctgtgctctggaatcatttcagcggaaaaacaaacagaaccagccgcagtgttgtgcaatcatttgtgtgggaaaaacattcagacactcgtagcaatgttctggaa

SEQ ID NO: 474379 - DNA, 10878 bp, Homo sapiens
cccagcagcagcgttccggaatcctatgtgatggacaaacactctgaaccaaccagcagtgttctggaatcccatgtgagggacaaacactcagaacccagcagccgtggtctggaatcctatgtcagggacaaacactcagaacccagcagcagtgttttggaatcctgtgtgagcgacaaagattcagaacttagtagcagtgttctggaatctcaggtgcgggacaaacactcagaacccagtggcagtgttgtggaatcctatgttggggacaaacactcagaacccagcagaagtgttctggaatcttataggagggacaaacagtcagaacccagccgctgttttctggaatcctatcagagagacaaacattcaggcactcatataagtgttccggaatcctatgtgttggaaaaacacccagaaaccagcagctgtgttttggaatcctttgtgaggataaacaaacaaagccagcagcagtgttctggaatcgtttatccccgtagtagtgttctggaatcctatgtgagggacaaactctcaaaacccagcaacagtgttctggaatcctatgtgaggaataaaagcacagaacacagcagcagtgttcttcaatcctatgtgagtgacaaatattcaaaacttaatagcagtgttctggaatcttatgtaaaagacaagcactcaaagcacagccactgtgttctggaatcttatctgagggacaaacattcagacactcgtcgaagtgttctggaatcctatccgtgttctggatcctatgtgagtgacaaacactcagaacccaacagcagtgttctggaatcctatgtgagtgacaaacactcagaacccagcagcagtcttctggaataccatgtgagggacaaacactcagaaaccagcagcagttttccggaatcctatgtgagtgacaaacactcagaaggcagcagcagttgtctagaatcctttgaatcctttgtgagggagaaacatacagaatccagcagctgtgttttggaaacctatgtgagggaaaaacattcagtacctcctaggagtgttcgggaatcgtatgtgagggacagacagtcagaacccagcagcagagttctggaattctatatgagggacaaacactcagaatgcaacagcagtgttctggaatcctatgtgttggacaaatactcagaagacagcaccatttttctggaatcctatgtcagatacaaacactcagaacacagcagcattcttccggaatactatgtgggtgacaaacactcagaacccatcagtaggattctggaatcctatgtgagggacaacactcagaacccagcagcagtgttctggaattctaagacccagagcagtgttccagaatcctacgtgagggacacaccttcagaacccagcaacagtgttctgaaatcctatgtgagagacaagcattcagaacgtcgtagcagtatttgggaatcccatgtggagaacaaacactcagaacccagccactgtgttcaggaatcctttctgagggacaaacagtcagaaaccagcagcagtgctcaggaatcctttgtgaggtacaaacatacggaacccagcagcagtgttttggaatcctatgtgagggacaaacatacggaacctcctagcagtgttctggaatcctatgttgttctggaatcgtatgtgagtgacaaacactcagaacccagcagcagtgttctggaatcccatgtgagggacaaccacgcagatcccagcagcagttttctggaatcctatgtgagagtaaaacactcagaagccagcagcagtgctctagaatcttttgtgagggacaaacaaactggcagcagtgttctagaatcctctatgaggaacaaatattcggaacatggaagcaagattgtggaatcctatgtgagggagaaacactcagataccagcagcagtgttgtggaatcctttgggatggacaaacattcagactctcatattcacagcagtattctggaatcctacgtgggggacaagcacgcagaacccagccactgtgttctggaatcctatccgagggacatacattcagaaacttgtagaagtgttctggaatccaacgtgagggacaaacactcagaacccagcagtagatttctggaatcctatgagagtgacaaacacaagccagcagtagtactccagaaatctttggacaaaaactcagaacccaacagcactgttctggaatcctttggaatggacaaacattcagagcgtcgttgcagtgttctggaatcctatgtgagggacaaacactcagaacccagcagcagtgttctggaatactttatgatggacaaacattcagaccctcgcagccgtgttctggaatcatatgtgagggacaaacactcagaacccagcagcagtgttctggaaaaacactcagaacccagtaaaagtgttctggaatcttatgagaaggaaaaacactcagaacccaacagcaatgttttggaatcctatgtgatcaacaaagattcagaagttcatagcagtgttctggaatcacatgtgaggaagaaacactcagaaaccagcagtagtgttctggaatcctatgtgagtgacaaacactcagaaaccagcagtagtgttctagaatcctttgtgaggcacagacgttcagacgctcgaagcagtgttctggaatcctataaacattcagaacctctcagcagtgttctggaatcttatgtgagggacaaatactctgaacccagcagcagtgttctggaatcccatgtgaggggcaaacactcagaacccagcagcagtgttctggaatcctatgttagaggcaaagactcagaacccagcagctgttttcttgaattccttgtgagggacaaactttcagaacctcgaagcagtgttctggagtcccacgtgagggacaaacactcagatcccagtagcagtgttctggaatcctttggaatggacaaacattcagatgctcgtagcattgttctggaatcctacaagctttctgtaatcctatctgagggacaaacactcagaaaccagcagcagttctctggaatcctttgtgagggacactcagaaaccagcggcagttctctggaatcctttgtgagggacaaacactcagaaaccagcggcagttctctggaatcctttgtgagggacaaacactcagaaccccacagaagtgttctggaatcctttgtgatgggcaaacattcagaacctcgtagcagtgttctggaatcctatgtgaggaacaaacactcagaacccagcagcaatcttctggaatacaatgtgagggacaaacgctcagaacccagcagcagtgttttggaatccggtatgatcgacatagactcagaacttcttagcattgttctggaatcccatgtgaggatcaaacactcagaacccagcagcagtgttctgaaatcctatgtgagggagaaacactcagaacccagtagcagtgttctggaatcctatgtgagtgacaaaccctcagaaaccagcagcagtgctctagaatcctctgtgtgggacaaatatccagaaactcgaaacagggttctggaatcctatgaaacctttgtgagggaaaaccattcagacactcgtagcagtgttctggaatcctacatgagggaaaacactcagaacacagcagcagtcttccggacacctaatgttctggaatcccatgtgagtgacaaacagtcagaactgagcagcagtgttctggagtcctatgtgagggacaaacactcagaatccagcagcagttgtctgcaatcctataagtattctggaatcctatgtgggagacaaacactaagaaacctgcagcagtgctctggaatcctttgtgagggacaaacagaacccagcaacactgttctggaatcctttgtgagggaaaaacattcagaacttagtagcagtgttctggaatccaatatgaggaaaaatcatacagacccacttagcagtgttctggcatcctatgtgagtcacaaacactcagaacacagaagcagtgttctagaatcctctttgagggacaaacatgcttaccctcaaaacagtgttctggaatcctatgtgagggacaaccactcagaaccgagcagtagtgttgggcaatcctttgtgatggacaaacattcagaccgttgtagcagtgttctggaatcctatgtgagggacaaacactcagaaccctgcagcagagttctggaatcatttatgagggacaaaacttcagaccctcgaagaagtgttctggaatcggatatgagagacaaacactcagaacacagcagcagtgttctggaatcctctgtgagggataaacactcagaacccagcagcagtgttctggaatcctttgtgatggacaaacattcagaccctcgcgacagtgttctggaatcctatgtgaagggcaaacactcagaaatcagcagcagtgttctggaatcctctatgagagacaaacactcagaacccagcagcagagttctacattcttttgtgagggacaaacactcagaacccagcagccgtgttcaggaatgctatgtgagggagaaacaatcagaacccagtagcagtgttctggtatcctatatgagggacaaacactcagaacccagcagaaatgttctggaatcctatatgagggatatacactcacaaaccagcagcagtgttctggattcctatgggagggacaaacattcagaccctcggagcagtgttctggaatcctatgtgaagggcaaacactcagaacccagtagcagtgttctggaatcctatgtgagggacaagaattcagacactcatagcagtgatacggaatcctttgtgagggacaaacatttggaccctcgtagcagtgttctggaatcctttcagtattctggaatcctacgtgagggacaacctagcagcagtgttctggaatccaatgtgagggacaaacacatacaacccagcaacaatgttctggtatcttatgtgaggaacaaacactcagaatacagcagctgtgatctcgacaaagaatccgaacttcgtagcagtgttcacgaaacgcatgtgggggacaaacgctcagaacccagcagcagtgttctgcaatcctgtgggagggacaaatactcagaacccagcagcagtgttatgggatcgtatgcgagagacaaacactccgaacccaggagcagtgtcctggaatcctatgtgagcacgaacactcagaacccaacagcagggatctcgaattctgggtgcaggacaaacactcagaacccagcagcagtgttctggaatcctataaacagcagcagtgttctggaatcctttgtgagagaaaaacattcagaccctcgcaacagtgctctggaatcctatgtgatggacaaatactcacaacccagcagcagtgttctggaatccaatgtgagagacaaacactcagaacccagcagcagtgttctagaattttttgtgagggataaacattcagacaatcgaagcagggttctggaatcctatgtgagggacaaccactcagaaaccagcagaagtgctctggacaaacactcagaaaccagcagtagtgttctggattcgtttctgagggacaaacattcaggaccttgtagcagtgttgtggaatcccatttgagggacaaatacactgaacccagcagcagtgttctggaatcccatgttagggacaaacactcagaaaccagcagcggtgttctggaatcctatgtcaaggacaaactgtcagagcccagcagcagtgttttgggatcctgtgtgagtgaaaaagattcagaatttcatagcagtgttctggaatcccatgcagtaaccagtaacagtgctctggaatcctttgtgagggaaaaacattcagaccctcgtaacagtgttctggaatcctatgtgacggaaaacctctcaacacccagcagctgtgttctggaatcctatttgagggacaaacactcaaaccccagccactgtgttctggaatactatctgagggacaaacattcagacactcatagaaattttgtggaatcctatgtgagggcaaacactcagaaaccagtagcagtgctctggagttctttggagaaacactcagaatccagcagtagagttttggaatcctgtgtgagggacaagtattcagaatttcgtggaagtgttcacgaatcagatgagtgttttggaatcctgtgtgagggacaaaaaacggaacacagaagcagtgttctggaatcctatgtgagtgacaaacattcagaacttcgtagcagtgttctggaatcttatggatattcagacactcgaaacagtgttctggaatcctatgtgagggacacacactcagttaccagcagcagtgttctggaatcctttgtgaaggaaaaagatttagaccctcgtagcagtgttctgggatcctatgtgagggacaaacactcagaacccattagcagtgttctggaatcctatgagagggacaaacactcagaaaccagtaacagtgttttggaatcctatgtgagggacaaacactcagaacccattagcagtgttctggaatcctatgagagggacaaacactcagaacccagtagcagtgttttggaatcctatgtgagggacaaacactcagaacacaggaacagtgttctggaattctatgtaagggatagacactcagaaaccagcagctgtgttctggaatggtatgtgagggacaaacactccgaatccagcagcagtgttctggaatcctatgtaattattctggaatcctatgtgagggacaaacactcagaaaccaacagcagtactgtggaatcctttgtgagggacaaacagagagatcccaacagtagtgttctggaatcctttctgaggcaaaaacattcagacacttgtagcagtgttctggaatcctatgtgagggacaaacactcagaacccagcagcagtgtcctggaatcctatgtgcgggaaaaacattcagacattcgtagcagtgtactggaatcctatgtgaggtacacacactcagatcccagcagcagtgttctggaatcatttgtgatggaaaaagatttagacactcgtagcagtgtcctgggatcctgtgtgagggacaaacactcagaaactggtatcagtgttctggaaccctatgtgagggacaaacattcagaacccagcggcagtgttctggaatcctatgtgagggacaaacactcagaacccagcagccgtgttctggaattctatggacaaacattcagacaatcgcagaagtgttctggaatcctatgtgagggacaaacactcagaaaccatcagcggcgctatggaatcctttgtgagggacaaacagaatccagcagccgtgttctggaaacatttgtgagggaaaaacattcagacactcaaagcagtgttccggaatcccatgtgaggggcaaacactcagaacccagcagcagtgttctagaatcttttgtgagggacaaaccttcagacactcgaagcagtgttctggaatcctatgtgaaggaccaacactcagaaaccagcagcagtgctctcagtgttcttgaatcctatgtgaggtacaaactctcagaacccaggagtagtgttgtggaatcgattgtgagggacaaacattcagaatcttgtaacagtgttttggaatcctatgtgagggacaaacactgtgaacccagtagcagtgttctggtatcctatgtgaggaacaaacacccagaacatagcagtcgtgttctggaatcctatgtgagggacacacactcagaatccagcagcagtgctttggaaaaacattcggaccctcgtagctgtgttctggaatcctatgtgagggacaaactctcagaacccaacagcagtgttctggaaacctatgtaagggacaaacactcagaacacagcagcagtgctgtggaatccttcatgagggaaaaacattcagaacctgaccctcgtaacagtgttctgggatcctatgtgagggacgaacactcaggaccctgcagcactgttttggaatcctgtgtgagcgaccaagattcagaaattcgtagcagtgttcacgaattccatgtcagggacaaacactcagaacccagctgcagtgttctggaatcctttgtgagggaaaaatattcagaacctcgtagcagtgttttggaatcctacgtgagtgacaaacactcagaagcctgcaacagcgttctagaatcttttgtgagggacaaacactcagaacctcatagcagtgttctggaaaaacaaacagaacccagtagcagtgctctacagtcttttgtgagggaaaaacattcagaccctagtagcagtgttctggaatcctatgtgagggaaaaacattcagaccctcgtagcagtgtcctagaatcctatatgagggacaaacactcagaacccagcagcagtattctgaaatcctttgggagggaaaaacattcacaccatcgtaacagtgttttggaatcctacgtgagagaaaaatattcagactatcgtagcgttgtgctgaaatccagtataaggaataaacactcagaacccagtagcagtgttctggaaccctttgtgatggataaacattctgaccctcgtagtagtgttctggaatcctacgtgagggacaaacactcagaacccagcagcactgttctggaatgctatgtgagggacaaacactcagaacgcagtagcagtgttccagaatcctatgtgagcaacaaactttcagaacttcgtagtagtgttctggaatcgtaagtgagggacaaacgctcagaacccagcagcagagttctggaatcccatgtgatggacaaacactcagaacccagcagcagtgttctagaatctttgtgagggacaaacattcagaatcttgtagcagtgttctagaatcctatttatgggacaaacagtcagaatacagccactgtgtactggaattctatctgagggcaaacattcagaaccttgtagaagtgttctggaatcatatgtgagggacaaacacttagaaatctctaacagtgctctggaatcctctgagggacaaacccacagaacccagtagcagtgttctacaatccttggtgaggaaaaaacattcagaccctcgtagcagtgttctggaatcctatctgagggacaaacacacagaacccagtagcagtgttctacaatccttggtgaggaaaaaacattcagaccctcgtagcagtgttctggaatcctatctgagggacaaacactcagtacccagcagcagtgttctggaatcctttgggagggaataacattcacaccgtcataacagtattctggaattctgtgtgagggaaaaacattcagaccctcgtagcattgctctggaatcccatatgagggactaacactcagaacccagcagcaatgttctggaaccctttgtgaggaaaaaacattcagaccctcgtagcagtgttctagaatcctatgtgagggacaaacactcagaacccagcagcagtgttctggaatcctaagtgagggagaagcactcagaatccagacactgtgtacaggactcctgcctgaggggaaacattcagaacctctagaagtgttctgcaatcctatgtgagggacaaacactaagaaatctgcagcagtgttctgtagtttttttgtgaggaagaaacaaacagaacccagaaagagtgttctacaatcctttctgagggaaaaacattccgatccttgtaacagttttctggaatcttatatgaggcacaaactctcagaagccagcagcagtgttctggaatcctttgggagtgaaaaacattcacaccctcgtaacagtgttctggaatcctgtgtgagcaaaaaacattcagaccgtcgtagcatttttctggaatccaacatgaggcagaaactctcagatcccagtagcagtgttctggaaacctttgtgagggataaacattcagaccctcgtagccgtgttctggaaacatatgtgagggacaaacacacacaacccagcagctgtgttcttgaatcttatgtgagggacaaacactcctgacccagcagcagtgttctggaatcctaagagagggacggacactcagaaaacagcaacagtgttcaggaatcatatgtgagtgaaaaacactcagaatccagtaactgcatactggaattctatctgagggcaaatatttagaacctcgtagaagtgttctggaatcctatgtgagggaaaaacattcagaccatcgtagcagtgttctgaaatcctatatgagggacaaacactcagaacccagcatcagtgttctggaatactttggaagggaaaacctttcacatcttcctaacagtgttctggaatcctatgtgagggaaatacatttagaatctcgtagcattgttctggaatccaatatgagggacaaacaatcagagcccagtagcagtgttctggaaccctttgtgagggataaacattcagagcctcgtaacagcgttctgaaatcgtatgtgagggacaaacactcagaacccaggagcagtgttttggaaagctatgtgagtgacaaactttcagaacttcgtagcagtgttctggaattctatgtgaggaacaaacactcagaacgcagcaacactgtcctggaa

SEQ ID NO: 474380 - DNA, 3760 bp, Homo sapiens
gaagcagtgtgctggaatcctatgtgaggggcaaacacttggaatccagcagcagtcattgttctggaatccaatatgagggacaaacagtcagaacgcaataacagtgtttcggaaccctttgtgagggataaatattcagcccctcgaagcagtgtgctggaatcctatgtgagggacaaacactcagaacccaacagcagtgttctggaatcctttgggagggaaaaacatttacagcctcgtaacagtgttctggaatcctatggacagagactgagacccagcagtagtgttttggaatcctgtgtgagggacaaaccctcagaaaccagcagcagtgttctagaatcctatgtgagtgacaaacagtctgaacccagaagcagtgttctggaatcctatgtgagggacaaacactcagaatccagcagcagtgttctggaatcctatgtgagggacaaacactcagaatccagcagcagtgttctggaatcctatgtgagggacaaacactcagaatccagcagcagtgttctggaatcctttctgagggacaagaactctgaacccagcagaagtgttctggaatcctatgtgagggaaaaacattcaaaccctcttagcattgttctggaatccaatatgagggacaaacagtcagaacgcaataacagtgtttcggaaccctttgtgagggataaatattcagcccctcgaagcagtgtgctggaatcctatgtgagggacaaacactcagaacccaacagcagtgttctggaatcctttgggaaggaaaaacatttacagcctcgtaacagtgttctggaatcctatggacagagactgagacccagcagtagtgttttggaatcctgtgtgagggacaaaccctcagaaaccagcagcagtgttctagaatcctatgtgagtgacaaacagtctgaacccagaagcagtgttctggaatcctatgtgagggacaaacactcagaatccagcagcagtgttctggaatcctatgtgagggacaaacactcagaatccagcagcagtgttctggaatcccttctgagggacaagcactccgaacccagcagaagtgttctagaatcctctgtgaggaaaaagcattcagaagctcatagcagtgttgtggaatcgtttttgagagacaaacactcagaacgcggcagcagtgttctggaatcctttgtgtcagacaaacattcagacagttgtggcagtgttctggtatcctatgtgagggacaaacactcagatccagcagcattttttctggaatcctatgtgagggacaaacactcagaacccagcagcagtgttctggaatcgtatgtgagggacaaactctcagaacccagcagccgtgttctggaatcctatgtgagagacaaactcttagaacccaggggcagtgttctagagtcctttgtatgggacaaacattcagaaactctcagcagtgttctggaagcgcacaaacactcagaacccagcagcagtgttctggaattctatgtgagtgacaaacactcagaacccagcagcactgttctagattcctttgtgagggacaaatcttcagaccctcgaaacagtgttctgaaatcctatgtgagggaacaacactcagaacccagccactgtgtgctggaatcctgtctgagggacaaacattcaaacactcgtagaagtgttctggaatcttatgtgagtgataagcaatcagaaaccagcagcggtgctctcagtgttctgggatcctatgtgagggaaaaacattcagacccgcatagcagtgttctggaatcctatatgagtgacaaacactcagaacccaccagcagtgttctgaatcttttcattgttctggaatccaatatgagggacaaacactcagaagccagcagctgtattctggaatgccatgtgagggaaaaagactcagaacccaacagcagtgttctggaatcctgtctgaggaataacccctgggaacccagacactgtgtactggaatcttatattagggacacatattcagacactcgtagaagtgttctggaatactatgtgagggacaaacacactgaacccagcagcattgttttggaatcccatgtgaggcagaaacactcagaactcagcagcagtgttctggaatcctatgtgagtgaaaaacactcagaacccagcagcagtgttctagaatcctttgtgggcaaaaaaccttcagaccctagaatcagtgttctggaatcctatgtgatgaacaaacactcagaacccagcagcagtgtttttgattcctttgttttggagaaacattcagaccattgtagcactgttccactatcctatgtgagggacaaactctcagaacccagtagcagtgctctagaatcctatgtgagggacaaacactcagaacccagcagcagggttctggaatcctatgtgagggtcaaacactcagaaggcagcagcagtgttctggaatcctatgtgagggagaaacactcagaacccagtcactgtgtgctggaatcctatgtgagggagaaacattcagaacccagtcactgtgtgctggaatcctatctcaaggacaaacattcagaccattgtagcactgttccgctatcctatgtgagggacaaactctcagaacccagtagcagtgctctagaatcctatgtgagggacaaacactcagaacccagcagcagggctctggaatcctatgtgagggtcaaacactcagaaggcagcagcagtattctggaatcctatgtgagggagaaacattcagaacccagtcactgtgtgctggaatcctatgtgagggagaaacactcacaactcagtcactgtgtgctggaatcctatctgagggacaaacattcagacatgtgtagaagtgtcctggaatcctataagtgctctgcaatcctatgtgagggacaacactctgaacccagcagcaatgttttcgaatcccatgaaagggacaaacactcagaactcggcagcatttttctggaatcctatgtgagtgacaaactctcagaacacagcagcggtgttctagaatcctttgtgggggacaaacattcagatgatcatagcagtgttctggtatctcatgtgagggacaaacactcggaaaccagcagcagtgctctggattcctttttgggggacaaacaaaccgagaaggaggattcctttgtgaggaacaaacattcagaccctcgaagcagtgttctggaatgttatgtgagggacaaaccctctgaacccagcagcagggttctggaatccgaagtgagtgacaaacactcaaaacccagcagcagtgttccggaatcctttgtgagggacaagctttcaaaccctcgaagcattgttatggaatcctatgtgaggaacacacactcagaatccagtagcagcgttctcgaatcctttgtgatggacaaacatccagacactcttagcagtgttctggaacgctatgtgatggacaaacctacagaacccaggagcagtgttctggaatcctctgtgagggacaaacactcagaacccagtagtagtgttctggaatctaatgtgagggacaaacactaagaacccaggagcagtgttctgcaatcctatatgagggacaaacactactaaccctgtagcagtgttctagaatcctttgtgagggaaaaacattcagaccatc

SEQ ID NO: 474381 - DNA, 4864 bp, Homo sapiens
cccagcagtagtgttcgggaatcctatgggagggacaaccattccgaatccagcagcagtgttgtgtaatcctatggagaaatattcaaacactcgtagaagagttctggaatcctatgtgagggaaaaaccctcagaagccagcagcagtgctctggaatcctttgtgaggggcaaacaatcagaacccagaagcagtgttcttgaatctttcgtgagggaaaaacattcagaccctcgtaatagtattttggaatcctatctgagggacaaacactcggaacccagcagctgtgttctggaatcctatgtgtgggacaaacacttagaacccagcacaatattctggaatactactgttcttgaatcccatgtgagggagaaaccttcataccctcgtagcattgttctggaatccaatatgagggacaaacactcagaacccagtagcagtgttctggaacctttattgagggataaacattcagaccgtcatagcagtgtgctggaatcctatgtgagggacaaatgctccgaacccagcagcagtggtttggagtcctatgtgagggacaaacactctgagcccagcagcagtgttctggaatcctctgtgagggacaaactttcacaacttcgtagcagtgttctggaattctacgtgaggtacaaacactcagaacccagcagcagtgttctggaatcctttgtgaggaacaaacattcggaacctcatagcaatgttcaggaatccgacaaagactcagaaaccagcagcactgttcaagaatcctttttgtgtgacaaacattctgaacctcaaagcagtgttctggaatcctacgtgagggacaaacaccacaatccctgcagcagttttctggaatcctttgtgatggacaaacattcagaccctcgtagcagtttttcagaatcctatgtgtgggacaaacactcagaacacagcaacagtggtctagaatcctttgtgtgggacaaagattcagaacccagcagcagtgttctggaatcctatgtgaggtacaaacactcagaaacagtggctgtgtactggattccactgtgtactggaatcctatctgaaggaaaaacattccgaacttcggaaaaactttcacatccttatagcagtgttctggaaacctatgtgagggaaagaaattcagaccctcgtagcagtgctctggaatcctatatgagggacaaacactcagaacccagcagcagtcttctggaatcctttgggagggaaaaacattcacaccctcgtaaaagtgttctggaatcctatgtgaaggaaaaacattcagaccctcgtagcattgttctggaatctaatatgagggacaaacagtcagaacccagttgcagtgttctggaatactatgtgagtgacaacactcagaacccaggaactgggttctggaattgtctgtgcgggccagtcattcagaacctcgtggcagtgttctggaatcctatcagccctgttctggaatcctatgtgaggtacaaactctcagaacccagcagcagtgttatggaatcctttgtgagagacaaacattcagaccctcgtagcagtgttctggaatcttatgtgaggcacaaacactcacaacccagtagcagtgttctggattcctatgtaggggagaaacactcagaacccaacagcagtgttctggaatcctttgtgatggacatacattcagaccctcaacccagcagcagtgttctagaatcctttgtggggtacaaacattcagaacctcgaagcagtgttctggaatcctatttgagggacaaactcacagaacccagcagcagtattctggaatcccaagtgagggacaaacactcagaaaccagcagcagtgtgctggaatgctttttgagggacaaacattcagaccttcgaagcagtgttctgcaatcctatgtgtgggagaaacactcagaatccagcagcagtgttgtagaatcctctgtgagggagaaacactcagaactcagcagtagtgttctggaatcctatgtgatggacaaacactcagatcactgcagcaggggtctgaaatcctatgtgaaggataagcactcagaacccagcagcagcgttctggaatcctttctgagggacaaacattcagaacctcgtagcagtgttctggaatcttatatgtgggacaaacactcagaaccaggcagtaacgttctggaatcccatgtgagggacaaacactcagaacccaacagcagtattctggaatcctatgtgagtgacaaacactcagaatccagcagcagtgttctagaattctttgtgtgggacaagcattcatgccctcaaagcagtgctctggaatcctatgtgagggaggaacagtcacaacccagcagcagtgttcaggaatcctttgtgatggacaaacattcagaccacacccgtggaggtgttctggaatcctatgtgagggacaaacactcagaaaacagcagcggtgctatggagacctttgtgagggcaacaaacacaagccagagttttattctggacaaacactcagaacccagcagcagtgttctagaatcctatgtgagagacaaaccctcagaacccaacagcagtgttctggaatcccatgtgagggacaaacactcagtacccaaccactgtgttctggaatcctatatgagggacaaacattcagacaatcgtagaagtgttctggaatcctatgtgagggacaacactcagaaaccaccagcagtgctctggaatcttttggataaaagcccagaacgcagcagcagtgttctggaatcctgcgtgagtgacaaacactccgaaccccgcaggaatgttcttgaatcctttgtgagggacaaacattcaaaccctcgaagcagtgttctggaatcctatgtgagaaaccagcagctgttttctggaatcttgtcgagtgacaaatattcagacactcgtggaagtgttctggaatcctatgtgagggataaacactcagaaactagcagcggtgatctggaatcctttgtgaagcacaagcaaacagaacccagcagctgtgttctggaatctttcagagttctggaatcctatgtgagtgacaaacactcagaaaccagcagcagtgttctagaatcctttctgtgggacaaactttcagacgctcaaagcagtgttctggaatcctatgtgatggacaaacactccgatcccatcagcaatgttctgcaatcctttgtgatgggcaaacattcagaccctcaaaccagcagcagtgttctggaatcccttgagagggaaaaacatttacaccttcataacagtgttctggaatccttactgtgggaaaaatattcagaccctcgtaacagtgttctggaatcctatatgagggacaaacactcaaaaaccagcagcagtgttctggaatcctatgtgagggaaaaacactcagaacccaactgcagtgttctggagtcctgtgggagtgacaaactttcagaaattcgtagcagtattctggaatcttatgtgagggacaaacacacagaacccagtagcagtgttctggaatcttatgtgagtgacaaacactcagaatccagcaacagtgttctggaatcctatgtgagggacaaacactcagaacccagcagcagtgttctagaatactttgtgaggaaaaacactcagaacacagcagtagtggacaaacactcagaaaactgcagcagtgttctggaatcctacgtgggggacaagcattcagatcctgatagcactgttgtggaatgctctgtgaggaacaaacaatcagaccctcgtagcagtgttctgaaatcctgtgtgaggtacaaaccctcacaactcagcagcagctttctggaattctatgtgagggacaaaccctcagaacctaacagcagtgttctggaatcatacgtaagaacacagaagcagttgtctggaatcctttgtgatggaaaacattcagaccctagtagcagtgttctggaatcctatgtgacggacaaaccttcagaatccagcaatagtgtactggaatcctctgtgagggacatacactcagaacccagcagtagtgttttggaatcctttgtgagggacaaaccctcagaatccagcagtagtgttctggaatcctctgtgagggacatacactcagaacccagcagtattgttctggaatcctatgtcagggacaaacattcagaaaccagcagcagttttctggaatcctatgtgagggacaaacactcagaaaccagcagcagtgttctgcaatcctatgtgagggacaaacactctgaacccagcagcagtgttctagaatcctatgtgagtgacaaacattcagaattttgtagcaatgttctgccattctatgtgagtgacaaacactcagaagccagcaacagccttctagaatcctatgtgagggaaaaacactcagaaaccaacagcaatgttctagcatcccttgtgagggacaaacattcagaatctcgtagaagtgctctggaatcgcaagtgagggagaaacacacagaacccagcagcaatgttttggaatcctgtttgagcgacaaagatacagaacttcgttgcaatgttctcgaatcccatgtgagggacaaacactgagaatccagcagcagtgtgctggaattctatgtgaggaacaaacactcagaacccagcagcagtgttctacaatcctatgtgagggacaaacattcagaaactcgtagcagtgttctgcaatcctgtgtgagggacaaacactcagaa

SEQ ID NO: 474382 - DNA, 4163 bp, Homo sapiens
agcagcagtgtccaggaatcctaaatgagggacaaacattcagaccttcggagcagtgttctggaatcctatgtgaaggacaaacactcagaacgcaatagcagtgttctggaatcctatgtgaaggacaaacactcaggacccagtagcagtggtagggagtgctttctgatggacaaacattcagaaccttgtagcaattttctggaatcctatgtgagggacaaacgctcagaacacagcagcagtgttctggaatactttggacaaacactcagaacccaacagcagtggtctggaatcctctatgagggacaaacactcagaacccagcagcagagttctggactcctaaaacctcgtagcagtgttctgggatcctatgtgaggtacaaaccttcagaacccagcagcattgttctggaattctacatgacggacaaaccctcagaacctagctgcagtgttctggaatcctatgtgagggacgaacactcagaacccagcagcagtgttctgcattcctatgtgagggacaagcactcagaaacctgcagcagcgtttgggaatcccatatccccgcggcaatgttccggaatccttcgggagggacaatcattcagaccctccgagcactgctctgtaatgttatggacaaaccctcagaacctagcagcagtcttctggagtcttatgtgagggacgaacacagagaacccagcagcagtgttctggattcctatgtgagggacaaacactcagaaccctgcagcagttttctggaatccaaggtgagggacaatcactcagaacccagcagctatgttccggaaacctatgtgagggacaaacattcggaccctcgtgtcagtgttctggaatcctatgcgacgatcaaacactcagaaaacggtaccagtgttccggaatcctttgtgagagacaaacactcagaaccctgcagcagtgttctggaatcctacgtgaggtgcaaacattcagaccctcatagcactgttctggaatgctacgtgagggacaaacattcagaccctagtagcagtgttctagaatcctatgtgaggtacaatccctcagaacccagcagcagtgttctagaattctacgtgaaggacacacactcggaacacagcagcagtgttctggattgttatgtgaaggacaaacactcagaaccctgcagcagtgctctggaatcctattcctatgtgagggacaaacactcagaacccagtagcagtgttcgggaattctatgtgagggacaaaccgtcagaacccagcagcagtgttctggaatcctttttgagggacaaactttcagacactcagagcagtgttttggaatcctatgtgagggacaaacactcagaaccctgcagcagggttctggaatcctatgtgtgggacaagcattcagaccctcatagcactgttctggaatgctctgtgagggacaaacattcagacccttgtagcagtgttctggaatcctgtgtgaggtacaaaccctcagaactcagaagcagtgttctggaattctatgtgaaggaaaaaccctcagaaccttgcagcagtgttctggaatcggacaaccattcagacactcgtagcagtgctctgggattatatgtgagggacaaacattcagaacccagcagcagtgttctggtatccttggtgaggaacaaactttcagaacctccgagcagtattctggaatcccgggtttggaacaagcactcagaacccagcagcagtgttcgggaattctatgtgaggaacaaaccgtcagaacccagcagcagtgttctggaatcctttttgagggacaaactttcagacactcagagcagtgttttggaatcctatgtgagggacaaacactcagagccctgcagcagggttctggaatcctatgtgtgggacaagcattcagaccctcatagcactgttctggaatgctctgtgagggacaaacattcagacccttgtagcagtgttctggaatcctgtgtgaggtacaaaccctcagaactcagaagcagtgttctgcaattctatgtgaaggacaaaccctcagaaccttgcagcagtgttctggaatctagcagtgttctggaaacctatgtgaggggccaacactcagaacccagcagcagtgttctggaatgctatgtgagggacaagcattcagaccctcatagcagtgttctggaatcttatgtgagggacaatcattcagaccgtcgtggcactgttctggaatcctatgtcatggaaaaacactcagaaccctgcagcagtgttctgaaatacgatgtggtggacaaacaaagaacacagcagcagtggagaatcactcagaaccctgcatcagtgttctggaatcctatgggattgacaaaccctcagaacccagcagcaatgttctggaatcctatgggagggacaaacactcagaaaccggcagcagtgttctggaatccttttgttatggaatcctatgtgagggaccaaccctcagaacccagcagcagtgtgctggtttccttcctgaggcacaaacattcagagcctcgtaacagtgttctcgaatcctatatgagggacaaacaccccgaacccagcagcagtgttttggaatcctttgtgagagaaaaacattcagaccctcaaagcagtgttctggaatcctatgtgacagagaaacacccaaaacccagcagctgtgttctggtatcctacatgaggggcaagcattcagaccatcatagcagtgttctggaatcatatgtgagagacaaacattcagaccctcatagctgtgttctgcaatcctgtgagagggaaaaacattcagaacccagcagcagtgttctggaatcctatgtgaaggacaaacactcagaacccagcaacagtattctggaatcccacagggacaaacaatcagaacccagtagcagtattctggaatcctttgtgagggacaaacaccaggaacccagcagcagtgttctggaatcctatgtgtgggacaaactctcagatcccagcagcagtgttccggattgctatggacaaacattcagaaccttggagaagttttctggaatactatgtgagggtaaaacaccaagaacccaggagcagtttcttgaaaacgttgtgagggaaaagctttcagacatttgtaccagtgttctggaatccgatgacaaacactcagaacccagcagcagtgttctggaatcctatttgattggcaaagacacagaacccatcagcagtgttctggaaaaccagcagcagagttctggaatcctatgtgagggagaaatcctcagaacccaccagtgtgttttgaaatccattgtgaaggacacacattcataccctcctagaagtgttctggaatcctatgacaaacattcagacccttcaagcagtgttctggaatcctatgtgagtgacaaacccttaaaacccagcagcagtgttctagaatattatgtgagggacaaaccctcagaacttggcaacagtattctggaatcctatgtgagggtaaaacactcagaacccaactgcaaggttcttgaatcctattgttctggagtccaatctgaggacaaacactcagaaaacagcagcagtgttctggaatcctttgtgagggacaaacattcagaccctcagagcagtgttgtggaatcctatgtgaggggcaaacacacagaacgtggaagcagtgtcctggtattctctctgtgggacaaacactcagaacctagccatggtgttccggaattctatatgagggacaaaccctcaaaaacgagaatcattgttgtggaatcctttgtgtgggacaaacattcagacactcatagcagtgttctggaatcctaggtgagggacaagcactcagaatccagcagcagtgttctagaattctacgtgagggacaaacccacagaacatatcagcagtattcaggaatcctatgtgagaggcaaacactcagaaccccgcagcactcttctggaatcctttgtgagggacaaactttcataccctcttaacagtgtactggaatcttatgtgaggacaagcactcagaacacagcaacagtgta

SEQ ID NO: 474383 - DNA, 1745 bp, Homo sapiens
ctgctacgagggtcggaatgtttatccctcacaaaggtttccagaacaatgctactggcatttgtccctcatattggattccagaacaatatcaagagggtccgaatgtctttccatcacataggtttccagaacactgtttcgatagtttgaatgtttttccctaccaaaggattccagaagattgctgctgggttctgagtgtttgtcccacatataggattccaaatcactgcaacgaggaacagtgctacgagtgtctgaatgtttttccctcacataggattccagaacactgttacgagggtgtgaatattttccctcctaaaggattccagaacactgctgctgggattccagaacactgctgctgtgttctgagtgtttgtccctcactttggattccagaacactgctacgagggtctgaatgtttatccctcacaaatgtttccagaacactactactggattctgagggtttgtccttcatattggattccagaacaatgctgcgaatgtctgaaagtttttccctcacgtaggattccagaactcagttacgagggtgtgaatgtttttccctcccaaaggattccagaacactgctgctcggttctgagtgtttattgcaaaacactgctacgaggttctgaatgtttatccctcataaaggtttccaggaaactgctgctgggttctgagtggttgccctcatattgtcttccaaaacaatggtacgagtgtctgaatgtttttccctcacctaggattccggaacactgttatgaggaacacagctacgaggttctgaatgtttattcctcacaaaggtttacagaacactgctatggagttctgagtgttttcccctcatattggattccagaacaatgctgcgagtttctaaatgttttcccctcatataggattcgagaacactgttacgagggtgtgaatatttttccctcccaaataattccagaacactgttgctgtgttctgagtgtttttccctcatataggattccagaacagtgctacaaggttctgaatgtttttccctcacataggattccagaagactgctatgaggaacactgctgctgggttctgagtgtttgtcccacacataggattccagaacattgctacgaggggctgaatgtttatgcccaacaaagggttccagaacactgctactgggttctgagtgttcatacttcatattggattccaaaacaatgctatcaggatctgaatctttttccctcacataggattccagaatactttaacgagggtgtgaatatttttccctcccaaatgtttccagaacactgctgctgggttcggagtgtctgtcactcatatagaactccaaaacactgctacaagggtctgaatatttttccctcacataggattccagaaccctgctacaagggtctgaatgtttttccctcacaaaggactgatcaacactgctacagggttctgtttgcttgtccctccaaaggattccagagcactgttgcagatttcttagtgtttgtccctcataggattccagaacccttctctgaggttctgaatatttgccctcagataggattccagtgcacggtggctggattctgagtgtttgtccctcacataggattccacagcactgctgctggcttctgagtgtttgcccctcacatagaattccagaacactgctacgaagttctgaaagtttttc

SEQ ID NO: 474384 - DNA, 6872 bp, Homo sapiens
cccagcagcagtattgtggaattctatatgatggacaaccactcagaacccagtggcagtgttctggaatcccatgtaagggacaaacactcagaacccagcagcagtgttctggaatcctttgtgcaggacaaacactcagaacccagccaatgtgttctggaatcctatcagagggacaaacattcagacacttgtagaagtgttctggaatcctatgtgaggaagaaacactcagaaacaagcaacggtgccctggaattatttgtgaggaaaaaacagaacccagcagcagctgttctggaatcctatgagagggccaaacattcagaacccagcagcagtgttctggaatcccatgtgagggacaaatactcagaatccagcagcagtgttctagaatcctttgtgagggacaaaccttcagacactcgaaggagtgttctggaatcccatgtgagggacaaacactcagtaaccagcagcagtgctctgggcaaacattcagaatcttgtagcagtgttctggaatcctatgtgaaggacaaacactctgaaactagcagcagtgttctggtatcctgtgtgagggacaaatactcagaacccagcaactgtgttctggaatcccatgtgagggacaagcactcaaacctagaaacactgttctggaatcctatggacaaacacacagaacccagcagcagtgttcttgaatcctttgtgagggaaaaacattcagaccttcgaagcagtgttctggagtcctatgtgagggaaaaacactcagaacccagcaacattgttctggaatcctatgtgagggacaaacactcagaacccagcagcaatgttctggaatcctatgtgagggacaaacattcagaagttcttaggagtgttctggaatccaatgtgagggacaaacactcagaacccagctgcagtgttcttcaatcctatgtgaaggacaaacactcagaacccagcagcagtgttctggaatgctatgtgagtgtcaaacactcagaacccagcagcagtgttctggaatcctttgtgagggacaagcattcagaacctcatagcagtgttcagcaatcatatgtaagggacaactgtgaaccgagcagcagcagtgtttttgagtcccatgtgagggacaaacactccgaaatccgcagctgtgttctggaatcctacgtgagggacaaacactcggaaccctgcaacagtgttctggattcatttgtcacggacaaacattcagactgtcgtagcagtgtggtggtatcctatttgaaggacaaaccctcagaaaccagaagcagtgctctggattgccttgtgaggtacaaacaagcagaacccagcagcagatttctggaatcctttgtgaaggacaatcattcaaaccctcggagcattgttgtggaatccaatgtgagggacaaaagctcagaaacctgcagcagtgttctggaatcctatgtgagggacaagctttcagaccctcatagcactgttttggaatgctctgtgaaggacagatattcagaccctcaactcagcagcagtgttcttgaattctatgtgagggacaaaccctcagaaactagcagcagtattctggaatcccatgtgagggaccaatactcagaaccctgcagcagtgttctggaatgctatgtgagggacaaacacaaaaaacccagcagcagtgttctggcttcctatatgagggacaaacattcagaacccagcagaattgttctggaatcctatgtgagggacaaacactcacaaaccagcagcagtgttttggaatcctatgtgagggacaaacattcagactctcggagcagtgttctggaatcctatgtgaaggacaaacactcagaacccagtatcagtgctctggaatcctatgtgagagacaaggattcagacactcgtagcaaaactagcagcagtattctgcaatcctatgtgagggacaaacgctctgaacacagcagcagtgttctggaactcgttgacagagacaagctctcagatccaagcaccagttttctggaatcctatgtgagggaaaatcactctgaactcagcagcaaatcctctgtgagggacaaatattcagaaaaacgaaggagggttgtggaatcctatgtgagagacaaccattcagatcccagcagcagtgttctggaatcctttgtgatggacaaacattcagaccccagtagcagtttcctagaatcctatgtgagtcgcaaaccttcagaagccagcagcagtgttctgaaatcgtatgtgagcaacaaactttcagatattagtagcagtattctggaatcctatgtgggggacaaactttcagaacccagccagtgtgttctggaatcctatctgagggacaaacattcagacagtcgtagaagtattctggaatccaaactgagggacaaacactcagaaaccagaagcagtgctcaggaatcctttgtgaggaacaaacatacaaaactcagcagctgtgttttggaattctatgtcagcctcaaacactcagaaaacagcagtattgtgagtgacaaacactcagaacccaatagcagtgtgctggaatcctatttgagggacaaacactcagaacccaacagcagtgtgctggaatcctatgtgagggacaaacactcagaaccaagcaggagtgttctagaatcctttgtgaggcacaaacactcagaacccagcagcagtgttctggaatcctttatgagggacaaatgttcagaacctcatggcagtgttttggaatcctatgtgagtgaaaaacactcagaacccagcagcagtgttctagaatccgttgaatcctttgtgatgggcaaacattcagaccctcgtagccgtgtcctcgaatcctatgttagggaaaaacaacaagaactcagcagcagtgttgtggaatcctatgtgaggaaaaaacactcagaacacagcagcagtgtcttggaataccaacccagaagcagtgttctagaatcctttatgagagacaaagtttcagaccctcgaagcagtgttctggaatcgtatctgagtgacaagcactcagaatccagcagctgggttctggaatcctatcaatgttctggaatgctgtgtgagaaacacacactcagagacgacagcagtgttccggactactatgtgagggacagaccctcaattcccagcagtagtgatgtgaaatcctatgaatcctttgtgatggacaaacatacagaactcagcagcagtgttttcgaatcctatgttagtgacaaacactcagaaacctgcagcagtgttctgtatcctattgaggggaaacattcagacactcaaagcagtgttctgcaatcctacgtgagggacaaacacagagaatccagcagcagtgttctggaatcctttgtgagggacaaacattcagaacatcataggagtgttctggaatcatatgtgagggacaaatactgtgaagccaacggcattgttctggaatctgatgtgagggataaacactcagaacccagcagcagtgttctggaatcctatgtgagtgacaaacactcagaacccagcagcaaacccagcagcagtgttctggaatcccacgtgagggaaaaacattcagaccctcgtagcattgttctggaatccaaaatgagggacaaacactcagaacccaaaagctgtattctggaatcccatgtgagggacacagactcagatcccagcagcagtgttctggaatcctatttgagggacaacccctcggaacacagtaactgtgaactggagtcgaatctgagggacaaacattcagacattcgtagaagtgttctggaatcctataagcagtgttccagaataattgtgagggaaaaacattcaaacactcgtagcagtgttctggaatcctatgtgagggacaaacactcagaacccagcagcagtgttctggaatcctatgtgagcaacaaacattcaaaactttgtagcaatgttctgatattctatgtgagggcaaacactcagaacacagcagcagtgctctggaatcaacccagcagccgtgtgctggaatcctatgtgagggacaaactctcagaatccatcagcagtgttctggtatcctacgtgagtgacaaacactccgaacacagcagcagtgttccagtatcttttgttctggaatcctatgtgtgggacaaaccctcagaacccagtagaaattttctagaatcctttgtgtcagacaaacattcagaccgttgcagcagtgttttggtatcctatgtgagggacaaacactcagaatgcaggagcagtgttctagaatcctatgtgagtgaaaaacactcagaaccgcggagcagtgttctagagtcctatgtgagtgaaaaacactcagaaccccgcagtagggttctagaatcctatgtgagggaaaaacactcagaaccccgcagtagggttctggaatcctatgagaggaacaaatactcggaatgcagcagcagtgttctggaatcctatatgagggaaaaacactcagaacccagctactctgttctggaatcctatctgaggtacaaacattcagacacgggaaaaagtgttctggaaacctgtatgagggacaaacactcagaaaacagcagcagtgctctcgaatcatttgtgagggacaaacaaacagtacacagcagcagtagtctggaatcctatgtgagggaaaacctctcaggacccagaagtagtgttatgaaatctcttggacaaacactcacccccagcagcagtgttctggaatcctatgtgagggacaaacactcagaacccagcagcagtgttctagaatcctttttgaaggacaaacattcagaacctcgtagcagtgttctggaatcttatgtgagggacaaacactctgaacccaacagcagtgttttcaaatcccatgacaaacacacggaaccctgcagcagtgttctggaatcctatgtgagggacaagcgttcagaacctcatagcactgcactggaattctatgtgagggacaaaaattcagaccctcctagcagtgttctggaatcctatgtgaggtacaaatcctcagaatggagcagcagtgttctggaattcgatgtgaaggataagcctcagaacctagcggcggagttctggaatacaaactgtgttctggaattctatatgagggacaaaccctcagaacccagcagcattgttctagaattctatatgagggacaaacactcagaacccagcagcagtgttctggaatcctatctgagggacaaacactcagaatgcagcagcagtgttctgaaatcctatgtgagaaaaaacactgagaacccagtagaagttttctggaatcctatgggagagctcagctttcagacactcataggagtgacagaatcctatgtgagggacaatgattcagaccctcattgcagtattctggaatcctatctgagggacaaacattcagaccttcgtagcagttttgtggaatcctatgtgagggacaaacactcagaatgcagcagcaatcttctggaatcctatgtgagggacaaacactcagaacacagcagcagtgttccagaatactttgtgagggacaaacattcagacaatcttaacagtgttctgaaatcctatgtgagggacaaacagtcagaacccagcagcagtgttttggaatcctatagcagtgctctggaatcctatgagacggacaaacactcagaaccctgcagtagtgttctgcattccaatgtgagggacaagcattcagaccctcatagcactgttctagaattctctgtgagggacaaacattcagaccctcgtcgcattgttctggaatactatgtgaggtacaaaccctcagaaatcagcagcagtattctgttattccttaacccagcagcaatttttctggaatcctatgtcagcgacaaacactcagaacaaagcagcagtgttctggaatcctttgtgaggaagaaacattcagaacctcataggattgttctggaatcatatatgagggacaaatactgtgaagccaatgacattgttctggaatctgatgtgagggacaaacactcagaacccagcagcagtgttctggaatcctatgtgagtgacaaacactcaaaaaccagcagcagtgttctggaatcatttgtgagggacaaacattcagaccctagaagctgtgttctggaatccaatgtgagggacaaacactcttatcacaacaggagtgttctgcaattctttctgacagacaaacattcacatcctcttagcatttctcgggaatcctatgtgaaacccagcagcagtgttctggaatcctatgtgagggacaaacattcaggaaacagtagtagtgctctagaatcctttgtgagggacaaacactcagaatgcagcagcagtgttctagaatcctttgttaggtacaaacattcagaaacttgtagaagagttctggaatgcgatgtgagggacaaacactcagaatccagccactgtgtactggaatcctattgacggcaaacattcagaacctcgtagaagtgttctggaattctatgtgagagacaaacactaagaaatctgcagcactgttctataatcctttctgagggacaaacaacagaatccggtagcagtgttctacattctctatgagggaaaaacattcagaacctcgtagcattattctttaatcccatatgagggacaaacactcagaacccagtagcagtgtt

SEQ ID NO: 474385 - DNA, 1017 bp, Homo sapiens
gtgtttgtccctcactgaggattccagaatactgctactgcttctgagtaacaattctacgagtgtatgaatgtttgtcccttagataggaatacagaacacagtggctggtttctgagtgtttgtccctctcaaaggattccagaactctgctgctgggttctgagagtttgtgcctcacataggattccacaacactgctgctggattcggagtgtttgtcccttacatagaattccagaacactgctggtgggtactgagtgtttgtccctcacataggattccagaacactgctgctgggttctgagtgtttgtcccacacaaaggattccaggatactgctactgtgttatgagtgcttgtccctcaaatagggttgcagagcactgttacgaaggtctgaatgtttgtccatcagcaaaaattacagaacactgctgctgggttctgagtgtttgtccctcacataggattccagaacactgcttcgagtgtctgaatgtttgttcctcacaaaggattctagacaactcctgctggtttctgagtgtttgccactcacataggattccgaagcactcctgctggatactgtttgtttttccttcacaacggaatccagaaaaatattgctgctttcggagtgtttgtccctcagattggattccagaacacttctttgtgtgtctgaatgtttctccctcagataggactccagaacacagaggctgggttctgattatttgtcccccacgtaggattccataacactgctaagaaattctgaacgtttattgctctcataggataccagaacaattctgctgggttctgagtgtttgtccctcacatatgattccagaacacttctatgagtgtctgaatatttgtccttcaaataggattccagaagacagtgcctaggttttgagtgtctgtccctcacataggattctagaacactgctgctgggttctgagtgtttattcctcacataggattccagaacactgc

SEQ ID NO: 474386 - DNA, 5334 bp, Homo sapiens
cccagcagcagggtcctggaatcctttgtgatgcgcaaacattcaaacccttgtagcagtgcactggaatcctatgtgagggacaaccactcagaacccaggagaagtgttctggaatcctctgtgagggagaaacactcagaacagagcagcagtgttctggaaccttatgaaaaacattcagacccttgtagcagtgttctggaatcctatttaagggacagacactcagaacccagcagcagtgttctggaatcctatgtgagggacaaacactcagaacctggcagcagtgctttggaatcctgtgcgatcgccaaagatccagaacttcatagaagtgttctggaatcctatgtgagggacaaacactcagaaaccagcagcagtgctctggaatcctatttgagggacaaacatacagaagccagcagcagtgttttggaatcctatgtgagggacaaacattcagaaactcctagctgtgttctggaatcatctgtgagtggcaaacactcagaacccagcagcagttttctggattcctatatgagtgacaaacactcagaagtcagcatcaaacccagcagcagtgttctggaatcctttgtgatggacaaacattcagaccctcgtagcaatgttctggaatcctatgtgagagacaaacactcaaaactaagcagcagtgttctggaatactatgagaggagcaaacactcagaatgcggcagcagtgttcgggaatcccatgtgagggacaaacacgcagaacccggcagctgtgttctggatttgtatgtgacggaaaaacactcagaacccagccactgtgttctggaatcctatctgagtgacaaatattcagacacccatagaagtgttctggaatcctatgtgagggacaaacacccagaaagcagcagtggtgctctggaatcctttgtgagggaaaaccattcagacgaacgtagcagtgttctggacaaacaaacagaatccagcagcagtaatctggaatcttttgtgacggaaaaacattctgaccctcgtagcagtgttctggaatcctgtgtgtggaataaacactctgaacccagcagcagtgttctggaatcctatgtgagagacaaacactcagaactcagcagcagtgttctagaatcctgtgtgagcgacaaagatgcagaacttcgtagcagtgttctggagtcccatgtgagggacaaacaatcagaacccagcatcagtgttctggaatcctatgtgagggacaaacactcagaaaccaccagcagtgtttttgaatcctatgtgagagaaaaactctcagaacccagcagcagcgttctggaatccttggtgagggaaaaacattcagaacctcgtagcagtgttctggaatccaacagtgctctggaatcctttgtgatggacaaacattcagaccctcgtgccagttttctggaatcctatgtgacggaccaacactcagaacccagcagcagtgttctggaatccaatgtgagggacaaacactcagaacccagcagcagtgttctggaatcttatgtgagggaaaaacactcagaacccagcagcaaacccagtagcggtgttctggaatcatttgtgacagacaaacattcagaccgtcgtagcagtgttctggtatcttacgtgagggacatatactcagaacacagcagcagtgttctggaatcctatgtgagggacaaatacacagaacccagcagcagtcttgtggaatcctatgtgaggaacaaacactcagaaaaacgcagtagtgttctgcaatcctatgagagcgacaaacactcagaaaccagccactgtgttctggaatcctttctgagggacaaacattcagacactcatagaagtgttctggaatcctatgtgagggacaaactctcagaaaccaggagcagttctctggaatcctttgtgagttacaaacaaacagaacccagtagcagtgttctggaagcctttctgacagaaaaacatacagatccttgtagcactgttctggaatcctatgtgagggacaaaccctcagaacccagcagccgtgttctggaatcctttttgcgggacaaacattcagaatctcgtatctgtgttctggattcctatgtgagggtgaaacactctgaacccagcagacgtgttcaggaatcccatgtgatggacagacattcagatcctggtaacagtgttatggaatccttatgtgagggacaaacactcagaacccaacagcagtgttctggaatcctatgtgagggacaaacattgagaacccagcaacagtgttctggaatcctattcagggacaaacactcagtacccggcagcagtgatatggaatcgtatgtgaagtacaaagacacagaacccagcagcagtgttctggaatcctatctgggcgacaaacattcagaacttcctagcagtgtcctggaatcctttgtgaggaaaaaacattcagagcctcataacagtgttctggaatcctatgtgaggcacaaacacacagaacccagcagcagtgttctggaatcctatgtgagggacaaacactcagaacccagtagcagtgttctggaatactatgtgagggataaacattcagacactcaccctcatagcagtgctctggaatcctatgtgagggacaaacacacagaagccagcagtggtgttctggaatcctatgtaagggacaaacatgcagaacccagcagctatgttgtggaaacctatgtgagggacaaacacccaaaacccagcagcagatttctggaatctgtgaaggacaaacattcagaccgtcgtagcagggttctggaatcctatgtgagggacaaacattcagaacccagcagcagtgtgctggaatcctatgtgagggacaaaccttcataccctcactgcagtgttctggaatcgtatgtggggaacaaacactcagaacgcagcagtagtattctggaatcctttttgagggacaaatattcagaccctcgtagcaatgttctggaatcctatgtgagggtcaaacactcagaaaccagaagcagtgttctggaaacctttgtgagggacaaatattcagtccctcatagcagtgttctagaatcctatgcaagtgacaaatattcatatcctcgtagcagtgacaaagactcagaaccgaactgccgtgttccggaatcctataggagagtcaaacactcagaacccagcagcagtgctcaggaatcccatgtgacagacagatattcagaccctcaaaacaacagcagtgctctggaatcctgtgtgagggacaaacattcagagcatcgtagcaatattctggactcctatgtgagggacgaccacacagaacccagcagcagtgttgtggaatcctatgtgagggccaaacactcagaacccagaagaagtgttcaagaatcctatataaggcacaaacactcagaaaacagtagccatgttctggaatcctatgtgagagacaaacactcagaacccagcagcaaggttccagaaacctttggagaaatactcaaacccagcagcagtgttctggaatcctatgtgagggacaaacactcagaacccagcagtagtattctggaatcctttgtgagggccagacattcagaatctcgtagctgtgttctggattcctatgtgagggacaaacactcagaacccagcagcagtgttctagaatcctacttgaaaaccagcagcagtgctctggaaacgtttgtgaggtacaaatataaagaccctcatagtactgttctggaatcctatgtgacggacaaacactcagaaccctacagcaatgttatggaatcctatgtgaggggcaaacactcagaagccagcagcagtgttctggaatcctttgtgacggacaaactttcagatccttttagcagtgttccggaatcctatgtgaggggcaaacactcagaaaccagcagcagtgttctggattcctttggacattcagaccctcgtaacagtgttctggaaccttatgtgaaggacaaacattcagaaacacacagcagtgctctggaatcctttgtgaaggacaaaccctccgagtccagctgcaatgttccagaatttttggacagacattcagaccattgtagcagtgttctggaattctatgtgagggatagacactcagaaaccagcagcactgatctggaattcttcgtgagggacaatcattcacaccagtttagcagtgttcctgaatcgtacataaaggagaaacattcagaccctcgtagcaatgttctggagtcttatgtgagggacaaactttcaaaccttcgtagcagtgtcccggaatcctatgtgagggacaaacactcagaacccagcagcagtgttctggaatactatgtgacggacaaacaatcagaacccagaaacagtgttctggaatgctatgtaagggacaaacattcagaccctcgaagcagtgtactagaatcatatttgagggacaaacactcagaacccagcagcagtgttctgcaatctattgtgaggcacaaatattcagaccctcatagcagtgtcctagaatcctatctgagggaaaaacattcagaccctcatagcagtgttctggaatcctatgtgagggtcaaacacacagatcccagcagcagtgttgtggaaaccttcgtgagagacaaacattcagacactgtttgcagtgttcaggaattctaagtgaaggacaaacgttcagatcctcgtagcagtattctgggatcttatgtgagggacaaaccctcagaacacagcagcagtgggctggaatcctatatgaggaaccaacacaaagaacgcagcagcagtgttctggaatcctatgtgagggacagacactcagaaactttcagaggtgttctggaatcctaagtgagggacagacattcagactctcaaagcagtgctctggaatcctatgggagagacaaacactcagaccctcatagcagtgttctggaatcctatgggagagacaaacactcagaccctcatagcagtgttctggaatcctatgtgagggtcaaacactcagatcccagcagcagtgttgtggaaaccttcgtgagggacaaacattcagacactgtttgcagtgttcaggaatcctaagtgaaggacaaacattcagatcctcgtagcagtattctgggatcttatgtgagggacaaaccctcagaacacagcagcagtgggctggaatcttatatgagg

SEQ ID NO: 474387 - DNA, 2890 bp, Homo sapiens
cagcaggcacctggctccagacctggtcacctgtctggagcaaaggaaaaagccatggagtatgaagcacccaggttctcacacctaagacaacatcagataattcatactgaagagaaaccctaccaatgtgaagaatgtggcaaagattttaagcagtcttcagatcttactatacatgagagaattcatactaaagagagaccctacaagtgtgaagaatgtgacaaagcctttaaacaatcttcaaaactgaataaacataagaaaatttatactggagacacaacctacaaatgtgaagaatgtggcaaagccttttcctattcctcaacccttactcaacataacatagttcatactgaagacaaaccctacaaatgtgaagaatgccttactcaacataacatagttcatactggagacaacccctacaaatgtaaagattgtggcaaaatttttaagtggtcttcagaccttactatacatcagataattcatagtggagagaaaccctacaaatgtgaagaatgtggcaaagcctttaaacaatcctcaaaactgaatgaacatatgagagctcatactggagagaaatcctacaaatgcaaagaatgtggcaaagcttttaaacaaccttcaggccttactctacataagagaattcatactggagagaatccttacaaattcgaagaatgtgtggtcttcaaaccttactatacacaagataattcatacaagagaattcatacgggagagaaaccctacaaatgtgaagaatgtggcaaagcttgtaagcagtctttggggcttactatacaaaagagaattcatactgaagagaaaccctacaaatgtgaagaatgtggtaaagccttttactgttcctcaaaccttattcaaaatgacatagttcatactgaagagaaacactacaaatgtcaagaatgtggcaaagcttttaagaagtctttagaccttaatgtacataagataattcatagtggagagaaaccctacagatatcaagaatatggcaaagtctttaaactatcctcaaaactgaatgaacataagataactcatagtggagaggtatcctacgaatgtgaagaatgtggcaaaggcttttactgctcctcaagccttactaagcatacgatagttcatactgaaaagaaactgtacaaatgtgaagaatgtggcaaagcttttaagtggtcctctgagcttcctatacatcggagaattcatactgaagagaaaccctataaatgtgaagaatatgtcagagtctttaaacactcctcaaaactgaatgaacataacagaaatcatactggagagaaaccctacaaatatgaagcatgtggcaaagctttttaagcagtcttcaggccttactatacataagagaattcatactggagaggaatccagaaatgtgaagaatgttgcaaagccttttactggtccttaagctttactaaacataagagagttcatactggagagataccctacaaatgtcaagaatgtggcaaaactttttcttgttcctcaagtttactcgacataagacagttcatactgaagagaaatcccacaaatgtaaagaatgtgggaaagcctttaaccagtccttatgccttattaaacttatgagaattcatactggaaaaaaatcattcaaatcataagactgtggcaaaatcttttaagtattgctcaaatatatccatccaaaatacagcttacaaaacaccacacagtttataataaaagatatttttgcagagggaacacatgtgtaaaaatatttagtcaaaattaagtctttgtaaactttagaaaattcacagtaggtagaactaaggcactggcacttaagacgttacactaaatcagaatgttctgtatagaaagtaatccaaagctaaaactgttggataatttatttgtatataagtttaagaggagtggaagattattttttggagttataattacattcaagaaatctgagaaattcccttcttattaggtaggcatcattcattaacttttccatggaagagtaaggatattaaaatgtaagatgcatattgaaaatctaattggagaggctctttatgtctgacttttaacattgttcatgtgatacatgagttatgtgtttagagtgatattctgcattataattttcatcctactttacactgatgtaaatttaactgcccaaggcttaccagaagctttattttacattatttctaccaaaaattcatattctcaaatattaaaagtggtattctgtattaccatttttcaagtaatgtagtctgcatttattagtacctttcaatgtattttttttttacatggggtaaggttattaaaatgtcttgcagttgattttctagaatactaattttccccagacaaaatatgcagagctatgtttcattaatatgcagagctatgttttattaccaaaacacactactgccaaatgcacaaaaggaaaaaagatatttgtaccctgtgctaaaacagattcatttgcggtatttaaatgacaaaactggaattatttcaacccggaaatcattgtttcaaatttccatggttaaaggtttgctcaagcaaatcttaaaacacagaactttcttggttcttcttgtccttttaaattttcaaaaaaattttaaattagcttgtcaatttttaaattacctgataggattttgagtaggattgcattcaaccataatttaatgagtagaaatgacttttttacaatataaaatctttctattcataaacattgtgtgtcttttttatgtatacaatatttatatctgttttaaaaattgtactttaagtt

SEQ ID NO: 474388 - DNA, 926 bp, Homo sapiens
atacacctaatggtaaatgatgagttaatgggtgcagcacaccaaagtctacttagtgtgctatcgtagtgtggctgagctggcactcagagtacaagatgcaatcctttccactctttcctcttctttctaaagaaagagaagcctcaccccatgaccactggcaccataggacaatggggacaactgccaggctactgctgatgttccctgaagtccctggggctcttcagtcagcttgtaaaagactgggaactggatctgatctatccttctttcaggttagagagccatcttctagtgatggtttagacagtgttccacaaatctctctgccccaagcttttctgctgatggttcactttgaaatgttagttgtgtcagcaattgatagaggtggtttttcttcctgtattcctcctgttaaccaaaatggattagaagacttcctgagtctggccacaaataacctgttgtttgaatgtgttttcaaagcgtcctaactgtgctttcttaatctatttgtaaccacagctttctttttgaaaataattatttccctgattgtcttcttaatatttttagggtttattttcttatttcttcccaccaatcccagatttcagtgtgttgtcatctatgacataaaatagcaaaataataataacaatagtatttatcaaatagttattatatactatgcactatgctaggtgaattacatgcatttttcatttaattttcttgtcagttctatacagtagacactattattacttcccatcttatgtatgagggaagcacaagcatgtatctaaaaagcgatagagcccatattctctatcactgtgctgtgtcaacactttatattacaaagtaccccgatccacagatttattttactgtccataatattcatatcatga

SEQ ID NO: 474389 - DNA, 824 bp, Homo sapiens
ctactgacagcttgtaccatgcacctggaaaagctgccaacactcaatgccagctgtgaaagcagctgggatgggggctgtattctgcaaagccacaggggtggagatgcccaaggctgccttcacattcactcatgactcattgactcatctggagcgacttccagttctgcaagcttcattcatgctgatgttggaaacctggctggcagaatttgggactatgatggaggttctaaatattgaaaactggagccatgaagaagcaccagtctttaccaaacatgttactcagtgtagggaggacatggatgaagctggaaaccatcattctcagcaaactatcacaagaacaaaaaaccaaacaccacatgttctcactcataggtgggaactgaacaatgagaacacttggacacaggaaggggaacatcacacactggggcctgttgtggagggggagtagcgggcagggaaagcattaggagatatacctaatgtaaatgacaagttaatgggtgcagcacatcaacatggcacatgtgtacctatgtaacaaacctgcacattgtgcacatgtaccctagaacttaaagtataatttaaaaaaaaggtgtaagacacaatactcatatagaagatttacgtttgcattgaaattcatgagcttaaaggaagaagaaacattgatagcatttggaagtctttttacagtactttatattttgatagttttacgtataaattccatggataatacagaccttgtaattttatattattttataatatagacctcgtgctactatattatattataaaga

SEQ ID NO: 474390 - DNA, 875 bp, Homo sapiens
gcctattctgaatgcgtacttttcttataatacataactagccatggctgaaaggggccaatgtacagctcgggccgtggtgcagcttgcacctccacagggtgcaagccacaagccttggcagcttgcatgtggtgttaagcctgcatgtccacggaagtcaagaatcgagaagggaaatatggggtcggaatccccacatggagtccctacctgggcactgcctagtggaactgtgagaggagagcccccaacatcctccagaccccagaatggtggatcctccaacagcttgcaccgtttgcctggaaaagccacagacattcaatggcagcccacgaaagccgccaggaggaaggctatactctgcaaagccacagcagtggagctgcccaaggccatggggacccacctcttgcatcagtgtgacctggatttgagacatggagtaacacctgatgtcatagagactaccttagcaattgatagaaactgtattatttaacgtattaatacatcaatgtacaatttggggaaaataatcattgcaggtcacattacctttaaaacagaatgctcatcagggaagggcagtagtttgacatcttttcacactgtgttctgctgagtagttagcaacacgagtcatttcagcaaccttagggcatttttccttttggatttcagaagaccaatgttttcattgaggtaatgaacacttactacgcattcagaaaactcttaacattttattatctgatctgcccattatgaagctattctttcattctttaatatatttgatgattactctcctaaaaaatgaaggaaaattgtttctaccatttaaggcattagtcgtgtaattaaaatta

SEQ ID NO: 474391 - DNA, 1272 bp, Homo sapiens
tccctgacttaactccctgactttttcctttagtgtttattagtgcaacagaatgagtcttcattacattgactctgaggagaatccccactgggcactgcctagtggagctgcaagaagagggccaccattctctcgtccctggaatgctggttctaccgacagcttgcactgtgcacttggaaaagctgcagacactcaatgtccacccatgaaagcagctgggaggagggctatacctgcaaagacacaggggcagaggtatcaaaggcccataagaacccacctattgcatcagtgtgacctggatatgagacatggagtcaaaggagattattttgaagacaaaacatgtgaagtaaatgttcttcaagacactgacatcaggctacaaaagacagaagttgaacaagccatgcaggaacaatggcgagcctctagcctgatccagagcggcaatgggcaactcactggatcagaagtgcagcagacaccctgccggatctggaagggtggaagtcagtggcaggtctgctacggcagcgatcggcagtggttgacggcgagcaaaagctcacctggaagtggaacaaacacggaccagaagagtgcgcagttgcaagatttaatagagtgaaaacagagctcctatacaatgggaggggacccgaagtgggttgccactgccagctcgaatgcctgggtttatatccggataattgtccctccctctgtgctctcaggtgatagatgattgactatttctttacctcctgcttttagcctaatttatattttatctggggacaagtttttaaaattctgtgacaacagggaagagtgattgttataacattccccaactaaagagaaaaatgactaaataggtggagaaaaaggaaagtggtagcgcatagagtggtagcaacaaatagtggtatttgttggtattctgtcattgttattgtagacaaagaaagcagtgtgaagctggaaataatttctcattacaaataagataactacttcagaaatatattgttaatagttcaaagtagtcaagagagcaatattgttattgagctcaatatgtctaattataattgagttttatgatatttaacagtgatctttgataatattttaggctatgatatagagatggattttttccctcgtaagtcaaaaattagaatacattaattgtagaaaatgctttgaacaaataaatatgtgagttttctgttttcccagaaaaaggagagctttatc

SEQ ID NO: 474392 - DNA, 771 bp, Homo sapiens
ttcaacctgcaaatggagaatttcccaaatggagaatttcccaaatggagagaagcagatcctactgtctggtacccacaagtgacattcaccagaccagatgcagatgacaaattccaaaggctgttcttgctaggcaatcaggaacttggttggggatgggagtggcaggataagaaagagatcaaaatccacctccagccaaaaaagggtcaggtagctgctcaagagggcttctcaatctcctgtcccatggcagccaagctacaagcaacatgttcccagtcaaggaaccaaaatctgttaccaaaacaccagctctttgagctctctgtttccacatttcacctcttctgccctgggtcttgctctgtcacgcagggtgaaatgcagtggaaccatcatgactcactacagcttcagcctcccagactcaagtgatcctcccacctcagcttgttgagtagatgggactacagatgcacatcaccatgcccagctaactttttattttttgcagaagcaggatctcaccatattttccaggctggtatctaacttctgggctcaagtgatctacctaacttggcctcccaaagtgctggattataggcatgaaccaccatgacctgatgaaagaaatttttttaaaccaaactgttttacccaaaattttaatccagagctttcattagatgacatatcagagaaaataaagttgagccatataaacatgtctcttttagccagaaatataatttagattcaata

SEQ ID NO: 474393 - DNA, 1195 bp, Homo sapiens
agcagccaggcgttagcgtcaaccacagctgtccaggacagcctggacgcataggcgactctcctctgccacctagcgctgaaaagaaagtgttcagggatgaacaatagctccatgaagttagaatataaggagattactggagaggaaggacagcgagtgaccaaagggcactacttgtatcaaagagtaaaagacacatggaattcaattgcttctgggcatggtgttgaagaccaagcagggcaaagagggcatccgagtgagtgtgggaaggcatggggactcacagcccaagcagaatggggagggcatccttacagagagtcagcttggtgtcagagcccatataaaagaggagatggctctatgggaagcaagagcctaggtggggagttctcaaagtgtggtccttggaccagcattacctggaaattgtcagaaatgcaaattctagattcccattccagacctactgaatcaagaacttggacttgggctgagtaagctgtgtttttataagctctccaggtgattctgatgcacactcaagttgagaacctgctttataataactttttaatagctatgtaacattgcaaaagttatctaaatatgtatgtttttaatcatagttaaaatcatagttatctaaatatgtatgttttttacattacattttgacattacattccctttttatgttacatacaatgttggcaataaaattgttcatatatatggggctttcttccacttttcaattattctttagagtagaatgattagggcaaagattatgaccatttctacgtcaccttttctgtcaaatttctttctaaacacacatgtttatatgcctctcccaaaatataggcaaagaagttttcctataacccaaccatcttgaggtagtatccttttaacatgaataatttaactgataatctcataactttaaagtgataccttgattcggttagcatatttattactaataaatgagaatactttttctcgtttgtctggaatttatattctcactgtgtgaattataattttgccttttgtccatttattagtcattttgtagttcttaaaaatgaagcactttacatatatatatgtattgacacactacttattttcttcttactctttttgtaacatatttatgtgaatttgagacaatatc

SEQ ID NO: 474394 - DNA, 792 bp, Homo sapiens
ggtgtttaatcaatgtgcaataatgttagctcttcctgtggagtatctgttgtccaccactgtaaaatcttctggggcctacctctcaacccaaccaccacttggtgacgatcctactgaaggcttcagtaggctttacccagtgaaggcgattttctctagtggtattcaaagggacgtgggccctaagcccaataacactgtggtttttgcagacttgagagagcccaaggaccattgcgtattccctggatatcactggtggttattcagggcccaagggctctttagtcagtcgatgatgaatcctgctgggactgggtccttccctcaaggcagcagccacctgaaactgagcaatggtgatacaagcacttctgtggccatcaccactgggtgcactgtgtcagacctgaatccagcacaggactgggccttgcccaagatccttcccttcaggtcaggaccctcagctgcaggtctgttggagtttgctggaggtccactccagaccctgttcgcctgggtatcagcagctgaggctgcagaacagcagatattggtgaacagcaaatgttgctgcctgatcgttcctctggaagttttgtctcagaggagtacccggcctgttctcattgcttttgtggataagcagattttcagaggcccttgctcttcactgatctggaagttcttcgcatagttatttttacacagaggactgaagtaactatgtttgattatagtatgttatgcaggtgcccctaatttggtctcagtccagttggccca

SEQ ID NO: 474395 - DNA, 1321 bp, Homo sapiens
gccgtcttgatatatcctcacatgacaaagagaaagagagaggaaggagagggaatatctctggtgtctcttcttgcaaacccaataaaaagcttcttgaaagtgaacagcaaatcttacaaatgcacaagatttcctaaagtcgatgaaaagatgttagagaattacgcagagttacgtagaaacagggttctagcagaagagcagcttacaactgaagaacagaaaatccagaaggatgatgttataatggcttcaaaagataattatttgactatccaaggattgacagagaccttgagaaaagcaataaggccctcaaatagtttttcacaattgcttgcacattttatgaaacaaattgctatgtgggagacaaccacatgccaaggaactgagggtggctgtgggccaatagccaacaaggaactgagggcctcaatgaactggatcctaccaactgtcatgtgaggagatgctagaatatcctctgattgtgtgtgtgtgtctatgtgtgtgtgtgagtgtgtgagacagaaagagagagagccagagagagagagagacagacagagagagagagagagagagagagagaaatatgtattagcctgcaggtcgggctgctgtccatggacttggggaataagggaatgcactagttctatggggctttgcacaaatacgctgccagtggactgtgaaatctgtttttccttagaatcagcagttcagaagttggaatatctacttaatgtgttttttaaagcaatactgttttggattataaaattgatgaacgcattgcaaagaatttaaaaactaaagaaaatataaataagaaaataaaaattacccttaatttcaccgggtattttgtcttacctatacgtattttagattttcttcctctctccttccctctcccttcccctccctccttttctccctccctctcttccttcattcatttcttctttttttccgatacatttgagacctatttagcattatatcctgaacattatctcataacattaatttttttcaacaataacattttaaagaactatataatattccagaaatttactccaggaaatttattcaatcccccatatgagttgttttctattttttggtgttatcactctataattaactaatgcacagttctacagtggacagatttggtagttttgcctttcttttaactagatttatagaagtagaattattggctaaaaatataaaattttacattattgtttacaggtatggccaaattaattctgtgggactgatatagatccacagtcct

SEQ ID NO: 474396 - DNA, 767 bp, Homo sapiens
ctcactgtgagggtccgcagcttcattcttgaagtcaccccatgtatgcattccaagtcttgtggagagctgcatggaaaagctgcagctgtttgcaaggggggctctgggagatgtgggcacataaggcgctgcttaggatcatcaggcagtgttacatgtgaacatagcaaaacggccattctgttgctctgtgctcacagttgtgcggaaggcctccgttgctctcacacaagtgaacaggagtgctttgtctcctggaagccgaccctgatcctgtgtgtgaagcatagactttcagcttttgcatgctctccccatggcccggactgccacacaccaggctgccttgaggaatttggaaccaaacatgaaaagtctttctcaacaatagagggaacattgctttgccctttcacacatcagtctttcctggtgaatggcttcccggccttctgattcttgccgtatggaacaattggcctgttcagttaacttgccagcagtaatcagttattttctcctcgccatatatttcaaccattctttttggaggagaaagaaattaaagaaacaaagggaagtggctataaagaacagaactgtcagaatagcaagtgtttgagtaatttgttgggtccttggtttagggttgattgattttagcactaattttggtttggagtatttcttgggacaaagaaaccctattttaaactgcatctccattgaagattgtgattaccagaggggaaatgctgtgtaac

SEQ ID NO: 474397 - DNA, 868 bp, Homo sapiens
ttctcactgattctacattacgtaatttggattatgttctgagcattttgagtgttataaaactctgcgtcttttttaaatttgatgaaagttgttaaaatttttgctggagcaggcaatcaaactgttaggttaagaccacaaattccaacctctacctgtgggaactgttgcaaatgtagtttccatttcttttcttttcctcctcctccccctccttcttcctcctcctccctcctcctcctcctttttctttcttcttcctcttccctcacctcttctttttcttcttctccttctttctcccttcctcctcctcttttcttcttcttcttcttcttcttcctcttcttctccttcccccctcctctttttcttcttctctttctttctcccttcctcctcctcctcttcttcttcctcttcttctccttctttccctcctcctccctctcctcctcttccccctccttctccttcttctacttcttttcctccttaacatttatcagtttattataaggaatattgcaaaggatagataaagatgaagagatacatagggcaagatatgggaggaggggcgcagagcttccatccaccctgtgggaaccttcacatgttcagctatctggaagctcctcatttccatttttaaagcctttgcagtgcaattctgatgtgtcccatatgtgtccctcagtggctcaagcatgcttgtgaaggggagttggagatttggaattgttttggtgacctccaggaataaaactaggaaattcaagggagctggtttgtgaaggcttctaattagaagtgccctcaaatgccttcatatgtagtgatgtccctatcaacagaggcattc

SEQ ID NO: 474398 - DNA, 987 bp, Homo sapiens
gatctcctgacctgagggttgcaatgatctgtgggaaagtgtggggtcctggggttgcacattcactcaccatttctctgggcgggggaggttcccacggttccatgtcactcccaggagtgctgtggaatataaaagtaggaatagcagtgggaagacccttgcaatcactcccagatcacagtgcagaacaagggcagtcatttcttactgctcctcacagaggatccagcagaggacagccaaaaagttcaggcagcatttggaagttgaaagaagctctcagtgaggtttcacattataacctcaggtggggacaaattccctttttcagagctagggcaggggagagtgaaaagagggccatgagtgcaggagttgcaagcgcaggagccgtgggagaaagatccacaggtacaggatctgcaggtgaaagatcctggtacctggctttacagcagcagggagaggtgtgtcctgaaagacacgattacaattttcatgggcaaagcttatgactccaggcagtgggctcaagtgttcatcatgtgtgggggccgtatttgccaactataatgtgaagagatttcacatgtaatttcaattaattctaacaacaattatgaacttatgtctattatcatttgaattttatagatgagaaagctaaggcattgaagcccatacagctaataaaggacagcgctgggatgccagctttcagaagctttgcggaggttgaacacagatcagaggatatgagatacttgtgtttctagatctcattgagtgtctttaaaatatatattttgaattctttttcaatcatttcaaagttttcattttgtttaggatccatcgttaaagagctaatgtggtccgtcggtggtatcacaacattctttcttcgtaatgctggagttcttgtgcttgttcttcctcatctgtagaagctgtcacttcttatttttgaatttcctttcattt

SEQ ID NO: 474399 - DNA, 579 bp, Homo sapiens
gtggccacctcaccagtgtcatggctaggaacgtgggctttcgtcaagaccgcctgggcataccccactcccgcctgggtggggtcctggaggcccttctatccacccaggaccttggctccgtccaatcttcctcttcctggagcagacgagaagactttaggagccatggaggaggggagagggtgaaagaaaatggccctcggaaaggcacagccacaaaaccagcgcacctttcttttgccatcattggtggcctcacgactctgctgcagccttgtttcttcttccacgtcaagctttgtttcaagtgcctttctctccgcatccgctgtcgccggcgtttcaaccgtcctctctgggaagactttatttcccccttttttccttttctcttcatcttctccaatcttaccctcttcattgtcatctccgtccgacccactgacatcacagcctgatatttcttccccttctgtgagcttctttttcaggtcttctatttctttctgaaattgatgaagcaaagcatccttcagatcttcattaaatctagctttatttttaatactttttttt

SEQ ID NO: 474400 - DNA, 1053 bp, Homo sapiens
gccagtgccacaacagcagagagagaaaggaatagcctatgccaaggcagttattagagtgtcctgaaagttgtgagtgcttgctggcaaggagcagaaataaagcactgctgatgagggaagggaggatggccttcacccacatccgtggatcctgctcagagctccaaatctgcacatgcaccaaccagattcggaagctgtggaaattagtggatcctctgggaacaatgcttctttataatgatgctaagaccttaaaaaacaaacaaaaaaacaatcttcatgaattataccaaagaagtgttgagtggaccagatggctcagttataaagaggattgttgctccttgcatcatcctttgaatgtgcaggtgggaaaagttcagggactcttctcggggagctcatttaataagtttcctcaagtggagattatcaagggccccctcaggtctcaggctgtaacctaaacattagtgattaactgtgcaaagtttgctactgctaaaaggtgatgattttcttcatgctattggctaaacagactttggcataaatgtctccaaatgctagagttctaggtacttaccgtgatgcaggaaagggtctggaaacctgagggtccttattggagccaccagtctgtgctgggagatcttaggtgttatttggaaagcatacttttagtgcctactttgtacctaagcttgtgctaaatgttgaggaggagtccagagaaagagtaaagtggagaatttaaactttaaaataattattataagtaatccatcctgcaaaacaatctgtcctctgagttcttggaggacaatcttgatttacttttcttcccttcaatgaaggtgaattgtaaaatttctgcatattactgtgagaatccataaataagaataattaagagtttggactctggagttaaattatccctgaattttatactgtttactaactatataactttgggcaaattaactactctcttaatcctcagtttcttgattagtaaaatgagaatgataatagtcctagatc

SEQ ID NO: 474401 - DNA, 590 bp, Homo sapiens
tgctagcagactgattctctctctctctctctcttccccacctcctttctccaaggaaatggtatttagaccagaagaggccctttggaattataatgaggttatgggttttgaggaggaagaccacagtgagggtgtatccggcagagcaacttccaatagtgtcgatggtgtcagaatgagcaggcccataaatcagccagggaggctgcaccctcactgtaaaagtgaaggggactttcagccgcattttcttcttgctgttgaaagtaaacagggcataaatcttgctgaagaagaaggtttctatccagccacctgcaaacaccccagcagtttggaggacagtcggcttacaccttcttccactcaaaacacagcacccagctcaggaccaggcacactgtgttcaagtattgctggtagtgggcccccgggggccccacacctccagtggctttttgtcaaagaagttagtctgcgatacattgaaattagatagcttttactacagttacaatgtcctggccacatgcagcaggcactgtcctaaaatttactatccttagtgaatatatattttatatgtg

SEQ ID NO: 474402 - DNA, 673 bp, Homo sapiens
tctggcaccaccatttaccatctgtgtggccttaagtcccctcacctctctgggccttagtttccccgatgatcacaatagccttgctgtcctccctgggctgtgggaaggacatgggaggaaacctgtggaaggactattcaatggtacagggctgtgcaaataagaccatttgtttgttgattgattttgaaaactctgcctcctgctcctggcgccctggacataggtacccttgctcctcactgctgcatctgaatggaacttcaaacatgcagtggcctcacacatacaagtttcaaggtggtcaccagagaatcagaccagagaccaaatggtgtgcaaagaggaaggacagaatccatcaagccccaggcccccagcttgagggcattaagggcaaggagaagggccagcaccattcagacctccagggtcccctccagaaggtcctcccagggaactctggtctataggttttattgttttatgttttacgtataagttaattaatgatccatttttagtctttgtgtcttttgtgagctatgtttttgtagttttcagtatacaagtcgtacttcttttgttaaatttattcccaggtatttatcatttttgatgctattttgaatgtcagttttaaaatttcactttcagattgttcatttct

SEQ ID NO: 474403 - DNA, 544 bp, Homo sapiens
aggggtgtgttgcaggtgattcaagactatgttttctacccccttcagtgcctcttttcttactatgatgttaaaaacagatatcagatatagtctaattacaaagaaagcactaacttgcctctgtggtaacagggaatggaatgggccccaagcatactacagcagctctatggaaaagtggccagattgttacatgggtgctcccaatagcaacttgacaactccccagatagagagcctccaggggcaactgaaagcctggcagtggaactgcccttgccacccttgtactaatgaaggaccaaagaccctaagtgccttatccatacctccaacaagctgcagtcaacccaaggagaagtgtccagtctctctcccaagggttccccctgccccctactgctcatcacaagacaggaaacccctggcttgggcccatagaacagaccctccatcctaggctgattgcactgagtgattgctggcctgcatctctctgggttggggaagggacacaaacacggagatcatctcagagctg

SEQ ID NO: 474404 - DNA, 474 bp, Homo sapiens
ccagaataggtttctggaaacatgaacaaagatgacggcccagagacaacagaaatttatccaaagaggataaaaattcctttccatagtggttcagtacagctgttctatgaattcagaagagacctgaagtctcctacccgagagttaggcacctggttactggtgttctttgcactggccagggctcagaccgtaagatctagtgttgaaagtgaatcacatcattcatctgatcaaaaccctcgcagagctcccatgttccttgggaaaaaaaacacagttcttttaacagcctgcaaagtcctctgtgacctgtcacatagtatggaggaaagtttaaaaggagttgtgctgaaacagttggatatttatatgcaaataagtaaacctaaacccagaccttaaccacaattaatcaaaatgtatcatacacttaaatgtaaaatgcaaaattataaaacttcttggaaa

SEQ ID NO: 474405 - DNA, 621 bp, Homo sapiens
tcatcagttaaggcaggaacaggccattttcacttcttttgtggtggaatgtcatcagttaaggcaggaaccggccatatggatgtgagtatctttgtggcgttctctgtatttcctgaatctaaacgttggactgccttgctagattggggaagttctcctggagaatatcctgcagagtgttttccaacttggtttcattctccccatcactttcagaatgaatggtaccatctcctccttgtacctctggtagaattcggctgtgaatccgtctggtcctggactttttttggagacgttataactgatactgtagaaattccaaggattattagaggcaacaatgagcaagtatatgacaataaactggaaaacctagaagaaatggataatttcctagaggcatacagttttccaagattgaaaaatgaagaaataaaaaacctgaatagaccaataacaactaatatgattgaagccataataaaaggtctcccagcaaagaaaagcccaggacccgacggcttcactgttgaattttaccaaacattttaaagaagaactactaccaatcttactcaaattggtctgaaaaatagaggaggaaggaatacttcc

SEQ ID NO: 474406 - DNA, 591 bp, Homo sapiens
ggaagcccatgctgccagcggttgggggccgcaggctcagacaggaaatgcccccgagtgtaccccagggccctctgcaaaggcctgatgctttggatgaggcctggcgccattttgaagctgggcctgactctgggactctggcctggttctggggctggtggcctgggatctggggactgctttgtcacctgcctgggcaggcttgggtcctggtgcctgcaatggccccagcactcatgccccctggactttgcgtcaaggagctgtcatactcatgccaagctcctgatgggtgtctgacccactcaagcctccgggctttctgtttctcttctctgagcctcacattgctcacctggagaatgaggaccataacgatatcaggactggaaggagctcagagatcagggcaccgtgccctctgggctcgctgcgtcttcctgcttcccagccccaatttccctcccctttcctacctccagcgcatcttgtgtgagacgcatggggacaggagggtggtaactccaagatgagagtggcagcaggggcgggctctgcagagggctgtcttccgggatgcagcctgcc

SEQ ID NO: 474407 - DNA, 689 bp, Homo sapiens
ggtgataatgatggtggtgatggtgataatggtggggatagtgatgatggtggtggtggagatggtgatgatggtgatggtggtggtggtgatgatggtggtgctgctgctactgatggtggtggtggtggtgatggtgacagtagtggtggtgctggaggtgatggggatggtgatggtggtgatggtggtggtcgtgatagtggtggtggggatggtgatgatgatggtggcagtggtgatgatggtggtgatggcaatgatggtggtggtggtgctgctggtggtgctggaggtggtagggatgatgatggtggtgatggtggtggtggtgatggtagtggttgtggtgatggtgatggtggtggtggtgctggaggtggtgggggtggtgatggaggtggtggttgtggtatgaagatagtggtggtggtggtggtggtgatgatggtggtggggatggtgatggtgatggtgatagtagcaatggtgatggtggtggtggtagtggtgatgatgatagtggtggtggtggtgatggtgatggtggtggtggggatggtgatgatagtggtggtggtaatgatagtggtgctggtggtggtggtgatggcggcgatggtggtggtggtggtgctagaggtggtggggatggtgatgatggaggtggtggtgtttatggtgacggt

SEQ ID NO: 474408 - DNA, 1067 bp, Homo sapiens
ggtgataatgatggtggtgatggtgataatggtggggatagtgatgatggtggtggtggagatggtgatgatggtgatggtggtggtggtgatgatggtggtgctgctgctactgatggtggtggtggtggtgatggtgacagtagtggtggtgctggaggtgatggggatggtgatggtggtgatggtggtggtcgtgatagtggtggtggggatggtgatgatgatggtggcagtggtgatgatggtggtgatggcaatgatggtggtggtggtgctgctggtggtgctggaggtggtagggatgatgatggtggtgatggtggtggtggtgatggtgatgatggtggtagtgatgatggtagtggttgtggtgatggtgatggtggtggtggtgctggaggtggtgggggtggtgatggaggtggtggttgtggtatgaagatagtggtggtggtggtggtggtgatgatggtggtggggatggtgatggtgatggtgatagtagcaatggtgatggtggtggtggtagtggtgatgatgatagtgatggtggtggtgatggtgatggtggtggtggggatggtgatgatagtggtggtggtaatgatagtggtgctggtggtggtggtgatggcggcgatggtggtggtggtggtgctagaggtggtggggatggtgatgatggaggtggtggtgtttatggtgacggtggtggtggtgaaggtgatagtcatggtggttgtgttggtcatggtggtgatggaggtggtgatggtgacagtggtggtgattgtgacggaggtggtggtgatggtggtggtggtgatggaggtggtgatggtgatagtgatgggtatggtggtgaaaaatggtggtggttgtaataatgatggaggtggtgttcatggtgatgatggtgatggtgggagtcatggttatggtgatggtggtggtagtggtggtgctggtagtgcttgtgctagtggtaaagctgatgttcatggctcctctcagttctctgctcccatggtctctaaataccatgtcccactcaaaggcaccag

SEQ ID NO: 474409 - DNA, 535 bp, Homo sapiens
tggagccagaatctgagaaggctgggaagagggggaagtaccagctgcagaggtttgaagggcgccatgtccctcacctcttcagagcttcttctccctgttgctaccgccaagagaagagagcaacaactgcagctgctactgtttcttgactctggcgaagaaagtgggcttggggccaggcctactgtccagggctcccagtggaagatgctagaagagggcagcgcacactctctcaccgtcatatcgagactcccttctgctgtggagccctcactggcctcttcatttcaggtcatcaggtggagagcacgctgcagagaggactgttcccatgcccaggagaggcttgcgagtgagctccgtgtaatcactcactggcagaatgcagtgcagggggctggggttacagtcagcgaggagcgaggcacgatgatgctttggagtggaagtgagctttcaaatctcagcagccctgagtgattcctccacttagggccagtgtgtgtgtgatgggtgtggttgagagctg

SEQ ID NO: 474410 - DNA, 1412 bp, Homo sapiens
ggcagcctcctctcccaggctgtccccgtggactggccagcaccccctgggctccagcagcctggcagtccctccctgtcgagcctgggctccaggtccacagggcctgcccccgttctcagttctgatggtcacgtttccctcctgccagccctgtaggcagtggcctcctgcgggtcaccccatggaagctcagagcccccttcacctgtggcctccagtgggttctattgaacaaccggtccctcaggtgcaatcctacctggcagacaaccatgccgcttcccaggggaccccagccagcatgggcattgaggaggggacagcgcacggaagccaggcaagggctggtcacgattgtgctagttgatcagctagcagtctacgcaatcacaactacactaattgatcagctaacagtctatccggtcatgactgccctaattgatcagctagcagtctatgcaatcaggactgttccaattgatcagctaacagtctatccagtcacgactgctccagttgatcagctaacagtctgtccggtcacaactgtgctaattgatcagctagcagtctttgcaatcacgactggtctaaatgatcagctaacagtctatccagtcacaactgcactaattgatcagcaaacagtctatccagtcacgactgtgctaattgatcagctaacagtctatgcagtcatggatgctctaattgaccagctagcagtctatccaatcatgactgtactaattgatcagctagcagtctatccagtcacaactgctccaattgatcagaatgccatgaagcacagagcaagagactcaaaccatgctgaggaatcagatgcacaattaaaaacctcccttccttctcttctccccagaaagaatggctgctaagatttttttctttatccttccataccctttttctgcatgcatacagggttaaaggactctcttcctgccttgagttatatgaataaaaacaagtgctcagggaccccacattctaaaataaggtgctgaggtgcccccatgagaagggtctgccagccttccctccttccccacctccaggcgacatgggggctgggacagtcaggggagcaagaggcggcgtgtgctgggggaggtggaagatggggctgaagaggccagtcacgccgcaccccctccccactgcgtcagtccggagtcaagtttttaaattgacatctaaaggatttcatcataagtgaaaatagttgcaaaggatttaactttcagtgtattataaacattaatgtatcaatcttttaactgtattgaatttttgtactataaaaattttatccccaccattatccattttaaaatgcaccaagttctttaaaagtttgaactttacgttttacctttttt

SEQ ID NO: 474411 - DNA, 615 bp, Homo sapiens
gttctgacgccaagaagaggcatgaagcccagcaggcttctctggatgctgggaacacaatataccacatttgggcatgaagtctcacactgctccagggaaaccagcaatgctgccagatgacaccccccgcaagtggatgcctgcagcattaggacagcttcattcagggcagccaggaggacgctgggggagcttttcttctctgtggaaatacttgggagcagtgcacctagtttttcacttcttctgggaagagagagatgcagagatatggactgatgtggattctgggaactggaaaggacatcactttggcatctgcacccagcaaggactgtatgagaagggaaatttgcaggcccatgtcactcccaaacgtgagcatcaaaactgtacagaaatcatttgcaaatcaatgtatacaaaaatagcaaacacaaatattcaggtttatcccttgagtctgcttcttggtatcaccatattggtaacagctgaattttggaggggacacattcaaaccacaggagatatctaccaagactctacagcaaaatcatgcatatctgtgaaaaaagtggaaatttccccatttacggggcgatgaaatat

SEQ ID NO: 474412 - DNA, 547 bp, Homo sapiens
cccaataggctccagtgtgtgtttttcccctccctgtgtccatgtgttctcattgttcagatcccacttataagcgagaagtgatacttttcctgaggtggattggactcaggaagaaagagatgtgggaacctggatgggttccattccgagggcaagtgataccagactataagctctgccgccagtaccctcagaggcaaggtccacgtgtgttggcaaaactgaacataagctctcaccccaaaggactccgcgatggaggggcagcaggcagaggaaatatgccctttgctgagaagatgcattcagccagctgtggagtaggagacagtatggggctgggacaagatttcatacagaagaaagaagtgactctacatttatatgaattaggagctggagtcaggacgaggggccacgggagactgagaggctacatggggaaaaagacgagagacagcaggaaacccactggttacttggaaaagagccctgatgtaagagaatgtcttgtgggttttttttgagataaacactgtgggct

SEQ ID NO: 474413 - DNA, 702 bp, Homo sapiens
ttctctctctctgtcttgctttctcttcttattcattagttgagctttgagactttacataatggttggatctcaagagggcacatatggaagctgcaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattatagagggctatattcttactgtaaagatgagaggatgtttggaaacattttcaagcagtgaagctgttaaatctttgaggctagagtgcgttttctggttgaatgtcagcacgtttgctttggatgagtttgtgtgctcttgatatttgacattctttggccttagaagccacttctgttaccacatgttcattagcagatgatgactgacttactcccataaaaactcatacctttgacggagatattttaaaagtttttgtttatttgttttaaggctgcttttctctactaaaccaatggagactcatttgctcccctgatagcaacccctaaattcttctgtgttttttattactgtcatttc

SEQ ID NO: 474414 - DNA, 594 bp, Homo sapiens
ataattagttgcaaagatggctgggaaatgtcattccagctacaatcctattgctctggagaaagcagaagtgaattttgatgatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtgacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttgtggtaaatgaaaactacataacagctgccataactcactagtaaaacattttagtctttatattctttcaggttttataccattaaagtataattgtattctgtatagtaatatgcttctgtgaaatccctctcatttaatccatttcttcctaaagttcttaaccttc

SEQ ID NO: 474415 - DNA, 814 bp, Homo sapiens
cctcatccgaatgtctgtcaccagcatcaaagaccaaaggttgataaatccatgaagatgaggaaaaaccagtgcaaaaaggctgaaaattccaaaaaccagaatgcctcttctcctccaaaggatcacaacgccttgacagcaagggaacaaaactggatggagaatgagtttgatgaactgacagaagtaggcttcagaaggtgggtaatgacaaactcctctgagctaaaggagcatgttctaacccgatacaaggaagctaagacccttgaaaaaaggttagaggaattgctaactagactaaccagtttagagaataacataaatgacctgatggagctgaaaaacacagcacgagaacttcatgaagcatacacaagtatcaatagccaagccgatcaagcggaagaaaggatatcagagattgaagatcaacttaatgagataaagtgtgaagacaagattagagaaaaaagaatgaaaaagaaggcaaaaagcctccaagaaatatgggactatgtgaaaagaccaaacttacttttgactgatgtacctgaaagtgatggggagagtggaaccaagttggaaaacactcttcaggatattatgccggagaatttccccaatctagcaagacaggctaacattcaaatttaggaaatacagagaacatcacaaagatactcctcaagaagagcaaccccaagacacacaaatgtcaaattcaccaaggttgaaatgaaggaaaaaatgttaagggcagccagagagaaaggttgggttacccacaaaaggaagcccatcagaataa

SEQ ID NO: 474416 - DNA, 908 bp, Homo sapiens
aagattaattctgccatttccatctagcgcagggccatgctgttgaatgagtggccatgtgggatatggatccagtactgtaaatatgaggcatttcccggctcctgcagtgcctggcagtcagcagcacctagtagccagcagctgcctctagagcaccggttcccacccctggccaggtttcgtaacatttgcagcttcttcagtgtctggctcctgcagtgtgtagttcccagcagcaaccagcagagggcagcctctcctggagccacatcagatagctttgtagcaaggtcacaaaggcactggggtgaggatgtttgtcgggttccaggaacagagagacccaaccatgggatcccagtgggtccatctgaggaccagagactgtggtacagagagcagggcttggacttcctgggaatttgccttttagcctgccaggtcccctatcctgccccaatagaaaccccaaacctcaggctccagaggagaccggcagagcagcagagcagcagaccagcagaccagcaacagcagaacaaccaggcagagaaagggagaagaggcgggacatctggatgccgaggggagtttggccaggggccaattggacgtttgggttgcttccaacttttggctaccataagtagtgtggtcatgtccttgtagacttttgatttttttttttttcagtcagcctttaagatgtgcagctcatcatatcatgctgtaatcaagatgtgacaacagtcatgtcatgtcatgccacccagtcctttggctgtaccaccaatgtattgcataaaaccactcgattactcttagtttacctcttaaatttctttcactttactcccattgtcaccacctgtaataatttgctatggctgccataacaaagtacc

SEQ ID NO: 474417 - DNA, 2828 bp, Homo sapiens
gaagagaatcttcgaacggacccgaatggaatcatctaatggaatggaatggaataatccatggactggaaggcaatcatcatcgaatggaatcgaaaggaatcatcgaatggactcgaatggaataatcattgaacggaatcgaatggaatcatcatcgcatggaaacgaatggaatcatcaccgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaaatggaatcaccgaatagaatcgaatggaacaatcatcgaatggacccaaatggaattatcctccaatggaatcgaatggaattatcgaatgcaatcgaatggaattatcgaatgcaatcgaatagaatcatcgaatggactcgaatggaatcatcgaatggaatggaatggtatcatcgcatagaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaatggaatggaatggaacaaattatggaatgaaatccagtgtgatcatcatcgaatggacccgaatggaatcatcatccaacggaagctcacggtatcaacatcgaatgaatcaaatggaaacaccatcgaattgaaacgaatgttggaatcattatcaaatggaatcgaatggaatcaccgaatagaatcgaatggaacaatcatcgaatggactcaaatggaattatcctccaatggaatcgaatggaattatcgaatgcaatcgaatggaattatcgaatgcaatcgaatagaatcatcgaatggactcgaatggaatcatcgaataaaattgattgaaatcatcatcgaatgtaatcgaatggtatcattgaatggaatcgaatggaatcatcatcagatggaaatgaatggaatcaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaataatcgaatggaattatcatcgaatggaatcgaatggtatcaacaccaaacggaaaaaaacggaattatcgaatggaatcgaagagaatcatcgaatggattcgaatggaatcatcgaataaaattgattgaaatcatcatcgaatggaatcgaatggtatcattgaatggaatcgaatggaatcatcatcagatggaaatgaatggaatcaatcatcgaatggactcgaatggaataatcgaatggaatggaatggaacagtcaatgaactcgaatggaatcatcattgaatggaatcgaatggaatcatcgaaatcgaatggaattatcatcgaatggaatcgaatggaatcaacatcaaacggaaaaaaacggaattatcgaatggaatcgaagagaatcatcgaatggacccgaatggaatcatctaatagaatggaatggaataatccatggactcgaattcaatcatcatcgaatggaatcgaatggaatcatcgaatggactcgaatggaataatcattgaacggaatcgaatggaatcatcatcagatggaaatgaaaggagtcatcatctaatggaattgcatggaatcatcataaaatggaatcgaatggaatcaacatcaaatggaatcaaatggaatcatggaacggaattgaatgaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggaatcaacatcgaatgaatcaaatggaaacaccatcgaattgaaacgaatggaattaccatgaaattgaaatggatggactcatcatcgaatggattcgaatggaatcatcgaataaaattgattgaaatcatcatcgaatggaatc

SEQ ID NO: 474418 - DNA, 1251 bp, Homo sapiens
gaagagaatcttcgaacggacccgaatggaatcatctaatggaatggaatggaataatccatggactcgaatgcaatcatcgtcgaatggaatcgaatggaatcatcgaatggactcgaatggaataatcattgaacggaatcgaatggaatcatcatcggatggaaatgaatggaatcatcatcgaattgaaatgaaaggaagaatcatcgaatggacccgaatggaatcatctaatggaatggaatggaataatccatggactcgaatgcaatcatcatcgaatggaatcgattggaatcatcgaatggactcgaatggaataatcattgaacggaatcgaatggaatcatcatcggatggaaatgaaaggaaatcgaatggaattatcatcgaatggaatcgaatggaatcaacatcaaacggaaaaaaacggaattatcgaatggaatcgaagagaatcatcgaatggacccgaatggaatcatctactggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaatgaaatccagtgtgatcatcatcgaatggacccgaatggaatcatcatccaacggaagctaatggtatcaacatcgaatgaatcaaatggaaacaccatcgaattgaaacgaatggaattatcatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcagatggagtcatcaaatggactggaatggaatcattgaatggactcgaaagggatcatgattgaatggaattgaatggaatcatcgaatggtctcgattggaatcattatcaaatggaatcgaatggaatcgccgaatagaatcgaatggaacaatcatcgaatggactcaaatggaattatcctcaaatggaatggaatggaattatcgaatgcaatcgaatggaattatcgaatgcaatcgaatagaatcatcgaatggactcgaatggaatcatc

SEQ ID NO: 474419 - DNA, 2204 bp, Homo sapiens
tgaaatggaatggaatggaatggaatgaaatggaatggaatggaatggaatgaaatggaatggaatggaatggaatggaatggaatggaatctacccgattggaatggaatggaatggaatcgaatggagtagaatggaatgaaatggaatggaatggaatggaatggaatggaatggaatggaatgaaatggaatggaatggaatggaatggaatggaatggaatggaaacttcccgagttgaatggcatggaatggaatggaatggaatggaatgaaatggaaaggaatggaatggaatctacccgatggaatggaatggattggaatggaatgaacgaaatgaaatggaaaggaatcaacatgaatggaatggaagggaatggaatggaaggaatggaagggaatggaatggagtggaatggaatggatcgaatggaacggaatggaatggaatggattggaatggaatgtaatgtaatggaatggaatcaaccccagtggaatggaagggagtggaatggaatggaatggaatggattctacccgaatggaatggaatggaatgaaggaaatgaaatggaatggaatcaacatgaatggaatggaattgaatggaatggaatggaatggaatggaatggaatggaatggaatggatttggaatggaatggaatggaatggaatggaatggaatggaaaggaatggaaacgaagggaataacatggattcaccccgaatggaatggaatggaatggaatgggatgagcaaactgaatggaacgctaaggagtggaatggaatggatctggaatggaatggaatggaatggaatggaaaggaatggaaacgaagggaataacatggattcaccccgaatggaatggaatggaatggaatgggatgagcaaactgaatggaacgctaaggagtggaatggaatggaatggaatggaatggaatcgacacatggaatggaatgcaatggaattggaatggaatggaatggaattgaattgaacggaatggaatggagtggaatggaatcaaccagagtggaatggaatgaaatggaatggaatggaatggaatggaatggaatggaatggaatggaatggaacggaatggaaaggaatggaatggaatcaaaccgatggaatggaatggattggaatggaatggaatggtttggaaaggaatggaatcaaaaagagtggaatggaatggaatggtttggaaaggaatggaatctaaaagagtggaatggaatggaatggaatggtatcgacacgagaggaatttaatggaatggaatggaaaggaatggaatggaataaacacgagtggaatggaatggaatggtatggaatggaatggaatgggacagaatggaatggaatcaacccgagttcaatggaatggaaaggaatggaatggaattaatgcaatcaacccaaatggaatggaatggaatggaatggaatgcaatggaatgaaatggaatgaaatggaatggattggaattaaatggaatggaatggaatggaatggaatcgaatggaatggaatcttcccgaatggaatggaatggaatggaatggaatggagcggaatggaatggaatggtgtgaaacaaagtggaaagcaatggaatggacaggaatggaaaggaatggaattgaatggaatggaatcaacccgactggaatggaatggaatggaatggaatggaatgcagtggaatggaatcaaaccaagtggaatggaatggaatggaatagaaaggaatggattagaatggaatggattggaatggaaccaacccgagtggaatggaatggaatggtataaacccgaatgtaatggcatggaatggaatgcaatggaatggaatggaatggaatggaatggaatggaatggaattgtgtggaatggaacggaatggaatggagtgtaaaggaattgaatagaatcaaccagaatggaatggaatggaatggaatggaatggaatggaatggaatggaatgcaatggaatggaatggaatggaatctacccgaatggaatggaatggaatcgaatggaatcgaatggaatttacgcatatggaatggaatggaatggaatggaatggaatggaatggaatgcaatggaatggaatctacccgaatagaatggaatggaatggaatcgaatgga

SEQ ID NO: 474420 - DNA, 8499 bp, Homo sapiens
gagtggaatggaaaggaatggaatcaacccgagtggaatggaagggaatgcaatggaatggaacggaatggaaaggtgtcaaaccgagtggaatggaatggaaaggaatggaatggaatggaatggaatggaagggattggaatcaacacgagtgcaatggaatggaatggaatggaatggaatggaatggaatggaatggaatctaccagaatggaatggaatggaatggaatggaatggaatggaaaggaatggaatggaatctacccgaatggaatggaatggtataatggaatgcaacggaatcaacccgagtgcaatggaatggaatggaatggaatggaatggaatggaatggaatggaatggaatcaacccgagtggaatggaatggaatggaatggaatggaatggaatggaatggaatggaatggattggaatggaattgaatggaatggaatcaactggaaaggaatgaaacggaatggaattaaacggagtggaatggaattgaatggaatggaaacaacccgaaatcaacctgaaaggaatggaatggaacggaatggaatgaaatcaaatcgagtggaatggaatggaaagaagtggattggaatggaatgcaatggaatggaatggaatggagtggaatcactccgagtggaatggaagggaatgcaatggagtggaatggaaaggaatggaatcaacgtgagtggaatggaatggaatggaagggaaagtattggaatggaaacaacccgagtgaaatggcatagaatggaatggattagaatggaatggaatcaactggaatggaatggagtaaacacgagtggaatggaatggaatggtatggaatggaatggaatggaagacaatgcaatggaatcaacccgagttcaatggaatggaaaggaatggaatggaattgtatggaatggaatggaatggaatggaatggaatggaatggaatggaatggaatggaaagcaacggaatggaatcgaatggaatcaacccaaatggaatggaatggaatggaatgcaatggaaagaaaaggaatgaaatggaatgaaatggaattgaatggaatggaatggaatggaatggaatggaatggaatggaatggaatggaatcgaatggaatggaatctacccgagaggaatggaatgcaatggaatggaatggattggaatggaatggaaaggaatggaatggaatggagtgaaacaaagtaatggaattgactggaatggaaccaacccgagtggaatggagtggaatggaataaacccgaatgtaatggcatggaatggtatagaatggaatggaatggaatggaatggaatggaattgtgtggaatggaatggagtgtaaaggaattgaatagaatcaacccgaatggaatggaatttagtggaatggaacggaatggaatggaatggaatggaatggaatggaatggaatggaatcaattcacatggaatggaatggaatggaatggattggaatggaatacaatggaatggaatggaatggaatcattccgagtggaatgggagggaatggaatggattggaatggaatagaatggaatggaacggaatggaacggaacggaacggaatggaatggaatggagtggaatggaatggaatggaatggattggaatggaattgaatggaatggaatcaactggaaaggaatggaacggaatggaattaaatggagtggaatggaattgaatggaatggaaacaacccgaggaatgcaatggagtggaatggaaaggaatggaatcaacgtgagtggaatggaatggaatggaagggaaagtattggaatggaaacaacccgagtgaaatggcatggaatggaatggattagaatggaatggaatcaactggaatggaatggaataaacacgagtggaatggaatggaatggtatggaatggaatggaatggaagaaaatgcaatggaatcaacccgagttcaatggaatggaaaggaatggaatggaattgtatggaatggaatggaatggaatggaatggaatggaatggaatggaaagcaacggaatggaatcgaatggaaatggaatggattggaatggaaccaacccgagtggaatggagtggaatggaataaacccgaatgtaatggcatggaatggaatggaatggaatggaatggaattgtgtggaatggaatggagtgtaaaggaattgaagagaatcaacccgaatggaatggaatttaattcaatggaacggaatggaatggaatggaatggaatggaatggaatggaatggaatggaatggaatcaattcacatggaatggaatggaatggaatggactggaatggaatgcaatggaatggaatggaatggaatcattccgagtggaatgggagggaatggaatgtattggaatggaatggaatggaatggaacggaacggaacggaatggaatggaatggaaaaaacacgagtggaatggaatggaatggaatggattggaatggaatgcaatggaatggattggaatggaatgcaatggaatggaatggaatggaatggaatggaatggaatcgagttgaatggaaaggaatggaatcaacccgagtgcaatggaatggaatggaatggaatggaattgaatggaatctaccagaatggaattgaatggaatggaattgaatggaatggaatggaatggaaagtacccgaatggaatggaatggaaaggaattctatggcagtggaatggaatggaatggaatggaatcatccggaatggaatggaatggaatggaatggaatggaatggaatggaatggaatggaatggaaaggaatggaatggaatcataacgaatggaatggaatggaatggaatggaatggaatggaatggaatggaatcaacccgagtggaatggaaggaaatggaatcaaactgagtggagtggagtggagtggaatggaatcgaatggaatggaatggaaagcaatgaaatggaattgaatgaaatggattggaatgtaatggaatggaatcaaaccaagcgcaatggactggcatggaatggaatggaatggaatggaatggaatggaatggaatggaatggaatggaatggaaacaacccgagtggaatggaatggaatggaatggaatggaatggaatggaatggattggaatggaatggaatggaatggcaagaacccgaatgtaacggaatggaatggaatggaattcaacggaatggaatcaactggattggaatggaaacgaaaggaatggaatggaatcgagtgaacctgagtggaatggaatggaatggaatggaatggaatagaatggaatggaatggaatggaatggaaactaccgaatggaatggaaaggaatggaatcgaaagcagtggactggaaagaattggattggaatggaataaaatcaactccagtggaatggaatggaatgaaatggaatggaaagtaatggaatcgaatgctgtggagtggaaagaaatggattggaatggaataaaatcaactcctgtggaatggaatggaatgaaatggaacggaatggaatggattggaatcaacccgagtggaatggcatggaatggaatggaatggcatggaatggaatggaatggaatgaaatggaatggaatggaacggaatagaatggaatggaacgaaatgaaatggaatttattcaacacacttggaatggaatggaaaggaatggattggaatggaatggaatcaaccctagtggaatggaatagaatggaatggaatcaatggaatttactggaatggaatataatgaattggaatggaaatggaatgcaatggaatcaaccagagtggagtggaatggaatggaatgcaatggaatggaatggagtagaatggaatggaatggaatcaactgaatggaatgaaatggaatggattggaatggaatggaatcaacccgtatggaatgtggaatggaacggaatggaatggaatggaatggaattgtatggaatcaacgctagtggaatgcaatggaatggaacggaatggaataaacgaaatgaaatggaatggaatcaacatgaatggaatggaatggaatggaatggaatggaatggaatggaatggatgggaatggaatggaatggaatggagtggaatggaatggagtggaacggggtggaatggaattgaatggatcaacacgcatgcaatggaatcgaatgaaatggtatggaatagaatggaatgcaatggaattgaatcaacacgactcaaatggaacggaatggaatggagtggaatggaatggaatcaacccaagtggaatggaaaggaatggaatggaatggaatgaatggaatggaacgaaatggaatgaaatggattcaacccaattggagtggaatggaatgaaatggaattgtgtggaatggaatggaacggaatataatgtaaaggaattgaatagaatcaacccgaatggaatggaatggaaaggaatggaatggaatggaatggaatggaatggaatggaatggaatggaatggaatggaatcaactcgagtggaacggaatggattggaatggaatgcaaaggaatgtaattggaagggaagggaatgtaatcgagtggaatggaatggaatggaatcaacccgagtgcaatggaatggaatgcaatggaatggaatggaatggaaactaccagaatggaatggaatggaatggaatggcatggaatggaatggaatgtacccgagtggaatggaatagtgcaactgaatggaatggaatagaatggaatggaatggaatggattgaaaccgaatggagtggaaaggaatggaatcaacccgagtggaatggtatggaatggaatggaatgcaatggaatggaatggaatggaacggaatgaatggaatcaactcgactgcattggaatggaaagcaatggaatggcatggaatcaactcgcgtgaattggaatggaatgaaattgaatggaatggaattgaatggaatggaatcaacttgaatggaatggaagggaatgaaatggaatggaatggaaatgaatcaacactagtggaatggaacggaatggaatggaatggaatggaattgtatggaatcaacgctagtggaatgcaatggaatggaacggaatggaataaacgaaatgaaatggaatggaatagaatggaatgcaatggaatcgaatcaacacgactcaaatggaacggattggaatggagtggaatggaatggaatcaacccaagtggaatggaaaggaatggaatggaatggaatggtacggaatagaatgcagtggaacgaagtggaacggaatggattcaacccaattggaatggaatggaatggaatggaattgtgaggaacggaatggaatggaatgcagtgtaaaggaattgaatagaatcaacccgaatggaatggaatggaatggaatggaatggaatggaatggaatggaatgggaatgtaatcgagtggaatggaatggaatggaatcaacccgagtgcaatggaatggaatgcaatggaatggaatggaatggaaactaccagaatggaatggaatggaatggaatggcatggaatggaatggaatgtacccgagtggaatggaatagtggaatgcaatggaatggaatggaatcaccccgaatggaatggagtggaatggaatggaatggaatagaatgtagtggaatggaatggaatcaacccgagtgcaatggaatggaatggaatggaatggaatggaacggaatggaatggaatggaatcaaccagagtgcaactgaatggaatggaatggaatggattgaaaccgaatggagtggaaaggaatggaatcaacccgagtggaatggtatggaatggaatcgaatgcaatggaatggaatggaatggaatggtacggaatacaatggaatggaaagaaatggaatggaatggaatggaatggaatggaatggaaaggaatggaatgcaatcattccgaaatggaaagtaatggaatggaaaggaatggaaaggaatggaatggaatggaatggaatggaatggaatggaatggaatcaactcgagtggaatggaatggaatggaatggattggaatggaatgcaatggaattgaatggaatcattccgagtggaatggaagggaatgtaatccagtggaatggaaaggaatggaatcaacacgagtggaatggaagggaatagaatggaatggaaaggaatggaatagaatcaacccgagtggaatggaatggaatgcaatggaatggaatggattggaatcatcccaaatggaatggagtggaatggaatggaatggaatggaatgtatggaatggcatggaatggaatggaatggaatggaatggaatggaacggaatggtacggaatagaatgtaatggaacgaaatggaatggaatggattcaacacaatcggaatggaatagaatggaatggaatggattggaatggaatggaatgcaatggaatggaatggaatggtatcaactcgagtggaatggaatggtatggaatggattggaatggaatgcaatggaatggaaagaaatcattccgagtggaaaggaagggaatgaattgaatacaatcaacccgaatggaatggaatggaatggaatggaatggaaaggaatggaatggaatggaatggaatggaatggaatggaatcaactcgagtggaatggaatggattggaatggaatgcaatggaatggaaggtaatggaatggaatcattccgagtggaatggaagggaatgtaatcgagtggaatggaaaggaatggaatcaaaccgagtgcaatctattataatggaatggaatggaatggaatggaatggaatggaatggaatctaccattatggaatgaaatggaatggaatggagtggaatggaatggaatggagtggaatggaatggaatggactgtacccgagtggaatggaattggaatggaaaggaatggaatcacaccgagtggaatggaagggaatagaatggaatggaatggaatggaatggaatggaatggaatgcaatggaatcaacccgactgcaatggaatggaatggaatggaatggaatcaacccgaatggaatggaatggaatggaatcaacacgagtggaatggcatggaatggaatgcaatgaaatggaatggaacgaaattggaatggagtggaatggaatggaatggaatggaaagcaatggaatggaatggaatcaatccgagtgcaatggaatggaatggcaaggaatggaatggaatggaatggaatggaatggattcaacccgaatggaatggaaaggaagggagtcaacccgagtggaatggcaaggaatggaatggaatggaatggaatggaatgcaatggaatggaatggaatggaatggaattgaatagaatcaacccaaatgaaatggaatggaatggagcgaaatggaatggaatggaatggaatagaatggaatcattccgagtggaatataatggaatggaaaggaatggaatggaatggaatggaatggaatggaatggaatggaatggaatggaatcaactcgagagcaatggaatggaatggaatggaatggaatggaatggaatggaatggaatcaacccgagtggaatggcatggaatggaatggaatggaagggaatggtaccgaatagaatggaatggaacgaaatcgactggaatggattcaacccaattggaacggaatggaatggaatggaattgtgtggaatggaatggaatggaaaggagttggaatggaagggaatggaatggaatggaaatgaatggaatggaatcaacacgaggggaatggaatggaatggaacggaatggaatggaatggaatggaatggaatggaatggaatggaatggaatggaatggaatcaacccaggtggaatggaatggaatggaatggattggaatggaatggaatggaatggaatggaatcaaccagaatggaatggaatggaatggactggaatggaatggaatggaataagggaatggaatcaaatcgcgtggaatggaatggaatggaactgaatcaaactgagtggaatggaatggaatggattggaatagaatggaatggaatcatcccgaatggaatggagaggaatggaatggaatggaatggagtggaatggaatggaatggaatggaatcaacccgagtgcaatggaatggaatggaatggaatggaatggaatggaatggattcaacccgaatggaatggaaaggaatggaatcaacccgagtggaatggcatggaatggaatagaatggaaaggaatggaatggaatggaatggtatggaatagaatggaatggacc

SEQ ID NO: 474421 - DNA, 8872 bp, Homo sapiens
acgtaatggaatggaatcaatccgagtgcactggaatggaatggaatggaatggaatggattcaacccgaatggaatggaaaggaagggatgcaatggaatggaatggaatggaatggaatggaatggaatggaatggaatcaacccgagtggaatggcatggaatggaaaggaatgtaatggaatcaacccgaatggaatggaatggagtggaatcaacccgagtggaatggcatggaatggaatggagtggaagggaatggtaccgaatagaatggaatggaacgaaatgcactggaatggattcaacccaattggaatggaatggaatggaatggaattgtgtggaatggaatggaatggaaaggagtgtaaaggaattgaataaaatcaacccgaatggaatggaatggagtggaacggaacggaatggaatggaacggaatggaaaggaatggaatggaatggaatcaactcgggtggaatgtggaatggaagagaatgtaatcgagtggaataacggaacggaatggaatggaatggaatggaatcaagtcgggtggaatggaatggaatggaatggaatggaatggaatggaatggaatggaatcaacccgagtggaatggaatggattgcaatggaatggaaaggaatggaatggaatcaacccgagtggaatggaatggaatggaatggaatggaatggaatggaatggaatcaacccgggtagaatggcatggaatggaatagaatgtaatggaatggaatggtacagaatagaaatgaatggaacgaaatggaaaagaatgcattcaacccacttggaatggaatggaatggaatggaattgtgtggaatggaatggaatggaatggagtgaaatgaatggaatggaatggtacggaatagaatgcaatggaacgaaatggaatgaaatggattcaacccaattggagtggaatggaatggaatggaattgtgtggaatggaatggaatggaatggagtgtaaaggaattgaatagaatcaacccgaatggaatggaatggaacggaatgcaatggaatggagtggaatggaatgtggaatggaatggattggaatggaatgcaatggaatggaatgtaacggaatggaatcattccgagtggaatggaagggaatgtaatcgagtggaatggaaaggaatggaatcaacccgagtggaatggaagggaatggaatggaatggaaaggaatggaatggaatcaaccgcagtggaatggaatggaaaggaataaaatggtatggaatggaatggaatggaatcaactcgagtgcaatggaatggaatggaatggaatggaatctaccagagtggaatggaatggaatggaatggaatggaatgtacccgaatggaatgcaatggaatgcaatcaatggaatggaatgggatcgtcccgaatggaatggatcagaatggaatggatcagaatggaatggaatggaatggaatggaatggaatggaatggaattgaatggaaaggaatcaactcgagtgcaatggaatggaatggaatgcaatggaatggaatggatacaacctgaatggaatggaaaggaatggaatcaacccgagtggaatggcatggaatggaatagaatggaaaggaatggaatggaatggtacagaatagaatggaatggaacgaaatggaatggaatggaatggaatgcaatggaatggaatggagtggaatcattccgagtggaatggaagggaattcaacccaagtgcaatggaatggaatcgaatggaatggaatggaatgcaatggattcaaccccaatggaatggaaaggaatggaatcaacgcgagtgaaatggcatggaatggaattgaatggaaaggaatggaatggaatggtatggaatagaatggaatggaacgaaatggaatggaatggaatggaatggaatggaatggaatggaatggaatggaatggagtggaatcattccgagtggaatagaagggaatgtattcgagtggaatggaaaggaatggaatcaacccgagtggaatggaagggaatggaatggtatggaaaagaatagaatggaatcaaacagagtggaatggaatggaaaggaatggaatggaatggaatggaatggaatggaaaggaatggaatagaatggaatggaatggaatggaatggaatcaactcgagtgcaatggaatggaatggaaaggaaaggaattgtgtggaaatgaatagaatggaatggagtgtgaaggaattgaaaagaatcaacccgaatggaatggaatggaatggaacggaatggaatggaatggaatggaatggaatggaatggaatggaatggaatggaatcaattagagtggaatggaatggaatggaatggattggaatggaatgcaatgaaagggaatggaagggaatggaatggaacggaatcattccgagtggaatggaagggaatgaatggaatggaatcaacccgagtggaatggaatagaaaggaatggaaaggaatggaatggaatggaatggaatggaatggaatggaatggaatcaacccgagagcaatgctatggaatggaatggaatggaatggaatcaacccgaatggaatggagtggaatggaatcaacccgaatggaatggagtggaatggaatcaacccgagtggaatggcatggaatggaatggaatggaatggaaaggaatagaatggtacggaatagaatgcaatggaacgaaatggaatggaatggattcaacccaattgcaatggaatggaatggaaaggaatcattccgatggaatggaatggaaaggaatgggatggaatggaatggaatggaatggaatggaattgaatagtatcaacccaaatggaatggaatggtatggagcgaaatggaatggaatggaatggaatagaatggaatcattccgagtggaatggaatggaatggaatggaaaggaattgaatggaatggaatggaatggaatggaatgcaatggaatggaatggaatcaactcgagtgcaatggaatggaatggaatggaatggaatgcaatggaatcaacccgagtggaatgaatggaatggaacgaaatggactggaatggattcaacccaattggaatggaatggaatggaatggaattgtgtggaatggaatggaatggaaaggagtgtaaaggaattgaataaaatcaacccgaatggaatagaatggagtggaacggaacggaattggaatggaagggaatgtaatcgagtggaatgtaaatggaatcaacacgagtggaatggaagggaatggaatggaatggaaaggaatggaatggaatcaacacgaggggaatggaatggaatggaacggaacggaatggaatggaatggaatggaatggaatggaatggaatggaatcaacccgggtggaatggaatggaatggaatggattggaatggaatgcaatggaatggaatggaatcattccaagtggaatggaagtgaatgtaaccgagtggaatggaaaggaatggaatcaacccgagtgcaatggaatagaatggaatggaatggaatggaatggaatggaatggaatggaatcaaccaaaatgcaatggaatggaatggagtggaattgaatggaatggaatggaatggaatgtacccgaatggaatggaatggaatggaatcatatggctggaatggaatggaatggaatggaatagaatggaatggaatcatcccgaatggaatggagaggaatggaatggaatggaatggaatggaatggaatggaatggaatggaatggaatggaatggaatggaatggaatggaatcaacccgagtgcgatggaatggaatggaatggaatggaatggaatggattcaacccgaatggaatggaaaggaatggaatcaacccgagtggaatggcatggaatggaatagaatggaaaagaatggaatggaatggaatggaatggaatggaatggaatggaatggaatcaaaccgagagcaatgctatggaatggaatggaatggaatggaatcaacccgaatggaatggagtggaatggaatcaacccgaatggaatggagtggaatggaatcaacccgagtggaatggcatggaatggaatggaatggaatggaaaggaatggaatggtacggaatagaatgcaatggaacgaaatggaatggaatggattcaacccaattgcaatggaatggaatggaaaggaatcattccgatggaatggaaaggaatggaatcaacccgagtggaatggaagggaacggaatggaatggaaaagaatagaatggaatcaaccagagtggaatggaatggaaaggaatgggatggaatggaatggaatggaatggaatggaatggaattgaatagtatcaacacaaatggaatggaatggtatggagcgaaatggaatggaatggaatggaatagaatggaatcattccgagtggaatggaatggaatggaatggaaaggaattgaatggaatggaatggaatggaatgcaatggaatggaatggaatcaactcgagtgcaatggaatggaatggaatggaatggaatgcaatggaatcaacccgagtggaatggtatggaatggaaaggaatgtaatggaatcaacccgaatggaatggaatgtagtggaatcaacccgagtgcaatggcatggaatggaatggattggaagggaatggtaccgaatagaatggaatggaacgaaatgcactggaatggattcaacccaattggaatggaatggaatggaatggaattgtgtggaatggaatggaatggaaaggagttggaacggaacggaatgtaatggaacggaatggaatggaatggaatggaatggaatcaactcgggtggaatggtatggaatggaatgaattggaatggaatgcaatggaatggaatggaatggaatggattcattccgattggaatggaagggaatgtaattgagtggaatgtaaatggaatcaacacgagtggaatggaagggaatggaatggaatggaaaggaaaggaatggaatcaacacgagaggaatggaatggaatggaacggaacggaatggaatggaatggaatggaatggaatggaatcaacccgggtggaatggaatggaatggaatggattggaatggaatgcaatggaatggaatggaatcattccaagtggaatggaagtgaatgtaaccgagtggaatggaaaggaatggaatcaacccgaaagggaatggaatctaatcgcgtggaatggaatggaatggaactgaataaaactgagtggaatggaatggaatggaatggaatagaatggaatggaatcatcccgaatggaatggagaggaatggaatggaatggaatggaatggaatggaatggaatcaacccgagtgcgatggaatggaatggaatggaatggaatggattcaacccgaatggaatggaaaggaatggaatcaacccgagtggaatggcatggaatggaatagaatggaaaggaatggaatggaatggaatgatatggaatagaatggaatggaccgaaatggaatggaatggaatggaatggaatggaatggaatggaatggaatggaatgcaatggaatggaatggaatggaatgcaatggagtggatacattctgcgtggaatagaagggaatgtattcgagtggaatggaaaggaatggaatcaacccgaaatggaatggaatggaaatgaatggaatggaatggaatggaatggaatggaatggaatggtatggaaaataatagaatggaatcaatcagagtggaatggaatgtaaatgaatggaatggaatggaacggaatggaatggaatggaatgaaatcaactcgagaggaatggaatggaatggaatgaattggaatggagtgaaatggaagcgaatggaagggaatggaatggaagggaatcattccgagtggaatggaagggaattggaatggaggggaatggaatggaatggaaaggaatggaatggaatcaacacgagtggaatggaatggaaacgaatggaatggaatggaatcaacacgagagcaatggaatggaatggaatggaattgaatggaatcaacccgaatggaatggagtggaatgaaatcaacccgagtggaatggcatggaatggaaaggagtggaatgtcaggcggaatggaatggaatggaatggaatggaatggaatggaatggaatggaatggaatcaacccgagtggaatggaatggaatgcaatggaatggaaagtaatggaatggaatcaacccgagtggaatgaatgtaatggaatggaatggaatggaatcaacccgggtagaatggcatggaatggaatagaatgtaatggaatggaatggtacagaatagaaatgaatggaacaaaatggaatagaatgcattcaacccacttggaatggaatggaatggaatggaattgtgcggaatggaatggaatggaatggagtaatcaacccgaatggaatggaatggaacggaatacaatggaatggagtggaaaggaatggtacggaacagaatggaatggatcgaaatgtaatgaaatggattcaacacaattggagtggaatggaatggaatggaattgtgtggaatggaatggaatggaatggagtgtaaaggaattgaatagaatcaaccagaatggaatgcgatggaatggaacggagcggatgggaatggaatggaatagaatggaatggaatggaatggaatggaatggaatggaatggaatggaatcacccgaatggaatggagtggaatggagtggaatggaatggaatggaatggaatggaatcaactcgagtaatggattggaaagaaatggaatggaatggattcaacccaattgaaatggaatggaatggaatggaattatgtgaaatggaatggaatggaatggagggtaaaggaattgaaaagattcaacccgaatggaatggactggaatggaacgtaatggaatggaatggaatggaatggaatggaatggaatggaatggaatcacccgaatggaatggagtggaatggagtggaatggaatggaatggaatggaagggaatcaactcgagttggaaaggagtggaatggaatggaatggaatggaatggaatggaatggaaaggaatggaatggaatcaccccgaatggaatggagtggaatagaatggactggaatggaatggaaaggaatggaatggaatggaatggaatggaaaggaatggaatggaatggaatggaatggaatcaaccggagtgcaacggaatggaatggaatggaatcaacccgaatggaatggagtggaatggaatcaacccgagtggagtggcatggaatggaatggaatggaaaggaaaggaacggtacggattagaatggattggaacgaaatggaattgaatggattcaacccaattgaaatggaatggaatggaatggaattatgtggaatggaatggaatggaatggaggattcaacactaatggaatggactgtaatggaagggaatggaatggaatggaatggaatggaatggaatggaatggaatttaatgaaatcaactcgggtggaatggaatggaatggaatggattggaatggaatgcaatggaatggaatggaatggaatggaatggaatggaatcattccgagtggaatggaagggaatgtaatcgaggggaatggaagggaattgaaattgaatggaatggattggaatggaatggaacggaatggaatggaatggaatggaatcaacccgaatggaaaggagtggaatggaatcaacccgagtggaatggcatggaatggaatggaatggaaaggaatggaatgaagggaaagtattcgagtggaatggaaaggaatggaatcaacccgagtggaatggaaggatatggaatggaatggaaagaaatagaatgcaatcaacccgagtggaatggaatggaatggaatggaatggaatggaatggaacggaatcacctcgagtgcaacggaatggtatggaatggaatggaatggaatggaatggaatggaatcaacccgaatagaatggaatggaatggaatggaatggaatggaatcaaccagagtggaatggcatggaatggaaaggaatggaatggaatggaatggtacggaatggaatggaatggtgcggaatagaatggaatggaacgaaatggaacggaatggattcaacccaattggaatggaatggaatggaatggaattgtgtggaatggaatggaatggaggaatcaacccgaatggaatggaatggaacggaatgcaatggaatggaatggaaaggaatggaatggaatggtatggaatagaatggaatggaacgaaatggaatggaatggattcaaaccaattggaatggaatggaatggaatggaatggaattgtgtggaatggaatggaatggagtgtaaaggaattgaatagaatcaacccgaatggaatggattggaacggaatcaagccgagtgcgatggaatggaatggaatggaatggaatggattcatcccgaatggaatggaaaggaatggaatcaacccgagtggaatggcatggaatggaatagaatggaaaggaatggaatggaatggaatgatatggaatagaatggaatggaccgaaatggaatggaatggaatggaatgcaatggagtggattcattctgagtggaatagaagggaatgtattc

SEQ ID NO: 474422 - DNA, 5019 bp, Homo sapiens
tggaatcaacccgaatggaatggcatggaatgctaaggaaatgaatggaatggaatggtacggaatagaatggaatggaacgaaatggaatgaaatggattcaacccaattggagtggaatggaatggaatggaagtgtgtggaacggaataatcaacccgaatggaatggaatggaacggaatacaatggaatggagtggaaaggaatggtacggaatagaatggaatggatcgaaatgtaatgaaatcgactcaacccaattggagtggaatggaatggaatggaattgtgtggaatggaatggaatggaatggactaatggaatggaatggaatggaatggaatggaatggaatggaatggaatcacccgaatggaatggagtggaatggaatggaatggaatggaatggaatggaatggaatcaactcgagtggaatggaatggaatggaatggattcaacattaatggagtggaatggcatggaatggaatggaatggaatgcaatagaatggaatggaatggaatggtatggaatagaatggaatggaacgaaatggaatggaatggaatggaatggaatggaatggactgtacccgagtggaatggaataatcaacccgaatggaatggagtggaatggaatcaacccgagtggagtggcatggaatggaatggaatggaaaggaaaggaacggtacggattagaatggattggaaaaaaatggaatggaatggattcaacccagttgaaatggaatggaatcgaatggaattatgtggaatggaatggaatggaatggaatggagggtaaaggaattgaataaattcaaccggaatggaatggaatggaatggaatggaatggaatggaatggaatggaatggaatgaaatcaaccagggtggaatggaatggaatggaatggattggaatggaatgcaatggaatggaagggaatggaatggaatggaatcattccgagtggaatggaagggaatgtaatcgaggggaatggaagggaacaatagaatggaatggaatcaaatcgtgtggaacggaatggaatggaactgaatcaaacagagtaaaattgaatggaatggattggaatggaatggaatggaactggatcaaacagagtaaaattgaatggaatggattggaatggaatggaatggaatggaatggaatggaatggaatcaacccgaatggaatggagtggaatggaatcaacccgagtggaatggcatggaatggaatggaatggaatggaaaggaatggaatgtggaatggaaaggaatggtatcaacccgagtggaatggaatggtatggaatggaatggaaagaaatagaatgcaatcaacccgaatggaatggaatggaatggaatggaacggaatcaactcgagtgcaacggaatggtatggaatggaatggaatggaatggaatggaatggaatggaatggaatcaacccgaatagaaaggaatggaatggaatggaatggaatcaaccagagtggaatggcatggaatggaaaggaatggaatggaatggaatggtacggaatagaatggaatggaacgaaatggaaaggaatggattcaacccaattggaatggaatggaacggaatggaattatgtggaatggaatggaatgcaggtggaatggaaaggaatggaatcaacccgaatggaatggaagggaatagaatggtatggaaaagaatagaatggaatcaaacagagtggaatggaatggaaatgaatggaatggaatggaatggaatggaatggaatggaatggaacgtggaatggaagggaatgtaatcgagtggaatggaaatggaatcaacacgagtggaatggaagggaatggaatggaatcaacccgagagcaatggaatggaatggaatggaatggaatggaatcaacccgaatggaatggagtggaatggaatcaacccgagtggaatggcatggaatggaaaggagtggaatggtacggaatagaatggaatggaacgaaatgaaatggaatggattcaaccgaattggaatggtatggtatggaatggaatggaattgtgtggaatgcaatagaatggaatggagtaatcaacccgaatggaatggaatggaacggaatacaatggaatggagtggaaaggaatggtacggaatagaatggaatggatcgaaatgtaatgaaatggattcaacccagttggagtggaatggaatggaatggaattgtgtggaatggaatggaatggaatggagtgtaaaggaattgaatagaatcaaccagaatggaatgcgatggaatggaacggagcggatgggaatagaattgaatggaatggaatggaatcacccgaatggaatggagtggaatggaatggaatggaatggaatggaatggaatggaatggaatggaatcaactcgaagtggaatggagtggaatggaatggaatggaatggaatggaatggaatggaatcaccccgaatggaatggagtggaatagaatggaatggaatggaatggaaaggaatggaatggaatggaatggaatggaatcaaccggagtgcaacggaatggaatggaatggaatcaaccctaatggaatggagtggaatggaatcaaccccagtggaatggaatggaatggaatggaatggaaaggaaaggaacggtacggaatagaatggattggaacgaaatggaatggaatggattcaacccaattgaaatggaatggaatggaatggaattatgtggaatggaatggaaaggaatggaggaacggaatggaatggaatggaatcaacccgagtggaatggcagggaatggaaaggaatggaatggaatgatacggaatagaatgggatggaaagaaatggaatgcaatggaatggaatggaatggaatggaatggaatggaatggaatggaatggagtggaatcattccgagtggaatggaagggaatgaaatcgagtgtaatggaaaggaatggaatcaaacctagtgcaatggaatggaatggaatggaatggaatggaatctatcagaatgaaatggaatggaatggaatggaatggaacggaatggcatcataccgaatggagtggagcagaatggaatggaatggaatggaatggaatggaatggaatggtatggaatggaatggaatggaatcaacgcgagtgcaatggaatggaatggaatggaatggaatggaatggaatggaatggattgaacccgaatggaatggaaaggaatggaatcaaaccgattgaaatggcatggaatggaatagaatggaaaaagggaatgtattcgagtggaatggaaaggaatggaatcaacccgagtggaatggaagggaacggaaaggaatggaaaagaatagaatggaatcaagcagagtggagtggaatggaaaggaatggaatggaatggaatggaatggaatggaatggaatggaatcaactagagtggaatggaatggaatggaatggattggaatggaaagcaatggaagagaattgaagggaatggaatggaatggaatggaatggaatcaacccgaagcaattgtatggaatggaatggaatggaatcaacccgagtggaatggagtggaatggaatcttcccgagtggaatggcatggaatggaatgaaatggataggaatggaatggtacggaatagaatggaatggaacgaaatggaatggaatgcattcaacccaattggaatggaatggaatggaatggaatcactccgagtggaacagaattgaatgtattcgagtggaatggaaaggaatggaatcaacccgagtggaatggaagggaatggaatggaatggaaaccaataaaatggaatcaacacgagtggaatggaatggaaaggagttgaattgaatagaatggaatggaatggaatggaatcaactcgattgcaatggaaggtaatggaatgaaattgaatggaattaacgcgaatagaatggaatggaatggaatggaacggtatggaatggaatcaacccgagtggaatggcatggaatggaaacgaatggaatggaatggaatggtatggaatagagtggaatggaacgaaaaggaacggaatggattcaacccaattggaatggaatggaaagcaatggaattgtgtgcaaaggaatggaatggaatgcagtgtaaagtaattgaatagaatcaacccgaatggaatggaatggaaaggaatgcaatgtaatggaatggaatggaatggtacggaatagaatggaatggaacgaaatggaatggaattgattcaacccaattggaacggaatggaatggaattttgtggaatggaatggagtgtaaagaattgaatagaatcaacccgaatggaatggaatggaattgaatggaatggaatgcaatggaatggaatggaatggaatcaactcgagaggaatggaatggtatggaatggaatggaacggaatcaaatgaagtgcaacggaatggaatggaatggaatggaatggaaacaaccagaatagaatggaattgaatgaaatcaacccgagtggaatggcatggaatggaaaggaaaggaatggaatggaatggaacggaatgcagtggaatggaatggaatggaatggaatggaatggaatggaatgatacggaacagaatggaatggaatgaaatggaatggaatggattcaacccaaatggaatggaatggaatgtaatggaatggaattgtgtggaatggagtggaatggaatggagtgtaaacaattgaatagaatcaacccgaatggaatggaatagaatgtaatgtaatggaatggaatggaaaggaatgtaatcgaatggaatgaaatggaatcaacagcagtggaatggaatggaatggaaagcaatgcaatgcaatgcaatggaatgagggtggaatccattccagtgcaatgcaaggcaa

SEQ ID NO: 474423 - DNA, 1042 bp, Homo sapiens
gtgtgcggcaacatggggagtctgcaatgtggacggtttggaaactggcaaggacagcaaaggcaccacgccggtcttccacccttccctgcatggttcagggtgcccgcagagctccgggagcaaacagtcaactactgggggagggagacgtccgaaggtgtcgggagtgccaccgtggggagcccaggccagaacttcactgacggacatgggaagagagaggacggcgggctcccgtgcatctcagcaggcctctgcactgtggcaggggcaggaggagacctggaatggaaaggaatggaatggaatcaacgcacatggaatggaatggaatgaaatggaatggaatggactggactggaatggaatggaatggaatggaatggaatggaatggaatggattggaatgcaagggaatggaatggaatgaaaacgactcatcccgatggaatggaatggaatggaatggaatggaatgaaaaggaatggcatcgattggaatggaatggaatgcaatggagtggaatgggatggaatcaacacaagtggaatggaattgaatggaatggaatggtatggaatggattggaatggaatggaaagcaatcaacccgagtggaatggaatggaatggaatggaatggaatggaatggaatggaatgaaatggaatggaatggaaaggaatgtaatggaatggaatggagtggaatgggatggaatcaacccgaatggaaggaaatggaatggaatagaatggaatgcaatggaatcaacgcgagtggaatggaatggaaaggaatggaatggaatggaatggaatggaatggaaaggaatggaaaggaatggaaaggaatcaacccgagtggaatggaatggaatggaacagaatggaatggaatggaatgggaaggactggaaaggaaaggaatcaacccgagtggaatggaatggaatggaatagaatggaatggaatggaatggaagggaatataatggaattgaacggaatggaatggaatgaaatggaatcaaccc

SEQ ID NO: 474424 - DNA, 648 bp, Homo sapiens
ggtcctcttatgccgtgttctaggatttaaagtctagcaaaccagtgttctgaggttaaatttattgaatgcacactatcagtgattttgctatgttttctccagttctctctcagttggttagaatttgttgcctagacatttcctccaaagggctcatgagaaaaatattccctgatttatattttcaacactgtttttctatagcctctattcagaaagatagcttggctggctataaaattcttgctgacatgtttccccttgaggatcttgtagggcaatgtcatcagaaatattcagaaaatcaaggaactctttcgttgagtgaagagaacagaaattttaagactgagcgaatagaagaagaagaggaggaggagggattggaggaggaaaaggaggagaaagtggaggaggaggaggaagggagaacttctcctgggctctctgccgatatctgccagggaaaacactgataaacagaaagggaaagaaaaagctaagttcaagccaaatgtttctgtgctcctcttaagatacaatggagataacattgaaatacaaaatgctgtctatgtgttccttttgaaaagagccttccttttaaggtcagttaatactgttcatgcagatttccatagcagt

SEQ ID NO: 474425 - DNA, 1359 bp, Homo sapiens
ctcactgatcagtgggtctgaggtccctgtattgagtctccttgagtagccttgggattcctcggtctacacacagcaatccataatcaaaccaccccagccggaacttctgcctgtacagctgctgtcacggagcagacttgaatctcacccatggagaccggcaggcaaacaggcgtgtctgctgagatgctcgccatgccccgaggtctgaagggcagcaagaaggatggaatccctgaggacctagatgggaacttggaagaacccagggatcaggaaggtgagctcaggagtgaggatgtcatggacctcacagaaggtgacagtgaggcctcagcctcagctcctcctgcagccaaaagacggaaaacacatacgaaacgcaagaaggagaggaagcccaccgtggatgcagaggaggctcagaggatgacaaccctgctgtctgccatgtctgaggagcagctgtcccgctacgaagtgtgtcgccggtcagctttcccaagagcacgcattgcgggtctgatgcggtctatcactggcagttcggtgtctgagaacgcggccattgccatggctggaatagccaaggtctttgttggagaggtggtggaagaggccctggacatgtgtgagatgtggggagagacgcccccgctgcagcccaagcatttaagggaggctgttcacaggttaaagcccaagggcctcttccccaacagcaactacaaaagagtcatgcaaacaggtgtgtctgctgagatgttcgccataccccgaggtctgaagggctgcaacgaggatggaatccctgaggccctagatgggaacttggaagaacccagggctcaggaatgtgagctcaggagtgaggatgtcatggacctcacagtagttgacaatgaggcctcagcctcagctcctcctgcagccaaaagacagaaaacagataccaaaggccagaaggagaggaagcccagtgtggatgcagaggaggctcagaggatgacaaccctgctgtctgccatgtctgaggagcagctgtcccgctatgaagtgtgtcgccagttagctttcccaaaagcacttgttgcacgtctgatgtggtctatcactgggagatcggtgcctgagaacatggccattgccatggctggaatagccaaggtctttgttggagaggtggtggaagaggccctggacatgtgtgagatgtggggagaaatgcccccattgcagcccatggatttaagggaggctgtttgcaggttaaagcccaagggcctcttccccaacaactataaaaaagtcatgttctaggcccaaggccagagggaagggtctgtttttgcagga

SEQ ID NO: 474426 - DNA, 553 bp, Homo sapiens
gtctgctgagatgttcgccatgccccaaggtctgaagggcagcaacaaggatggaatccctgaggacctagatgggaacttggaagaacccagggatcaggaaagtgagctcagaagtcaggatgtcatggacctcacagaagccaaaagacagaaaacagataccaaggggaagaaggagaggaagcccaccgtggatgcagaggaggctcagatgacaaccctgctgtatgccatgtctgaggagcagctatcccgctacgaagtgtgtcgccggtcagctttcccaaaagcacgcattgcagctctgatgcagtctatcactggcagatcggtgtctgagaacaccgccattgccatggctggaatagctaaggtcttggttggagaggtggtggaagaggccctggacgtgtgcgagatgtggggagaaacgcccccgctgcagcccaagcatttaagggaggccgttcgcaggttaaagcccaagggcctcttccccaacagcaactataaaaaaatcatgttctaagcccaaggccagagggaaggg

SEQ ID NO: 474427 - DNA, 1659 bp, Homo sapiens
ccttggttcagagtaaggccaattacttaatgcattttctttgtagcattggccttaacaaattgtcacaatttggggaaggtgttctcaatagattttcataatcatgttggctcagaggttaggagttttgcctggtggagatggcagtggtaatggtggtagtaataatcttggaggtaatgatgacggtggcagaggtgatggtagcaatggtgatggtgtcagtaatgatggtagaggtgatgatggtggtggtcgttgtgataatggcattgagggaatggtggtgatggtggtggtgataatggcaatgggggaggtcatgataatagtgttggtggtagtggtggaggtggtagtgatggcagaagggatggtgatggtaataatattggtggtattagtaatgatagtagaggtgatgatggtggtggtcatgatggtaatagtagaggcaacagtgatgttgttaatgatgatggtggtagtggtggtggtgatggtttggttgtgtggttaacgtggtggtgatggtgttggaggtgctaatggtggtggtgatgatggtggtggtggtagaagcgatgatgacagttggaggacagtggacatggtgatgatcataatgctgacagtgatggtgataatggccgtggtctgtgtaacaatataatctttgcattcaaaatattttttcttaaggaataggacacctctttttaaagaaagcactttgctcctatttcaaatcagacctctgtaaaactgtttatctgaattcctgcccaaatttgtgtatcacaaaatagaggttgcaaaatgaaagttccatttgtgagggagactgcctgctggtgtccaaagcactttcttgactttgggacgaggtgtcctgaccatcctctcttctaaaggccaaatcttgcttactctagaccccagctccagctcacctccacagctgtacactgtggtgactcccctcctcaaaccttactcatttgccttagctcatatattgcgttaattattatttattttagcttgtgtatatgtttgacctccccaaccagattgtaagctccttgaagacagggtgcatgccttgtccttcttaaatcccataccctttgaagaaatatatatattgaacaaatgaatgaatggattgatgagtaaatctatggtgctattattaactccagaaagtacacacagcataatggtttacacagtaatcataacattaatttgagcataaagaccttctaatgacttgcaagaaagagggaatttagttactgctactactactacaatagctagcatttactgctactactgctacaatacctagcatttatggagctctgcaccaggctctgtgctcagcactttacacacattatcttcattaattttcacaacaatcctgtgaagtgggtactatttccccattttacagatggaaaacctaggatcagagattttgaataatttgtattatttggttaacgatactcactttctattcagacagacatgagttcaaacaacaactctggcgtttgccagttgcatggcttttatgatatcaattttggtcctggacctcagtttcttcatctaacatgtggggaaatatacttaactgtc

SEQ ID NO: 474428 - DNA, 741 bp, Homo sapiens
gtggatttctactgcttgtgtcatggggcatttgttcatttgcagagaagatatatccttgaccagtgccttgcaaaatagatttgtgaaagcagcacctgcatcactggagagtcctgtaattgctcttctctgtatgtcagatttaacagtgggaacctcagtcactcagctccaaaatttaaatacaatgggaacaactggatcccaaggtggaaggggccaagtggcagcactcagccatcaaaggcaaggtgggtgtagcgacctgggtccccggactcatcctgtggtcatttccccagtgccagaatgcataattggcatagcatgcttaagcagctggcagaggccccacattggctccctgactgctaagaagacagatggatcttggagaatgacagtggattattataagcttaacccagtggtgacttcaatttcagcttctgtatcagatgtggtttaattgcttgagcaaattaatacatctcctggtactggtatgcagccactgacttggcaaatgcctatttctccattcccatccataaggcctgccagaaacagttgtctttcagctggcaaggccaggaatatatgtttactgtcttacctcaggggtatatcaactctccagctttgtgtcataatcttattcggagagaccttgattgctttttgcttctgcaagatgtcacactggtccattacattgatgacattatgctgattgga

SEQ ID NO: 474429 - DNA, 745 bp, Homo sapiens
tgccagaggaggcagagtggtttatagtcctggaccttaaggatgtctttttctgcattcctgtacatcctgactctcaattcttgtttgcctttggagatccttctaacccaatggttaaaattatccaaaggcaccagggccctcagcgaggaatgtatccatcctatactggcttatcctgatcccaaaaccctgaagcaattaagaggtttccatggcataacaagcttctgccaaatacggattcccaggagattattattggctgtacagaaacctaaagaggtggcagtcttacactgctggggttatcagaaaggaaaggaaaaggaaacagaagaaaaccaccgagcagatattgaacccaaaagagccacaagaatcgaagctgtaaaactacaaatcgttcttgaaatggagccccagatgcagtccatgactaagatctactgcggacccctggactggcctgctagcccatgctccgatgttgatgacatcgaaggcatccctcctgacaaaatctcaactgcatgacccctactacaccccacttcagcaggaggcagttagagcggttttgcctttcaccagctttgatttatacttgattttaaaacacattgagtcttattctcccctcactagcatgagagagtagctgccataaatccttgatactgccagcttacacaaaggaaaagattgttctgaattgtgcaacatatataataccagctca

SEQ ID NO: 474430 - DNA, 1753 bp, Homo sapiens
cagactaatgcagtatattggtaccggtagattggggcactgctgtaaccataccccaaaatggggaagagactctggaactcagtaacaggcagaggttggaacagtttggagggcttagaagaaggcagaaaaatgtgcaaaagtttggaacttcctagagacttgttgaatggctttgaccaaaatgctcataattatatggacaatgaaatccagacagggcccctctactgtgtgcagcctaaggacttggtgctctgtctccctgccactctagccacggttaaaaggggccaaggtgcaactcaggctgttgctttggagggtgcaggcacaagccttggcagcttcttaagtcatgttgagtctgtgggtgcacagaagtcaagaattgaggtttgggaacctccatctagatttcagaggatgtatggaaatgcctcgatgtccaggcaaaagtttgctgcaggggaaggccctcatagcgaacctctgaatggtagatccatcagcaatttgtaccatgcccagaaaagccacagaccctcaaagccagcccacgaaaacagccaggagggaggctgtaccctgcaaagccacaggattggagctgcccaacaccatggaaacccacttcttgcactggcatgacctggattttcttagagacttaaaaaacggatttgagagctttccttttccaatataagtatctagtgctatacatttcccttgtagtactgttttagatgcagcgtatcactctttatatgttgtattttcattttcacttagttctattaatttttaaaattttctttgagattattcaatgacacatgcattatttagatatgtgttgtttaatttccaaaagtttggagatttctcctttgaattcattcttgtcagaatatatactctgtaatacagcaattcttctaaatatgtcaagatttgttttaaggacccttaccttaatttcagttattacatttttcagttctataatttttacttaccttttttaataatgtctatttgctgatatattttctttttagaacattttttcaagataatttttaactgcttgttagagtatttttataatggttgttttaaaactctttctagataatctcaatatctgatttaatttgatgttgacatttgttgtctcttctcattcatcgtgtgattttcctggttcttgctatgaggactgattttaaactgcatcctgtaaaactctgaatcttatttaatcatttattttcagcagaaaagaaaaatagataaaaattattaaagatgaagaagattcaaacaaaactctgagtcagtttgctatttataaatcaatacttccaaaatctgcaattcaagttcacatgtaatagttaaaacataggtcatatactggttcataaaacatgtaattacttgaaaatatttaaataatacaaattttttcaatattaaatgtcaatgacaaagcaatatttactaaatcaccaaacatttggaaattaagcaacatatcatttcaaaataacctataggtcaaaaaagacattacaaagaaaatggtgaagtatttcaaactgaatgataatgaagagacaacatttcaaactttgtggaatacaattaaaactgtgctaaaacggaattttctaggtttaaagtttatatcagggaaaaacggttttaaaacagttaccaaaaacttaaaatttaaaagttg

SEQ ID NO: 474431 - DNA, 959 bp, Homo sapiens
aggaaaaccagagacctttgttcacttgtttatctgctgaccttccctccactactctggtcctcttacaaccacatgagaagttgcggaataactcaacatttaccattttatggtcattcagcatttgaagcaattggaaaagtgaagaagctcagtctgatcaactccagcttcctgaatcctggtgaaaccattatatctgagaagtatactcagcaaatccatgagatacaccaaaaactacaatgcctgcagctgcctttggtcaacagaaaggtcccaattcttctccacgacaatgcccaaccacatgttgcacaaccaacacttcaaatgtttgtcaaagatcagatagttgtaggacttgagatcaaaatcagcttctcacaaagagactccagagtcgggaagagtagaaaaacaggccataagtatcaatcagaatctggcacgtggaaggcaaaacgcatgcatgagaggactctcccagagcttctacatgacaactcttcatttacctgaaggatataaaagctaaaataggaaatcagccaaatttgtgttcaagtatacaaataaattttgctctttagccttctgttgaattttttcccctcaaggcttaatggacttctctgaagtcttttaaaactgttttggaaatgtaagcccgttatactgcaacatatcacatttcttagcaagaaatgttgaacaaaataataacatttaagtctgtaggtttgagtttcaattaagctaagcttcaattactgtacttttaaaaaatagaatatattacctgggagaactagatttttcatttatttctcccttttcagaattttcatactattcttatctatttctattcccttagttttcttgtgatttctgtttttaattagaaattgtgtttcaaatttgattaaatattaagcctggggtgtttttac

SEQ ID NO: 474432 - DNA, 1518 bp, Homo sapiens
caggtcctaaagaccttgctgataaaacaggttgcagtaaaggagccagccaaattccaccaaaaccaacatggtgatgagagatacctccagtcgtcctcactgctacactcccaccggcaccatcacagtttacaaatgccatggcaatgtcaggaagccaaaacccaccaaaaccaaaatggtgacgagagtgacttctggtcgtcctcactgctacactcccactggcgccatgacagtttacaaatgccatggcaacatcaggaagcaagctgatgaagactcaaagttacctgacctctggctgaatggaaggttctcagtgtcatggaacattgatagtcaagagaagaatgctccagagctgatacctaagaaggctgctggtggtggagagggtgcctataatgggaaggccggagctactaccagagtagaacatctgaaacagagaaacttctgcattgcaaattaggttgggcttagtttcacctgtgatttatagctaggttcatttcttcctgtttaacttggtttttgttatttgtatctgtttaacatggtaataatggatcattttcattaagatggtatcatgccctgaaaatgatgccttaactggagggatgaagaattccgcaatgacgtctgtcattctttaattaattagagtgcacctaataaaacccagaagaatgaatatcctgtctgaacacaattacattatgtctgcataagggcctgcatttgactgttctgggcttcctgtttctccacatgttgcaaaaatatggacaacttgagcatatcacatagctatcgcatattgggttatgggagccaaacttaaagatgggttctggaatttaattttgcaagtattcagttgaaagaaggatttttgctgtttgttgaggttaaaatatcttagtgaaatctgaagtaaactaattagttgtaggtcagggaattattttagtatttcacaacatgattgtttttactaagtccaaaatttgcctaaaatttagtgattttacgttcacattttttaaaatagtcctagtttcatatttatttactttccattcctagggaggttcatgttagtcacgtcatagtgaccaaatttttggtttagaaattaggaacatactaaaaatctggcaaaagagaatgtgtgttttacttcatggcatcatttttattttgtttagtttttacttgccaaagctgccaaagtggaacatacaggagttgacataaatactgcaaactgacaggcaatccaaatatttctttctgtggtacaggcttttttgttaatagtaaatttgggaagaatctttaaatcagcttctaagaaattggttgagccaaatgtacgggtagcattcagtacaggttgatttctgctgctacttttactggcaaacaatggccaactgccaagccatggtcaacccacacagctgttttcaatgattcatttcccttgatttcccagctgaccca

SEQ ID NO: 474433 - DNA, 2852 bp, Homo sapiens
gaattctatgtgagggacacacattcaaaacccagcagcagtattctggaatcctatgtaacggacagatattcagaccctagcagcagtgttctggaatcctatgtgagggacaaacattcagaccctcgtagcagtgttcaggaatcctatgtgagaggcaaacattcagaccacagcagcagtgttctggaatcctatgtgagggagaaaaattcagaccacagcaggagtgctctgtaatcctatgtgagggacaaacattcagaacctcatagcagtgtgctggaatgttatgtgagggacagacatttagaccctcgcagcagtgttctggaatcccatgtgagggacaaacattcagacactcgcagcagtgttctggaattctatgtgagggacagacattcaaaacccagcagcagtattctggaatcctatgtaacggacagatattcagaccctagcagcagtgttctggaatcctatgtgagggacaaactttcagaccctcatagcagtgttctggaatcctatgtgaggtataaacattcagacaccagcaaaagtgttctggaatcctatgtgagggacattcagaccatggcagcagtgttctggaatcctatgtgagggacaaactttcagaccacagcaggagagatctggaatcctatgtgagggacaaactttcagaccacagcaggagtgttcttgaatcctatttgaaggacaaacattcagaccccaggagcagtgttctgaaatcctatgttaagggcaaacattcagaccccaatgtgaatgttctagaatcctatgtgagggacaaacattcagaccatagcaggagtgttctggaatcctatgtgagggacaaacattcagacccttgtagcagtgttctggaatcctatgtgattaaaaaacattaagaccacagcagagtgctctggaatcctgtgtgagggacaaacattcaaaccccagcaggagtgttctggaatcctatgtgagggacattcagaccctcgtagcagtgttctggaatcccatgtgagggacaaatattcagaccacagcaggagtgctctggaatcctatgtgaggacattcagaaccgcatagcagtgtgctggaatcttatgtgagggacagacatttaggccctcgaagcagtgttctggaatcctatgtgagggacaaacattcagaccccaacagcagtgttctggaatcctatgtgagggacaaacattcagaccctcgtagccgtgttctggaatcttatctgagggacaaacactcagaacccagcaacagtgttctggaatcctatgtgagggaaaaacattcagaccctcgtagcagtgttctggattcctatgtgagggacactcagtacccagcagtagtgttctggaatgctatgtgggggacagatattcagaccacagtaggagtgttctagagtcctatgtgagggttagtcagaccacagcaggagtgttctggaatcccatgtgaggaacatacattaagatcacagtaggagtgttctggaatcatatgtgaaggacaaacgttcagaccctcataacagtgttctggaatcccatgtgagggacaaacattcacatcccagcagcagtgttttggaatcctgtgtgagggaaaatcattcataccatcgtagtagtgttctgaaatcttacgtgagggagaaacactcagaatccagcagcagtgttctcaaatcctatctgagggacaaacattcatacagtcatagcattgttctggaatcctatgtgagggacaaacactcagaacccaacagcagtgttctggaatcctatgtgagggcaaatattcagaacacagcaggagtgttctgaaatcctatgtgagggacaaacattcacaccacagcaggagtgttatggaatcctatgtgagggataaacattcagaccacaacaggcgtgttctggtgtcctatgtgagggacaaatactcagaacccagcagcagtgttctggaatcctatgtgagggacatacattcagaccccagcagcagtgttctggaatcctatgtgagggacaaacattcagaccccagcagcagtgttcttgagtactacatggggtacaaacattcagaccacagcaggagagttctggaatcctatgtgagggacaagcattcagatgctcctagcagtgctctggaatcctatgtgagggacaaacattcagaccccagcagcagtgttcttgagtactacatggggtacaaacattcagaccacagcaggagagttctggaatcctatgtgagggacaagcattcagacactcctagcagtgctctggaatcctttgtgagaaataaacattcagacaccagcagcagtgttctggaatactatttgaagggcaaacattcggaccctcatagcagttttctggaatcctatgtgaggaacaaatactcagaacccagcaacagtattctggaatcctgtgtgagggacaaacattcagaccacagtaggagtgttctggaatcctgtgtgagggacaaactttcagaccacagtaggagtgttctggaatcctatgtgagggacaaacattcaaaccctcgtaacagtgttctggaatcccatgagagggacaaacgttcagaccctcatagcagtcttctggaatcctatgtgagggacagacactcagaacacagcagcattgttctggaatcctatgtgagggagaaattcagaccacaggaggggagttctggaatcctatgtgagggaaaaacattcagacctcagtaggagtgtt

SEQ ID NO: 474434 - DNA, 799 bp, Homo sapiens
gggtgaagtgactgaagcacagaccctttacgggggtcgggctgggggatggtcaggtctttttcatcccatgaggccacatttcagactatcacatggggagaaaccttggacaatacgccgctttcaagggcagaggttcctgcggctttccacagtgtatcgtgcccctggtccactgtcctccctgcgtggtgcacgatggaggctcagactctgtcctcaaggctggcaagaagacaggctctaaggacttcctcatcatcatgcaagaagaagagaaaacaaccatcaccgccatcgtcttcggaacagttttatctttcaaaatggaaattgcacccattcaccaagctctccattcctctctctcgcctacccctgggggccacctttctagtttgcaactctatgagtttaactactctagacacttgatagataagtggaatcataaccgtccaccttcattcttctgcatgtggaaatcaagtttctccaacaccaattcttgaaaaggctgtttttccaccaatgagctttcttagcactcatgttaaaaatcgtttcaacatataggctgaataatacttcattgggtgtgtataccacagtttcttaattgaaaaaatttctaaagagcaaatatttttaaagtctcggaatatgaaacttcagggatactgtgcctattttattcttttctatttcccatcttatgtatatgcaagtgtataacaaagcagcaatcaatgtgtgtataaatctataacttcaacaaatgtaaaatgtaaatgct

SEQ ID NO: 474435 - DNA, 804 bp, Homo sapiens
taatatcgcgctagcatattaccaataacatcacagggtgtccacccatggtgtacacgcactgtgatgttagggataatatttcgctgggatatgatgaataataccacagggtgtacagaaactgtgatattagaggtgtccaagtcacacagagccacggaatctcacaggtgtctgagaattcctcctcctgggactctcagaggatccagaactgcagccggtcctcgctttgctgtccctgtccctgtccatgtatatgctgacatcggtttcaccttggccatggttcccaagatgattgtgaacatgcagtcgcatagcagagtcatctcttatgagggctgcctgacacggatgtctttctttgtcctttttgcatgtatggaagacatgctcctgactgtgatggcctatgactgctttgtagccatctgtcgccctctgcactacccagtcatcgtgaatcctcacctctgtgtcttcttcgtcttggtgtcctttttccttagcccgttggattcccagctgcacagttggattgtgttactattcaccatcatcaagaatggatccttttgtcttactataaaattgtcccctccattctaaggatgtcatcgtcagatgggaagtataaaggcttctccacctgtggctcttacctggcagttgtttgctgatttgatggaacaggcattggcatgtacctgacttcagctgtgtcaccaccccccaggaatggtgtggtggcgtcagtgatgtatgctgtggtcacccccatgctgaaccttttcatct

SEQ ID NO: 474436 - DNA, 2109 bp, Homo sapiens
ccgcctcctgcaggcgaggctcacatccagcactgtcccttacagtcaccatgcccctggcgacctcagccataaagggagacagacccatcatctggagaacagggtaccaaacagcccacaggatggctgtgatgcacccacaaatcccctcagagatgggcaaactgagactggctggaggtgggccagaagctgtgaagccagggcaggggctaaggaagtacctgtcattgggcatggggcccccaaccctgcccagtctcaccttcatgtgcaggctcgagcccaggtacacggtgaagatggccacagcctgccaccagtgtgctgctatgaagagacaaggatcccctggggttgaccggaggagatgggatatggagctgggcagaggggatgccaggaccagacagggcacaacatgggtccaagatacccaggttggactctgcccagaattggctatctttgggaaaaacggccaagagactctggtgcagtatgaggctccagcccctgctacagacagagacaccgagccagcctatgccctgccagcagcaggcatgacctctgccactccacacccccaaggatgatgttcaaaactgttcacagctttggcccatcagaacagacactgacatgggtgcctcgcaggactgtgcccatgtgtgctagctgtgtgtcactgcatgtgcccatctgtgggcagggagcatcctggagctgaacatgggcccacccgctgccttctgcaaacagggccctgttccccagcagcccagacctggggcctggactctggtactgagcagaatgggttggggctgcaggcctgctcctctctatacaaaggcccatgtctgtatctatgccatggatgtacaacgggccacttgctcctaccacatgctccatgaggcagagaccaaaacatctgctccaagtgtcatgacaattatgccagggtaagccctgtcccctggtatgaaaagggagaatccctgatgtgtttttcaaactgtccctaaggggtgtccacagagccccacacctgccccgtgtagccacgagatttcacactgacactccagtgttgatggggccctgtgcccgccctggggtattaatggaatgtccatggcgtggaaaccccatacctctctccagggtgtccatgccttacccatctgtccccaatgtgtccatgagacttcccttccacccccagagtgtccacaggaagccccacctgcctctgccatgtccacaggaccctatgtgaccatgggaccccatatctgtccctgggatgtctatgtctagccaaccacccacagatagccataaagccccctgccccgcccccccccgctcccccccccccccagtgcacacagctatactcactgctgagtccagtcttgttcagggagctgcccacaacccaaagggcggctgccacatagaggatccagctgtgttgcaggacccgaggcacaggggcccagaaaaagaggatgaaggtgagcagcaggtgcacccctgctccagccaccaggggcacagggcgtggcagccacaggcccagcaggcccaggagtgaggtggctgaggcgcccaggctgtaaggcacgaggaggtaagccagccactccagccccaccgagcacacaccatagccctgcggggggacaaggggtgagtgttgaagtccggaacagcccagaccccagtctcagagccctccccgcagcgcggggagtgcctcacccccctgcgatgggggtcctaagagccagggggggaagaggggttggctcttactccccgcatcatggggggttcctcacccccctgcgatgggggtcctaagagccaggggggaagaggggctggctcttacaccccgcatcgcggggggcgcctcacccccctgctatgtgtgtctcttaatccgatcaagtagatgcctaaaattaaccatcagaatatttatgcctgattcatgtctgaaatttcaggatgaaagctatgaaatctctatttgtgtttgtatatctgttaaagtatgttatgtatatgtgatatattcttaactcc

SEQ ID NO: 474437 - DNA, 1466 bp, Homo sapiens
cagctggacggctccccaggcagagcctgccatggactccatgcacacagaggatgcacaccttgaggctggactatgaggagaacattcctgaagaggtgcatgaagcctggtcctgccctcactgggaacccccttccctctgggtaccagacagaattctatgcactttcctggaggctccatgctggtctgttcatttggaagtttgaggctgtccatgaggaagtaacaaaagagatatctcagagcaggttgtggggcacaggctgagcccttgcctagtccctccctagtccctttgcagagccagggctggaacaaggacctgtggataatgagggaactgctctgcaataaccggcctgagcagctgcttcaagaaacagccacaatcaaggcacctatagcccctgctgacccgtggagccaggaggtgatttacaacttctgcaaggcagtcagctccgtcagctgtatgcccttcaacattcacttcaactcaaacatcccaccagaaagcagtggggactggcgaatgcagcagccctgcaaagtggaacagagcatcctgggctccatacctggtccttgccacacagccctttctacagagaatagctctggggcgtttggggatccctatggccccgggtggcttcctgtcccccgctgcctatgctgcttcccttgcctgctgtcagagcccaacatggaggaggaggttgccgtcctgggagcctgagggagctcttcccttgcctgctggcagagcccaacgtggaggaggaggttgccgccctgggagcctgagggagctcttcccttgcctgctggcagagcccaacatggaggaggaagttgccgccctgagagcctgagggagctgtgtctgactggggcttctgcctggggttttgcaaagagctacttatgaatatagtctctccagattccttgtttcaaaggaagtgagcatgagctagcaagtgtagcaaccccacagctgataaacaactttgtcttggttttaaaccatcacatcttcatttcacattggaataaagtaagtgaaacctgctaccccagccttgcccgtgtgttctgtaacccagtctcctttggttgtgagggctgttgtcagaaatgttataagaaaagattatgcataaatgaaatcaaatgtaaaattatgcttataatgtcacttgagtgaaagtgaaaacggttcacatggctaacaccacttcttaagatacgggcaccatgtaaagctgagaatggattgggtttagttactattgtgcctcctcctcacccgagaggcccatttttcctggttgattcattaagtgtattagtgctgtcagtcgcctttggacaactcaaatgacaagtggctgttgtttcataaagaaaatgaaggctttagatgtgaaaccctccttttctcttctgcttctctt

SEQ ID NO: 474438 - DNA, 1471 bp, Homo sapiens
ctttgcattttctagaattttatataaatggagtcatccaggaatccaccccctgaagtcatctggctgcacaatgggaatgagatccaagagtcagaggacttccactttgaacagagaggcactcagcacagtctttgtatccaggaagtgttcccggaggacacgggcatgtatacctgcgaggcctggaacagcgccgaagaggtccgcacccaggccatgctgatggtacaagccgtctccaaagacaatggccacttcgaggtgcttcagaatgaggacgtgttcaccctggttctaaagatggtgcagccctggcatgccggccactatgagatcctgctcaagaaccgggttggcaaatgcagttgccagatgttactgatgctagagaacagccctgccaaagccctcctgcaggggagtgagcctgccagctgtgagggcctctgtggtggaggagttggtgctgatggtggtggtagtgaccgctatgggtccctgatgcctggctggccagcaagagggcagggttggccagaggaggaagacggcgaggacatgcgaggggtgctgaagaggtgcatggagacgaggcagcacactgaggaggcgatccaccaggaagagatggagcagctggacttccgagacctcctggggaagaaggtgagtaccaagacactatcggaagatgacctgaaggagatcccagccaagcagatggatctcctgctgggtggcaagaagaaattaccagcagagaatggtagcagcagtgctgagaccctgaatgccaaggcagtggcaagttccaagcccctgagcaatgcacagccttcaggacccttgaaacccgtgggcaacaccaagcctgctgagaccctgaaatccactagcaaagaagaactcaagaaagaccttaagaatgatgtgaactgcaagagaggccattcagggaccacagataatgaaaagagatcagagagccaggggacagacagccccagccttcaaggagaagctgcaagatccaccatcacctggacgctgaatggaaagaccctcaagaccaccaagttcatcgtcctctcccaggaaggtccctgctcaggggccttgggtacatgcaccaaggctggggctaagggctgggatcctggtctttgtggcacatgcccacatctcggcatccgtctggcagagcctctcatggcacccccacctgtggctccccagaggagacctgagcctgagttaattcccagctccagcgtggagagggctctgttcacaggcttggaggtgggggacacggaggctcaagccagcgaggagctctgagtaaagagctgtttagagcagcgtcttaggttaggggaagggtgggcagtgaccagatggcacggagctctgagttggggtcaacaataacttaagtcttgatagcattgtgggtttgaaggga

SEQ ID NO: 474439 - DNA, 1323 bp, Homo sapiens
ggtgtccacccatggtgtacatgctctgtgatgttagggataataactccctaggatattatgaataatacaacagggtgtacagaaactgtgatattagaggcgtccaagtcacacagagccacggaatctcacgggtgtctgagaattcctcctcctgggaatctcagaggatccagaactgcagcccgtcctcgctgggctgaccctgtccatgtacctggtcacggtgctgaggaacctgctcatcatcctggctgtcagctctgactcccacctccacacctccatgtacttcgtcctctccaacctgcgctgggttgacatcggtttcacctcggccacggttcccaagatgattgtggacatgcagtcgcatagcagagtcatctcttatgcgggctgcctgacacagatgtctttcttggtcttttttgcatgtatagaagacatgctcctgactgtgatgtcctatgaccaatttttggccatctgtcaccccctgcactacccagtcatcgtgaatcctcacttctgtgtcttcttagttttggtgtcctttttccttagcctgttggattcccagctgcatagatggattgtgttacaattcaccttcttcaagaatgtggaaatctctaattttgtctgtgagccatctcaacttctcaaccttgcctgttctgacagcgtcatcaatatcatattcatatatttagatagtactatgtttggttttcttcccatttcagggatccttttgtcttactataaaattgtcccctccattctaaggatgtcattgtcagatgtgaagtataaagccttctccacctgtggctctcacctggcagttttttgcttattttacggagcaggcattggcgtgtacctgacttcagctgtgtcaccaccttccggcaatggtgtggtggcttcagtgatgtacactgtggtcacccccatgctgaaccctttcatctacagcctgagaaacagggacattcaaagtgccccgtggaggctgcgcagcacaacagttgaatctcatgatctcttccatcctttttcttgtgtctgtaagaaagggcaaccacattaaatccctacatctgcaaatcctgccccttagtcacattttttttgttgcttgatggcttttattcctttccacatttgctatgtgaatattgctttcttcgttatgcctttaactggaatggaaataacttctcacctatgtgttcaaatgatttttaacatgagtgctaagaaagttcattggtggaaaagcagccttttcaagaaatggtgttggggaaa

SEQ ID NO: 474440 - DNA, 632 bp, Homo sapiens
cacctctagagcacgtcgcagttctgatggggctgtcaaatgcagctccagagcacctggcagatctggccggctgccattgcaactttagagcacacagcaggttttatgggaactgtcaatgccagttctagagcacaacgcacatctgacagggctgtcaattgcaactctagagcacattgcagatctgatggggctgtcaattgcagctctagagcacagggcagatctgatggggctgtcaattgcagctctagagcacacggcagatctgatggggctgtcaattgcagctctagagcacaccacagatctaacagggctgtcaatagcaactctagagcacacagcagatctgatggggctgtcaattgcagctctagagcacatcgcagaaaattcaggtcaggaacctctcagactgcgcttgcacccagccacctgcacagtgaagccatcctgcaaagcgagtggcaagcttaacttcaaatgtcacattgatgtccccaataaaatgtcacacatgcacagagtttactgagccaaatttcgatccactgccaaaagaaaatgctgacgacagatcatgagtctctgttttcctatttagacttttcaattctaaactg

SEQ ID NO: 474441 - DNA, 800 bp, Homo sapiens
taacggaatggattggaatcaacccgattacaatgcaacggaatggaatggaagggaatggaatgcaatggaaaacaatggaatgaactggaatgcaatggaatttaatggaatggaatggaacggaatggaatcaacccgagtggagtcgaatggaatggaaatggaatcgaatggaatggaatggaataaatacgagtggaatggaatggaatggaatggaatagaatggaatggaatcaactcgagtggaaaggaatgtaatggaaaggaatggaatggaatggaatggaatggaatgcaatggaatgcacgggtatggaatggagtcaatgcgagtggaatggaatggaatggaattgaatgccatggaatggaatggaatggagtggaatggaataaacaccagtggaatggaatggaatggaatggaatggaatggaatggaatgaaaaggacaggaatggaatggaaaggaatggaatggaatggcacggaatggataggaatggaatggaatcaacatgactggcatggaatggaatggaaaggaatggaatggaatggaatggaatggtatggaatcagcccgagtggaatggaatggaatggaatggaatggaacggaacgtaaagtaatgaacccgagtagaatggaatggaatggaatggaatggaatggaaacaacccgagtggaatggaatggaatggaatggaataaacacgaatggaatggaatggaatggaatggaatggaatggaatggaatggaatcaactcgagtggaatgaaatgtaac

SEQ ID NO: 474442 - DNA, 2324 bp, Homo sapiens
tcaacatcaaacggaatcaaacggaattatcgaatggaatcgaagagaatcatcgaatggactcgaatggaatcatctaatgaaatagaatggaataatccatggactagaatgcaatcatcctcaaatggaatcgaatggaatcgtcgaatggactcgaatggaataaatattgaacggaatcgaatggaatcatcatcggatggaaacgaatggaatcattatcgaatggaatcgaatggaatcatgaaatggaatcagatggaatcatcatcaaatggaatcaaatacaattatggaatgaaatccaatatggaaacgaatggaatcatcatcgaatggaatcgaatggaatcattgaatggaatcgaatggaatcatcttcagatggaaatgaatggaatcatcaaacaatggattcgaatggattcattgaatggaatcagaaggaatcatcgaatggacttgaatggaatcattgaatggactcgaatggaatcattattgaatggaatagaaagaatcgtcatcgaatggattgaatgcaatcatcgaatggtctcgaatggaataatctccaaatggaatggaaaggaatcatcgtatagattcgaatggaattatcatcgaaaggactcagatggaatcaacatcaaacggaatcaaacggaatggaatcatcgaatggacttgaatggaatcattgaatggactcgaatggaatcattattgaatggaatagaatggaatcatcgaatggtattgaatggaatcattatccaatggaatcgaatggaatcaccgaatagaatcgaatggaacaatcatcgaatggactcaaaaggaattatcctcaactggaatcaaatggaattatcaaatgcaatcgaatggaattatcgaatgcaatcgagtagaatcatcgaatggactcgaatggtatcatcgaatggaacggaatggaataaatcgaatggaattatcattgaatggagtcgaatggaatcaacatcaaacggaatcaaacggaattatcgaatggaatcgaagagaatcatcgaatggccacgaatggaatcatctaatggaatggaatggaataatccatggtcccgaatgcaatcatcatcgaatagaatcgaatggaatcatcgaatggactcgaatggaataatcattgaacggaatcaaatggaatcatcgtcgaatggaaacgaatggaatcatcatcgaatggaagtgaaaggaatggaaacgaatggaatcatcatagaatggaatcgaatggattcattgaatggaatcagatggaatcatcaagaggacttgaatgcaatcactgaatggactcgaatgaaatcattattgaatggaattgaatggaatcatcgaatggtctcgaaaggaatccttatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcaaatagaatcatcgaaaggactcgattggaatcgtcgaatggaatggaatggaataaatcgaatggaattatcatcgaatggactggaattgaatcaacatcaaacggaatcaaacggaattatcgaatggaatcgaagagcatcatcgaatggactcgaatggaatcatctaatggaatggaatggagtattccatggactcgaatgcaatcatcatcgaatggaatcgaatggaatcatcgaatggacacgagtggaataatcattgaacggaatcgaatggaatcatcatcgaatggcatcgaatggaatcatcaaatggaagcagacggaatcatcatcaaatggaatcgagtagaattatggaatgaaatccaatgtcatcatcatcgaatggactcgaacggaatcatcatccaatggaaactaatggaatcaacatcgaatggaatcgaatggaaacaccatcgaattgaaaggaatggaattatcatgaatttgaaatggatggactcatcatcgaaaggattcgaatggaatcatcgaatgaaattgattgaaatcatcatcaaatggaatcgaatggaatcattgaatggaatcgaatggaatcatcatcagatggaaatgaatggaatcatcatagaatggaatcgaatggattcattgaatggaatcagatggaatcattgaatggacttgaatggaaacattgaatggactcgaatgcaatctttattgaatggaattgaatggaatcatggaatggtctctaa

SEQ ID NO: 474443 - DNA, 1222 bp, Homo sapiens
ctggctctgtggagtgtgcagctccagcctcatctcccctctagcggccagccagcgccaccagccccgggcagttaggggtttagcacccggaccagcagctgcgagtgcactgggtcccccagcagtgccagcctgccagtgctgcactcgaattgtcaccaggcctcagctgtctccctgcggggcagggctcggcacctgcagcccaccattcccgagcctctcccctgccggcttaggagtgtgggcgcatggctcgggaccagcaggcagctccacctgcggccccagtgcaggatccactaggtgaagccagctgggctcctgagaggaatgaacaactctggaccggagaaacgaacaactccagatgcgccaccttaagagctgtaacactcgctgtgaagatcgcggcttcactcctgaagccagcgagaccacgaacccacgggaaagaagaaactccgaacacgtccgaacatcagaaggaacaaactccagacacaccacctttaagaaccgcacccacagacatactgaatggtataatgaacactggggctcagagggtggagggtaggaaaggggtgagggatgaatatctacctgttgaaccacaaggagcaaatataaatgacctgaatacaagtaaaaatgagatatggaataaacaaaaggtcagaagaagatgaacatttattgaatgtttaatgttaatatattaaagaaagtgtgtttttttcacattgcttaatacaacaaactccgtgacatgagttcacctgtataacaaacctgaacatgtacccagaacctaaaataaaagttaagataaataaataaatatatatattaaattcttcgaaatattctaacagatatttttatcatcacttgtttcataaataaacaggtgtttgtttaattaaaggaatgaattcattattctctcttttacagatgaggaaactgaaaatcagaatgatttatttacacattttccaagattattcagccaaaggatgacaagaaagtgttcaatcataattctaaaacatacttttgctatcatatagtaccaaattttagtatagtagaagtaaattatctctttaccattattcatcttagtttggaaagagatctcaacttcaacactgacaatgacaaagacaaaacccataagaaagtcagagaggacctagcttgcctgataact

SEQ ID NO: 474444 - DNA, 725 bp, Homo sapiens
aatcagctctctgtaaaacagaccaatcagctctctgtaaaatggaccaatcagcaggatgtggcttcactcctgaagccatcgagaccacgaacccactgggaggaaaaaacaactccagacacaccaccttaagaactgtaacactcaccacgaaggtctgcagcttcactcctgagccagcgagaccacgatcccaccagaaggaagaaagtccaaacacatccgaacatcagaaggaacaaactccagacacgctgcctttaagaactgtaacactcaccgcgaggtgttgtgagcccttaaaagggacagaaattgtgcactcggagagctcggattttaaggcagtagcttgccaatgctcccagctgaataaagcccttccttctacaactcggtgtctgagaggttttgtctgcagctcgtcctgctacaattacagtccacaaaaatgtatcgtacattgcaaaataaataagactataatctgaatgtttataacaaaaaaaaataaatgcttgaggtactagataccctatttactctgatgtgactattatgtattttatacctgtaggggggaggggggagggatagcattgggagatatacctaatgctagatgacgagttagtgggtgcagcgcaccagcatggcatatgtatacatatgtaactaacttgcacaatgtgcacatgtgccctaaaacttaaagtataatt

SEQ ID NO: 474445 - DNA, 676 bp, Homo sapiens
ttttcctatataacaaacttggacagctcccaggggtgacccatgtataatgacagccacctacttaacccattgtaaggagatggacacaggggagccaggatacggcttggcttgtgcccaaatggaaggagttaagttgctaaccctagagctggccttgcaggctggctgtgcagctgtgcgtgggagccagctgctgagaggagccacggagccggagcagacagtcgagataaaggcaaacagtgtaaagagctatagcacccacaccacttctttggttccacaggaaacctccaggataaagacacttgctgagtggaagtgctcacataccagcagttactgtgtcctggaggatgccctcatgagtttgaagcgggggcggggaaagagctttgagttctcctctgccgtcactagatggcggtgtgtcaaaggctatttcctaccaggatgctaacctccaaggaatgcacctgttttgttctggggtgttaaaatttttttttgcctgagtttgaaagaagagttgtaggaatgagaaaaaattattacaatagctcaccttcacttaatggacttcagaaaaaaatgattaactgggtaaggtttcttttagacttacagaaaaatttttagatgctaataaagtatttaatgactgttagag

SEQ ID NO: 474446 - DNA, 532 bp, Homo sapiens
acccccagcaaactgcagcagccctacagaagagggacctgaccatggaaagaaaaacaaacacaaagcaacgacgacagcatcaacaacaaaaaaacaaactcatgaagatgagaaataatcaacaaaaaaatgctgaaaatccaaaaggccagagtgccttttctcctccaaatgatcacaatatgtctctagcaagggcacagaactggacggaggatgagatggatgaattgacagaagtaggcttcagaagatgggtaattaaaaactccactgagctaaaggagcatgttctaatccaatgcaaagaagctaagaaccttgataaaaggttagaggagctgctaactagaataaccagtttagagaggaccataaatgaactgatggagctgaaaaacacagtacaagaacttcatgtatcaatagacaaatcaaccaagtggaagaaaggatatcagagtttgaagaccaccttgctgaaataaggcatgcagataagattagaaaaaataataataataataaa

SEQ ID NO: 474447 - DNA, 942 bp, Homo sapiens
aacttaaagggaaactttcacaatgtctagagcccttgatgtcctgcaaatgaaggaggaggatgtccttaagttccttgcagcaggaacccacttaggtgctcgtgccatcgctgcctttaaaaaccctgttgatgtcagtgtcatgtcctctagcaatactggccagagggctgtgctgaagtttgctgctgccactggagccactcaaattgttggccgcttcactcctggaaccttcactagccagacccaggcagccttcagggagccacggcttctagtggttactgatcccagggctgaccaccagcctctcacagagacatcttatgttaacctacctaccattgctctatgtcacacagattttcctctgcgctatgtggacattgccatcacatgcaacaacaagggagctccctcagtgggtccgagctggtggatgctggccctggaagttctgcgcgtgtgtggcaccatttccctcgaacacccatgggaggtcatgcctgatctctacttctacagagatcctgaagagattggaaaagaggagcaggttgctgctgaaaagactgtgaccaaggaggaatttcagggcaaatggactgctccagctcctgagttcaccgctattcagcctgaggttggagactggtctgatggtgtacaggtgccctctgtgcctattcatcaggtccctactgaagactggagtgctcagcctgccacagaagactggtctgcagctcccactgctcaggccactgaatgggtagaaacaaccactgaatggtcttaagctgttcttgcacaggctcttaagcaacatggaaataacgttgatggaaaatacacatcagtttctaaaaaataaattcactttggttatatcagaggtgtcaagtctgggatttgattttaccctatttgcaagct

SEQ ID NO: 474448 - DNA, 538 bp, Homo sapiens
aggactggcgatgaaagatgagacatcaaactctgaaggtgctaaagcaacaggtcatgagcttgccaaccaaccacctcagcagctgatgcctgcagggcagtggagaccagaagtcaccagagacatagcagcagaggccagtgagaacccaggctatagcttgaaatcccgcacacagatctcccctcccaccgctgccttgaggcttcccctgtatcctgtaggccgccttgggaagtcaaggggaagaaggcggccataccaggaagcagctggaaagctgcagtcctacttagagaagccccattaccttcagggcaaaggtcccataccaagccctagtgttttcctaacaccttcctccatcccagagaagggccctcaccagacactgaatctgctggtgccttgatattggacttcccagcctccaaaactgtgagaaatttctgttgtttataagccactcagtctagggtttttggttgtagaagcccaaatggactaagacatcctccatgtggattgtgcagta

SEQ ID NO: 474449 - DNA, 668 bp, Homo sapiens
tcagtgaacacatgagtgatatgaatataaaacaggtttttgctctcatggagaaagttttgttggtctggatagaagatcaaatcagtcacaacattcccttaatccaaagccaaatctggagcaaggccctaactctcttcagttctttggaggctgagattggtgagaaagctgcagaagaacagctggcagctaacagagatcagttcatgaggtttaaggaaagaggccaactccataacataaatgtacaaggtgacgcagcaagtgttgatgtagaagctacagcaagtagttatttagaaaatctatctaatttcaatgatgaacgtagctatccgaaacaacagatttttaatgcagaagaaacagccttctgttggaagaagatgtcatccaggactttcacagatgcagaggagaagacagtacctggcttcaaaactttgcaagacaggctgcctttcttgtcagggacgaatgcagttgatggcattacattgaagactgaattgtgattaatatttcagtactggtttattataaattatgcaggtatcccaaattaagtcattaactaacacaatttttaatattagctcaaggctttaattttttattttattttactttaagttctggaatacatgtgtagaacgtgcagg

SEQ ID NO: 474450 - DNA, 1967 bp, Homo sapiens
tcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggcactgggttgggtgctgaagacagtggtgaacataacaggcatgatccctgctctggaacaagagctgccactggaaaaaaaggataaacaagtgattcaggcactaaatgctatgattccaaaactggatgcttcacaaaggagccaaagcaatggtcaaaaaggactgacagctgagagatgtcttctgacaccactttctgcagctggggtaatagatccattcctcaagagggatctggggtgctcaccagaatatccactacaaatggtcactaatttcatggttgaattggtgttttttaaggtcatgatcagttccagaagtggctcctgggtgatgagccgggtctgggacaatggttatccttgggacatgctgctcgtcactcgatttggaaccttcctcaagaacaatttaccgacagccatctctgactggttgtacatgaagcagatgaatgcaagattcaagcatgaaaactatggcttgatgcctataaaaagagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtccaccagtcccattcctgtgataatccactaattcattaatccataaatgatgcttcaatttatttaagcagagtcctcataacccaatcacctcttaaaggcctcacctttcaatactgctgcattgaggattagttttcaacatgagatctggagagaaaaacattcaaaccattgcatcatacaaaaaaaaggctattaaaaattggattatagcaacttaatcttctatttattttttgtactggcatttataacatgaagcaaaaaatttttatgggctgtgtttaatttttagttacttgattctatttagggca

SEQ ID NO: 474451 - DNA, 474 bp, Homo sapiens
gacttaccctccactgtgagagttacctaaagctcggtgtccgtgatggtctacagggcttccaaggtgattgggcagcctcagtcttcagctgctaggctgagaagatctgggaaggagtcagagagccttgggccagagttccacgggctctgggagtggctgccagtggggtcccgcacagatgggacgtggcttaggaggaatcctgggctgcgggcattccttggcctggtggccagatttctggcacttgtagcaagctcctgggggaggcaggcctggaggaacgcctggtcactgcggtttaggcgtttggaagttcttgtgtgctggagatgtggctggggtttgtctcacagtggaggcaaggaattgcaactcagaaatatgttgctatttggctgcctctactctattattgtacaccttgaaggtgaggttaattaagtccttttgtggggttttagggcc

SEQ ID NO: 474452 - DNA, 641 bp, Homo sapiens
acgccaacagcgcagaggtgttaccagggcggtagctttcggtggagtctgcacgctggatgggccccagcagtgctgggggagtggagctgacgagggaggagacaggaggcccacagggccagaggggaggccttccgccttccaaggccttgtggatggggcaaaagaggttggtctctgtcccgggagcaacgcgagccattgcagagttttcatcagaagcagagcagtgtgctcagctggggcagatcctgcgtttgctgggtccgaagcttaaacaactgggccatcccacaggaagagaagtcaaatgttctgaatgtgcatgctcctttgagtgcggtcattcgggttctgttctgagcacctctcacgcatttgctcatttcatcctcacaccacctggggatacccacgttaatgcaatcaacaggacccagaaaatccagttgcttatccagaaggcctctgaaaatagtccatgcattaacattcagtgttcttcaattaaccacttgaatgttccacacgggaaccttgcccaatacactttccttggttcttcagaatggttcttgccttgaatcatattttgtctgagaccacccttaccatacatggtttttgttgagttgttc

SEQ ID NO: 474453 - DNA, 974 bp, Homo sapiens
gaagaagcttctcagaggcggctctcccggctccagctccccaatggccatcatgtggagtcaagaagaacccaccgtggagtggacagctcctcagctgctgcccccagctctgggcccaaatataaatacagatgtaggtgtaggtgtagacataggtgaaggtgtaggtataggtgtaggtataggtgtagacataggtgaaggtataggtgtagatgtaggtgaaggtgtaggtgtagatgtacatatagatgtagatgtagttatagatttatgtgtaggtgaaggtgtaggtgtagatgtagatgcaggtgtagacgtaggtgtaggtgtagatgcaggtgtaggtgaaggtgtaggtgtagatgtaggtatagatgtagatgtaggtgtaggtatagacataggtgtaggtctaggtatagacataagtaaaggtgcaggtgtggatggaggtgtagatataggtgtaggtgtaaatatagctgaaggtgtgggtgtagatgtgggtgttgatgtagatgtaggtgcagatatgggtgtaggtgcagttgtaggtgtaggtgaagttggtgtagatgaagatgtaggtgtaagtgtaggtgtagatgtaggtgtagacgtaggtgtaggtgtaagtatagacataagtgaaagtctaggtgtagatgtaggtgtagatataggtgtaagtgtagatgtaggtgaaggtatagatgtagatggggtaggtataaatgtaggtgtagatgtagatgtaggtgtagacataggtgtaggtataagtatagacataggtgaacgtgtaggtgtagacataggtgtaggtgttgatgtaggtgtagatatagatgtaggtgtagatgtagatataggtgtaggtgtaggtgtagatataggtgtaagtatagatgtaggtgaaggtataggtgtagatcaagatctgggaatgttattgctctgaagaagaa

SEQ ID NO: 474454 - DNA, 2818 bp, Homo sapiens
gctatattggctatggtgggtgcggggaggggcggtcggctgagctggctgatggcagggcgttcctgagaggtttttgaactggaactaaacaagaatggcagaagccatcagcagccacgcttctcccagcaggggagaagccggcctcagccagagaggagaaaccactgatcagaaaggagctgggatgggactaggaggggagcgtcctagtgccatcctctttccggagcaagttcaagtggggattctgtcacatgcaaacaaaatgacaatgactaattcaatcattacggcttttgaaaaagcaaggcctgctgggcacaaggggggatcccgggctgccaccagccacacagaaactgagtcctctgtgggcagccagagcggggatgtgcgacctgctcagccagaggtggagaaaggatggctctggacagtgacaggagaggaagaggtttccctgcagggcgatgacctggcttgtgccttagaggcaggtgaatgtgtccgcaagaggtgcgcccaagcagaggcaaatggagtggagatcctgggccatccctggctcctgggccttttcctgatgcctttgaggctggattctgggctcacactttctcctgcaactcacgttttcgcaggtgtctcatgttccacctgggttggtctacatgaagggacagtggaactgggaatgaactatttcaagcggctcttcctggtgtgcagggagcttccaaggctgatattgacacccctgggtccatatttctttgatcatatccacagagatgggtgagggaagaaggtggtgaattacatcactccaccatgaggaacccatatgcaattaactcctaatccatccagaatttatgcttgtgtacagtgtgagatgaacaggcaacttacgttttttttttccttcaaattgttaaccaattgttccaatgtcatttgttcaataatttgtttctgctgaattcaatgtcacttttagcatagagtaaattcttatatttaacaagtctctttttggactttgtacttcattcctctcatctttctataagccacattcttaaatgtcatttcataacaggtatccccttattagtttttacccaaagcattttggctagtctaatttatttactctcacaaataaacttgagaatcacattgtaaaaaaagtgatttttataaaaatagaattcaatctacaaattaatttgtgggagcactgacaactacagaatatttgcccctctcatcctggaatattttatgacttattttagttttgagattttttttcatatagctcatgtacatttcttaaaaagattattcctagatatttgacagtttggggagttttctgaaacacattttataactttattatatgtttattttgtatgactattggaaaccaaaaataaaattctaagccctccaactgactgaatggatccctcctcttggccaagggcatcccaaagaaacctgaaaacctagttcaggccatgatgggagggactgtcacatttgccttgttatgctctccccgctttggagtttaggcacagctgaccagcattaacattaaaatagagatcataagactgacaaacagactctttgtagcaataaggtatcaaattccaacctgactctggcatcacatcacaggacgaacagcaggccctgagggaaatcaaaatattttaccccaaaatatatttctttgacatattttgaaatggtcccacaaaacctctcttgtgggggatatttgcattctgtagagaatctcactccctaactaggtcttttccaagtgattgatgccttttcaagtctggtaagagacattccccatctattctctctggggcctgttgctctgaggcttcatctacatgacaagaaacttgccttccacaagacgccttatcttaactgaagcatttctctctgctaacttcaactctttagacaaagctcaactctttcaaccaactgataatcaggaaatctttaaatctactaatgacctggaagcctccactttgagatgaccagcctttctggaccaaaccaatatataccttacacacattgatttaggtctttgcctgtaacttctgttctcctaaaatatataagaccaatctgtaatccaaccaccttgggcacatgttctcaggacctcctgtggctgtgttatgggccatggtcctcatatttggctcagaataggcctcttcaaatattttacagtgtttggctttttccatcaacattctcttatggaaatatcatgttacttccagtacttgttgttgattttatcaaaaataatttagttacttcttttctaattgtcaaaatttacttttcctgtcttattgctttgactagaatttccagagcaatttaaaatagtgttagtaatagcagacatctttgtctcatttctgaaaatgcctctagagtcttcacattaagaatgacttttgtttttaagatagataagttgtattgtgttaagaaagacctttttctatgtgtagcttttcaacagttgtattaagaatgggtattggattttataaatgccttttgcacatttatctagatcagggatggacagtccaagggccccaagggcctagtctgggtggcctatttgtgcaacctgtgagctaaaagtgactcttatacatctaaagggatgttaacaaataaaacaaaaaaccccacaatatgcaacaaaggtggcatgtggctcacaaagctcaaaata

SEQ ID NO: 474455 - DNA, 870 bp, Homo sapiens
aaatcaccaacttcctgctggcctttgggtcctctctcctgcagacatgctcctcttgtttttccagacctaccattggttaaagaagcaggggcatctcttccaggctgagccagaaacttgctgtggaccttgttggtcaaccctgcccttcactatcaggttctcactgtccccatccctgaagaaggcaagggagccagtgaacacagccagagaaagcaatcctgttgttgtgtgtctgcccttggaaagggctgcacacctgagactacagggtgtgccacagctggagctcctgcaggaggacacattccccacacccaagaaaggtccaaatagggttgtcacagcaaggcaggacggccatttggcctgctcccattcaagaaaggcctcaaattcacactgagtgaaatacactcacaggactgaaatgagaagtccatccacaacttcaaattgtgtcccattgtccaaccagcctgcctcttggtccctgtgcatgtatacattttataaatctgtcaagtctcttcttgtagcataacacacagtattgcaatttttgtgttaaaagtacttgtttgttgaatgcaaatattacggcaatttttgtaaccctgttttgacattacctctttaatatacattatatatatttaatatataatatatttataatatataataatatatatttataataaatatataataatatatatttataataaatatataatgtatagtatatatttaatatatattagatatttataatacatataatatatattacctcttttatatgttatataaaagatatataatatacttatatatttatatataaatattttatatata

SEQ ID NO: 474456 - DNA, 1708 bp, Homo sapiens
ttttgttcttgtgataaggttggaacagtatggagggcttagaagaagacaggaagatgtgggaaagtttggaacttcctagagacctgttgaatggttttgaccaaaatgctgatagtgatgtgaacaatgaagtccaggctgaggtggtcttagatggagatgaggaacttattaaattcaatctggctgcagaaatttgcatatgtaatgaggaggcaaatgttaacagccaagacaatggggaaaatgtctccagggcatgtcagagatcttggtggcagccccttctatcacaggcctggaagcttaagagggaaaaatggtcttgtgggctggacctagggccctgctgctctgtgcagcctcaggacttggcactctgcatcccagctgctgctgttccagctcaagctggtgttaaagggggccaaggtacagctcaggccatgacttctgagggtgcaagccccaagccttggcagcttccatgtggtgttgggcctggggatgcgcagaagtcaagaattgaggtttgggaacctttgcctagatctcagaggatgtacggaaatgcctggacgtccaggcagaagtttgctgcaggagtggagccctcatggagaacctgtgctagggtagtgtggaagagaataggagctgtgggaaaagggccactgtcctccagcccccagaatggtagttccactgacagcttgcactgtgcacctggaaaagctgcagacactcaacaccagcccatgaaagcagctggggcagaggttgtaccctgcaaagtcacaggggtggagctgcccaagaccatgggagtccacccctttcatcagtgtgccccagatatgggaccctcagctgcaggtctgttggagtttgctagaggtccactccagacgctctttgcctgggtatcagcagtggtggctgcagaacagcagattttcgtgaaccgtgaatgctgctgtctgatcgttcctctggaagttttgtctcagaggagtacccagccgtcacagccctacacactgagttacaagtggaagccatgggaatttagtgaagtacgagggaaggacagaagcagcaaagggatcccagggcctctaagcagaacacagtgcccactacagcaggtgattagacgtcaggatactggaccctcatctctcttccccatcatggaggaaaatatacaaatagacccttttctggggcagctttcgaaatgcctgattctttattgttcaattttgaaggctttgacaatggaaattctgactgctggactatttgagtatctgtcaaggcttagaggctctcagctttctgggtcaaatcagaggcaaatgttttcagcacaatgcagcagacaatgcaagtctctgattcttgaaagaagagaaattcacatttgtcccggtcctggaggcccttcccagactgcagcaggaaagttgagccccagtggaacacaggggtctttctgggtggagaaggcagagaatgacatttggggtgtttggatttagtagggaagggtgctaaaaggagagagtgcacaaggcagagcattctgggctgtccatgtgcagagcaaggctgtcctggaatgcagagaactaagtcaagatcacagaagtagtgaagtcctgggaaatgtttgagttcccacacagtcagtgttcagaga

SEQ ID NO: 474457 - DNA, 937 bp, Homo sapiens
tttttgtgatacaaagttaaatccaggtgcacatgtggacctcccatgctctccactttggtggtgggcgacgaccttgggcagtcgcatgtcccagcaggtttctatggctgtgactttgctcagccagaaagctggaagccaaggtctgtctccagatgccttgaaacaagccaaactacttcaagccaacatcccttctgccaacattccttctgccaccagctctctgtccccagtgctgacgccctttgctctgaagccagatggaaccaggttgttcccaaacgtcatgtctcctctcgcaagtgatttgcttcctcagatgccgggctcgatgctcttccagagtcctttctccattgtcgcgctagaaccatccaagaaagggaagaggaagccaccgaacatctccacagtcgacctcaaacccaaagatgaggcggtcctctacaagcacaagtgtcagagcagtctcccttccgtgatgaccgctttgttagcagcccagccacgccaacaggccaagcaacatggctgcatgtggtgtgggaagaacttctcgtccactggtgctcttcgcattcacgggtggacccacactggagagaagtcttttgtaggcaacatttgtgggcgagttttaccaccaaagccaaacactagacagaccctagcacagcctcgatggagaagaaatagcctaaatgtcaatggaacttatggaactttttactgtgtgccaacaagacctaggggacatttgtgggagcagcttgtgtgtggagtcctcatgaatggaattagtgtccttataaagaagtcccagagagctgctctgccccttctgctatgtgaagacactgtgagaagtcagcagtctgtaacctggaagagagcccttaccagaacttgaccatgctggcactctgatctc

SEQ ID NO: 474458 - DNA, 677 bp, Homo sapiens
tgacatagaaagaaagatctgaagatggaacagaatataatgcacagagctaaatccagacactcctcgcgcagctgcacaccaccccttgcctgcatctttggtaataggctgtggggaacaataccacgtggacagaaaggctttcaggaaaacaaatgcaaaaaggaacacaacaccaaaatgtacaagaacagagaaaatcaagattataagagaggcactaatgaaacagatgaatgcacacctgaggaagcatggttaatccagcaaataaaacttcagttggttaagacagaatttcatatcaagcaagaagaagttactaagaaaaaagagttaattacaaaaactaaaaaaagaagccaggcagctttgcaggaagcaatggaaacaaataggaagagaaaggaagagaaaggcacatgccacatggcagtttgtgaacaatacaagacaaaactttgaacactgccccctgtcgcaaaataaatgggggccacttttgagggtatggttggctgtatcccagagatttgtatatgtaatgcctcttctcattaatttctaatttggtctataagttgtttcattttttcttgctgacattcatatattttggaaggattatttctattctaatccaataaatcattttggggagattttaaatttag

SEQ ID NO: 474459 - DNA, 2499 bp, Homo sapiens
gggtggagccggctgaggtggatggcggcttgtgtcccgagctcctgtggtttcagttggccgcgcgtagaggagagatttccaatgtttccagagaggtccgagccacagtcattcggggcatccgaggacgagatggggtttctgacagcgacttaagtgccaggaagggtcagaatctgccaaggcccgtgtcccagggtggggccgaaggaacccaaggtagagggagtcagcggtccgacagagagagctccagccctaggccccactgtgcagacccaatcagaagaagagagtccttcatcctatatgccacatccctccactgaacttgggagcggatccgttttccaaacatgaggtgactctcgctttgcgatggatcacagggggccgggctttccacagttggcagggtaaagaagtcattctggctcggcctcccccatcccctggtaactggtgagtttaaatgagctgaggctggctttgccggagccgctaccggggggaggggtgtgggcggggtggggggctcccgcggcactgcagaaagtgggcctgagcctcgaggatgatggtgctacaggaacccgtccaggctgctacatggcaagcactaaaccactatgcttaccgagatggggttttcctcgcagaacgcctttatgcagaagtacactcagaagaagccttgtttttactggcgacctgttcttaccgcccaggaaagacctataaagcatatagactcttgaaaggacacagttgtcctacaccacaatgcaaatacctgcttgcaaaatgttgttttgatgtcagcaagcttgcagaaggggaacaaatcttatctggtggagtgtttcataagcagaaaagccatgatgatattgttactgagtttggtgattcagcttgctttccccttccattgttgggacatgtatattgcaagacagatcggcttgccaaaggatcagaatgctaccaaaagagccttagtttaaatcctttcctctggtatccctttgaatcattatgtgaaataggtgaaaagccagatcctgaccaaacatttaaattcgcatcttcacagaactttagaaactgtctgcccaactcttgcaaagcacaagtacctaatcatagtttatgtcacagacagcctgagaccattcttacagaaacaccccagaacacaactgaattaaacagattgaatttagaatctgccaattcaaagtactccttgaatacagattccccagtgtcttctattgattcagctgtaatttcatctgatactgtcccactgggaacaggaacttccatattatctaaacaggttcaaaataaaccaaaaactgatcgaagtttattaggaggaccagcatctcttagtccattaaccccaagttttgggattttgccattagaaaccccaagtcctggagttggatcctatttacaaaactacactaatacagcttctgtaatggatgtgacatccactggagtccctccaaaaaagtctgttgccagaatagtccaaattggagcaaagtctgtcttctcacagagtggaaatagccaagaggtaactccaattcttgcacaaacagaaagttctggtccataaataagtacaacacctcaggtattgagccccactatgacatctccctcaaatgcactgcatcgaagaagttcacgactcttgactagtgacagttccacaaccaaggagaataggaagaaattaaaaatacagtttccacctaaaatcccaaacagaaaaacaaaaagtaaaactaataaaggaggaataactaaacctaatataaatgacagcctggaaataacaaaattgtactcttccatcatttcagaagggaaaatatccacaatcacacctcagattcaggcttttaatctacaaaaagcagcagcagaaggcttgatgagccttcttcgtgaaagggggaaaggttatttagctttgtgttcataccactgcaaagaagctataaatattttgagccatttaccttctcaccactacaatactggttgggtactgtgccaaattggaagggcctattttgaactttcagagtacatgcaagctgaaagactattctcagaggttagaaggattgagaatcatagagtggaaggcatggaaatctactctacaacactttggcatcttcaaaaagatgttgctctttcatttctgtcaaaagacttaacagacatggataaaatttcgccagaggtctggtgtgctgcaggggactgtttcactctgcaacgggaacacgatattgcaattaaattctttcagagagctatccaagtggatccaaattatgcttatgtctatactctattagggcatgagtttgtcttaactgaagaattggacaaagcattagctagtttttgaaatgttatcagagtcaatcctagatattataatgcacggtaagtggt

SEQ ID NO: 474460 - DNA, 789 bp, Homo sapiens
tttctagcaacggagaactttgattggatttttcctgtctacagacagaatgagtctgctgttttcttttttaaacccgaggggactgagcctgagagcctcgagcgcggccatcctcctccaacccacaactggtgattgtggtggtggtggtggtggtggtggttttgtgttccagcttctgttctgttgttgttgttgttgctgctgctgctgttgctgctgctgctgctggtgctccaaggctcccaccgccgctgtgggattttccgtgggagagatatgggagaggactgacgcggcttccagatctatatcttgccagacatctctggctcagcgtcccccaccggctgcctgccaccttccaaggagctctgaggccgatgccccgcccccttcacatcccgccaccctcctccggttggcctacgcccggcgaccccaagggagccgccgaagtcttccaccagatgccccgggtgggccggatggatgggatgagactggaccaccccagaccgtgctgttcttgggggtgggttgacgtacagggtggactggcagccccagcattgtaaagggtgcccagtaaaagctggccaatctgaataatcctcctttaaacacaatttttgatatggttaaagtttttaagaatgtgactcctgcagaatagctgaacagacaatacacatttaaaaaagaacaacacaagggtcaatcagacttgggaaaaaatcaaaaacaacacaagtcttatgaagaactgagttcttaaaatattac

SEQ ID NO: 474461 - DNA, 501 bp, Homo sapiens
tccacatccagtttctcacctgctttaggccctgggggttacattagttagagcagcaattctcaacgccagtgctgttatgttttctttccctttctgcaagctggaagccctaggagatagcgaatccaaagaagaaagcaactcagaaaatctgaagctgagccctgaaggatgggtgagggttgccaaacaagaaggagggaggaatggattggagggtgccagagatgctgcaaggaggccggtggttgtagccgcagtctgggagagatggaatggtggcttgggttatggtatgggaagacatggagagaggctggtgaaactaaagtattgggacttgaagcagcagttttgggggaagatcttaagttcagtggagtatgagggacctgtgggatgtcaaagaaaatacatagattgggcggttggtcatgtaaacatggacagcagagagcaagagacagacctctccaataaagggattgcttggtaagc

SEQ ID NO: 474462 - DNA, 504 bp, Homo sapiens
cactggcatggccttctcagtgttaatctcctgccctggacgactgtcctcaaggtccgttaccatccgaggaatcctgggacagcctgtaaccagactcatcaatgaggcagtaattcctctatatccagttgtacccaacccctataccctgctctctcaaataccagaagaagcagaatggttcactgttctggacctcaaggatgccttcttctgtattcccctgcactctgactcacagtttctctttgcctttgaggatcctacagaccacacgtcccaacttatgtggatggtctcaccccaagggtttagggatagcccttatctatttggtcaggcactggcccaagatcgaggccacttctcaagtccaggcactctggtccttcagtatgtggatgatttacttttggctaccagtttggaagcctcatgacagcaggctactgtagatctcttgaactttctagctaatcaagggtataaggcatctaggtc

SEQ ID NO: 474463 - DNA, 757 bp, Homo sapiens
cctcacttacaatgtccttcgccaagcacctgttagacacaatcagagcacagagctgcaggcagggaaggaagaaactgaaggatcctgtactagcttgttttcatgctgctgataaagacatatccgagactggtcaatttacaaaagaaagaggtttattggacttacagttccacatggcttgggaggcttcacaatcagggtggaaggcaaagagaagcaagtcacatcttatgtggatgacagcaggcaaagagagagcctgtgtagggaaactcccctttttaaaaccatcagatcttgtgagacttattcgctatcacgagaacagtatgggaaagacctaccctcatgattcaattacctcctactgggtccctcccacaacacatgggaattcaagatgatatttgggtggggacacagccaaaccatatcagatcccatgtttaagaagttcccagttcagcatacagccttgacctgaagccttctcgatgtttccctgcactgactcttctgaacctaatcctccatctggaatatacgagtcttcaagaaaacattctttcttgctaccctgaagcatgacatccaggggatggaaagaaataatttgtccataccattcatcgaatgcagctgtggcccctatatcttacctaaaaactatttttatttttcacaattttaagatagaggcatagcttgtcttattgtgcatcatttgattgtgctttgcaggtactgcatt

SEQ ID NO: 474464 - DNA, 753 bp, Homo sapiens
cttcagcacatgatggggatacagtctccagctcatgtaaaatgcctagttgtcatactgtaccatattctcctcactttgccaggctgtccaggtcctttatgttgtcctctggacatagagttgctacaaccttttctggattcttatacctgctatggctgggggcctttcccagacagcagtcacctaaacaggacatttacccttataggtgctgagtgtttatggctgaatggaccttgcttcataggagaattaatagaagacaacttgatggaggtgagtgcttctgattcagtgctgcacgatgaggaagatgtaaaagtgccagaaaacaaattgaaattatacaatctggcagaaggattccgattatttaagactgcttttgatgtcttttatgacatgcctactgaacatgaagatgatgaggatgaacacctttatgatcatccacttccacttaatgaatagtaaacatactttatcttccttatgattttcttaataacattttcttttttctagcttactttattgtaaaaatatagtagataatacatatatgaaatatgtgctaatggaccatttatgttattggtgagacttccagtcaacagtagcctatttattagcagaacttgcataatgtgtttattgcttgattgtgtcccataagtctcttaagctatattcactgtttttcatttctttcttggttttcttttactttctccagatgattttcaa

SEQ ID NO: 474465 - DNA, 992 bp, Homo sapiens
tgaccataggaaccatcgaagacttaaagcagaggagagccacagcatgggtggtgatgtgagtaaaagggataaaagactgaccaaatgtcctgggcaatgtgagaagaaatgtgggattagatctcccacaaagagtccccactggggcactgccaagtggatctgtgagaagaggccactgtcctccagatcccagaatagtagatccactgacagcttgcatcatgcacctggaaaagcttcaggcactgaatgccagccagtgaaagcagctgaggggattgtacccggcagagtcacaggggcagagctgcccaaggccttaggagcccaccccttgcatcagtgtggcctggacatgagtcatggagaatctaagatgagcagttcttatatccataaaatatgcctatacataaaagatgacaatgttgaattttacctgagccatgtacttctggaaaacagtgaaggttaaagaaatcagaaatcccctgcagaggggaaagattttctttctccacctatcacaaggttcacggctgaaatctctattaactaaagacagattaacaagagaaacacatacacatttatttaatataagttttacatgacacaagagccttcagaaatgaagactccatgaaatgggaatctgtgtatttttatgctaagtttgataatgggtggtcagtcatgcagaactgtaattgaacagagagggtatgatctaatggtaataaactggggggtatcttagtcaattttctgctgctaaagcagaataccacagactaatttatttaaaaaaaataagttttatttggcttatagttctggaggatgggaagtcaaagagcatgctaccaacatctggtgagggctttttatatcatggtagaagcaaataagcatgtgagacaaagaaaagaaatataaacaaattcatcctttttactaggcattaactcaaatgataactaatt

SEQ ID NO: 474466 - DNA, 711 bp, Homo sapiens
gggcggtgcaagatgtgctttgttaaacagatgcttgaaggcagcatgctcggttggggctctcatggaggacctccactagggcaatgcagaaggaaaatgtgggttggatcctcacacagagtccctaatgggacactgcctaatagagctgtgagaagagggccaccatcctccagaccccagaatggtagatccaccaacagcttgcactgtgcagctggaaaagccgcagacacacaatgccagccagtgaaagcagccaggaggggggctataccctgcaaagtcacaggggtggagctgctcaaggccatagtagcccacctcttgcatcactgtgacctggatgtgagacatggaatcaaaggagatcattttggaactttaagatttgactgcctcgctagattttggacttgcatggggcctgtagcccctttgttttggccaatttctcctatttggaatggctgtatttacccaatgcctgtacccacattgtatctaggaagtaactaacttgctttaactttacagtcttataggtggaagggacttgccttatttcagatgagactttgaactgtgaacttttgagttaatcctgaaatgagttaagactttgggtgactgttgggaaggtatgattggttttgaaatgtaaagacatgagatttggaggggctggggtggaatgatatagtttgg

SEQ ID NO: 474467 - DNA, 704 bp, Homo sapiens
aggtgccaaggggtgcctgcaggccagcgctgagatgccctcaaactctcctcggcttccctcctatgcttgtcagtgcccaaagtctggagcgggctgaggtggcaagaaggagctggtgtgtcagcactgctccaagtgtgtgcacacccagccaggctgcagcagtgcctaggctcagccccaactttgctctgagattggagtgggcactgacagcagggagaagccaggcagtgggagcaggcacttgcagagatgcctgggtcttcagacatggtattgggagcaggcacatgcagagatgcctgagtctgcagccatggattgagcagctgcagctgtgcccaggggctcaggtctcctgcctgctctgtggagtgggagaattgggtttgcagcctctgtttgggtggctgcagctgtgcctgggaggaaatgtgggagaactttgttccaacactttcctgcttctggaatccactacctctgagctttgagtagctttggggtcttgcctgtttttatgcttcaggttcttttgtgcatgagttttggctgtgattttctctttcaaaccaaggcttatagctctatgcatgtgaatgaaagtaacattgtggagagatgaaattacataggaccatgacaacatgataaaaatgtcttaaaaatgggctttctgtaatagaaataatattcaa

SEQ ID NO: 474468 - DNA, 653 bp, Homo sapiens
cgtcgacctggtgctggagctcgcgccaatgtcggtcctgcgagtgtctcttggtggacacaccctcatcgtgatccccgaggtcctcctgagctccgtcgacgaatgctcaggagcgcagggcgactggtctgccggcctggaagtggacgttttcctgggcgctcacggggaagacgtcgtcgtcgagcaggaagtctgcgcatctgtcccagagatcgctgccgaggaagaggcctacgaggaggacgcggactctgagttcccggagctctggatggactccgcagccggctcagccgctgggctctacccctccgctagaagtatgttcagcccctaccgggagggccccatccgagggccctgtgctctggcccccaaccccagttcagagagacgctctccacgccccatcttcgacctggaattccatcttctggagcctgtccccagctcacctctccaacctctacctccctctccgagtccaggtccccacgcgcgcccggagctcccagagcgccctccgtgcaaggtccgaagacgcctgttccaggaatgagttgcctcccacaatcccttgccaccctgctgggctccaggagaccgtctcctgatagccgttgtgtgagtcaagactcagagccaaa

SEQ ID NO: 474469 - DNA, 945 bp, Homo sapiens
gcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtggactggctatcatatgccaaagcacgatgtgaacctgcagcgactcaggctgcccttccagctatcaggcagaggaaaactccctgagcgccttttgtaatcttgctgatagcacaaactccaaactccctccagaaactgctactc

SEQ ID NO: 474470 - DNA, 637 bp, Homo sapiens
ctgcagctcctggatctcctcttcatgcagttgcctgaggaagttgatctcgtcagtcagcccttccaggcgagactccagctctgccttgttcatgtaagcttcatccatgtccttcttgatgaggacaaattcattctccgtttctgtacgcttattgatctcatcctcatacttgttcttgaagtcctccaccagcccctgcatattgccaagctccgcctccagcttcagcttctcctagcccagagcctccagctgccgcctaaggttgttcatgtagctctcaaatacgttgatccgagccatcttctgctgctgcaggaggctccacttggtctccagcatcttgttctactgctgcaggaaccgtaccttgtcgatgaaggaggcaaacttgttgttgagggtcttgatctgctccttctcctgggtgtgcatggcctggatattgggatctacctccaggttaacagggctcagcaggctctgcacatcgtggagaatggggtgtccatctcctcaagcatttatcctttgagttataaccaatccaattacactctttaagttattttaaaatgtacaattattactgactatagtcaccctgttatgttatctaatagtaggtctt

SEQ ID NO: 474471 - DNA, 641 bp, Homo sapiens
agtctctttgtctgttctgagtcacctggagctgggggtggattgacataagcacccatcttgccaccactcctagttctatgctgggtcagacctgaagctagcacagcactgggtctctcccaaggcctgctgtaaccactccctgactatggcctatgttcgctcaaggccctggggctctacaattaacaggtggcaaagccagccaggcctatatccttcctttcagggtaaagaactgccccaggccctggctgtgtccagagatgccatctgggagccgagtactagagtcaaaaaccttagaaatctacttggtgttttattgtactgcaggtggactggcactcaaaccacaagacacagtccttcctactcttccctccaatttccaaaggcaaaggagcttcaccctatggccaccaccaccacaggcccatggggattaccacagatgtttctttaaggcccacaggctcttcaatcagcctgtgatagatgcttcctggcttaggactcaccctttagggcagtgggctcctctctggtccagggcaagtccagaaatgccatccaagagccaagttctggaattgggtactccaagagcctaggcctggacttggggaccctaagag

SEQ ID NO: 474472 - DNA, 683 bp, Homo sapiens
tgtctttttttttttttccgaccttttggcttttttcttcctctgtttcagagaatatttgtttatattgtgactatcacagtgaccttttctacaaactatgaaaagctatttcaaattaaacctcctggccaactgtcctcttccttcagatgagggcttcagacccaaatctgaggtgtatgctgcgagtctgttggagttttgccggaggtccactccagcaaacgctttttgcctgagtatcacaagcagaggctgcagaacagcaaatattgcagaacagcaaatattgctgcctgatccttcctctggaactttgtctcagaggggcatctggctgtatgaggtgtcagaaaggaaatcccttgacccctggcgcttcccaggtgaggcgatgccctgccttgctttggcaaagcatcccctttccatggactgcatccactttccaaccagtcctaatgagatgaaccagatacctcagttggaaatgcagaaatcaccagtcttctgctagcaacccaactaaagttcctgtgcatatttttaatgtgctgctagatacggataaacaaatcaatgatgctgccataaacttcactggggaagttcttggtttcagctaaagtgatttgtcatctaaacactaaagttccatttttggtggagtctatggtcag

SEQ ID NO: 474473 - DNA, 806 bp, Homo sapiens
ggcggcagacaagagaaaagaatggaagccaagcaaaaggggtttccccttataaaaccatcagatcatatgagacttattcactaccacaagaacagtatggatgaaactgcccccatgattcaattatctcccattgtgtctcttccacaacacaagggaattacgggagctacaattcaagatgtgactctccaaaggccacatactggaacgacagagtggaccaaacatcaaagatggtggcccgccctccccacattgggagctctgtcctgcctcaggcaggttccacttgttgccagtggctcgttggaattccaagcctgtgggtcttatcttgtgaggtgccatggacgtggggacctcagatctatgctgattggctccctggatttggcacccttcctaggggtatgtacagatgtcccaccttacctgagttgcagtcacctttgtgagggatcccaggagtatgtaaagctcctgggtatctgtgcatgcctgagcagatgctctgccgtgactccatacagctctgtgtatcagactcaaggccctggtggtgtgggctcacaaggggacctcctgatctgaggcttgtgaagatccatggaagaagtgtggtttcccagaagttatttcacctccttgtttaaatgtatgtctaggtattttcttatagctatttcaaatgggattgagttttttatgtattcctcagccttattttattggtgtatagaactgctactggcctaagagggcttgctagaagcagctagtgtgcaccactctcactgaaa

SEQ ID NO: 474474 - DNA, 536 bp, Homo sapiens
gaaagttaagaaaccagcagtctgatgcaaggatgagagaagccaaaaacagccccaccgatcttttccatgggactctaaattcctcaggactgaatctagatggttctttattgcgggatctggccagcagcccgcaatgcaatggcgctgtctctttgttcccaggcagatcggcaggtcgagaaataatagacacacacaagatagtgaaagctgggtacaggggggtcactgctttctggtcccatggtgccaataatgcactggatataccagcatttattattaagtttaatgagggcgggggtagggaggctctgcagctgcagtattggctgctgcccctccaccaaggagctcagatgacttacacagcaggcatccacagaagtggtgatggctgcccctcccaccaggaactcagcaggcttagaggcaagttctaaccatgctgcatggctccatagtggggacccaaggccctgatgagcactggctcctgagtgggatcttccgatgcatgggttgcacag

SEQ ID NO: 474475 - DNA, 1564 bp, Homo sapiens
atatagtgagaagtagggtcagtctgtgtcaagagttccatgactccctggcaacttaccagtcccctgtgcttgctggaatcagagcaagttatggggtatgtctgtggctgctctggtgatgtggtaggtcaagggcagaggatccctggacagggcagtggcacttcaggtatgcaactgggatgttttccacaggagtggccaggaaggcagtcatgggaggagccagcagacaagggggtaattggatcaaatgcacctttgtcctccggctgtggtagctctgctgtctctcagccctgcagacagcaggagctacaaccactcagtgcaagatggagagccttatgtgataggcacttacagctgcatttccctgcagcttcacagcacagcaaaaccttccgggctctgaccatagtcccatctgactctctcgcgctactacaacttctgtcctccttcagtacttgaaaagtgatgaaagaagcaattttgcttcttctggttttaaaggaactttctatctcatgttctattccctaccaaaatggtcttcactctgttcttttctgtagcaatataattgaaaatggggtgaatgaaaaactttacacttatcttaaaattgagttggtataagtaattatatctaaatggaagatttagttttaacaccccgtttgatttgccccatgcattcaatgacgatattaacatacaacttttcaaaggaaaatgatagacatgaacatgattgaatatgatattcaaaaggttaacagggaagaaacttgcagcttagaattttagcaaattgtttcaaaaaataaacgtaaaataagacatacatatacacatatatatctgtatctgataaacatacatatttatatgagagatctatacgtgaaaaaaatcagacaatacatttaggaaaaaatgaataatacataaaagataaatattttggtaaatctaaatggattaactgcttaaaacaataagagtgacatctgatagaacttaaagcacacgagagcaagatagtataagttcagagaaagagaaaggtaatgatctaaggtcttgcaattttcagattaagatataaatatttttattagactttgataagacaacagtatacaatctattgtggtaactacaaaaatactgctaaaagaagaggtaactataaaaggactagtatggaaatgaaaaatatatatttttatttcaagatttatttttgatacttggagtacatgtgcagatttgttacatgggaatattgtgtgttgctgaggtttggagtatggatcctgtcatccagaatatgctccacatgcagttgagaacaatgtatattctgtaattgctgggtggaattttctgtagatgtctgttagatccaattggtcaagtcctaaacttaagataaatatacaagaaagagaataaataaaatatattaaaatggtttatataaacctgaaaatatcagaaattacattaaataaaatataaatttatggttcaattaacagaaactaattat

SEQ ID NO: 474476 - DNA, 717 bp, Homo sapiens
gttcgtctgctcgtcttcttgtctccttgtctgtttgtctgcttctggagcatggggttcaagcttatttgggtagaggataagggcgtgccaccggaagcaggattggagccttgccagaaagaggattctgaggagcctgacaaatgttctcgtcaatggaaagggtctttgtcagtagatgtaccaaagtctatccattcacccactgaaggacatctagacctacaatttttagcaatgatggataatactactaagaacacttatttaaaggattttaatgaagcctttaaaatcactgataggattttgagaggagagaatgacttcagtgcctttggtgttccagaagcactctcaaggggtgattgccagaagctgctggctacagtggctttcagtagctctgaaggctggaaaagagagcagttgcaggcctcagaagcctttggaggttctgatgctggcagtttccagcagggtcaatggattcctacataatctatttcatggctttcttgtttttaatacattcatttcaatctaacataactttagttgcaccccataatttgaatatattatatatttttgtactatttagtagaaaatattttctaattaccattatgactttttccttgagctacggactatttagaagaaagcatttacattcttaaacatatggtagttcttaagttatatttagtt

SEQ ID NO: 474477 - DNA, 481 bp, Homo sapiens
ccacgaagatggggagaaaccagcccaaaaaggctgaaaattccaaaaaccagaacgcctcttctcctccaaaggatcacaactcctcgccagtaagagaacaaaacaggatgcagaatgagtttgacgaattgacagaagtaggcttcagaaggtgggtaataacaaactcctctgagccaaagaaacatgttctaaaccaatgcaaggaagctaagaaccttgaaaaaacattagacaaattgctaactagaataaccagtttagagaagaacataaacgacgtgatggagctgaaaaatacagcacgagaacttcgtgaggcatacacaagtatcaatagccgaattgatcaaacagaagaaaggatatcagagcttgaagatcaacttaaatacagcgtgaagacaagattagagaaaaaagaattgaaagaaacaaaccaagccttcaagaaatatgcgaatatgtgaaaagacca

SEQ ID NO: 474478 - DNA, 1110 bp, Homo sapiens
ccgaatgtaatggaatggaaaggactggaatggaatggaaaggaatggaatggaatggaatggaatggaatggaatcaactcgattggaatggaatggaattaacccgaatacaatggaatggaatggaatggaacggaatggagtggaatggaatggaatcaacccgagtgcaagggaatggaatggaatggaatgcaatggaatggaatcatccggaatggaatggaatggaatggaatgcaaagcaatgcaatcaactcgattgcaatggaatggaatggaatgcaatggaatcaacccgagtacagcggaatggaatggaatggaatgcaatggaatagaatcatccgtaatggaatggaaaggaatggaatggaatagaatggaatggaatggaatggaatggaatggaatcaactcgattgcaatcgaatggaatggaatggaattaacgcgaatagaatggaatggaatggaatggaacggaacggaatggaatggaatggaatggaatggaaaggaacggaaaggaatggaatggaatggaatggaatggaatggaacggaaaggaatggaatggaatggaatggaatggaatggaatggaattaacacgaatagaatggaatggaatggaatggaatggaatggaatgcaatggaatagaatcatccgtaatggaatggaaaggaatggaatggaacggaatggaatggaatggaatggaatggaatggaatcaactcgattgcaatcgaatggaatggaatggaattaacgcgaatagaatggaatggaatggaatggaacggaatggaatggaatggaatggaacggaaaggaatggaatggaatggaatggaatggaatggaatggaatcaacgcgagtgcaggggaatggaatggaatcgaatggaatggaatggaatcaacccgagtgcaggggaatgtaatggaacggaatgcaatggaatggaatcatccggaatggaatggaatggaatggaatgcaaagccatggaatcaactcgattgcaatggaatggaatggaatggaaaggaatagaatggaatcaacccgagtgtaatggaatggaaaggactggaa

SEQ ID NO: 474479 - DNA, 1315 bp, Homo sapiens
taggcttcaggaggcccgcgtcctacgcaggctctgccacaggggttagaccccagaaacctggaggcataggagggaaaaatggttttgtgggctgggcccagggccttgctgctgtgtgcagcctagagacttggtgccctgtgtcccaaccactccagccatggctaaaaggggccaacatagagctcaggccattgtttcagagggtgcaaaccgtaagcattggcagctttcacgtggttttgagcctgtgggtacacagaagtcaagaattgaggtttgggaacctccacctatatttcagaggatgtacggaaatgcctggatgtccaggcagaagtatgctgcaggggcagagccctcatggagaacctctgataaggcagtgtggaaaggaaatgtggggttggagccaccacacagagtccccactggggcactgcctagtggagctgtgagaagagggccaccgtcctccagaccccagaatggtagatccaccaacagcttgcaccatgcacctggaaaagccacagacaataccagcctgttaaagcagccaggagaagggctgtaccctgcaaagccacagaggcagagatgcccaagaccatgtgaacccacctcttgcatcagcatgacctggatacttcatgacatcttagaaatgagccttcctagccatgtggatactagccttctaggaataaatcattctagtgatgatttattttcttctacagtactttctttgaaatattttgaagaacaggggtgatatggtttggctgtgtccctacccaaatctcattttgaattttagcacccacaattcccatttgtcatgggagggacctggtgggaggataagagctttcagtctttcatcattatgtatgatgttagctgtgggtcttcatagatatcctttctcaggttgaagaagttcctgtttacttctagtctgttcactgcttttatcatgaaaggctactggaggttgtcaaatgctttgtgtctatggaaatgattatgtatttatcttttgtgaattatcccattaatatactggatttactgattttcgtatgttaaaccaatcttgctttcctgggataaatcccaattgatcacagtgtataattcttttgatatcttgctggatttcatttgctagtactttttttttttgcctctgtattcaaaagggatattggtattagttttctttcctagtaatgtctttggttatggtatccatgtcttctttaactcatgtgtctggttatggtatccatgtcttctttaactc

SEQ ID NO: 474480 - DNA, 1771 bp, Homo sapiens
aaccatgcttttccctgagacacgtatctgttagaaagaattagaatgggtcccagtcagaagctacttggaatatataggaaatatatgacatgccgtgctgacttacagtgtgtatattttttacagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagagacaaggacacaaacagccccctccaactcagtgcctctgccagagacaactgactgaatatggacccctggaaattttttgtcctcaggcactagtttattatatagcacttaatcctagaaaccagattcctaagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctgctggcattggtcaacagaaagggcccaattcttctccacgacaatgcccgaccgcatgttgcacaacccacacttcaaaagttgaatgaattg

SEQ ID NO: 474481 - DNA, 1187 bp, Homo sapiens
cttctctctgcctggtgttggcatttactgcacgtcccacactcatgggtctgaaactccctggaaactgcctagaaaaagaggaacacattttaaaagtctgtgaactgttcaaaattgagcacacgctttctagctggacaccttatcattttctttgtcagatatttgacatcaacatgcagagcagtttggatgaagagagcaagcatttggtggagagaaatgggtatcacagacatattgtcatattgccaccaaaagtatttacttcagataggaaatactcagactatatcttcaatgagagaactgtgaagaaggtgaaaccatgccccggagtaggccattggagaactggccaccccttcattactgatgaaattgatcacgaagactatggtggaggttttcccccatcctatatttttggctgctggttcggaggcaatcaccagagacaaagaaaagagatgcttagacaagcggactggttcagctggatgaagcgcaaccgctacaaagtcttggtttggtagatttgactttgctctttcctttctcttcggaggggaacgttaggaaaggcctgtggcttgcagagatgcactccccactggtgtggttcccatggctctaaactcctgtgcctgctcatgtgggaaacctatttaagacattctgttgcataattggaggaaaataattggaggaaaagtgtaagccatcttgagggaagcaatcactcgactaacattcctacttaaaaataaatgagaaaaaccagattttgcaatttcaacagacttttattgaacatttactaactctgcaaagtattatgccagatacagtaaagggcataaaaaataaatgggctagtcccagttctcaaatagctagtgggaaagtcggtcacttaaaaatctgattagattataacggaaagtgattctgaatagagtaatgagaaaacttgcatggagttggggagggaggggtgctcatctcagaccatcaagaacaaaggccccatggtgggcacagcattggtggaagactgtgggactggggtgctccttggctgtccccacaggccctatatatgtacctctctgttgccacctggagcaaaagccttgagagcttggctacaatcttggggagaagatagggggagggaagaa

SEQ ID NO: 474482 - DNA, 522 bp, Homo sapiens
taatattttgttatggcagccctagcaaactaatataggttgacactgccctttcaacatgcaaggcactggagacagcccttcattcagtgaaactgaacggccacttgggcttgtctctggttccaaaccaataacgaggggtcaccaaggtgcaggcccacaaggggctcctggctggattgccaacatttgttataggaccaactggtttgtatccccactgtgcaataacataccaattactgtgagacagcaggatttgcagcagagaaagtttcataatcacagcacaccaagtgaggacacaagaggagaccctcaaatccatctcaccaaggagttctgggctggggcttttaaggggatcgtggaaggtaaagggttggaaaattggggttgttggccaaatgtctgaaatttgaagacatttttattttacaaataatcttgaaaactgtctttatttctaaaagactgctaaagtaacgtgaacaaaaaggcattaaagtttctattttt

SEQ ID NO: 474483 - DNA, 4232 bp, Homo sapiens
cattggcatcaagacttagaatgctgctgacatgtcttggtaaagattacctctccgacctctgtgtctccatgaacaaatcaattccagtgacccaggaactgatatgtaaagctgtgctgaaccccaccaacgctgacatcctgattgagaccaagttggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtggtgctccggggaggaggctttttgcccatgactcccatggctgctgcccctgaaggcaatgtgaagcaggcagagcctgagaaggaggacatcatggtcatggacaccaagctgaagatcattgagatactccagtctgaggccaaaagccggagaacctggagctctgatgggcaggagaagatgagtgtcccagctccagaacaggtggattcggtcttcctccacctgtttgctctatccaggccctccgtggattggatggtgcccactcacactggtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggtgagcgagcccagcctggctgtgcccttctcgttgctatgtggtgtgtgctgtcgtggctcactgggagacatggtggtggctggcctgggggagccctcatggctctgaaagctgcagctcattttgtagtgggatttcagttccctaaaacattttctcgagcattgattttgcatgaaaggaacacggaagaagttagtcgttctttctgtatctttaagaacagtgaggaaaaaagcttcagctctgtggactaatttagcctgttgagcaaaggggatatgacctgaatgaacttttcagaaatgtgacgaagagtaggttgagatctagtccatatgaatgtaagacttagtaagttaattctttaaaacaaaaacccttattacagaaataatggccattataaaaaatttaggaactacagacaatcaattaaaaaaaaaaataatgaatacctaagttttgaagttaatccttccaggcttccttttttcctactcatagattatattgattagtaatgaaaaactggattataaagtatatatttatgatatataaagtatattataaagtatatatttatgatatataaagtatattataaagtatgtattgtaggttttacaatgtgtaatattagtttgtagtacacatttatattacattaaaatatatgacatatatcatataatgtttttaggttattttgaaaagctaaaaacagtcatgtgtcgcttagtggtggggatatcttttgagaaatgcgttcttcggtgatttcctcattgtgcaaacatcatacagcgcacttacacaaacctagatggcacagcttgctacacacctcggctatatggtacagcctcttgcttccaggctacaaacatgcacaacatgtgactgtctcagtaccgaaggcaattataacacaattgtatttgtgtatgtaaacatggaaaaggtccagtaaaaattgggtattataatcttatgggtcactgttgtgtatgagacccatcattgaccaaaatgtcattagtcagtacctgaccatactctttgaaaagttcaaatatcaaagactgtaacggggtaaaccatgaaaagtcttataatctgttttcccaccaccctacagaaaataatttattatgttcttgtgtatttttctagaattttgcacataaacgcatacagtatatatactttacttccccaccccctttttgtaaatgcagaagatgatactctaggtatactattctgtaccttaacactgtaacttcttttcatatcaattcataaaaagatgccagatgtttttttacagttgcataaaatgccattgtatagatgtactgtcacggccctttggctgtctcctgagggtaaccacaagctgatttttatgtaatcctgcagttgcttttctgtatacatccctcaacaatatagtttagttttgtgaggttttggacttcttctgtgtatcattccatgcctttttaagttcagttctgtgttgttaaggttgatccaccctgatatgtagctgccatgaaagtagccatggcaagcagatttggctgtgttccaataaaactttatttataaagataattactggccctgattttgccgatccttgcattaaattacttagaaatgctgtaaaatcagttattaatatcattcttggaatatgttctcagactgtctagttttaaggggagaaatattggccagcaggcctttacctttcatttgttaaaagtaacccacaggagggagtcgcagatttcttaatgtttggtgtaggttttggtgtaatgcttaacatacccacttgtcttccaggcctgtaacaacactagtgacaggaaacatgcagactcgattttggagaagtatgtcaccgaaatcgtcatgagtattgttactactttcttcagctctcccttctcagaccagagtacgactttgcaggtaagaaataaccaacgtcaagcagaatgttcacgatacaccttctgcagttgggcttgatgtgaatttgggagtaagcaattgtaaatgaactggtctgcaaggcattaatacaagatatatttctcttggtggaagatagctttgatgggatttcttgggtaaagaagtacctggggatattttcttatactgaatggttctgttaactgttgattttctccttgagatcttttctgctttttttgtcctccagtcctctgcttccctgccctccaatcctagagataacatttataaaacatctagcacagtgcctgacacagagtaggtgctttaataaatggtagcctgtgctatttctgtcagactataagctacatgaagacaaagttatgccttacatgcatggtcatctcatatactactctatcccttgtacctggcattgtgactggcactgag

SEQ ID NO: 474484 - DNA, 924 bp, Homo sapiens
gaattctctttatgtcattgaagaccttgccagaaataaagaagtagcagtcgagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaatgcagggaatgccctgaagtatctttaacctgagagctcttaataaatatttgttcattaacggactagttaaaataaattgcttgtgaagtctttttaatttaaaattagcttcaaggaagtaatccgtggttttccccccattcaggttaataaagcatacaaaacagctgctagaagaaaatgaagagaagctctgcattaaggtcctacagaccctgagggaaatgatgaccaaagatagaggctatggagaaaaggtactgcattttattttcatggtcaaaccaggttttactatgaaactgaagggagggacctttcaaaacccaccttagctcaggcattactgactgaggggctagctttttttaaaagaaagaaagaaagaaagaaaaagctgtttatcctgcc

SEQ ID NO: 474485 - DNA, 1719 bp, Homo sapiens
ggctcactgctgatgtgtgaccttcagcagtaattgccaataaatgcagtggggctgtttactgttagacactggcaaccacagagcaaactcaactcagaacatacagaacctattgcaaagcaagttctggtcaaccgttactatggaaacgtcagaccttcgggacgaagagagagccttaccagctttggcaatggcccactgtcagcaggaggacccggcaagcccgggggaggaggagggggcttccaatctagttatcgacctcatcatgaacgcatccagtgaccgagtgttccatgaaagcattctcctggccattgcccttctggaaggaggcaacaccaccatccaggtaggaaggcagcttggctactggtatggcatccctgctgagcaggaggagagtctgttctgggagccagatgtctgggtggttttatccatgtgggaaaggagtgaagccagcagtggagtcagggcagctctcctcctgcacgtgggggttcgagagctgttggcattaaagaaagagggaggcagtgacttgtccccagcaggcgtccccagagacactgcccttctgcggaagctgtgaggggtcagcaaagccaccccaggttggctcaaggaccagcttggctcctttgagaaatggtggcgtaaaggaaactggactgttattgaacaggagtccttgaggattattggtctaaatccaggtcttaaggaggaagctcaaaattcaaaagtcgttacattcttaggcatatcagacttgagtgagccctcctgcagaagaagatggcagttcccacaactctgccctggtcatccttagcgcagctctctgagtgacggcagacagtaggggcagagttgagtagttgtgacagatagctgcaatgaccctcagcgtgtgaaatgtttaccatttggccctttggaaaaatgtttgctgaccctagggtttgtttaatctttactatgtagatgttaaactgcctaagggaaagaaccacagtatttcccctttgttctgtgctcctcatcccctggtgtcaggcatagcgaagggcgtctgccccacccttgcctggcagggtagttgaaactggtttgtctctcacttgttaaaaggtgactgtacagtgtggatgagggaggaccttatttcagacaaatgaaattgaaatgttgacacctctccaatacagacttgcttcacttcatcgcttcctttctacttggaagtctatgttatttctgaactcattaaagctggaaacatcctgagagaggctggtaaactgagagctgcagatgttggctggttgaaagccatcagaccttgcaaaaaagtttcttgttaggcggcgtctttatcctaagatggtgttttgggaccggagaggagcacgttaccctgctgaaaaaggcatttggaaactgctggattccagtgcttccagctgcagagttctgtgatctgtgttctcttgctcttttgttgtggttgaagtttccagaggccacccacatcccttggcttgtggctccttcctccatcttcaggtttagcaatggtgaatggagtccttctcacattgcctctcgccaccctcctctcctgcctcctgcctccacagcgaaggctccttgtaattatgttgggcccacccgggtaatccaagctcatctgtctactttaaggtc

SEQ ID NO: 474486 - DNA, 1675 bp, Homo sapiens
ggccaccttctggtgcaccccagctttagcgggcagtcctctgtaagcccgcatgggtgagatgttggatggtctgtcttggtgctctgggggcagctggaaaccactcaggcgaggcatctgccttcacagagcttgcactctgcataaggcagacagtaaggaggtgaacgaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaatgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagaggtgggttccaacgcatcagcaacaacacagagagacacagttctgggatttcacaaacttgggcttgatggtgcgttcatttccaagcaggagcaaagctagtatcatttatgatactttgcacctctgaccaccaggaagtcataaccagttttgcagctgatcagtgggctcaagccaaagtatgataactcccctgaaaaggcttccttcatcagaatttgacttgatttgattggaaagctccatggaagactttttgaatgcctcttttgata

SEQ ID NO: 474487 - DNA, 1944 bp, Homo sapiens
cccgcaacatgtctttctggagcagcatttcgtttaacctggccgtcctgatgaacctgctggtggcgtttttctacccgtttaagggagtccgaggagctttgccttttgaaggatttcaaaagggaagaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgacccttccttttaatggtgattggtgtgcctggtccaccaagattgaagctccacagttggcagcctttgggggatctgagaggaaagctccacaggaattgggtcagcccaggaattcaagagtcacacaaccgcactgtgtactgggcactcccgatctactcagccgcacttacaccaagaggagtgtttttgaggctgtcatccaacagctctcagggagtccatttcttgtgaacacgtgtagcgaccataagaggctctctcccaagagacaggagatgcccctttggtcaacgccaccttgccccagtagacacttcgacctttcctccaatctgcctccagttggcttggcttcttttctgttcatttgagtcctcttctcttcatcacttgcaatgcaggccagtgccagtgcctgacgcagggcacataatggtgagaggaacacagtccctaccctcataggcctcacagtcaggagcacattacagggacagccgttttgtgagtggtcaccctgcactcttctctacacactctcactaccacctttgaggtagatggtatcttccaattacacctgaggaaactgaggcttggtgaggttaggtaacttgctcagagtcacactgtcagtaactggtggaggcaggagagcctcacaactctgttgattcccaagttgacactgccttttattcaagcatgtgaaaaagtccttgcatcagtgaaactggcatttcacgttccagtttgcatctgtgctttcaagtctccaacctatcacagaaagataagagtaactctcagcttctgatcatgctacctcagttcacttttaggaaacgcaataggatcaaaccagattatggttggctgcctctcctgtgctttgcggggggattttctaagctgtgtggaccttgacttgtttgtgtcttcaagtgatgtgctccttttggtatcaaagcagtactcaatgtgtctggtaagaaccagaaaacactgacacttcaaattattctactaataaggaaagcctgcaaccaaaagaaatcgggctgcctgtaaaaggagagagacctgagcagggaacacccatgtgttccagagttgggagagctccctccatgccagcaggccggaaggtagggagggtgatctggtggcctaattaaactgctgccccccctcccccacaaagactggccggacctggtcgtgagcctgcattaaagctgtgtccttagaaaaatattaacacctggagatgaaaatgtgcaaagttcataagcaggcagttaacaaaagcagaaatccagatggtcagtaaacatggaaaaatgttcatccttggtgctaaacaaagacatgctaattaaaacagcgcaatcctgtgttttacctgtgacattagtaaaggttaaaaagcctgatggtgcccagtactagtgagagtggggt

SEQ ID NO: 474488 - DNA, 1894 bp, Homo sapiens
gactgtgcacgtagaaacagacatatatgggagaacgttcgctgcagtgtacagttggaagcagtgtaaatgttcgggggtgtttcatcagatcatggtacatccatgaggtggggtgccttgcacatagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcactgtgctgagtcacgggctgcggagcgggggtggagtaggagatgtactcaggaagccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggttctggagggctttctggagattctgtgccgtctgtacccttgaggtccttagagttgaattccatgcttctcaaattttattgtacatatgaatcacctgtggagcatgttaaaattcacattttgactcagcagtcacttccaggacttgagatattctgcatttccaacaaccttccaggagatgccgaagctgctggcccgggaatcaccctttaagtacatttatactgacacagacctgtccacatgcacagataatgaccttcatttgcattcgatgtcttaatgtctagaggaggcctgtactgttcacccttgacttatgttccttctcacccctgactttgttctcttgtctctgaagtgtttgagtgggtcctatctttacatcttccaggggccagttttgaagttttctcttaatcaccttactttccggtcacagaaaactctggcacacttttgggtttctgtctcaatcatagaaacagtgtgtttcttgtcatctctggagggagggaaagagggaccacgtaaagaagctctgtcttaagttgagaactctgcaactagctgttcacccacaagttaatcttgtttaaacataatagatcatatatttccctctccccttttggtcttcccctttctcctttcactggagatgggagtatccccctcaaagctggggccaggctgatgcctactatgaagtcctcactacccaagaagtggaggtagaagatccaaggtgagagtttccgctctgtgccttccctcgccgtgtgaccctgggcaagtcacgggactttgctgacctgggtttcctgtctgtacatcgcggttcctaccgcctcacacatccgttgggtggtagacatgagctaaatgagacctggcaggtgggaggcatgcacagagggagggagcaggcgaaagagcaacaggcccagagcacagccagccaggaagcaggggctgcggggctgacagcagagctgacagaagcatcatttcctatggttccaaaactctgcaagacaccttggctgtgggcacgttgtcactaagaaaagtcagagtgggcatcttgactctaagagcctcctcctctggaaaatccctgtgtctttctctctcttgaactttaaatctttaagtgtccttcaaagttgaggcagggcatggttgacgttagc

SEQ ID NO: 474489 - DNA, 1024 bp, Homo sapiens
aggagatatacctaatgaccttggtacttatttgaagacgcaaaagaccctggataggcaaagcaggcttgcgcagaatgaccaaagctgcaggcattacagtactggacatcaaaatattccacaaagtaaacaggacagcatgttacgtggcacaaaaacagacacccggacccagtgtgaattactcccgctcaggaaatttccacctgagaaacatcattaactctttcatggtaccagcaatctggttagcaaattgcctctttactgaactaaaattctacattcagaaagaagaggaggagcttgctttttctctccatgagcacaccctagaaaggtcatgtgaggacacagccacagccagaggtggccatctgcaagccaggaagcagacactcaccagacactcaagctgctgccaccttcatcttggacttcaaagcttccagaactcttcaaatctctattacatagtcggccatttgctagctatggtataaatgaggaaccaaactgatgacatgcttaccttccttttgcatgtcagcaccaacggctagaattaaagtctacataaatattccagtccaagctttttaaattacaaaatatttgagttattatatttaaagaaaaaatgatttggttttgaactaaagtacttatcgtattctaaagtgaataagaacagttggaggttagatgatgtattggatcatagtatagaacctgatcagaaaaacaaataaatcaaacaattcttttggtgcttgatttatctacttgtttccatgctatctaaataactaaattaacaacaatttggggagtacacaggacacttttagcaaatctaggcttgaaatttgactttgtctttctatacctcactgaaatctctctcaccaagtaactgtgtctaaatcgtattgccattttcactttttgtcttaaaactttcaaaagcccttccatagatgagtcctctcctctttatgaagtacttttattccctcac

SEQ ID NO: 474490 - DNA, 678 bp, Homo sapiens
tttacccctcacagcagtgttctctggatatgggacatgaattcaaaatgggttgtaaagcagcgaagacaacttgcaacatcaacaatgcatttggcccaggaactgctaatgaatgtgcagtgcggtggtggttcaagaagttttgcaaaggagatgagagccttgaagatgaggagcgtagtggccggccaccagaagttgacaacgaccaattgagagcaattgtcaaagctgatcctctcacaactacagaagaagttgccgaagaactcagaggtgactattttacggtcattcagcatttgaggcaaattggaaaggtgaaaaagctcgataagtgggcgcctcatgagctgagtgaaaataaaaaaaatcggcgtttcgaaacgtcatcttctcttattctacgcaacaacaatgaaccatttctctcttcgattgtgacatgggacaaaaattgcattttacctgaccagctcagtggttggactgagaagaagctccaaagcacttcccaaagccaaacttgcgccaaaagcagggcatggtcaccatttggtggtctgctgtcggtctgatccactacagctttctgaatcccggccaaaccattacatctgagaagtatgctcaggaaatcgatgagatgcactggaaactgcagcacctgcagcc

SEQ ID NO: 474491 - DNA, 771 bp, Homo sapiens
atagaggctgcagtgagtcgagatcatgccactgcactctagcctgggtgacaatggcaggctgggaatgtattattctgaagaatgtaattcaagatgcctgggaaatatgaagcacgggtcatcccaaactacacactcaggaaaaacagcctttagagggaagcaatgcttgagcagaaacctgtatgaaaggagggcaccagacatggaaatacctagggaagaggacaagaggcataaggaacagcaaacacaaagtaccttatatgagaatgagtgtggaaacaggaaggaggaccatgtggctagagcggagtccgctggggagaaggtggaaggaaatgaggtcaggaaagtagccaaaggcaagatcagggtcttactgaggcaacagttatgtgcagagacaacaatacacataaaagtagaggaggaaaaattgccgtaatatattcagacaacccttgaaatagtcaatctggttggagaatgggaggaagtggcataaggtgaaacaggaatgctagagagagcccaaaatcagttaagctgtggtaaaacccaaatttgttaggtttgtttgacaaaacagcttcttttcaggattgagggcaatcttttgttaaggagaatagaatgctctagacatatttcacaatggttatttttttttccctctgaagtatgatgagaattttctccaatcttcaccttgataacttagtaggtgttttgaaggtagaactgacaaaagtataggggccttcc

SEQ ID NO: 474492 - DNA, 651 bp, Homo sapiens
acgtcttgattttggatttgtggcctccagaactggaacctcagagagagatgaacacagaatggattattgcagtcacacaggagggactctcgtgttactataatttacctattaaagagaaggctcatagaggatgtgttaaaagtagaattgagaatttggtttcaattgacaaaatccaatatgaatatattgtgcataaactagaatttgtagaagacataagcaatcaaaaggagaatggagatgacaaaattgacaggtacacaaatacttttaggacactttcccttcttgttgtcatctctatttcccttgatttctcagcttcaagtctttcaatttgtcttcagtggaagatcagaggagtcattgacataaatcttttcagcagctatctgaaggagaaactgaatgatacagagaacccacacttaaagaacagaaaaaaagaagtcattaaatacaacacagaaaccacagttattttacctgatgctcctcttgccgccctcctgatggattcctttggtgccagacaggaatgggctgcttggggaccaagagagctcccagggcctttctacggcttcctttacccctttattttgttcggctctctaaattgactcagctccaggtaaagtc

SEQ ID NO: 474493 - DNA, 629 bp, Homo sapiens
gcgcagagacttgcccaaaattatgcagctagtatcacagagccaggatacaaataatctacacacatatgttgtatatagaaaggcactggtgacagatccagactattgtattactcagcttccttttggtgagaagcagcagaaaccctacaaaaaccagttggaaccctgtaaaaatcagcataaaagggactttattgtctcattaatcttggcaatcaaagggctagatccatacactactggattgaggacctcaaatgatgttgtcagggcattttatctctacatctttttgttcttcttgtctgtctttttgaatgttggtcttatatttttcctcctgtttctgatagattttctccgcctgagagccaagctggatcttggcagacctaggcttgcagactttggcttacagtgccatagggatacaatacagtgcaatacagtagaatacaatacaatacgataagacacaatacaacaggaatagaggtcttctctctccccttgtccacatgtcagtcctgtggaagggctctgattggattttgttagctatgtgctcattccttgcatgagcatatggtagcatgtaaatggcatgctacagtgctcaaaat

SEQ ID NO: 474494 - DNA, 614 bp, Homo sapiens
ttggtgtaggcacctgagggaatctcctggtttgagggttgcaaacaccgtgggaaaagtgtagtatctggaccagaatgcactattcctcacagcacagtccctcatggcttcccttggctagaggagggagttccccaaccccttgcgcttcctggaggaaatgcttggttctagaatttcttgcatttttatgggctgaattgggctctgaagccaaagaagagaaagaagaagaacggacctgccggttgctgggcaagtgtgtagatgccgaaaaccattcccttgttattggaggactgtttcctattgactccaggaccatcccagcaaatgagtctattttggagccagcatcagcaaaatgtgaagggatggaggccaggaatgggtacagcttcaatattcacccagaaggggatatctgggagcaggaaacagaaaaggtcgacactgaggccagagagtcagcagggcctgtggagatgagggcctgagctcagaacctgcctcagagaggtatcagtaagctgattttaacctcttcataaaattgtgagaaaataagcaatagcatttattcacttcatgtatttgttatttgattttct

SEQ ID NO: 474495 - DNA, 602 bp, Homo sapiens
aggcgttggtaaagcagtggaggcaggccaaggttgttaccctacttgagctccctcactatggaaggagtgaagagtgggaagaaagatgccctgcccagagaggaggaatatagagaggcagtctggctacagtggctttgtggcactgccatttgttctgcccagtccaaacttcctggcagctttgtttacactgtgaagggaaaaccacctactcaagcctcattaatgctggacacttctccccacaccaagctcgagcatcccaggtccacttcagactactgtgctggcagcgagtatttcaagccaatggatcttatatgggggtgggatctgctgagcaaggccacttggctccctggcttcagccccgtttccagggggagtgaatggttctgcctcgctggggttccaggggccattgaggtgaaaaaacaaacaagcaaacaaacaaacaaacaaaaactcccacagctagctcagtgtcttcctaaactgccatccagttttgtgcttgaaacccagggcccttgtggtgtagtcatctgagggaatctggtctgtaggctgtgaatactgtgggaaaagcatagcat

SEQ ID NO: 474496 - DNA, 785 bp, Homo sapiens
cctacctcctctgagatggtggggcagaggggagttgtgatggtcatcccagggcttggggtgtgcccaagagtgagatcagagatgtgtttgaggctgtggggagcagcgtatgtcactttcagaatgtcagacttgggaccactcaacaaggagatcaagggctggtgttaccattattgtaagaacaacacaaagcctctcttctggcgaggtgttgctgatgccgagattcccatctttgacctggggtggaagaagtacatgatgaaaagttgcggcgaggatggctttcatatccaagtgcggctccaccccttccacgttatgcacatcaacaagacgtcctgtgctgggctgacaggctccaaacagggcactgtggccagggttcacattggtcacgtcatcgtgtccatcggcaccaagctgcagaacaaggagcatgtgattgaggccctgcacagggccaaggccaagttccctggccaccagaagatccacatctcaaagaagtggggcattaccaagttcaatgtgaagacatggtggctgagaaacggctcattccagatgactgcggggtcaagtacatccccagtcgtgccctctggacaagtggtgggccctgcactcatgagggcttccactgtgctgcccctcctaaggcccaacaataaatcctactttctgtccacctgaaaaaaaaaaagacacctcaaactgactaggaatctactacagcagtggtccccaacatttttggcaccagggactggttttgt

SEQ ID NO: 474497 - DNA, 1748 bp, Homo sapiens
gttaatatactgatgaataaaattgaaaaataccatttccatagcatttcctcagtgcatcacagcctcgtggagtttcacttgaaggaactgagaaacaaggacaccaacatcgaggttaccttccttagcagtaacatcacctcttcatctaagatcaccatgtacgacagtgatgagatcagatgtgagtttggagatatttctcgggttgggatgttggacatgaactctgctgtgaggcactacaagtttctgctggaaggagtgcatttcactcccaaaaccgtggccactagctggtgttccttctggctcacccaaagtcacacagctagatatgaaaatccaggagctactattttgttgcagtgtccacttgtttattctaaaaaatcaacaactactttcttggtcatattcaaagctgtaggtgtgggcagaggggctggtgaaggtgacacaaaggactgtggtaaggagctaaccccttggtgcatgacagccaaccagtgccaccagcagagcccgatcggagccaaaggggaagtacaggtgcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaatcatttaattgttttacttgaatggaattctgttacctacaaaaagttgagatttatactctgtgggattggagaaaacagtattgcattatcggtattaaaatagcaactaaaagaagtacttggaaaaagagaggggatgaagggtagggaggaagatggcaccatttaccaacccttaccattacctcctctggatatctggaaggtttgagggatcagagagatcttggggaatacaggtagatttcctctgggttagtgtttcccaaactttgatctttgtaaataaccttgtatcagccgcagcccagcaaaaaacagatggtgcgctcaatctgggttatttgaggagaatttaagaaaaggacaatttgccatagtcttttgtggggcaaccacagggataatgcagttccctgaagctactggcagtagaagctgctactaccctacctgtgaagaggccagagaaggaggggaagcaccagaaggctgcagacctgcagtgcagggacacagccagccagcagcaaccccgcagggagggagcagaagcacaggttctctgacttcactcttcttcctctcccattttcctgct

SEQ ID NO: 474498 - DNA, 939 bp, Homo sapiens
ctctcctggccttcacctcgccctcagcattgaacaatccccttcaggactcgcagagccctctgggatcgcccccctcagctctcatccctcgctaggcacttgagggctggggaagtcttacttattgctgtggccccagcaccccacacaaggccacatgtgtgacatttagttggagaactgcaacatgtttctgttttccaacagagcagtcttccctgtttctctgttctcatggtggaatatgtttgccctcagctcctgagttcacatggaacaattccaacaaccagaagacaatgttaccattattgtaagaacaacacaaagcctctcttctggcgaggtgttgctgatgccgagattcccatctttgacctggggtggaagaaggtaaaagtggatgagtttccactctgtggccacatggtgtcagatgaatatgagcagctctcctctgaagccctggaggctgcctgaatttgtgccaataagtacatgatgaaaagttgcggcgaggatggctttcatatccaagtgcggctccaccccttccacgttatgcacatcaacaagacgtcctgtgctgggctgacaggctccaaacagggcactgtggccagggttcacattggtcacgtcatcgtgtccatcggcaccaagctgcagaacaaggagcatgtgattgaggccctgcacagggccaaggccaagttccctggccaccagaagatccacatctcaaagaagtggggcattaccaagttcaatgtgaagacatggtggctgagaaacggctcattccagatgactgcggggtcaagtacatccccagtcgtggccctctggacaagtggtgggccctgcactcatgagggcttccactgtgctgcccctcctaaggcccaacaataaatcctactttctgtccacctg

SEQ ID NO: 474499 - DNA, 529 bp, Homo sapiens
gcggcataaaaaagttaatgatagtcgataaatgcctgacttacaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaaggcatcaaggataaggtggtgaaaaagacacacaatccttgtctttattggagtttattgtctagtggggtataccatctagtaggatagataacagtgaaaaaatagttacataagtaattagcattgtgataagaaaatacaagttgt

SEQ ID NO: 474500 - DNA, 1071 bp, Homo sapiens
accatttgaaccacagctggggagtctgaggaacactgtactggcatgcagggagcagtgtcctaatgaaacccgaggcaccactatgcctgtctggtactccagttttgatatgcattttcctgatggttaatgacgttgagtatcacacagtcgctgccgccagcccgtgcaccatgtcctcctactgctctgccgccctgctcctccgcctgtcacaatggaagaagagattgccatgctggtcattgacagtgtctccggcatgtacaaagctggatttgctggggacgacgccccctgagccgtgttcccctccatccttaggcgcccctggcaccagggcacgatggtgggcatggcgtggcatcatcatcaactgggatgacatgaagaagatttggcaccacaccttctacaatgagttgcgtgtggccccggaggagcacctggtgctgctgacagaggcccttgtgaaccccaaggccaacagagagaagatgacccagatcatgtttgagaccttcaacaccctgtccatgtacgtggccatccaggccatgctgtccctctatgcctctggatgcaccactggcattgttaatggaccctggagatggggtcactcatacagtgcccatctacgaggcctaagccctcccccatgccacctacatgccaacaaggtgctgtccagcggcactaccatgtacccgggcatcaccaacaggatgcagaaggcaatcactgccctggcacccagcaccatgaagatcaagatcatcgtgcccccagagcgcaagtactctgtgtggatctgcagctccatcctggcctcactgtccatcttccagcagatgtggattaacaagcaggagtacaacaagttggcccctccatcgtccaccgcaaatgcttctaaatggaccaacgtgcttgtggaagacaagtctgtggcttggtgagtctgtgtggccagcagtatccgatctgtgcagggtattactgtgtcaggacttagtgttctggaatttctctagaggctgatgctcttgggaaatgtaatctatt

SEQ ID NO: 474501 - DNA, 910 bp, Homo sapiens
ggtcttctttctcctgactctccagacagtactccggccactactgaaccatatgagggacttcttaaaaaaaaaataaaaatatgatttctttcaaaatactactgctcattgacaatgcacctggccacacaagagctatgatggagatgtacaaggagattaatgttgttttcacacctgttaacacaatatccattctgcagtccatggatcaaggagtaatttttactttcaagtcttattatttaagaaatacattttgtaagactatacctgctatagatagtgactactctgatggacctgggcaaagtaaattgaacaccttctggaaagtattcatcattctggatgccattaaaaacatttatgatcaatgggaggtcaaaatgtcaacattaacaggagtttggaagaagttgattccagtcttcatggatgactttgagggattcaaggcttcagtggaggaagtaactgcagatgtggtggaaataccaagagagctagaattagaagtagagcctgaagatgtgagtgaattgctgcaatctcgtgatcaaactcgaatggatggggagttgctttttacggatgagcaaagagagtggtttcttgaaatggaatctactggtgaaaaagctgtgaacattgttgaaattatcacaaaggatttagaatattacataaacttacttgataaagcagggtttgagaagatagtttccaattttgaaagaagttctactgtgggtaaaatgctatcaaacagcatcacgtgctacagagaaatcttttgtgaaagaagagtcaattgatgtgccaaacgtcattgttgccttatttctagtaattgccacagccacctcaaccttcaggaaccaccaccctgattagtcagcagcca

SEQ ID NO: 474502 - DNA, 879 bp, Homo sapiens
tgcagtgtgtaggccatctaaaccagaatatccagtgtgcagcagccacagaccgcctgatggagcagagggtaattgaggggaaattggacaaaggaggatctgacccaccttcagtctttaggctcctcatgggcacagggaagtcctacttcaaaatacgaaactttctagtcatgactggctgggctccatctgacggcacagaagcagaccggcacttttattgctgtttattgtcaatacccaagcatccttggtgcaagaagaccttcagccatcagtaccagcagagggtttcagtgtctcagagtcaccaattccagaaccagcagaggcactgtgatgacataaaaggagcactggccaaaagaatgcagcaggctgaaaaacctgagcaggctggctgtattgtcttaatgcattgcttgtatttttcagtcgtgttggtgattcaccagggtatttctttctccaactttccaaacctgcttcgttaaagtcattcttgcaggatcttcaggatgttttattaaacaaaaacacgaggtacagaactgtgtgtatggggtgagaaaaaataatttaagcatacatgtgtgtttgtgaagaaagaaagaataaatatttctggaagaagacatgagagactgactcgattgacttgaatggaacacctcttgtgaggggagcactgttttaggcttgggactagtactaaactgaattcgatttgactctggtcaggaggtagagagggagatgagaactagactcctcgactgaacatcagaagagctgatcatggaaccatgggtctaccacttcccagccacgctagcctggacagtatttttagccaccagttctgtcatgtgt

SEQ ID NO: 474503 - DNA, 569 bp, Homo sapiens
ttgcctttcaccatgattggaagcttcctgaggcctccccagcaggaagctgccatgtttcctgtacagcctgcagaattgcagtcttcagctccaggctcatggcagagggaacaagatagagaagggaaagtaaagataaaggatggcaagaatggacagggacaagacaaagacctgcatgccaggaacatgaaggaagagttggactgtgaaggaaagaggaaggaggtagatgtggaaaagcatctaaaaatttctcatggacccctacgatggataccaaacaagctgagaataaattgtgacaaggtaaatcaggagcgcatagacatctcaactggcagccagggcaggaccacagatattagcagcagatgccagtgcttcatggtgggaaccaggacctgtgatttgctggtaaactgattctccaaggaggaaaatgtgccttgatctgtggcatttcatgatatccgtgggataaatattctgaccatggctgatatccagctaccgacggtttaacaaccagtcatgaaattcccaaatatttaacacttcatctc

SEQ ID NO: 474504 - DNA, 706 bp, Homo sapiens
ggtcaggtgggccggagggaagatgccaatagtggcagccatgggctggaaggttggtgggttccaaggcttctggcctgccaatatggcatgggcaatgacagtagccatggtggaacaatcctctgtgtccccctatgcactagtattggcagtggctgaaatatggtgggtgggccagtctccatgtctgcaggtttcaggctacgcaaagggagggagagaggaggagagcattctaggaagaaccaagtgtcacaaaaagaatgaaatggaagcagaaaattcaagctccgtgtgcttctcacactataaaagcaaatacatagcctcacctaattgccagggagactggaatatgccattgagctatgagcacacgaagaagaatgaagtggtttatgagcatctggatagcctctgcaacccagagttaagtacagatactaagaaaacacagagcatgactccccaaatcggttgtagtgagttgtaaaagaggtatgagaagttctgggagggaataagacaggcatgacttggagatattgcttattcagtttgagatcaccacaataaagtgaattttacaataaagtgagggatacaaattttttgatttcccagtgcatataaccgttatgtttatactatactgtagtctattaaatgttcagtagcatggtgtctaaaaaacaatgtacag

SEQ ID NO: 474505 - DNA, 562 bp, Homo sapiens
cgccgcctttaagaactgtgacactcaccacgagggtccgtggcttcattcttgaagtcaacaaaccccagccacatgcacacaagaacttccaaatgtctgaaccacagcggccaggcattcctccagaaccgcctcccccaggagcttgctacaagtgccagaaatctggccacaaggccaaggaatgcccacagcccaggattccacctaagccatgtcccatctgtgcgggaccccactgaaaatcggactcagctgaagactgacactgcccgatcacctcggaagcctataggaccatcacaggtgctctgggtaactctcacggtggaagatacctctactccctccttggcgaccaatcatgcaccccttaccatctcattaaaacctaatcacccttaccgcactcaacgccaatatcccatcctgcaatgcgctttaaaaagattaaagcctattatcactcgcctgctacagcaaggcttttaaagcctataaactctccttacaattcccccattttacctgtcctaaaaccagacaagccttacaagtt

SEQ ID NO: 474506 - DNA, 1060 bp, Homo sapiens
gctgctcacaaacgcgctctcctctagcaccgcctgctgggccgaccacgaggcgcctgggctccgtgtagcggaaaatgccgtgtgtttctagggaggtgaaaaaggagccctccaccgaaaggcagaatcagccatttaaagttttggcaacgaaaactgtaagtcatgaggcattagatgcaggtatctacagtgcaattccaacagaaaaagtggatggaacatgttgttacgttgctacttacagagatacctttcgctggagctctgcgagccagaggcagcgctggcgttggagagtgatggcggcatggcggtgcggcggcggctgcgaacaccttgaggacgggtcgcattatgttgcccaggctggacttgaacttctgggctcgagcaattctcccacctcagcctaccaagcagctgggactacaggtctgcaccactgcaccccacccattcaagtccacatccccagaaacgaggataatgcttggcacaaggtaggcatttaatacatatatgttgaatgtatgaataaatatactggctctttctcaaggccagagaagcctctcttcatcttcccaggacttccattacctactttttttctggagggcgggggggaataatttcaacctacagaaaagatgcagatgcaagaataatgaaaggaactcttagataccctttaaccaaattcaccaataatgttttagtttgtaaaatctaatttgaaataatttttttaaaaatttattttctcctcaaatttctttttctttttctttggcttaagaatcttcatgtttttatttatttatttatttattttttgtttttgtttttttgagacagagtctcactctgttgcccagcctggagtgcagtggcattatctagactcactgcaacctccacctcctgtgttcaagtgattcttgtgcctcagcctcctgagtagctgggattaccagtgcacgccaccacgccaggctactttttgtatttttagtagagacagggtttcgccatgttggccagcctgattttt

SEQ ID NO: 474507 - DNA, 2583 bp, Homo sapiens
ttagctaacaatgagttgtcattttttcaataaaatacactttttgttatggaaaataactggtgaagtttgtgaaacttgtgtgcctctaaaatcagagtctgaggagctagctcatggggataaaaggagccagttaaaaataccaggaaggagagaaacacacataggtaaacagaaggggacatgcaaagtctataggatcatggcctataaaatgcttcaagtagtcctgtgctcaacattgcttatcggagcattgggagcgccatttttgttggaagaccctgcaaaccagttcctacgtctcaaaagacatgtaaatttgcaggattactgggacccagatcacagttcagatgtgtgggtaaacacactggctaagcaggtatttgtattagaaacaaatggtccttcaccatttatctttttaaatagtcattgcattagctgaccactaattaacacatgactagcctagccctgatttttcctctctagacactctgaactatatctgctttttcttgcccatgaagtggtttttgcctggtaaactctgcctcttgcttaaagactagactcaaatgtccctctgaagcctttcccttcttctcagggcgacatttgtctttccttctctccctttttgcatgctctttcacaaataaatagctctcaaaatgtcaattggaattacttgttttgtgtacccaacctacctacctagactataaaggtagggtctgtatcttatccttcaaggtaattattctcgggaactagcaaaatgattgttatatagtcaaagcttaataaattattacatgtatgtgtagattgatgaatggatagtggtcggactttagttcactttcagttgttcagtagctaaatatccccggtgacaattattcaaggctttaatgttgttcctccttttgcttgccttttgtacattttcctattcatttgcattctcgctgcaaaagaaacaaagaagaaatttgcattggccttttttattctatatttacttttctgatagaagaagacattaaaactccaggccaaatgaaattgctgaattatctgagtatttcaattattcatgatctccctcttacaatttagcaatttaggaaacaaagttgtataatgaatgaatgaattctttcacttattctttctttctttccacatatctcaggatctgattatcatcaggcatgaggattgtataaagtcataaaaagttgaatgtccttgttttcatggggccttgatcttgtccgtactccacataactgggtcttaaccggtctaccaggatctgcttgttttgcacttgctgatgaaaactactaactgaataatgcatccagttttatggctgtttttgtccaataggcattatttagcattattaaaacaagacatttgtttatttggtcaattaagtgattaagtaggctggtagactgtgtcttctttatagaatgttgacattttcaggtactctcctgcctctacttgtagaccagatttgtaccaactgacaggcactatgtaatgtagcaagactctgctacattggtttatactgtggccccacaaatactgtaaaatatctgagtattgaaataaacagataattaaaagtatgaaaaccaaattctatttggtataattcttccattatatttttctcatcttttaggaatatctgtatgataatcagaataactgatgcaagatgtgttctacacactcagagatcatgacttgtgtttccttttcttgaaggctcgtgaaacatggattgctttgaaaacaacagcacagtattatttggatatgaataccttcacctttgacatgtctactgcccagtaaatatgttttcctggttaaagcaggaggatgaagatggcagaggttggaatggcattgtgccaaaaccatgggttttagagatctgagggtatatccatgctgtttactacattatttattatgtctgtctcaaagttgttgaaaacagtagttatgaaaacccatgtaggaaactggaataagacattctcaataaatggtagttctcaaaaaaagaactaaaaaaaaaaaaggctgtagtaataacatttaccaaaacgatggcatttatgggaaaaggaaagcaaaaacataaacaaagaaaagtagtttcattaaaccactctgttcatagcttttactctctattgcctcttctttgagagagttttttaattcaaagaaggacagggagctctcaaatggagctgatcctcttctctcttcttcagtgcttgtcgcattcttaagtcagtcgattttaaaaccatgactttgaaacgtttttcatcaaaggtgtactgctgagtggagaatacagccttaccttaatacaacaagtagatagtggctaggaactcaatggaagtcattcacttatgcctcaaactgtggatagtactgaattagtgtactatcagtactgaattagtgtactgaattagtgtagcgaatacctactgcattagtgcattctcacactgctat

SEQ ID NO: 474508 - DNA, 936 bp, Homo sapiens
tatcaaaccactgatttgatattgcaattcttataagcagccttcctttccttctcccagcatgatcgacgcagaagatgggtgatttctgcatttccaactgaggtacctggttcttctcaatgggactggctggacagtggatgcagcccacagagggtgatccaaagcacggcagggcatcgcctcacccgggaagcgcaaggggatagcagctcctcgccagcaatggaacaaagctggatggagaatgagtttgacgagttgacagaagtaggcttcagaaggtcggtaataacaaacttcaccaagctaaaggaggatgttcgaacccatcacaaggaagctaaaaaccttgaaaaaagaatagaccaatggctaagtagaataaacagtatagagaagaccttaaatgacctgacggagctgaaaaccacggcacaagaacgagaactttgtgacgcacgcacaggcttcaatagccaattcaatcaagtggaagaaaggataacagtgattgaaaaccaaattaatgaaataaaattcaccaatgttgacatgaaggaaaaagtgttaagggcagccagagagaaggtcgagttacccacaaagggactaacagcggatctcttggcagaaaccctacaagcccgaagagagtgggggccaacattcaacattcttaaagaaaataattttcaacccagagtttcatatccagccaaactaagcttcataagtaaaggagaaataaaatcctttacagacaaggaaatgctgagagatttcatcaccaccagccctgccttacaagagctcttgaaggaagcactaaacatggaaagaaacaaccagtaccagccactgcaaaagcatgccaaattgtaaagaccatcgatgctatgaaaaaactgcatcaattaacaggcaaaataa

SEQ ID NO: 474509 - DNA, 479 bp, Homo sapiens
cagcgtgacctggatgtgagacctggatagtcccgtgtctattgttgccacattatgtccacaggtacacaatgtttagctcccccttatgaaattgcagggccactagtagcatataatgcccatcagggaaagctgcaggcaccagcgtgcaactccaacccaaaagagctgaagtgtaggctgaccctggcaaagccacagggtttgccaaatcctactgccactgacaccagtgcagccctagagcatgcccaaggcctgcagcctgcctgccacttaattcagggcccaaggccactgtattcagctgatgatgatgcagaccaaaacattttaacttctcgtgaaaatctctccagcatttcatctctctggctgtgctatctgaaaaatttgggaatcctgtgttccagatgctgtctctacaggagaaacggtaaattcttcaacaacctgtgtccctgagtgactaggtt

SEQ ID NO: 474510 - DNA, 897 bp, Homo sapiens
attttcaattaaaactaactgcagtgcgctccgtccagtttgaaattccaggcagctttgtttacactgtgatgggaaaaccgcctactcaagcctcagtaatgatggatgtccctccccctaccaagttcaagtgtcccaggtcaacttcagactactgtgctggcagcgagaatttcaagccagtggatcttaccttgctgggcgccatgggggtgggatcaactgagctagaccacttggctccctggtttcagccccctttccagggagtgaatggttctgtctctctggcattccaggcaccactaggccccaagcatcacctgaaacatgaatatagcttcaactctggagaagcaggagaacagagccgcaaagctcctgccatgacctttggtggcgatgactcatatcacagtggccatccatactcatcaatgactaataccacaggctctgcagtcagagatcaagttcaaaatcctagatctaccacttaccagatatgcaaactgcaaccatatatttaacctctttgttcctccattttctcatctgtaaagtggagataataatagaacctgtcacctaagagttttcttaaagactaaatgaaacaattcatgaaaaatgcttattagagtgtctttctggtaatatttttctataacttaagcttattaattatagttttaatgctttttaactaaaaatttaaataaaaaagaaagcatgtatatactgctaaattcagttgggaaaatattgcaagttaatttaatttttaaaaattttttaaggatgctcccatacttctaaatttaggatttgaggtttcatgcattcttagtgcacaatgataaatcagtgtaaaaggataaatcaattcacaaa

SEQ ID NO: 474511 - DNA, 719 bp, Homo sapiens
gtgagacttattcactatcacgagagcagcatgggaaagacctgccccaatgattcaattaccttccaccaggtccctcccacaacacatgggagttcaaaatgagatttgggtggggacacagccaaactatatcactaataatcagagaaatgcaaatgaaaaccacaatgaggaagaaaagcatctggatttcaaagctgcttgtgatactagatcagcaaatgtccccatgacggaatcccatgtgccctggaagaagacttctcatgtgctcgtgactattcctgaattattggcttattcctctatcactacctgtgatactggagtcttctgggtgacagtggtgaccactactggtccaaacagatcatatgtaaaagattattggagcttcattaaacagcaactgagaaaccacatgcctatttgtttgactcttattgcctctggagtcatggatgggaaacctggagctactgtccagcaagtggccttcatggcaagctccctgctagcggtcacggggatctatcaatgtagtccatcagccatctgcatagaggtcaaggtcaaaggatggagagcagacctggaggggtaaataaaggatctctttcataagaagagaaatgaacttggtcttgaagatgaggaaggagggccattgagagctgtatgcatacataaattctgatatttggaaaagcaccttg

SEQ ID NO: 474512 - DNA, 660 bp, Homo sapiens
acaggggtacatgtgcatatttattacatgggaatgttgtgtggtgctcaggaggaaaagtttgaataccttcatcttagattggcaagagaagggggataatagtctcaccaaaaggaatagaagtcttcaggccaataggggaagtatccctgggcaggcacaagttgtggctaaggcaggcctgaatctggggtgtgctcctcctgtggggctgcactcaccctggattgttctagaaaggctgtctataggtgtctccatgctgcattcctatgaaggaagctccagctgtgtctatgcgggagtgataggggatacaaggatcccttccccaaggtccttcatgatcacagaggctgcctgcctgttgaagtataggccatacaactttggatctatttgtgaggaactagaagtaggaataggtgaagattacaattgggagagagaaaccaactgggagatgtcagtgggcggtgagggagaagcctatagatggatgtgcgagtaggagaaatatcgctgaattcttttcccagcaaggagtaaccctggggaaggaatgcattcctggggctaagttttgttacaattttaagtttagtatttacacctgtgcaccatttttggttaatttttgtacgtggtataatgtat

SEQ ID NO: 474513 - DNA, 928 bp, Homo sapiens
tttttcagatgaggaaactgagggttaagtagcttacaggaatggcaactagcaagctgaatcattttgtgcttgttgctattggagagagaaaagccactgagcagagaatttttacaactgagaaattggaagaacaattcctgccttctaacaccaggtctttcagtttagcagcatcttctggccaaagttactgctgtatgtgctcccagaaattcaaattcagtgaaccttgggaactcatggatgaaccccaggctccactgggtgttcatgaaaatgtgcacagctgtgacttactggtcaagagtccaggctctggattcagcgctgagatcttgtacaagttatttgatctttctgggcctcaatttcctcatctgcagaatgaggataatgattcctcctgcagagagctgtgttgtgaattcaatgctctgcccctggactgccctggctgctgctttggtaaaagcttgcaaggagagagagtaacagccgctggcgaatccagtttgtgcaagcagcatcagcaatggatgagacctccccaaggctggaagaagactggaaaaaagtacttcagcgagaagcaggctggcagtgaaccagcttttacttatggagttggaaatgaactagatgcaatttctagaatcaactgtaaatctgaaaatccatttaagcatataaccatcctggaaaaccaacagcagctgtagcacagttaatgcccctgtcccccatagcccacttcagctctgggagagcactcagggacagagatggcagtggcttatgccaccagggagctgtatgaccatgggcaaacttagcctgatcactggcttcttcacttgtaaaccgaggtgattacgcttgcatgaggacttggagggaagatgggatgtatccttcgtgacac

SEQ ID NO: 474514 - DNA, 827 bp, Homo sapiens
taaggggagcccatctccttgcaagcattgaattctctaacagtggttctgatggcacctgtgcctgctgccgcctgcctccttagcatcatgctccatccacctccaccaataagtgaatccaaaggaaagatgcaagtgagggtcaaggttcagagggagtctcttgttcattctggcttcagctggggcttttgcaactgtgcctttgcccaagagctccagagagaagggacagaaagttttgacctctctaaaaaacatgaccttactctaaagtctattattttgcagatgacttattttgcatttaaaagaagaaagaagtgttggcaatctgcagttttacaggtagcagacaggatgacagtggtcccttccatttgttctggaatctgcaaaggtcctatttctgctactaattcttcatacatctcagcacattccccagagaaacccactacccctcattatcgtagttgaacagatggtcccaagcatttccctgaatttctgtatgatgccaagtgaaaattatcactcacggggactctctgccattctaaaaccaagatctcagttttggtttttggagacccttccccaacctggagtgtgtcagtaatcacaatttacagcatttctgttcctcttaagcaaatattacaggaatgtagtctgctcagaggaggctgtgtaaacggtttcaagttcttattgttctccatgatttatagtttaggtacatatttatcaaaactactgccctgtgatcagaaaatgtgttaatgtatatttttatagaaagcagtcaaaagtaaatatac

SEQ ID NO: 474515 - DNA, 886 bp, Homo sapiens
aagactttgtgaaggactttgagttaattctagaagaactgatgcaataatggctttccaacccctaaggctaaacgcagcaccctaaggaaaggctcaggtgagaggaggttcaaggttaaaagtcattcaaggagtacccactgactatttataatgtttaactggtattgggcagactgtcatacctagggactatatggccaccatctgggtactaccagcaactgctttcacgtgaaaaaaagatttccagaagaaacgggaagaattccaagacagcattagaaagcgtctcaacagtaggcatagggattctgcggtagctctgtagagacttctgttataaccactctgatctttgcacatcaaaaatccaagataaatcctgataaaatgaccagttgatggttatacaaataggctctggggttctaggcttggatttaccatgattttactgtgcattcatgggaacatgactcaaccctcagagccaaatcccttaaggtccaagaaggagactttttctccaaaaggaattcttccaaaagagaagccaattcagatcagcagaatgagagatgacgtcacacctgaacaccaggaaacagctcatctggctctggcactggggaagggagaatgtggaaacataaaggtgggaactgaaagcacaggcaagaatgaccaggtcatggaggctgtgcagagggtaaagttgtcacaaagagaacaagtcagctttgagaatcatttctacacccaaagagcctacagtctggactggaaaatgaagcaacacagtgaaacagagaacagtacagggtcatgcatgagccattgctatatgaacatcacagaaggtgagagattgatgtaactt

SEQ ID NO: 474516 - DNA, 978 bp, Homo sapiens
gacgttgaggctccagtgagccgtgagccatgattgtgccactgcacttcagcctaggtgacagagctagaccctgtcccaaaaaaacaaaacaaaaaacaacaacaacaaagacaagaaaagtggagaagctaccaccacccctgggcctgcgctgggtcacacttgaagccagcacagcactgggtctcaccaacacctgcagtgactacttcctggctactgacaaggttcactcaaggcccaagggctcttcagtcacaggtgggcccagaaatgccatctggaagccagagcctagagtcaggaacttaaatgaagaaattaagggccattatcataagataatgaatgtgcacgagagtgtttctggttgtttgttgccacacaagctgataaacaaaggagcagtacccaaacccaaggcatctcaactcttcagtgttctccccactgaggaaagaggaaggaaaacttgcctaacgtgtgaagagagatctcccaaatttaggcagatgggagaaagccttagggatgagcttgatggtttatctgggtatatcctcaagcctcagagggctgtgagaagaggggaacagactggaaaggatcaagaaacaagacatggagagttcaatgtcaagccaaatttccaaagaattggcagaatccaggactgtcagagtgtaaacctgtgttcttagcacctatgtgtttagctcatgtgctatcctctcaaaaccttcttccacctatctctctctcacacagcattgttagcccctttgtcacacttacccattctccttgttctataacatttatagaaatgtctttccaaaatatgaattccttagaagaggaactatattttgaccgtctttataacactctctgcttagaacacaggacccggcacacagtaggtgctcatatgtttaggtttgtcaaagatcagatagttgtaggtatgcggcg

SEQ ID NO: 474517 - DNA, 514 bp, Homo sapiens
cagtgacgtctcctttgcccagctgctctccagacttttgccttcctctgtgaagctgttcatgaaatgcccgttcttccctagcactgtggtcaccagatgtgatgctctgcacacagagctggatgagatcagccacacaggaggccccatttgtgaaagccatggggcacgctcaagaaaagcacctccattaattattctgttgtcaaactggaccagccaaataacatggatccttcacaagaccaaagccactgtcttgccccaaaagcacatccttgaaacacaagaaaggcacagcattactgccaataaacgggtgtttaaatttaccaagagggtggaggttaacttttccaaggtctcacagaaagaaagtggaaacaggcaagagtctgatgtgcacttaagctccatcactaatatctatttgttctgcaatgaagaggaattaaaggagaggaaaatagaaggttgcatgtttcagagaggatttcaagctggctgagga

SEQ ID NO: 474518 - DNA, 422 bp, Homo sapiens
agtgaccagtaggggccaagatcatggtggttggctccaccatcaatgatgttttagcagtaaacacacccaaagatgctgcgcagcaggatgcaaaggccaaagacaacaagaaggagcctctctgcaggcagaaacaacacaggaaagcgttggataaaggaaaacccgaagatgtgatgccatctgttaagggggcccaggagcacctacaaaaggtacccctgcccagcatgtacaataagtccggaggaaaagtgagattcaccttgaagttagaacaacaccgactgtggattggcagtaaagagcggactgagaaattgcccatgggatccataaaaaatgtggtcagtgaacatatggaaggacatgaagactaccacatgatgggtttcattgatttttgtatatgataggag

SEQ ID NO: 474519 - DNA, 1439 bp, Homo sapiens
tacttagccaaagcccacagcaagtgttacactggagcggaggggtgaaagaagactggggattggtcaggcagacagagaaaggcactgcaggtggagggaacggcctatgtggaggcatggaggtgacacaggggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaatttaaaaaaataaatgtgttttgcacaaagctgtttattacaaaacccatgtt

SEQ ID NO: 474520 - DNA, 911 bp, Homo sapiens
catcaacagcaaagacaagctcccaagttaacttttcaatgctccacgggaaaatgggtgttaaaatgttgagaatgccacctgcttccactttcaatagaaactctttgtactttcatgcaactgctcctttggggatccctctccctactgaatatgattctagaggggctgtccctggggcacagcccaccagacaggtgaacgtggcactgggtctggcacttcacaatggaatttttgaaatggacaagtgttctttgagtctgtctttccaggcaactgaactgtggctggtttggccaaaagaggtatacggcgggttatctgagcttccattggaatattcctctgatctccagcaagagccttgccttctcatcacctgtgaaggtggcagtggctgtgccaaagctctgttactgagtagtgtggggatgctgttagcggcagcagctgtaatcaggcaacttgggggtgtgcactttgcttgcacttcagccccacagcaccctgcagcagtgggtgggaatttgtcctcacagcacataaaaatgtgcagtcacccctctactagaggtcgggtggtgtcactgccagttgctccctccttggttcctaaagcaacggctatgggtggggaatgtccatgggattccagagatgcaaaagcgcaaggggtgttgggccctagggaagaatgcagtctggtgtggctgggctctcaaaatggcagcctgctgcagctgcttaggactgggaagaaggtgtgggacacagaatggactccctctctggagcagtgccttcccacagtctccatgcagttccttatgttagtctcaggggccagaaagattgaggggctctcccatggctaggactgtaggaatctgttgtgggaatctgga

SEQ ID NO: 474521 - DNA, 2890 bp, Homo sapiens
agaccaaggcgacaagatgagaacctctcaaagccatccagcacctccaggcagaggcagttgggggcaggagcagtcgcgtgatgaggtgaaggcaggcttcaggtccacggtgcccccgtcccactggaggggctttgcagactgtaaagtgctatctatctgtataaatgcagaatattgcccttgtgccttcatggttttatttatttcaatctatatccttcatgcttctaaagaatttgtagtggctgacaaaggacaggtaagactgatagaggagatagtgggaaaaatgtacaacgaaggagaggcacacgtactgttcacggggacagacagtgagcctgaaacagtagctcctgctcccttagcagtggaaagaaagcaaagggcaatggggaatgaccaacacagccctcaccacttgattaaataagatgaagccaaactgctcttcttgggccaaattccaaaagacatttataacttgcattctcttacaaggggcattgaatgaaagaatgggaaaggataaatgataactcacatatgctaagtgcttcctatgtagtagccatggtcctaagtgctttttttttaataccattgaccgaggctccttgctctatgtgagctctttacattggagatctcacttaatcttccaacactttggtgtaggcattattatggctattttagaggtgacagaactgatgttcagagaagctgagtaacttgcctagagtcgcactcagctttgctccaaccccctccctctgaaatccttttgccaaccacatcttcaaagcccttttgtactctctcaaagacccttcccttcaactacacagtgcatactcttctgagtctacagtgatgcacttctcatcattcagtatacatgcatcatctattgaacataatcgacctgttcctaaaaaccagtcattctgtttgaagacactaagaatgtatttcccattatttaagtgggaaaaattacaatgcatcactcttcaacccaaatttcttaaccaatttcttaaaatacaatgtaaacacaacaaaatagataggatatccatctgctaatatgtcaagtgtttccattccatcctcatgatcaaacactaaatatagttaatgatgttttagttttgggcttttgcagtaacatggtcttgtttaccctcagcagtgtctaagacgcacatccctgtggcgatacatacttaatgtgatttttcaaactgactacacttggttcttacatttcactagttgtatttgaaatgtaacttgagacttgacctgatatcacattgttaaaaatgttatattgagtttcaaggctgtaaatataatttttttcaatgtaaacaatagctgaaaaagtactgatagatacacacagggttaagccatgtgaaattgccaatgcttaccattttgactatggaataacaatttcacatggttcaacctaatacagtccatgcagccttagtaatgaaaatcaagaggcactggaccaagaaaatgttaagtgcagaggcgttctgcagggtgaatatgcctgaatgtttgttgaacacctactatgtaccaggccctatcatgggagggggaatcattcatcaaccagatgtggccgctctactcaaggtgctcattgtactctaggaggggaaggataagataaacatacatacagttttagataatattgagtttatgcatattaattacttgaagcagtgtttgacatataaatactcagtgggaattgaacaatgagaacacatggacgcaggaaggggaacatcacactctggggactgttgtggggtgtggggaggggggagggatagcattaggagatatacctaatgctaaatgacgagttaatgggtgcagcacaccagcgtggcacatgtatacatatgtaactacctgcacattgtgcacatgtaccctaaaacttaaagtataataacaaaataaaaaaagaaacctaataataaaataaaaaaaaaactaaacaagaaactgtgtaaaactggtgctaattcttcctcaaacgtttgatagaattctcttgtgaaatcatctgagcctgatttaattttcagaagctattgtgaatttaatttatttaacagatataggagtgttcattttttccttagttgaattttggtagtttgtgctttttgaggaattggtccatttcttctaagctatcaaaattatgagtaaaaatgtgttcacaatattctctttatctgtttaatggctgcagaatctgtgttggtagcctctgtttcattcctggttttcattatttgttcttctttcattttatgtttgtcagtcttgctagagcttgatcaactttcttaaatatttttgaagaatcagcttattctttcattgattttctctactgttctcctattttcaatttcattgatttctactgtttattatttcattctttcagcttgccttgggtttattttgctctttttaatttttattatgtttaattgacccacagtaattgtacgtatttacgaggtactgtgtgatattttgatacatgtatgcaatgtgtaatgataaaaatcagagtaattagcataagcatcatctcaaaggtttatcatttctttgtgttggtaacattcaaaatctgctcttccagtatgttgttgactatgggtttgtcatgtatggccttcattttgttgaggtatacaagataatttattaaacaaatattcactgaataccaactacacgttaggcactggtttaggtgctctggatacattattaagtaaaaggaatcatgtccctgcatccatggggttacctaatt

SEQ ID NO: 474522 - DNA, 1414 bp, Homo sapiens
tggcacacagtaggtgctcactgagcgctcactggatggataaatgatgaatgcacaaatgagagccccagctcctaaggatccatctaagaactcagagactcaagggaaggtggaaccacaggtggaaggagccttgatgcctgagtcactgcctggaggaaggccactgcctggccacaccattggaggctacggctcctccctgggtgctagaattcgggagctgctccaaggccctgctgattttggacaggaggaccccaacttactggggctgtgtacctactgcgtgccaggggctaacacaccagactttattttatcctcacaacaggccagagagcaccgtgaagctggcgccaagtctgcttcctcctgcctggtgtgtgacccggcacagagcagacgctcgaggaacattgacgacctaaaatctccccgatgcagggtctggacttgggctggatagagaagttctaataatagctcacatcggcaaaaggtttgttacgtgttctttgttcctcaagataaacactattagctgttcaccttgaagcaacagactcactttgttcattctcaaaaaatgtctaccgagagataccatcttctgtaccaaaaatagacaagagaatgctgtcaatattggtgtactgtaatgtgaatctatactggtgaaaacaattttttgttccccttattaaaaacttagtgtccttttctcaaaaaaaaaaattgtctaccaaaaacacaagtccgaataaccatggttagcctgtcaatcattctttcaaataaaaagggtactcggtgaagaaggcagtgagtttcgcttaccactcaaatgactgcacgactgtgtttcttccatctgcagtggaagtgctttatgcaggcttcccattttgtcacacagaatgctgaaaagacattctcaaagattgagatttgacaatccttaacgaattttattgcttcattgaagattatgtgtttatgttttactgactgcatgatggtgaacaataccgtaactattagcatagtatagcatagcatagcatagcatagcatagcatagcatagcatagcatagcatagcatagcatagcatagcatagcatagcatagcatagcatagcatagcatagcatagcatagcatagcatagcatagcatagcatagcatagcatagcatagggtggggccagcattttgattcgagttaagccttagcggttttccccactgttggatttgtatcatcagtgattagtcaacagagtaaaatataacttagtgttagtagtattagtattaatactaacattaggatacaatattaatattactatcaacacaagattttacctcatagacctcagagaatgtccaggggtccatggg

SEQ ID NO: 474523 - DNA, 693 bp, Homo sapiens
gaagcggtgaccttctggtttcccatcttaccatggtggaaaccttagtagccaccctggccagtcactccgaggcggttcagcctccagctcctctttagccttcccaagaggtttgcaagcacctcatcccctgttaagtctctgagaaaacagaaggggccttgggagttggtgttgccagatgcagcacacagaggtttgggatgatgcctcctaatatgctgtgcggttctggagccataggcactgcagggaagcagaatgaggagcaggacctcagggggtccatgtggccagtgctgctgcccagggctgtattctacatgctccaggctttcctgtgcgtggcccaggggatgagtgtggagctcatcctcagctacagccccatttgggggtcagggtccaagaactcaggggactgggccaccatcctggaggagggagagaagggggcctgtgagctcagtgagggagactggatcctcttcccactgaccaagactgtgtggcctgcaagattggacccaaggtggaatccagcggagaatgttacctggggcctggggccatcacccccaggcattcgtggaggcccccgtctgaccacctccttgcagagctgttagcccatctcacagtctgctccaccacttgctagctgtagcggtgtcaccatgcacctgttac

SEQ ID NO: 474524 - DNA, 844 bp, Homo sapiens
tttcttgcattattaactaatctaggttttgtggcatatgttagcccagtccagcagggagcatgacgtcaggggttatacaagaagaagacaggaagatgagggaaagtttgaaacatcctacagacttgttgaatggctttgaccaaaatgctgatagtgatatggacaataaagtccaagctgaggtggtctcagatggagatgaggaacttattgggaacttcttaggtgcaaagccccagcgctgccacctgccccccgacccagcagccccctttggagccctcctccttcatctggcggggccatcccagagctcacaggacactggctgtgagggtactgtgaggaggggagctcaggcagtaatgttcgctcacccaccactcacctgctgtgtagcccagttcctaacaggccaaggatcggtaccagtccacagcccagagattggggacccctgccacagatgaatggaagggagaaaaccacaggctcagattgataaatcaccaattaaaagatgagtgtgagaatcagaagatctctttggcaaggtttcagtgacttttttctctgcagctggagttggactgagctggagaccagacacaggacttaactggaagatagcagaacttcaaggaagattgattgctcagcctaggtgagtcttctgtgacatagaggaacagaagcacagagcagaatcttgagacctggattagagatatttgcatagatgtaaccgagaactttgaaattcccttgagccctctgaccctaaagagtggcccatcccccttgttggaagttaatgggggtccacagcttgaagacc

SEQ ID NO: 474525 - DNA, 5083 bp, Homo sapiens
gaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatgtcattccacttacagtatggaatgattgggccattattaaagcagctttagaaccatttcaaacagaagaagatagtgtttcagtttctgatgcccttggaagctgtataatagattgtaatgaaaacacaaggaaaaaatcccagaaagaaacggaaggtttacattgcgaatatgtagcagagccggtaatggctcagtcaacgcaaaatgttgactataatcaattacaggaggtgatatatcctgaaacgttaaaattggaaggaaaaggtccagaattagtggggccatcagagtctaaaccacgaggcacaagtcatcttccagcaggtcaggtgcccgtaacattacaacctcaaaagcaggttaaagaaaataagacccaaccgccagtagcctatcaatactggccgccggctgaacttcagtatcggccacccccagaaagtcagtatggatatccaggaatgcccccagcaccacagggcagggcgccataccctcagccacccactaggagacttaatcctacggcaccacctagtagacggggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgctcatggacataaactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttaatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccccacaagcggcagtgcagcagggagcccccacaaaaaatccccacaggggtatatggccccctgcctgaggggactgtaggactaatcttgggaagatcaagtctaaatctaaaaggagttcaaattcatactagtgtggttgattcagactataaaggcgaaattcaattggttattagctcttcagttccttggagtgccagtccaggagacaggattgctcaattattactcctgccatatattaagggtggaaatagtgaaataaaaagaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtatggagattttacattgcttagggccagataatcaagaaagggcggccactgtagagcctcctaaacccataccattaacttggaaaacagaaaaaccggtgtgggtaaatcagtgtccgctaccaaaacaaaaactggaggctttacatttattagcaaatgaacagttagaaaagggtcatattgagccttcatcctcgccttggaattctcctgtgtttgtaattcagaagaaatcaggcaaatggcgtatgttaactaacttaagggccgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaaatagaaataagaaaagacacattaaaaacactaaatgattttcaaaaattactaggagatattaattggatttggccaactctaggcattcctacttatgccatgtcaaatttgttctctatcttaagaggagactcagacttaaatagtaaaagaatgttaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataataaaattatgtggaaatgacccagacaaaatagttgtccctttaaccaaggaacaagttagacaagcctttatcaattctggtgcatggcagattggtcttgctaattttgtgggaattattgataatcattacccaaaaacaaagatcttccagttcttaaaactgactacttggattctacctaaaattaccagacgtgaacctttagaaaatgctctaacagtatttactgatggttccagcaatggaaaagcagcttacacagggccgaaagaacgagtaatcaaaactccatatcaatcagctcaaagagcagagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattactcatattcgagcacacactaatttaccagggcctttgactaaagcaaatgaagaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatgcatgtcacgcatgtaccttcatttggaagattatcatatgttcatgtaacagttgatacttattcacatttcatatgggcaacttgccaaacaggagaaagtacttcccatgttaaaaaacatttattgttttgctataatgggagttccagaaaaaatcaaaactggcaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttca

SEQ ID NO: 474526 - DNA, 1637 bp, Homo sapiens
ttctgtcttcaggtagtttaggaaacatgttttatgcttatgttactgctgcagctgctattaccacttctactactgccttacaactgcttaatatttcacagttttcagagaactttcatgttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggcta

SEQ ID NO: 474527 - DNA, 2532 bp, Homo sapiens
agacagctcctaaatgccatgtaaatgactttctgtctttcaggcatacagagcaggacacctgtgttgtgatgtcttatggcctactttcaggggaggctttccagtgcactcagaagcatcactgctactgtaacagtcgtggagtcagtgggcttcagagggcacttcctcacagtcagcttcaggtgactaagtatgatgctgcagcacaccaaggatttctaatacccaatttccccatcactactgtgtttaaagctaaggacatggccaaaccaaccacagaatttcatttagaggggccgtttcctgggaccacttctggttccaaatatcatatcagtcaaagtccattaaggaagggacttacggaattgggacccagacctctgaggacagaacaccatcccggtgctgctagtacctctgagggaaagccaggtattgtccaaggtttctccccatgtgatagtctgaaatatggcctcgtgggaagggaaagacctgaccgtcccccagcccgacacccggtgaaggtacgctcgagcgtggtcattgaggacaagtcgacgagagatcccgagtacgtctacagtcagccttacgaacaaggaactttagatctaaaagattggaaaagaattggtaaggaactaaaacaagcaggtaggaagggtaatgtcattccacttacagtatggaatgattgggccattattaaagcagctttagaaccatttcaaacagaagaagatagtgtttcagtttctgatgcccttggaagctgtataatagattgtaatgaaaacacaaggaaaaaatcccagaaagaaacggaaggtttacattgcgaatatgtagcagagccggtaatggctcagtcaacgcaaaatgttgactataatcaattacaggaggtgatatatcctgaaacgttaaaattggaaggaaaaggtccagaattagtggggccatcagagtctaaaccacgaggcacaagtcatcttccagcaggtcaggtgcccgtaacattacaacctcaaaagcaggttaaagaaaataagacccaaccgccagtagcctatcaatactggccgccggctgaacttcagtatcggccacccccagaaagtcagtatggatatccaggaatgcccccagcaccacagggcagggcgccataccctcagccacccactaggagacttaatcctacggcaccacctagtagacggggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgctcatggacataaactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttaatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccccacaaacggcagtgcagcagtagatttatgtactatacagtcagtccctctgataccagggggatagttaccgacaagcatctttaaaaaaggccaa

SEQ ID NO: 474528 - DNA, 1588 bp, Homo sapiens
tggcgtatgttaactaacttaagggccgtaaacgccatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccacggagatggtaacaccagtcacatggatggataatcctatagaagtatatgttaatgatagcgaatgggtacctggccccacagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatggtaagcgggatgtcacttaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgttgacctaaattccagtctaacagttcctttacaaagttgcgtaaagcccccttatatgctagttgtaggaaatatagttattaaaccagactcccagactataacctgtgaaaattggagattgcttacttgcattgattcaacttttaattggcaacaccgtattctgctggtgagagcaagagagggcgtgtggatccctgtgtccatggaccgaccgtgggaggcctcactatccgtccatattttaactgaagtattaaaaggtgttttaaatagatccaaaagattcatttttactttaattgcagtgattatgggattaattgcagtcacagctacggctgctgtagcaggagttgcattgcactcttctgttcagtcagtaaactttgttaatgattggcaaaagaattctacaagattgtggaattcacaatctagtattgatcaaaaattggcaaatcaaattaattgatctt

SEQ ID NO: 474529 - DNA, 2552 bp, Homo sapiens
gaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatgtcattccacttacagtatggaatgattgggccattattaaagcagctttagaaccatttcaaacagaagaagatagtgtttcagtttctgatgcccttggaagctgtataatagattgtaatgaaaacacaaggaaaaaatcccagaaagaaacggaaggtttacattgcgaatatgtagcagagccggtaatggctcagtcaacgcaaaatgttgactataatcaattacaggaggtgatatatcctgaaacgttaaaattggaaggaaaaggtccagaattagtggggccatcagagtctaaaccacgaggcacaagtcatcttccagcaggtcaggtgcccgtaacattacaacctcaaaagcaggttaaagaaaataagacccaaccgccagtagcctatcaatactggccgccggctgaacttcagtatcggccacccccagaaagtcagtatggatatccaggaatgcccccagcaccacagggcagggcgccataccctcagccacccactaggagacttaatcctacggcaccacctagtagacggggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgctcatggacataaactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtacctgcccctcatttaatacagtaagacaaggttcaaaagagccctatcctgattttgtggcaaggctccaagatgttgctcaaaagtcaattgccgatgaaaaagcccgtaaggtcatagtggagttaatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaataaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccccccacaagcggcagtgcagcagggagcccccacaaaaaatccccacaggggtatatggccccctgcctgaggggactgtaggactaatcttgggaagatcaagcctaaatctaaaaggagttcaaattcatactagtgtggttgattcagactataaaggcgaaattcaagtggttattagctcttcagttccttggagcgccagtccaggagacaggattgctcaattattactcctgccatatattaagggtggaaatagtgaaacaaaaagaataggagggcttgtaagcactgatccaacaggaaaggctgcatattgtgcaagtcaggtctcagagaacagacctgggtgtaggccattatgcaggaaacagtatgaaggtggtgacactggacgagagcctatcatgcttaacaggccaaaaatgcctaacaaagcgtacagactgcgctagccagctcaaggatcaagagaattactgctagcgaa

SEQ ID NO: 474530 - DNA, 725 bp, Homo sapiens
gggaagccatacctcttgtctgtaagcatgttgtgggagctccagctttatgtaactgtaagcgggaccatcctgaagatgatcaaagaggcgggcgccatcatcagcacccggcattgcaatccgcagaacggggatcgctgtgtggccgctctggctcgggtcgagtgcacccacttcctgtggcccatgtgcatcggtgaggtggcccacgtcagcgcggagatcacctacacctccaagcactctgtggaggtgcaggtcaacatgatgtccgaaaacatcctcacaggtgccaaaaagctgaccaataaggccagccacccttttggagcaggaggaggagggccagaagcggtacaaaacccagaagtggagcgcatggagaccaactggaggaacggggacatcgtccagccagtcctcaacccagagccgaacactgtcagctacagccagtccagcttgatccacctggtggggccttcagactgtaccctgcacagcttcgtgcatgaaggggtgaccatgaaggtcatggacgaggtcgccgggatcttggctgcacgccactgcaagaccaacctcgtcacagcctccatggaggccattaattttgacaacaagatcagaaaaggctgcatcaagaccatctccggacgcatgaccttcacgagcacttattttttgtcataattatactaattataaataagtaataattg

SEQ ID NO: 474531 - DNA, 651 bp, Homo sapiens
cccgctgcccctgtgcttcccctccccgctcccctttcgcagcccctcccccacaggcccagtgtacccagacctgatctacgctggcttgaaggcaggatggggtcagatttgactctgtgtccgcagagtccggtgactggacagtccccagatctggggccccgtggagcctggtgaagtgacaatggctgccctcccggcctgtgggtggtctgctggcccaggaggcccaggtgacagtgtgaccccacgtttcccaccacatcagccttccagcctgcagcagtttgccagatttggcaggaacttcttcaggtatctcacttgtctcatgggaccctgcaggctcctagataagattgctggatccctgcagctggctgccccggctgccgacctctgtgcacctcagggcggcctgaggtggggattcttggaagtgtgggtcctggcagatggtgtcagtagaacactccagaatgtagcgtcagaaattggccttggacactcaggcacagcacctgcttcgagaaggaagagcagaggcccctggaaggaggggctgggcaaggggtggtgagaaaggggtgccctggaagcctgcatgctgctcaagtgttgttaccgcccatggtagctatctcaccc

SEQ ID NO: 474532 - DNA, 645 bp, Homo sapiens
aatgatatccagcatacagtaaaaagtgtgaagaaacaggtggaatggggttccaggagtgccaggctaagcaggaagccccctggaagctcccagggcccaaggacgcaggccacgtggtggcctccaggacccgagccgcgcgcttaacttctcgggctgggtccggcgggctgccccgccccggaacaagccccagccccactgtcaccgttggggatggagggagccacggcttcaccacttcctgccggtgtgccgggctgcgctccagggaccgctggggccgtcaccaaaagaacggagcccagggaacgtggagaggagcccagatgcctgagcgtcagcgccagagtccctctgggtcctccccctcccatggccgagccgtcgagagacaccgtgggcccgtacctgctggccctgagctccctgagcctgcgtgctcgttgctctgagcgcacacaaggattcgatggcagataaactactgccgcatggggagtgtgcgcagacccccaagagtgatgggcccggcgggtgtgtggggtctggtgggcgtgtgggagggctggggctggagtggggacactggcttcacaaaggttgtgacacagagctgggccctgacaggaggggggcagc

SEQ ID NO: 474533 - DNA, 637 bp, Homo sapiens
ccctcacattgctctggtcacttcagtcatgacccccaaaacaggcctctgctggagcccggccgcctcggtctccccttactgcagccagcccgcaggtccggattccctgcctctgctgtcccaccatccagacaagacccaccagctgggccacctgtcaagtcctcagtgggggccacttttctgcaaatgccccaagaatgctatggggctctccgtatcagtgctgtccagagaaacagaatccaggaggcgctggctggctggagacctggggaggagctgccgccgcccctcaagtccagagcaccgtgctggcagccttccctcctccttgggagcctttttcctctcaagcccttcaactgctcagatgaggcccacccacaccgtggaagccaaaatatgcatcattgttcttttcatgtaaggtcattgtttctggctattttcaagatttttctctttctgtttggatttcggcattttggctatgatgtttctgggtgcgattttctaataatcctgtgtggggtttgttggatttcttggatgtttagtttatgtttttcaccacattttggaaatctgtcacctttatttcttcaaccattttttctacctcatttctctc

SEQ ID NO: 474534 - DNA, 913 bp, Homo sapiens
tatgactgagctgatgtccaacatgcaagacaaagtcctctttacttttctttctcctctcctcaagcagaagaaaggacttactttctttgctgagaactgtgctacctggggttgggggaggagagatgcaagcactccgttagtcaccctggctggtgtcccaggcaacactgaattcaatgtgctctccctccctcaagagcacagattctctctccttgccatgaagctactgccaggggactggggaggggtgatatcagtgattcgagactgtttttcctacccccttcagtacctctttcagcgatatgaagagaatcttcctgaataccagtgccatcatataagtgatccctacactagtggccctgaacttttgtccccaggcctgtctcctattcctggcctaggattatctcttgaaaaggataacaaatttggttttcttggtttttattttcagttctctgagactccacttgctttcactctggctcctgttcctcctacttcagccagaggtcctgaacacctggagtaaagtggttattatgcagaaggcagatagtatttaaggaatgttataaagaaggaatgggcaaagcttttggactgattgatatgggtaacaaatgatagggacagataaaaaggactccctgattctgggcttattagggtagcaaagtcaacaaatattttttatgtaaggacatctttttgagaaattcatagccacctacaagatcatagtcgtaatttaaaaatccaatgatggagaaaaatatttaacaaataattgctattaactcaataatgcttttagatgaatatatatttataaataacatccgctatatgtctgttcacactgtgcactgtttgactcttctgcatattgacactg

SEQ ID NO: 474535 - DNA, 1003 bp, Homo sapiens
ggactgaggagagtttcagctacgtcatcagagcccccagcagtgaggggttcgacataatgaacgttgatgtgaagattgacacatcctggatattccaggacatggaagatagtgctgaggagcgggaatgtcttcaggaagaagcagctggccgcccagacatggatatgggtgcgctcaggaggcagctggagtcctccgagcagaagctgtcagcagcagaggacaagtacgtgacatcggagtccgggctgagaagcagaattcaggagctggagctgtcagaaaggaaactcctccggaaggtggaccagctgagcacccacgtggcccaggagagaagcgcctggctccaggcccaggagaagctggcggcgctgcagggggagctggccagccagatccgggaggagagcgtggccaggcggcagcagtggcggctgcggcggttgcaggagcggttgcggcgcaaggacgaggcactggggcagcaggcggtggccctggagcgctgccggcggacccagcggcgccagctgggcctggtgcagcggttggagcgcaacgtgcggtgcctttgccgcgccgcgggtcttctgctggcccagaggggacaccgcggccccaggctttccaggggcgccaccgaggcggctgcggaactgcgcgccctgcaggcgagggcagagcgcatcgagcgcgagcgggaagaggcggctcgcatcctgcatgaacaccgggctaccgagcgccagcttccgggtcatttggaggagctgcgctgttgcatttatggcctgaagctgtcagatattggcctgcaagggccaggtggaggaaccttgccaaaaaaaccaatgccctgtaataggaacctggaaacccatgtctcctattggtaacttgcccctggtaaggtggcggtaactctagggtagggaatgaatttttgccttttcttccttctacttccaaccaattggttgaaagccttgggccc

SEQ ID NO: 474536 - DNA, 933 bp, Homo sapiens
tttactcaaagccctcgtgtacatgcgttattttagtgacttctcgctgctgccaggcgatgggtgctgctgtttcccttcttggacagaagagaactcctgcctttacggcttcttctgcaagctctgtggggaagcaggaggggccctccctgccgcagctggctgggcctctgtctggatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaagaggaacggctgggcgcaaaacttggccagaaaagaaaagaaagagcgcggtgtcttgtccagaggaaaggccgtggccctagaaattggatgtgaatgtttctgaacttatgaagaaattagatatccttggcgataacggggtaactatgagcgatcggtttctgctttcgtgttcttgttttgatctgggtgtattctgtgtgacttttgttttgttttgtttttaatttctctctgatgtaagagatctaagaagtacaatgtaaggcttttgtatggccgtgttcctgtgtgggtggtggggttggcattcgtcagaagtggggttccgaagttagattcccctggcctgttgagtgaggaggggacgggaaagcctcagaatccctacccagaatgcaggtggagtcacacgagattgctgaaatcagaaagggatctttttgccgtcctgaaagatgagcttgcatgtagccatgtttcacaaaagcttagtgccactctgtgaaatgtccccaaccagagggacaggagctgtctgcctgaggc

SEQ ID NO: 474537 - DNA, 4238 bp, Homo sapiens
aggccagcaggttggcagcagggacatgctttcacagaagtccgtatgatggccaggagccgccagtccccagaggggccctgcacctggagccgcatcaggcctggacgggcctcttctgttttggctccaggcccggagaccacaagcgagctccccagagacctggccggatccaaccgtgaacaggtccccagcttggaggtggaccccgagatccaggctcgacggcccacactgccccatgctggccctgagggtcaggagcctgcctgggacagtgccttggtgtctggatggaaggacattgcagacaaaggcaaagacaacagaggacgaggtgctgcccactggcagctccagggagcagggatgcggtggcccctccaggcaggggcagcactcctggccttcaagccccctctgcctgagggggctctgctgctgagcgaagagcacgtgcaaaggccctggggcggtaccagctgtgtcctgtgtgggaaagagcttgtcccctgtgcagctggtgaggaaacacggagaaccccaggagagcccagcttggatgaacagattcttctcctggtctgtggctgcccaccagaggagtgcttggacgagtcactcctccgcatggacctggcctggatttcagagaatctagcagctgacccagctgcagaagcctttctcctggtgcagacatccgcactccctctctgggggccggctggggactccgcttcttggcgaccactgctgctccaggaggttccctcagatggacaaaaaatccaagaagagttggccaccaggtccccgcctcctcccaaagccacaggacacccaggctgggattgtcaccagacaagaggccgcggtgcctccctcttccacgaggccccctacatttcaaatcacccatttctgaaaaaacaccccaaggatctgaaagacacttggaacaatggaggaggaagccttgcggggagaactgaagaggggaaggcaagggggactttgggcaggaaggggaaaaaccttggtgacaagtaccagctaagtcaggaaagccatcagaacctgagcttggagaatggggctggagctgcagaggacgtgcaggatcagaatggggcttcagagactaaggccgccacctgccgccctgggtcctggcaggagtttttgatgcctcttctacagggggaggcctcagtatcaaaggagggtcccgaatccctgagcaggagggaaagggtggaaggatacgtctggggtctccgaggaggactgtcatcagagaatgaggaagtggcacccccagccaccttctccagggctcatgagaccaaagagccatggccaacagacagtcagctcctcgcagggaaagtcagagccactgggaggacagctaggggcaaggaggaaaaccaagtgtggcttggaaatgctctgcttctgcaaggaggaagcctggaggacaaagggctagaggaagaggatgagatgccgcatcaagaagcatccggtctggggtgcaggggtgcccccgaggagcctgactcccaggaacatgagagcaaggaaatgcttttctttgcaggagagacaggtttgccactgtttcccagatttgccttatcagttgaaggggccgaacccactgatcatggtcatccacaggctgtgagcaaaggacacaacaggtgtgcactcacaatcgatgagcttgcacaggacgtggaggcttgtttccagcagctgtccaccctgcagccgggcagcaggggctggcagtgctcagcctctgcatgtaggggagagaactggagctttgctcagaagtggcacagtggctgggagagagctcactctcagcaggtttggggaaattggggtatttgttctaatgaagaagcgaagtctaaagagagtggtgaaggtgataagccgggaaagaccacggccctgggcaccagcgaagttcctggtaacccagggacactgcctcattgggatgaagccagcccaaaccctccacaggggcctgctgagccctggggtgccctcgagagagtgaggagcaggtttcatcagctcatttctggattgaagaaacagagaagccagattttacatgacaacaccaaacttcacggagaccaagagaggttccatgaaagagtgtgcgcccttgaaagagagagagagagagaggtgacaaaaatatccaggctcgagcgggataaccacaggctggtaggggacatctctcagttaaagaaagaactggatcaatatttacaggcaatctctgaccttgaagactgcaatgggaagagttactgcaaaattttggagcttgaagaggaaaatgaaacactgaaagggaatctgggccaactccagaaagccacgtctgagagtgtcaggaaatccaaagacacgatggagcaagtcaccctggaaaactggaagctccagacactgatctcggagcttggcgtcagttataaagagctgataaaggatatcgtgctaggaatagaagacatgatccgggccttaagtggggagaacgagcaccttctacgcagggtccatgtcctggagagggaagtcaccttgcagaggagcacggatcaggggcgtttggacagctgctttcaagagcctgtgggccacccttggaggaggaaatgagtctggctgcagggcagacaggaccttccacaggcaccgggaattccagacgcggtgctgattctccccctccatcgctggtctggagaaacactggtgtagccaatgccctgcaaggaaatgtcagtggagcagaagtgaaagaagcacatttggagaaagaggagaagaggcccaggtgttctgtggctcaggggcaagctctgagctccctgagcaatggccccatggtaggttgggtctgcatatctgcttactcatcacgcatgactctgttccgggggccaccccattcacttatgcaattcaccagagtcctgtgagggaggtcattgattttcagctgttcttcttttgcaatctatgcaattaaagctataaatttctctctaagcatcccacacattttgagatgaagtctgttcagttcaaaatagtttctaaggattagagctttctcctctaggtctcctgctggggggcctctcctccagaaagcttccccccacccccaggctggttctgtgcagagatgagtcagagcctactcatgtgtgtctcctcccagctcatgtgtgtctcctcccaactctgccttcaatgataccattttggtagcttgcagtcagtcatggtgggaatattcacgccatggaaactggcaaatgctacaaattggtactgtccccccaacccagatgtggttgttgtacagttgccaccccccaactggatgatgtctctgttcagtgcccccttcaggtcatcacagcctcctggcttccctttatcaggctgtattgaatgttgaactacctgcctgtcattctccacacccgcctgagctcctggagggcagcgtcaccaccgcccatctcaggccagcgtacaccctgcccatgtgctcatgatgtctgctagacagcaggagactctctgggcagctcacagggctgctgtgtggggtgatcccatgggacagcaggctgcccaccccccaccgcacagccattctctttagaggataccttggtgctctctgaggacccatgagacgaagctctggtccaagtcactgccagaggagggaggtagaggaggcaatgtacttcccagaaaggccaagttgttttgacgtcttgaagctgaattttacgggaccattcagagcacccatctgttcttaacacggcccagcccgtgcatctcaggcccatgtcgtgtatatttctattaattaaaaaaaaaatcttctgctattgtatattttattatgagagatgccccagcagccctggagtcacctgaattcttccttctcctcctcttctccctcgtctctttttcccaagcagggtagcttgggatccccctcctacctacccctgctaggtcgggatgagttttgggggccttacaattcccagggaagctgccttacaggaaaagggaactgccatcacaaggggaagggagtttgagaagcgtttgagtttctgggctcctaaatcttcacaaacggaactttt

SEQ ID NO: 474538 - DNA, 1330 bp, Homo sapiens
gaagccctcctgctttttgatgctggcaggtgagggaagccaggacagaataagaaagaagtcacagcccacaggaaccaggaaaatggtagggcttcttggcaatgcttgggtccctggtcactactgtgtggagctgagctctgcccctgtggtagctgcacacccatcccttgttacaggactagccttgccttcctgtgccatttttgcccaggcaacttcagtttggttcctttcacaagcagccaaattgtgcctgcagatacaaaacctggtctatctcagtgaaatctatggttctaggtacagtgtacttcccagcagtagcatgtgtgcacataacggtatcaagaacaaactgtgtctgagaatggcaggaactggatatgatcaaaccttaaagcgtgtggacaaaatgatgggaaatgcctggaggtttggtcccaacgtctgtggacgatttactgccttatttctaaataggatcaatacacccaggagccctagtgtaatgagattcaaagggaccctgactcctgaacgaatccatcaattggaccggaatgttaaggacagcgaaagtgaaatggctctaatgaatcttgatattgaaacaaaatattagggcattttgagaagaaagcattttatctcatctgtattttccattccccatgtgattaggaagctcatggaaattgaacaggctcatctgtttcatagtatatgctatttctacacaccagagctttctctgaccctcactaccctcactcaaaatgtgttcccagaatagtcattgcctgcctgccattccccaggcactgtgcagaacactagagacacggcctcctcctcatcaaggagctatggtctggagtttccagtagtttcccaggatcagatgccagctctgccattgctaaggcctctgagtatctccttctttacaccagccccataagggcctgagagcagcaagtttcctcttcatctttttatctggggcaggcaaaatggatcctgccaccttgagtggtgaagcaggccaagctgggcctttctgcatgttttgtcattctgatggacctgtaggcagccagggaaccaggcttacctatctgaagagaggcccctctctgtaaagggatcccttgctggggttgtaagtgacatgtgaagcattccctccctggcttcacacacattctagcaagtctcattgtaacttcactcatgaacgaattccccaatagttggagttgtccatgaaacagacttccctggcacagctggtgggctccccatcagaggacacatccatgtt

SEQ ID NO: 474539 - DNA, 843 bp, Homo sapiens
tgtccttgtggcactgagaaattgcctagtttgtgagtacagagaactcagtgctggcgaataaacatccctgctcttcttcaaccactcacccctacccaccactccgttggaaacgattctgggacatactgatgtctgtgcagtgtacagatgtctgaatttgagaagagttgctggcaaacagtaagaagcactggtatacatgagctgtcgaggtagcaagaaggaatgcctgcaaatatggcccttttggcgtactggattggcccccgtgcctggacagctcaggggaccgaggtgcctggtggggggctggcgagccctggctctgcagctggtactgcagcagcccaggaagaaatccagggctgccgtttgactcagcatctgatctccacagacatgaaagaaaatgggtcagaaagaatgtgtatggggagggaggaagtccctgggaactggagcactcagggtcagtggggactctgggcctgtgatgtcacctccattcccaaggagagcatgcctcgctgcctcaaacatcctgatgtgcagaggatgtcagggatggacagaaacagcccaagaacagaggtcctggctgactcctctcccaagtatgcttgtaagcttctgaatttgttccggttaaattgaatagatgcgtgcgtgttgggggaggaggggatgggggctgggggctggcagtgggagagagaaattagggagactgagtgttccatgacagctccacgagtgaaagctggaattgggcttcattggaaaagacacagttggggaaatacttgagaataataaccttgaataattacaagaaaa

SEQ ID NO: 474540 - DNA, 552 bp, Homo sapiens
gctcatttaaacacagaggaaaggagctgtgatggggggaatgggtgccccccttgggcgacttgtgggacccagaactcatcacgcagagcgtcccactgctgtgcagccactagctgctcggtgctggggctgtggtatgagcatggactctggagtcagaattcctgccttcaaagccccactcctcaccttgctagctgtgtggcctgggagacccacagtgaagagtggggccatcgtgttgcatgtgtgtggctgggccccatcccctcctttctacagcaccacccctctattccttatcaagttcacctttaaggctcctttgcccctcactggggcagtcatgaggggagcagaggcctcggatctgggcatggatgagggtagagccctggctgtgtcctgcagctggaggggccaggaagggctttaagccatggagtgagggaccagagttgggtttacaagggtcactgtggtgtcggtgtggaggggcttgaagggaggagtttggagggaggggctgtagcaatgttgagattccct

SEQ ID NO: 474541 - DNA, 751 bp, Homo sapiens
cttggtctgatgattggtgtgggggccacctcccggcagagcagacgcacctgctccacctggtgggaagataactcacctaagccccggggcagcgcagacgcacctgctccacctggtgggaagataactgccctaagcctcaggggaccgcagacgcacctgctccacctggagggcagcagcctccacagggacctggggagtcagccagggttacagttcgtgacagaagccctgggggatgcggaggaagatgaggacgatgaggactttgtggaggtccctgagaaggaggggtatgagccacacatccccgaccacttgcggcctgagtatggggtcctgagcccatcgacaatagcgctcagcaagggggccgagcggtcgcagcacatgccgggtgtgatgggacgctgatatgacacagccctgctgcagtgagacgccgtgcgggcaaggcgggcgcgcgttcggctgtgacgtgtggcctcttgttttccgggagtcgttattcttcctgaaaatgccctcagtgcctgaggaatgctgtctgatttttggggttttgctttgaaatatttaccctgctttaacacgcttacccatctttttaatggtttaaaacaacaaatcgatgaaaaatatatttcattcttgtaactcttaggaattctcagattgatcttttggctgcgattgtatctaaatgtcacattgttcacttgtcagtcttgcctccgtcactgtg

SEQ ID NO: 474542 - DNA, 676 bp, Homo sapiens
tgcccacccgtgcattgggaggagtgggtggagcctctgaaagttcatgttgtttgcagggggaggagcctggcctctcctgttcttggatggtgatctgggattccagcctaaccatgtggtagaaaagaaaaacccattttctggggaggaatacaaggctgcagaaatttgcataagtaaagagccaaatgttaatagcctagacaatgggaaaaatgcctccagggcatttcagagaccttcccagcagcccctttcaccacaggcctggaggcacaggaaggaaaaatggttacatgggccaggcccagggccccactgctctgtgcagcctcaggacatggtgccctgtgtttcagtggctccaggtccagctgtagctaaaagaagccaagagcccagaatgggagatccactgacagcttgcaccatacaccgagaaaagctacaggcactcaatgccagaacaggaaagcagctgtactctttcctgtactctgcagagccacaggaatggcacaaaacctaatcttttatgtctctgtgggcttcctcaccttgcctctctgactttgtgcattccgatccttttgctaagaatatctttcttcccttttgtcacctggcatattcctgtttatgttccaagactcagtttaagtttaatgattgg

SEQ ID NO: 474543 - DNA, 1056 bp, Homo sapiens
ctgaagatcctgaagtattgctttgaagaattgtaatgggaaatgaaatacggctttaccagtacaatccaaaaggcaaagcacaatcaaagcaatggctactaagagatggaagtagtccagtcaaagcaaaagcagaccagttaagcgcaaaggtcatggcaaaaattttcagggatgcccaaggcattttgcttgttgactgtctgaagggccaaagaacaattagatctgcttattatgagtgttttaagaaagttagccaaggctttagtttaaaaaaaaatgcctggaaaagcttcagcagagtcctctaccatgacaatgttcatgctcattcctctcatcaaacggaaaattttgcaaaaagccatttgcaagcagctgaaactgcaaatgctagatctgtaattgttaatggagtctgtttttacatgttaaaagaaaacaaatgtactatgcacaataatgtcattgatttttaaaaattctttgttgaaagaaaaccaatattttatactgtttatgtttaaatataatacttctcaggtctttctacataaacctctctgattgtacgtaattctcataccctctctgatcgtacgcgcttcacacaccctctctgatcgtacgcgcttctcacaccctctctgatcgtacacgcttctcacaccctctgatcgtacgcgcttctcacaccctctctgatcgtacacgcttctcacaccctctgatcgaacgcgcttctcacaccctctctgatagtacgcacttctcataccctctctgatcgtacgcgcttctcacaccctctgatcgtacgcgcttctcacaccctctgatcgtacgcgcttctcacaccctctctgatcgtatgcgcttctcacaccctctctgatcacaggtgcttctcataccctctctgatcatatgcgtttctcataccctctctgatcatacacttttcataccctctgatcacatgcaccttttcgtgccacattgctggcatacttactagcaaattagtaacatttgacacttgatgtttac

SEQ ID NO: 474544 - DNA, 746 bp, Homo sapiens
tagtttcagctagcaaagcagaaagatggtttgcatcataaaacagagtcgagaagtgtcagccagtctgagaaataaagagaaagagtacaaagagaggaattttacagctgggcctctggggatgacatcacatattggtaggaccatgatgatgaccccgagccgcaaaaccagcaagtttttattagggattttaaaaggggagggggtgtacgaacagggagcaagactatcaaagagacatcatagcatcttaatgcctcctgacatgtctgattcttgtaagaaaaatgctagccatatcaaccctggggatgaaaagaatctttccttgaatttcacccatctgtgtaatttttcactgattctaactaggaaaaatgccgtgctgttcatggaagatgtgtggactaaaaagaaaaggatctggggaaataggcgaaagagtttacaaatcagatttccaagggatagggtaggaggcgagggagatggtcagagatgcagctttgcttgccacctctccagcgttgaaaatgcttctatgtgtcagtggcttcaaatggactcctggctctgctcccgtggcctggaggaaccctctcccaaggcaatctccatagatacaggtactagtgacaatttaagaggatattaactacccagaacatcaatattatatttatatgttatcaaatgatatgccaacatgttctaagcatattctgtgtataagtcattac

SEQ ID NO: 474545 - DNA, 670 bp, Homo sapiens
cctgaatgattgccttctagctttggtacacttacatcaacctatatggtactacgcacctaggctatgtggtatagcctgttgttcctaggctataaacccatacagcatgttactgtactgaatactgcaaacaattgtaacacaatgatgtttgtgtgtctaaacatagaaaagctaagatatcctccagaatctccaagggggagaaagagggattctgttttgatagttaatggtcgtgaggcttacaagttcccagaaactgacaatactgctttgtttataggcattagcaccttaattttcacagcaataattgaaaccgtactctctgaggcagaggttattggtgtttcaattttgcaaaagaggaaattaaggtccagagaggtcaagaaacttgctccaggtggcagagccaggaagtgttctgagcgttgtgcatgtcacggaggctcgcatgctttatcttctagggtcagatgtgctgctggagagggataatgctgcatagctcacccaagcagctgccagtgctgatgcttagatgtgtgctgatttcttcctgtcagatgcttgaatcttgtgtcaattcatattaggaccttagtatttcctgcttctcagcattaacatttcctgtaataagcttcttgtgattcccttt

SEQ ID NO: 474546 - DNA, 1085 bp, Homo sapiens
tacagaaatgaggtgtcgcagaatagaagtcaatgtgaagctgaggaaagctaagaggaatgaccagatgctgaagaggagaaatgcaagctcatttcctgatgttgctgcttctccgctggagaaaaaccgcaaaaaccagggcactgtaaattggtctgttgatgacattgtcaaaggcacaaatagcaacaatatggaaagtcagctccaagctactcaagctgccatgaaactactttctagagaaaaacagccccccataggcaacataatctgggctgtttggctcctgcatcatgatgatccagaagtattagcagatagctgttgggctatttcctaccttactgatggtccaaataaacgaactgacatgttcttgaaaataggagttttgccccaacttgtgaagcttctaggagcttctgaattgccaactgtgactcctgcactaagacccatagggaatattgtcactggtacagatgaagagactcaggttgtgatcgatgcaggagctcttgctgtctttcccaacctgctcatcaactccaaaactaactttcagaaggaaggtacatggacaatgtcaaacatcacagctgaccctcaggatgagatacagcaagttgtgaatcatggattagttattctggttatcctggatgccatttcgaacatctttcaggctgctgagaaactaggtgaaactgagaaacttagtataatgattgaagaatgtggaggcttagacaaaattgaggctctacaaaaccatgaaaatgagtctgtgtataaggctttgttaagcttaattgagaagaatttcttggtagaggaagaggaagatcaaaatgctgtgccagaaactaactctgaaggctgtaccttccaagttcagaatgggactcctggaacgtttaacttttagatcatgtagctgaggtatgtatttgttgtgtactatatttggtattttgtcttactgtttctctactaagaactctttttaaatgtggttggttattgtagcactttttacactgaaactatacttgaacagttccaactgtacatactgt

SEQ ID NO: 474547 - DNA, 617 bp, Homo sapiens
caccgtggaagcccctctgtgtcctcatggtctctctaccagcacaggagtgccctgctccagggactctctctgccacacccttggccctaccctgccagtcctccactcctactcactggcaagactctaaccttggaaggacggacccccctgcttggcatggccctctgagctgcctgcaggccagctttctcatggagctgtccactaagcacattccccatccacctgaagctcatgacctcactcctacccccaagaagacagaatcttgtgaaatcaggagcttttgtctctgtaccttcagcctctgcctgccatcctgtgaacaccagacatattcctgcctcatcaggacaggctccagtgccagcagcctgaggtccccaggcctggagcagcaagggtggaggaggaaggaaaagaaccaatcccctctgggcgggcccagctgtgccccaggcgctgtcatgggatggcgctggctttgcttctccgagtccacccaatgagagacccttgcactgtggccctccctctgacgagcctttggggcaggaaccccaccaagagcacccccgataatgctctttcccatgcagccctgaacagtg

SEQ ID NO: 474548 - DNA, 2466 bp, Homo sapiens
ggacagtcagctcccggaggggagagtcagctcccggaggggagcgtcagctcatagaggggacagtcagctcccagaagggtagtcagctcccagaggggacagtcaactcccggaggggacagtcagctcccggaggggagagtcagctcccagaagggatagtcagctcatagaggggacagtcagctcccggaggggaaagtcagctcccggaggggacagtcagctcccggacgggacagtcagctcccagaggggatagtcagctcatagaggggacagtcagctcccggaggggaaagtcagctcccggaggggaaagtcagctcccagaggggatagtcagctcatagaggggacagtcagctcccagcagaggggacagtcagctcccggcagaggggacagtcagctcccagaggggaaagtcagctcccggaggggacagtcaactcacagaggggacagccagctcccagcagaggggatagtcagctcctggcagaggggacagtcagctcccggaggggacagtcagctgccggaggggacagtcagctccaggcagaggggacagtcagctcccagaggcgaaagtcagctcccggaggggacagtcaactcacagaggggacagccagctcccagcagaggggatagtcagctcctggcagaggggacagtcagctcccggaggggacagtcagctcccagaagggatagtcagctcatagaggggaaagtcagctcccagaggggatagtcagctcccggaggggacagtcagctcccagaagggatagtcagctcatagaggggacagtcagctcccagcagaggggacagtcagctcccggcagaggggacagtcagctcccggaggggaaagtcagctcccggaggggacagtcaactcacagagaggacagccagctcccagcagaggggacagtcagctcctggcagaggggacagtcagctcccggaggggacagtcagctgccagaggggacagtcagctcccggaggggacagtcagctcccagaggggatagtcagctcatagaggggaaagtcagctcccagaggggatagtcagctcccggaggggacagtcagctcccagaagggatagtcagctcatagaggggacagtcagctcccagcagaggggacagtcagctcccggcagaggggacagtcagctcccggaggggaaagtcagctcccggaggggacagtcaactcacagagaggacagccagctcccagcagaggggacagtcagctcctggcagaggggacagtcagctcccagaggggacagtcagctgccagaggggacagtcagctcccggaggggaaagtcagctcccggaagggacagtcagctcccggagggaacagtcagctcctggaggggacagtcagctcccggaggggacagtcaactcacagaggggacagccagctcccagcagaggggacagtcagctcctggcagaggggacagtcagctcccagagggaacagtcagctcctggaggggacagtcagctcccggcagaggggacagtcagctcccggaggggatagtcagctcccggaagggacagtcaactcacagagaggacagccagctcccagcagaggggacagtcagctcctggcagaggggacagtcagctcccggaggggacagtcagctgccagaggggacagtcagctcccggaggggaaagtcagctcccggaagggatagtcagctcccggaggggaaagtcagctcccggaggggacagtcaactcacagaggggacagccagctcccagcagaggggacagtcagctcctggcagaggggacagtcagctcctggaggggacagtcagctcccggcagaggggacagtcagctcccggaggggatagtcagctcccagaggggacagtcaatccgggacagccatgaatgccatgacttccagaaggacatgggcaccctctgcccggaattcatctctggacctgacggagattcacccgctgaagccggcatcacaggcccgctgtgagtactgtgtgaccagaatgcgtagtaatcacctaacgcaggatgtggcggcgccgacccacgctgcgtgcgcaccccacagcagccctgtctcccccgcgagctgcagccggaaccttctaacaggaactcaacaggcagggaatttgcagaggtggaatcctaataaattcaagaaacacaacatcatgaatgctcggagcatctctggcatctctgagaacctcggagcagcacgcacacccccgcccggcggccagcagaagatgtggaccgatgctgcagggcccgtgggcacccaggaggaagagcagggggaggtgaactgtggtctgttccggggctggggctgagtccagcctgccacctgtttttgtaaataaagtttta

SEQ ID NO: 474549 - DNA, 660 bp, Homo sapiens
gcatagataagcttgccctgtagggagtgcctggtgaggggaagatgtttcttgggagcctgggggacagacgattcaccatgcctttggctcgtgctctgcctccctgtgcatggatcgcgctggggctggcgccgacattcctggcacagggcttggcttggaagtgcagccctgccacactgcagcatgtgtttgttttacaatccacagacaagaagaagggaggcaaattccagccttttaaaaagttgtttggcaaaaggaaaaagaaagacccttcgttgttccgggtgccgtcgttggggaagaagagttactctcaccagagtgtcagcaatgggaccttctcttcggatgaggagaccctggaagacaatctaaggttttacaaagccttgggaaattccactttggatcaaatagctgcatttctaataatgtcacctgtcctcgttattgactcttgtccacaaacctgcatttatgagacgtgtactatattttaattaaacctttttataataaacacatctcttaagtaaggatataaaaggataagctttggactattaatttttaaaatgtcactttaaatatttaaaaaattagtgggtatatgcccagaggagtataaagcattttaccataaagccacac

SEQ ID NO: 474550 - DNA, 1068 bp, Homo sapiens
tcgctgaaagccaggtatgagctcacaaaaacaggttacatcaaaatggctacataaacatgatgacatagtgcacggggttgtctggctgttccaagcaccggtacacaggcaggttctaggcagggcttgcagctggaccaggcatgtcaccccgaagggaatgcggtggcaccccaagaggggtgctcagaccttgaagccccggaaggggcgattctacttgctaattagctcttttagttctgccatccgcagccctagggatagtgacatgttaacagctctgtcagccccttgccctgctctggctggtggctctggggctggctcagctttgccactgcttcctgtcatgtggggcagccgccctcccccagaggacagaggaccacagtgttacagccttctgagtacttgtgttcagtgagtcccaagttcttgtctcatgtccaagacgaatgaggtcacgctgacagttcaagagtgatgaggacaaagaattttattgagcgacaaaacagctctcagcgaacaggggaggagaaggtggtctctgacctgaagttagctcatctagccaaaatcccactgaagactgtaacactaagtacattatatcattaaagtcagggaaatagtgtctcaacttatttaaatttgcatcattttgcatatttttgccaaaagtaataaaatgatatgataactaagaggaagaaacaaaatatttattattttcagatgacaacattatttacctgtaaaacacaaataaatcatctattaagctacaaaaatcatcaagatcacttagtaagatttctgtatacaaatcaataggcagaaatcaataattcacagttagcatattttttataaaagaagcattaacattagcaaagatcaatataatgtgaaaaactttgaaaaaatcagactcaagtttatttttgaaactatgtatttagaagagccacgttaatgataggatcctgtggcaaacaaaatctgagatgctctcatttttccaacccattggtgcttatgcatttttataatcccttc

SEQ ID NO: 474551 - DNA, 2082 bp, Homo sapiens
gaggccacagcatcacagaaccactggcagaatgaagcacaagttctccaacttgacagtacctaagaatcagcggaagatgatgataaaaatgaaaactcatggatcttccaaatctaggatagattctagtattcagcatgcttaccaagcaattgcagatattgagacagccagatggaaaagtctccctggcaaaactttagccagactacgcactgggaggaatgcacactggggtggagccacagaagtttgcgctgtttgcagccaggttgatcctggcccctcctcttcctgggtggaacctgggattcagtctgtgagtcaggaagcccactggcaggaaggacactctctcacttcaccaagagtctctgtttcccctttttctttcttttcacccaataaaccctgccctactcacccttcaaatgggctctgaattatttcctctgaggaagcaaggatggagtttgcagcagactcttacagattcactgccaataacattagagattcacaatgcattttaaaatattaaaagttttgaagtagagtggtggttatgagacagtaggtagagtagtgggaaaggggggataagaaggggttggttaataggacagactggagaaaaagaaactcttctcagttgactgggatgactagaggctggtaatgacaaggggctgaagttttcactaccatgagttgtcacatctaatggacttgacagccggagtgtttttaaacactaaacctagctgggtgtttctcaactctgctgcatcttagactcatgtggaaaattttatcccaaagaagggaaagagggcagtggacaggaggagagaagagaaaaagaaaacaccaatgcttggatcccactcctgggagactaatttaatgatctgggaagaataaatcctcagatccttgcccatgtgctcacttggctccagagcctataaccgagtgacatctaaaaacagagttatccaagaacactcaactggtaagggaagaacgcctcaattgagcatgtgtacaactccagtaaacacactgtgcctgcagcccctcccaactgctggcagaccactctacatgcagacagctcaccccaaggagagaatcaggggagaagagacacaaccgcctgaaagcatgccaacatattccccaagtcaaaaggttcaaaccatacacttgattctctcaagttgcttgcttggccttctttcaagtgtactttacttccctccatccttgccctaaaactttttactaaactttcactccataggctgggcacatggtaaacattccactttggctcaatgtcagattgatcaatgaaagttaattgatcaattaactaagatgttagtctctttgccttcaagtactataagggaaaatacaacataaaagtaagaagtttaatgctccctgttgaaaataaagaaagagaacaaacccccacccttttcttaggatacttcctttacaaaacttgtacattctctctttgtctctttgaaatatattttctatttacagttcattaaatctccagaggcagaacctgtggatacagaaagtctacttacacttcaattggtgttatctacagctgctccttgattacattaagtttctgagccctcatctgagaaaacttagattatcatagggaataatggagtctttcattcagtctttcaacaagtctggcatatttattgaatgtaaatgctctagacaactgtccaggtactagagataaaatagtgaataaagcaaagcctttgtgtttaagaagtttgcattattctaaggaatgaaaggcaataaagaactaaatatcttgtttttcacattttaatatttttaaaattgggatggcatggctgtaataatcctgattattagccaggcaacaggaatgaggtagttgtcattgcctgcacatatgccaacttggtcatatctgttcacactgccattatgccagttgaatcatgtgtagtgctaatacatgttctatttaattgctatgtaaagtgccttttttat

SEQ ID NO: 474552 - DNA, 1018 bp, Homo sapiens
tggcacaccaggagattatatcccacacctggcccagagggtcctacacccacggagcctcgctcattgctagcacagcagtctgagatcaaactgcaaggtggcagcgaggctgggggagtggcgcccgccattgctaaggcttgagtaggtaaacaaactggcgaggaagctcgaactgggtggagcccaccacagctccaggaggcctgcctgcctctgtagactccacctctgggggcagggcatagccaaacaaaaggcaacagaattctctgcagacttaaatgcccttttctgacagctttgaagagagtagtggttctcccagcacacagctggagatctgagaacagacaaactgcctcctcaagtgggttcctgacccctgagtagcctaattgggagcaccccccagtaggggcagactgacacctcacatggccgggtactcctctgagacaaaatttccagacgaacgatcaggcagcaacatttgctcttcaccaatatccactgttctgcagcctccgctgcagatacctaggcaaacagggtctgtattggacctccagcaaactccaaaagacctgcacctgagggtcctgactgttagaaggaaaactaacaaacagaaaggacatccacgccaaaacaccatctcaatggaacaaagctggacagagaatgactttgacgagttgagagaagaaggcttcagacaatcaaactacaccaagctaaaggaggaagttcgaacccatggcaaagaagttaaaaaccttgaaaaaaaattagacaaatggccaactagaataaccaatgcagagaagtctttaaaggacctgatggagctgaaaaccatggcacaaaactatgtgacgaatgcacaaccctcagtagccgatcgatcacctggaagaaagggtatcagtgatgcaagatcaaatgaatgaaatgaagtgagaagtttagagaaaaaagaataaaaggaaatgaagaaagcctccaagaaata

SEQ ID NO: 474553 - DNA, 634 bp, Homo sapiens
tcttattctcaatatgcattttatcacccagtcagctcttgacattagaaaacttcaaaaattggaatccggccctcaaacgccacaacaggaattaatcaacctcaccttcaaggtgtacaataatagagaggaggtagccagacagcaacgtgtttctgagttacagctacttgcctctgctgtaagacaacccacaaccatgtctccagcatacaagaacttcagaacatccaagccacagctcccaggggctccttcaaaacatccttgtggaccttgcttcaaatgccaaaagcctggcccctgggcctcagaatgcccggtgcccaagattcctcctaagccatgtcctgcctgtgtgggcccccactggaggtcagactatccgactcacatcgctgccgctcctaaagcccctggagcccaaacccaatgttccttggccgactccttcccagctgtcctcggcttagtggctgaagactgatgctgcccgatcgcctcggaagcctcctggaccatcgcagatgctttgggtaactcttacagtggaggaccattgatgtttaaggtgatttttaagtatatttggcattaatatataaccatatttgttattaaaaaatggtgc

SEQ ID NO: 474554 - DNA, 1009 bp, Homo sapiens
taataggcttctgccgaatatggattcccaggccttaaagaaggccctaacccacgtcccagtgttaagcctgccaatggggcaagacttttctctatatgtcacagaaaaaacaggaatagctctaggagtacttacacaggtcaaaggaaccagcttgcaacccgtggcatacctgagtaaggaaattgatgtagtggcaaagggttggcctcattgtttatgggtagtgacggcagtagcagtcttagtatctgaagcagttaaaataatacagggaagagatcttactgtgtggacatctcatgatgtaaacgacatactcactgctaaaggagacttgtggctgtcagaaaaccatttgcttaaatatcaggctctattacttgaagggccagtgctgtgtctgtgcacttgtgcaactcttaacccagacacatttcttccagacaatgaagaaaagatagaacataactgtcaacaggtgattgctcaaacctactccactcaaggggaccttctagaggttcccttgactgatcccaacctcaacttgtatactgatggcagttcctttgtagaaaaaggacttcgaaaagcagggtatgcagtggtcagtgataatggaatacttgaaagttatcccctcactccaggaactagtgctccactgacagaactaatagccctcactcaggcactagaattaggagaaggaaaaagggtaaatatatatacagactctaagaatgcttaccttgtcctccatgcccatgcagcaacatggagagaaagggaattcctaacttccgagggaacacctatcaaacatcaggaagccattaggagattattattggctgtacagaaacctaaagaggtggcagtcttacactgccagggtcatcagaaaggaaagtaaagggaaatagaagagaactgccaagtggatattgaagccagaagaacggcaaggcaggaccgtccattagaaatgcttatagaagga

SEQ ID NO: 474555 - DNA, 821 bp, Homo sapiens
tctggagtgaacctccagcaaactccagcagacctgcagcagaggggcctgactgttagaaggaaaactaacaaacagaaaagaatagcatcaatatcaagaaaaaggacatccacacaaaaaccccatctgaaggtaaccaacatcaaagatcaaagaaaggaaacaaaactagatggataatgtgtctcgtgaattgacaggcttcagaaggtggataataacgaactcctttgagctaaaggagcatgttctaacccaatgtaaggaagctaaaaacctgaaaaaaatgttagaagaattgctaactagaataaccagtttagagaagaatataaatgacctgatggagctgaaaaacacagcacaagaacttcatagagcatacacaagtatcaatagccaaattaatcaagcagaagaaaagatgtcagagattgaagatcaacttaatgaaataaagcatgaagacaagattagagaaataagaatgaaaaggaatgaacaaagcctccaagaaatatgggactatgtgaaaagaccaaacctacatttgattggtgtacctgaaaacagaccaacattcaaattcaggaaatacagagaacaccacaaagatactcctcaagaagagcaacccaaagacacataattgtcagattcaccaaggttgaaatgaaggaaaaaaatgttaagggcagccagagagaaaggtcgggttacccacaaaaggaagcccatcagactaacagtggatcgctctgcagaaaccctacaagacagaagagagtaggagccaatattcgacacttaaaaaaaaa

SEQ ID NO: 474556 - DNA, 626 bp, Homo sapiens
ggcggcgctcgggctccgccagtattttcagatttttaatcttttttggtttgagtgaggcttatgagatctgatggtttcaaaagcacctggcatttcctctgcttgcactcattctctctcctcctgccctgtgaagaggtgccttctgccatgattggctcagaagaagacaggaaaatgtgggaaagtttggaactttctagagacttgttgaatggctttgagcaaaatgctgatagtgatatggacaatgaagtccaggctgaggtagtctcagatggagatgaggaatttgttggaaccggaataaaggtgttcttgctatgctttggaaaaagactggcagcattttgcccctgccctggagatctttggaactttgaggttgagagagatgatttaggatatctggcagaagaactttctaagcggcaaagtttcaaggggaagcagagcataaaagtttggaacatttgcagcttgaggatgcaatagaaatgaaaacctcattttctggggagaaattcaagcaggctgcagaaatttgcataagtaacaaggagctcagtgttaatcaccaagaccatggggaaatgtcttcagggcatgtcagagaccttcac

SEQ ID NO: 474557 - DNA, 490 bp, Homo sapiens
tgagggtttggtgtacagattatttcctcatccaggtaatgagcataaaactcgatagctctctgatggttacgcaaggtttgctggtgaagatgctacggagagggccactgggaagcacgccagttgggcagctgaggctgtactgcatgcagaagttctccctgtcaactcaaatgtccatgagggttatgaagtcttctgcagctggaattccagagatccgtggtgagaatgggccactccatgcctacttaatttacctctttcccaggagccacttggggccaggaacaagttctggtactcagcaactttgtgcagagtttccagcttcctcttccttcagcccaggggaagtacagttaatccccagcctggcatatctgagcagtagcccatatgactgtcatccctgtggttgccccactcctacagacaactggacaccaaaagagcagggaccagtgtggtggactctgttttagac

SEQ ID NO: 474558 - DNA, 2788 bp, Homo sapiens
ggcctgactaagtctgttctttttgctcttatgttttggtctcagcacacttccgttcctctggaggcaggcagcttggttcaaagaagtacacagtagatttaggaaatgcaacactggaagtctgatgccagctccattatatacttgggcactcttgggagattcacataccatcaccagcctcacttcatctgtgaaatggaaataagggctgcccaatcttctagcctctctgaggttctacttcccccacgaaagccccttgatgctgtcccaccttttccttctgccttcaactttaacacctctgacaagcctgttgtaccacagggtggaagatactcacgccagatccaaatccaacttcggtcaatcaccagctgtgtgatctttggtaagttaaataactcattggaacctcagcttcctctcttattggatgaggaacataagtctccccgctgcctttgggactttgtgcatgttatttttgctgccaaaaacaatctcctcctctgatttatttggatgactcattcttcaggactcagctcagaagtcacttcttcctggaagccttctttgatttgccaaatcagattagatgtcccggctattctctcttattttccctgtcactacttcctgttacattgtaattacatgtttgtatccctctcaagaccatgtcaccaggcttagaccatagattacatgaacagtaaatatcaccaaaagatgctttattaatcatatgggtaaagcaccaggcacatagtagctgctgaataagtcattccgtatcctttagtatacattgcactgaagttagtgttatttatgtctctccacttgactttgtgtattggaagacatagacccactcaattttatacgtcttaagacctagatccacaacttgattatctttgtgtccctcgcaagatctaatacatacaaaaagacaaatgttggattgaatcataatgaacataaattaaaattctttaaattcaagccttcacatgaggaaaacattttgccaaacttcactgttgttataatagagaatccagtttactttaaaaatggtttctctttttgataaaaggtgctcagtaaatgattatggaacacacagatgatgaacacattggatttttcctgtatgtgcatgtactggattctaaattggtccgatgaggatagagtaacccccattcttcatcttgcctctcattgtgccttgcatctggactggtgctcagaaaagcttgctgaattgaactggggaaggagctattgtgatcctgctttttccttgctttttagaatcttcttagagaactgctcaaaaggttgctttgctatgcagagaggcagatagtattttgtatttttcttttataggccttgtgtgagttatgttttaaagaggttctgtttcaatgtatttccaggattcatttcaagatttggacctccttatagaagttcttgtagtggtgtcttggtaatggcaaattctctgagcatttgtttgtctgaaaatgattgtatctttccttcatatatggtacttagttttgttggatacaaaattcttggctgataattgtttttttttttgaggagcctgaagataggtccccaatcccttctagcttgtaaggtttctgctgagaaatctgctgttaatctgataggttttccttacaggttacctggtgcttctgtctcacatctcttaagattctttccttcatcttaactttggataacctgatgacaatgtgcctaggagaagatctttttgtgatgaatttcccaagtgttctttgtgcttcttgtatttggaagtctaggtctctatctaggctggggaagttttccccaattattcccccaaatatgttttccaagcttttagaattgtcttcttcaggaacaccaattattcttaggtttggtagtttaacataatcccagacttcttggagggtttgttcatattttcttattcttttttctttgtctttgttggactgggttaattcaaagactttgtctttgagctctgaatttctttcttctactcattcaattctattgctgagactttccagagcatttcacatttctaaaagtgtgtccaaagtttcctgaatttttaaattttttaagctatctatttcattgactatttctccctttactttttgtatcatttttttggatttccttgcattgggctttgcctttctccggtgcctccctgattagcttaataactaacctcctgaattctttttcaggtaaatcagggatttcttcttggtttggatccattgctggtgaactagtgtgatttttttggggtgttgaaaggccttgttttgttatattaccagggttggtaatgtaacaggtaatattacagggttggtacagtattcaatgaatttcataagatatttaacactgtattataaaataggctttgtgttgttgatgattttgctcaactgtagcctaatgtaagtgttctaagcacttttaaagtaggctaggctcagctatgatgtctgtagtttaggtgtatgaaatgcatgtttgacttatgatattttcaacctgcaatgagtttatgacataaccccataataagttggggagcatctgtatatccattaggtgaaatgttaatgggggacttcatgaaaggtacaacaactgacaacactgattaatcttaacatcatgtaaatagaagcaatcagacatt

SEQ ID NO: 474559 - DNA, 956 bp, Homo sapiens
aagacactgtattttgttttatgtggctgaggaggcctcacaatcatggcagaaggtaaggaggagcaagtcacatcttacatggatggcagcaggcaaaaagagagagcttgtgcagggaaactccccctcatagaaccatcagatctcttgagagtccttcactatgatgagaacagtgcaggaaagactcgcccccatgattcaatcaccttgcactgggtttctcccacgacacatgggaattataggagctacaaactcagccacatgagttgctttagccaatactatgaggtggacatagcagtatgccagttgcaggtctctttcatcttggtcatctctgtgagaaatttgcacatcctcgcctgctggggagataagagatgtgtggagctgagtcgagtcatagagtctgatgcagatctggggtttgagcccagttctatctgacttgaaaaccagaggtcttgtccactctgctagtcttcacagtattattattgctgtagaataaaccactgtgcttctttattatgtaattttccgtctgtaataagtttctgtccttctttctgcattaaattttttatataatttgggagcttgattagttgacccaaattttgattttctatgatgctttgatactttgccttaaactagaagaaatagtacctcacaggttaaaaggtacactctagggactcaataaataattattgaatgaactagaaatacactaattgctttgaattacaggctctggcataatcaagttgtgagcattcaaatcttggcttaactatttgtgtcttggcaaattccttgatctttgtttcaccatatgtaaaatgggaatgatcacagcactcatttcacaggcaaagagtaaaggcaaatagtaaattaggtaataaatgtaaggtgctagagcagtgcctggttcctag

SEQ ID NO: 474560 - DNA, 680 bp, Homo sapiens
tgcaacttgcatctctccagtagataaaagctaggaatgctgctcacccttcacagtgcacaggacaacgccacatcaaagaataacccagtcccaaatgtcagtggtgctgatgttaagaaatcctgcattaagaccaaaaagccagatgagtttggagtcactaaggagaggtgcaggagaggcggccagtctaaagtgtatgaactttactgttttagaattaggacagtttcacgggactgggatgaggggaacttggctctgtcgataactctgatacctggattttctccaagaaatgaatttcttccccctcaggggttctttatgcgctggtgtttgacaaccacaccttgcagcttcatccctggttgctgccctcctgcagacaccgtgccttttcctgtctacatagccttcatccctgactacctggtgcactcttccttctttgtctacctgcctactcaacatggagacgatgaggatgaagacctttatgatgatccacttccacttagtaaatagtaaacattttttctttatgattttcttaataatattttcttttctctagtttactttattataaggatacagtatattaatacatataacatacaaaatatgtgttaatggactgtttatgttattgacaaggcttctggttaatagaa

SEQ ID NO: 474561 - DNA, 616 bp, Homo sapiens
catctgcaacagcccaatttccaaaaatggtcgcatctgaggccagagcctactctcggctaagggatggcccctcctggggcatgccgtccaggtcagtgtgctccaaggacagtggttctttcaactgctccttatgtgaagaatttctccaggattcatcattccatctggatctgtataaataaagctgaagttctggtcatgaccactccctggatcactcctgcccctgtgttcctggagcctcagagttttgcagacttgttgaatggttttgaccaaaatgctgatagtgatatggaaaataaagtccaggttgaggaggtctcagatggagatgaagagcaaagatatggtttggaatcagaacttatgcttaaaagggaagcagagcataaaaatttagaaaatttgcaggctgatgatgcaatagaaaagaaaaacccattttctgaggagaaattcaagcctgctgcagaaatttgcgtaaataatgaggagaaaaatgttaatcaccaagaaaatgcagaaaatgtctccagggtatcacagagagatttgcagcagcccctcccatcacaggcctagaggcctaggaggaaaaaatggtttc

SEQ ID NO: 474562 - DNA, 532 bp, Homo sapiens
tagtgttgtcttgtgatggaattctcacaagatgtggttgtttagaagtatagtgccttaccctttgcactcactctctctcctcccaccatggctctgctctaaaatggcattctttcatagcatccagtgtataggttacagtgatgttctagttgtggaaggtgtctcctctgaactcaaagaagcccaccaggagcactatattttatttactatccccataactctctatgggttctgggacattcccatcttattggtggttgctgggctttgctgggatgttcttctggtttcaactatactcacctatgagtcaagggtcagctttggtgaggtgggtggttttgctgatcctggcaaacttcatggtcactctgatagcacagctaagaaatccagggcaagaagtgatcctggagatcaattctattcgtcttcctactgtgcagatgtgaagactttcccagagataggcctgcccgaatttattagtttggtagtgctgccataacaaaattaccacaga

SEQ ID NO: 474563 - DNA, 488 bp, Homo sapiens
cctcttatagtgtggtgtgcaccatgtgtctgggttctggtgaatgtaagatacacagaagtgatgtaaaatacttccagaagcatctctcagagagtgacatccccctgcacacagctgccatgtctgtatggctgacttgggagaaatgccagaaaggttggcatgagatgatggtagaggcacattttccagatggagtagatgtaatatggcagagcatctatgaacttaagtctctgagtgactgtggttcagcatcctttgccttccaagaagggtacacttatatggatgtgactaagaagcagaaaaaaaatgaagattgtcaccaggtaaacgggagcgccatctggatgggactagagtttctctgtggacccaagtcagctcagtcaccccttcatcacggatccagacctgacgaatttctaatacaaatgtccacctggaagcatcactctgcctaacccagctgtgctttcatt

SEQ ID NO: 474564 - DNA, 545 bp, Homo sapiens
ccctcgggctcgggctctggctcgggctctggctctggctctcctagggaatatggagaatccaaatggcatgttcagtttgtgctgcatggtggaggtcttggtaccagagccaggaatttgggctctactccgcaggcagcagcaaaccacagaaggggttgcagatgtcaaacagataatgaatagcatcaattatagctatgacatctccaggacagagatggaggaaatgaggccacataccaaggagtataggcagtatctaaaagatgcaaaagggaaggaaagggattctcccacagagcctccagaagagaatgtaaccctgcagataccttgcttattagtccagacatgtctaaggaacggcaaggaagccaatagggctgaagtagatgtggccaaaggagaagaagccattgaattagaaggagagaacgtgactactggatagatgaaggatcaggatgattcagaaaagaaatgtatagcatttgcaaaggacttgaatgataaattactgagcattccccaaatgccag

SEQ ID NO: 474565 - DNA, 729 bp, Homo sapiens
cactagggaacgcactagtgcatggctttgttctctggcccctcaaggttcaggacctgctgtgctgcagggcccaaggtgttcccagtccatttgcaacaccactgtgatgggggatgctggtcaaagtacttcacatggacagcggtagtgggatttgctctcatatacatgtgtcatcagtgatggcagtgcagcaggatgtgtgcacattagagttggggactgtagaacgaaaactaggaaagcctggggcaagcagaagccagccaccctatttcaaaccatcttcaagactaacagcagttgatagatgtggacagagaaagatgctacaacagaacaagccaaaaactgatcttccagaaagagtcaacaaaacaaaagttgatcctcttacaactacacgagaagttgccgaagaactcaacaatgaccattctgcagtcgttcggcatttgaagcaaattggaaaggttttgaaaaagctctataaagccatttctccatccagttgtgatgtgcagcaaaaagtggactttatacaacaactggcgactaccaactcagtggttgggccgggaagaagccccaaagccctttctaaagctaaacttgcaccaaaaaaaagtgatagtcactgtttggtggtctgctgccagtccgatccactacagatttctgaatcctggtgaaaccattacatctgagaagtatgctcagcaaatc

SEQ ID NO: 474566 - DNA, 1015 bp, Homo sapiens
gactttgtcaaagatcagttggtttttgcaacagctctgagggtcattctagctccagggctcctcactgagtcagctgaggactttgttgcaactgcatccgcagctcaacttcttcctctgctcactcttacttccctcactccctcacagggcagcatgcgcgagcaagcgctgggagagcgagcgaacggggagcggaggcggcctgaccgagtgagtgccagcgagtgtggagttaggggaagccgcctacccccgacccgcttccccattccttctctccccgttcccgtttctccccccaaccaccacaccccgccccccgccccccgaactccaagcagcaccaagtctagagcttcttgacctgctttactgaccattctgatgcaggtgctggtgagttatgagaggtcatcacaggtagtacttggccaaacccataacagtgctgcttggttcccaatgtggatgatgaagaagaaggagaagaacaagatgatgatgatgatgaagaagaggaaggattataagatattgatgaagaaggggatgaggatgaaggcgaagaagaggaagatgatgatgacaattcattcttatctcttcctgtctgaacaaaaactgtatggaatcaacaccaccaagttctgtgggagaaaagaaaaaccttctccctttgctctgctggaagctggagagtgccagacccctgtggtggcaagacaagtgaagcctgactatgcctgcagcatccactgtggaaactactacatctttgccatgccaaacaagtgggggtgaataacactggggtagtagaaccagttcagtcaccccttcctaagccctagaggtggtgctgccccaatttatttgcagctttctagaatgtgaagtctttttgtcctagctctaaatatgaggcattaggaaaagtgcctttggaaatcctattgcaaatatctgttgagggaaccaaccaatgtgtttgctgcgttgtcggctcctt

SEQ ID NO: 474567 - DNA, 566 bp, Homo sapiens
agctgcgtcctggagggggcgccacagtccatcatatgctctgggaacaaaatggggttatgatcgtgtcaacggttcatggcgggcaccttggctggtctgtctttccaattatcggattcagcttcagcaagagtcctaagtctttttcaacaccctcatgatgtaggtgctgttgtcctctttctggaccttagagatgtacagtgcgccactctgaggatcaagtctgaccctgcctttaaatttggattcaaagtacttagattttctggaatcccattctacaatcttctggtcgaaagtataaaaccaggtaacgtggggaccaagggaaagcttccccttcaccttctgaaggtttgccaaaaatcactgacaagaggcagattaaggaggaaaggcatacagatcaatttaacgtgtaagcagagccttcctaatgaagagccaaagatacagggcaaattgtccatttttatgcttaggttcaacaaagtatggacagtcatggagaaatatgattggacaaaaagggtatgattgaatgccaatagactgactgc

SEQ ID NO: 474568 - DNA, 1131 bp, Homo sapiens
gacaagagatcccgagtacatctacagtcagccttacgggtgacaatggggcaaactaaaactaaaagtaaatatgcctcttatcttagcttcattaaaattcttttaaaaagagggggagttagagtatccaccaaaaatctaatcaagctatttcaaacaacagaacaattttgcccatggtttccagaacaaggaaatttagatctagaagattggaaaagaattggtaaggaactaaaacaagcaggtaggaagggtaatatcattccacttacagtatggaatgattggcccattattaaagcagctttagaaccatttcaaacagaagatagcgtttcagtttctgatgcccctggaagctgtataatagattgtaatgaaaagacaaggaaaaaatcccagaaggaaacggaaactttacattgcgaatatgtagcagagccgttaatggctcagtcaacgcaaaatgttgactataatcaattacaggaggtgatatatcctgaaacattaaaattagaaggaaaaggtccagaattagtggggccattagagtctaaaccacgagggccaagtcctctttcagcaggtcaggtgaccgtaacattacaacctcaagcgcaggttagagaaaataagacccaactgccagtagcttatcaatactggccaccggccgaacttcagtatcggccacccccagaaagtcagtatggatatctaggaatgcccccagcaccacagggcagggagccataccctcagccgcccactaggagacaatcctatggcaccacctagtagacagggtagtgaattacatgaaattattgagaagtcaagaaaggaaggagatactgaggcgtggcaattcccagtaacgttagaaccgatgccacctggagaaggagcccaagagggagagcctctcacagttgaggccagatacaagtctttttagataaaaatgctaaaagatatgaaagagggagtaaaacagtatggacccaactccccttatatgaggacattattagattccattgctcatggacatagactcattccttatgattgggagattctggcaaaatcatctctctcaccctctcaatttttacaatt

SEQ ID NO: 474569 - DNA, 878 bp, Homo sapiens
cgagctccagccattggagcctgggactctcataaaacagcactatctgggatgtttttctctgggaaaccagaagcaggttccttgagtccagaccacaccagcaaagagaacaaaaaagcaatcactgtcattatcaccatcattgttgtgatcatcatcaataacatcatcatcatcacggcactctctgccccaaagctttggacatttgaagaagtatttgaaacctggaactggccatgccggctcagtgagggtccactggccaatcctgaacattggccaagtttacctgtcagatgctgtgccccagacctaggcgtggaaaaccagccagcaaagcaggttccccgtagaagcccccaccatcaccttctttcccatttaaccaaagaccagagagtgggacatcggtacccagagcagagaaaggctttactcaagtcaccaagcctattagtggcagagccagaattagaagtgaagttcccctatctctcagcttgccacctctcccctactctgccaggtaaacagaagagggagaggcagggggagtttggggagattccagatggctccatgagcaaagtcttagaaaaactacctgctgcagaaaggaactaaatgatcaaaccacagagagtcattttgcctacttctaagggataaaatctaaagctaataaatagactgtattaggcagttgtatggagaaatgaagaaattcgcagttaggatttgggttacagctgccaagtattgattgcaagtaacagaaattacttccaactaacttgaacacaaaatgaatctgtttgaagaacacaggtaacatggtttggatctttgtctcctcaaaatctcctgttgac

SEQ ID NO: 474570 - DNA, 2183 bp, Homo sapiens
ggggagagtttgagtgcccgtggaaaatatggtcactctattcagggcagtggaagaacactgtccttggtttcctgaaaagggaacgttagatgtgaaactatgggattgtgttgctgcaaaattccgggaactggtcccaacagggaattatgttcccgtcactgtttggggtgattgggccttggtacgtgccatcctaatgacataccaatcctgtgaccccctgcagttaccacaagtttcggaatccggcaaccctctacctcttcctcagctttcctctcccactcggcctttgttatctgctcagcctctcccttcgcctactcctcccccacctgaagatggtgagaattcaatatctaactccggtgactttggcttaacctcaccccctgatgatcttatttctttccatgaagagccgatacttgtagctcccgaggcccggactcggacagcccaggatcataactatgctaatttttccctcttcaaagctttgcagcctttggctccagagccatctaatggccccaggaccaaactacaatttacctgtaattctgcaggccttcccccatccaccgcagcccctcatcctcctgtcatttcggtccctcaaccggtcactttgccatccactcaacctgcttctctgtacccttcttcatgcatggatgcccctgccattcttgttgcacaggattgcgccaataaccaccagtatgcttttacctcttctgctcccccaatgccccttctcacactctcataccagtccgacatcctcaacttcaatgcgtgggcttatccagttgcgctggaacctccaaatgctcaaggggtaggagtgcgtcgatatgcgccactcaatcttacctttttaaaagaattcaaggatgcttgtactcagtatggtcctacttctccatatgttaaaatggtattacagactctttgtactgaggtcattttgcttcctttagactgggatcttttggcaaaagctgttctaagtccatctcagcatttacaattccgtaccaggcagtcagaggagtcccctttgcagactcagctaaatcgggctgatggcattctaataactcaggctcagctcacaggccctgataattactctgatactactgcccaactaggctttgatgctctcaccacggaacaagtaacaaagtgtgtatgagagcttgagataaattacgtgccccaggccaagctcctgtttcttttactactgttaaacagggtcacaatgaattatatccttattttttggtcaaattacaagatgctgttcaaaaacctgtctctgatgagcgcgctcaaggtattctccttcgtacgttagcttttgagaatgcgaatcatgagcataaaatggccatgtgttctgtccaatgacaaaatttacctcaattacatttagcattgtttactttcaactttctaaatgttcctaaagacaatactctgactgcagctgaatgccattatacaggcaaaaaattctccctaaatgaaggcaagccagtgttatggaaaaactcctaaaccaatacctggaaacctggaacaattataacgtgggaaagagggtatgcttgcgtttcaccaggagatcatcaatcccctgtatgggtgcccactagaagacttacacttcgtgtgaatactgacaaagaaaaccacagggaaaagacgtccgtgtcagagactgccctgatatgtggtgagatctgtgctgactcctcagaaactggcacaccaaatcaaaatgggtctggttcaatcctccctaatggcaacggagaccccctaactaatcccacttctcctaattacctttctttttctccttacaaacctaaaaatctcaacctttctattagcctgaaaataacatctctctgttcttctcttcctcctttagcactgaatttcagttacaataggttttatttaataattctcctccttatactttctatctcaccagtttccctcacactgatttacctgctacacaaaattattcttattgggcttatgtgccttttcctccacttattcgacctctgacctggatggatgctcctgcggaaatctatactgaggatagtgtgtggatgcctggagctacagatgaccattgcccc

SEQ ID NO: 474571 - DNA, 981 bp, Homo sapiens
cacagtcggaattcacaggtccaggaatcaaggggtgaaattggaaatggcaccatttaacatcacctttagtgacccactagcaaaatttttgctgcctgttctgacaacattatgttctgctggcctagttccagagggaagaatgctgccaccagtagacacaatgattccattaaactggaaattacaattgccacctggacatgttgggcttctcctatctctaagtcaacaggctaagaagagagttacagtgttggctggggtgactgacctgaactatgaagatgaaatcagtctactactccacagtggaggtaaggaagagtatgcatggaatacaggagatccattaaggcatctcttagtattaccatgctctgtgattaaggtcaatggaaaactgcaacagcccaatccaagcaggactacaaatggcccagacccttcaggaatgaaggtttgggtccctccatcaggtagaaaaccacaaccagctgaggtgctttttgaaggcaaagggaatacagaatgggtagtagaagatggtagttatcaataccagctatgaccatgtgaccagttgcagaaacaatgactgtaattgtcatgagtatttcctttttcttttgttaagaacatatttgtgcatttatacacctgtaataagaaaatatcttcattttatttcctttatcatgtgacataagatttattgacttcatatcagcatttaaagtgttgataactttatgtaatagcatttaggttaaggattagtgtgcttccagttgtgcgaaggatagctgtattacgttaggcataattaggagcttattattgtctttatttgaggattatgtattatttcaggacattcatatgggttcaagttgaacagatgaacttgtgatggttaatattgagtgtcaacttgattggattgaaggatgcaaagtattgttcctgagtgtgtct

SEQ ID NO: 474572 - DNA, 524 bp, Homo sapiens
agactgaaattcctgaggtcaccaaagaatggctggctttgtatacatctggattaaaaatggcatcctgctaccaccctggcctgccacacccccaacctgtgcctatgcaaacccccagaccctaggaggcagacaaacaagtgactggaagtggagcagaacacattggcagaagacacaagtggctggacgtcaagaggacgttgaggagagcatgccggtggaagagcacatgacagacgccagcaggcctgcaggccatcaaccagcagaacaaggcagagtttggccgggacagttgaaggagagccccagccacggacaacggggaaactattccccttctggctccccatctgctgagagctacttccactcaataaaactttgcactcattctccaagcccacgtgtgatccgattctttcccgtacaccaaggcaagaaccccaggatacagaaagccctctgtccttgagacaaggcagaggtctaactgagctgactaacacaagccacct

SEQ ID NO: 474573 - DNA, 632 bp, Homo sapiens
gcctgtggtttgaaagagaaatttagattcctttagataaacctctttgcataaaaacgtgtaaagccctggtgaggatggcacgtgggcatggcacaagggactacaaggcatttggtagaatatggaagttcccccttctggggatcaaacccaaagtatatgatcctgagagtgttgggtacaaaggtgaatgccgcagagttgctggaacagattatgttggtatcagccgaaacctggactttgctccaggcgtgcgcatgcagacattccaagtgaccatccttgatgacctgggacagcctaccttggaaggcccagagaagtttgaattacttcttcagatgcctatgggtgcagtgcttggagaaccaaataaaactaccattttcatcgaggacaccatcacggactatcaaagaattaacctctctttactgattgatgctgcatatgaaacacttttcaactctctctctccatatataaagttcctttagcgaattcttcgatttttgttcacaagtctttatcagaactacttggtagggaaatttttcaactttttattcctttgcactcttttgtaaaaaaaaaaaaaaaaggataataaacagtaaaatgatgaa

SEQ ID NO: 474574 - DNA, 875 bp, Homo sapiens
ctcggaagcatcagtgtaacaatgggacaagtgtgggctctggttcgttccaccttggaaccttttcacactgatgatgaggagaaaggagagtataatgaagtaacagaagaagtaacagagcaagtttgtttgcctgctaaagctaaagtggcaaaggagggagaggtttatccctatccttctgcaccccctccttattttgaagaaaaagagtggcctgaccctccagatctttcttttctggaggatgctgggcaaaaagtgattgccccagtgactgttcaagcagcgcctcaagcgatcgctctcagttctattcaggcaggaattcagcaagctagaagagagggtgatttagaggcttggcagttccctattagaatacaccccccagatcaacagggaaatattatagctacatttgagccttttccttttaaattactcaaagaatctaaacaagctattaatcaatatggacaaggttctccttttgtaatggaactgttaaagaatgttgctgtttccagtcagatgattcctactgactgggatgctcttgctcaagcttgtctaactcttactcagttcttacaatttaaaaccttgtgggcagatgaagtttccattcaggctgcttgtaatgcctaggcccaacctcagattaatataactgcagaccaacttttaggggggtaaggtgttttgatgaaccactagttagactacccaagagaagaagagagaagatccaaataaacataatcagaaatgaaaaaaggacattacaactgatactacagaagtacaaaagatcgtcagagactattatgaacaattacagagtcacacactagaaaacttagagggaa

SEQ ID NO: 474575 - DNA, 993 bp, Homo sapiens
agagaagccagaaataaggatttttctctgctatatcccaatttttaagtgctagtaaatccttcacattttttttttaaacagtgggtttgtggtctcgctgacttcaggagtgatgcgggagaccctcgcggaggaagaggaggaagaggaagaggaggaagaggaagaggaggaagagaaagaggaggaagaggaagaggaggaagagaaagaggaggaagaggaggaagaagaagaggaagaagaagaagaggaagaagaagaagaggaagaagaagaattattattatttcagccggacatttcatgtgggggaacaaaggaaagatctgatcccccggttcacatttcccatgggtcaaagatttatcctctgtggtgttacacccttccttgggttttgcaacattttgtttggctatgtgttgacaggagtttagagatgcgcatggtggacatgccacgaggaactagcaggctgtgcctgtgtgagggtggtcagtttgtcacacagtcaaactctgcagcagcaccaggggcagaacaaagtgacccaaagcccccaaactcgtaaggctgagaggacctgaagaggcaccaaagaggtgactgatgccctctctgcctttctctcatttacctatccatttgtttttattcttgtgaaatcacattctccctacctccttcagttggtgacatacttgatatacgccgctgaaagtatgtgtcataatgaaattgtgtttgtgcctgtgtgtatgtctatgaatttttagtttacatagatgactacaagtctttatcaactttttactattttccatttctttttcactttttctgtttagggctattttgttgttgcttagtatacatccagtattaaaactggctaagcctaatattcttccattcattatgttgtttgctgatgtttttgattaattgctaggttatttatagttctctgtgacagatcatagattt

SEQ ID NO: 474576 - DNA, 773 bp, Homo sapiens
ctcatcaaagcagaaaatagaatgatattaaggaaaggacagactagctacacagagttaacggataaagaaaaattactggaaaggacaccagagttaacagcaaatgcctgggatgaggcagtgccaggttacacctgtgcaaagccagcccacatagaactcgtcactgcatccagagctgaatgtgaggccaagggaacttggagcaggacacaagaggtgtcagatccacaattcttaaaaaatatcaaaagcttagcacctgagtcacatatgggcagaaagaagcaatgggtgctagaatgggccagaagctttggctgggaaaagaaggaagggaaagaacacttgtcaaaaattaacttttacccagttaaaatccagtgtggtgatactggtgttgtgtggatgcagccaacagtcatcaaattcagtcattacagcaacctcaagtccatgagagctgtgaagtggatcctggatttggcaatgaggaaggcacttggtgtcctttcagagctgtgccattggagaggcaaggaccaacatcagctattaacctaagagacttcagcaagtctctaagaaactagaagatgaaaagaaaaatatcccagaaagggggtagagaagctgagaatacttacatgaaaataagctttactccagtgacactttggtacagtacaaaactaaatgaagaaatacaggtatagtctttgtcattcaatcccctgttatatatttagagacttgtgtgaatcttgctt

SEQ ID NO: 474577 - DNA, 642 bp, Homo sapiens
gataaaactcagggcattggatgccaaccactcctttctgctgggagaccccttctgctatagaggaagcttgtagtgaatgggcccaaacatcaatggctccactcgtgaaatccttttggattccaaaagagaaaacacagacaactcttctgttgcaattatgggtgctcagaggtcagctgctgtgaaggtggagtcaaaccttcatgtgactctggagtcaaatcttcatgtgatcccatcacagcttcaagctctccctgaagattcaggggctttcctaatgttatcaggacctgcagtatttgaagtttcagctgaagcttctgaatcccactttcaagctgtgagttttcagactgcaaagacacttgctcagtttggagaccttttatttgtcctgaagtctcctgtgtccctaagtgaagacctgtttggacttttattacgtgctttgaaactcagagtttattgctttgggggactggctttcaccacaggtgacttgagggcttgataggcttctgtaattattcccatcttttcactaactttgtgatattcttagatctgggcagaaagtcttttggccagcttatccctccttgaagtctgttggctgtttactataaaaacaac

SEQ ID NO: 474578 - DNA, 1802 bp, Homo sapiens
agctgcctccttggggcaggattttaaaggttgagaaagtccttttcactggtttgtgagttcatcactagcttcatgcaagacctattttacaacaggtcttctaaatctggttattcaaaaagcattgctcagtcagtggagaaagagagtgccaacctgctagtaccaaccgtttgttatgaaatacttgatttcgttcataactggactcaaccactaactgaatttttatgtgaaagagaacacaacagagcagcaaataaaagtcagaatacaattgtgagaattcagtccagagaggatcataagtttaatgagagtactggcagtagatgtggaaataggtggatagactcaggagagttaaagtttacagaattgtctgttttattgggcataggaatgaacaagaagaaagttgtagggctaaatgtcacgtttaaagcttttgccattggattgatgggagcgccattcagcaagatatgaaagctgaataggaccaagttatgcagggagattgcaaatcttccttcctgtagtatttggaaccagtactgcctgcacatcaagcttgcatggcaatgatattttcaggacattcctctgatgcatccatgctgttggtagtggtacgtaaagctggacttcttattggtcagccttggagtctccagcttggcaacacttgttcaaaaataagcaaccagcatctcatgacactttgctgtcctccagcatcaagatgatgctcctgaattctgacaatacctctacttcaggagcagaaatgcctgaattatatgatcaacgttcccaagtaaatgggattatcccaggacatgtaggttcacattaatgtaattagtaaaagaactgtaatctttttggcctctcaagctggtaaagcaggaaatcaaaactctgttcatactcttacaatgtgaatttcattattgcatgagaccatgctgtttattatgaatttatccaagaagagaaaacatacttgacacaatagaacatgctaaagaaatataccaactttctcacttatctggacaaattaaatccaacttgcaaacttgagttgtgaaatataataataataaaatctatatgaagtttaagaacaggtttatttgtgattagaaaatgacagaaaattcagaaaattaatttacctatcagtattccttttatatccaattaatttaaaattgtatattctgtgataggaagctagtttgtacttgtagaatatactatataatccataaatagccatgactttttcattcaaaaagattgggcattgagtttgctatagaattttcatattgattttaaataaatattctaaaataagatatgagggtcttatcccaaagaaaatgaattttaaacaaaagcatcaagtatgccttgtcttcaagagaaaaccactggattgcaaaagtggatatagttttaatattggcctttaattcttcctataactgtttggaaacacagtacgcctgccatcagtatccatgctatgtgataaatcaaacagcaaaatatgtgaatgtgatgtgtctgccttttaaatgactattctgttttccacatttctgtacacagaggaagtagataaaatgtcacctgtagctaatcatgaggatgcattttattgaatacttctatggtagaatctacggcattttctgctgagctgctatcaagctgtgttagggtactggatctaccaattacgtttatgttaggttacttacaagggtagcaatacaataaaa

SEQ ID NO: 474579 - DNA, 588 bp, Homo sapiens
aagtttcctgaggcttccacagccatgcaaaactgcgagtcaattaaacctctttcgtttataaattacccagttgtgaagtctgagttgctggggtacatcaggccaaagcagattcagggatcccaacatggtggtgactacacagctatgacggggttccactggctccattacatccggcacagaggactggtcagtggtagtttttcagtcacagctccaaaactatcttataaacttacactcttctgcatccttggtttcagatggtgccactttgcatcttatcctgatcccacatttctcactgattgtttcatgtgtcccaaattgctgacccattttttaccccacactcacagatttgggtcaactcactctaaacactattctgatcgtaaccacacatcaactccgtcagaattagggctaaaatcgattcggtaaaattcaaatgtaccactttggtagtttccagacatcttgatgttgaatgttttatatttatctaaccctttcaaaccacttactatgtgctaggcaccatattaagtactttacaaatattaattcataacagcccac

SEQ ID NO: 474580 - DNA, 598 bp, Homo sapiens
tgactaagtcctagagatctactgtacagcatagacaccgagtttgaggaaacgtacagaaggaagagaagtcactggaatctgaaaaacaggatggaaagaataaaagctgtgctaagcaaagctattcatgaaacatgtaacattttatgtagaattgctaggtgtttgcagttggagggtttcctgttagccaagcttggcatcttgctgaatatggaatccattgaggatatttcttatatctacattgggacagaacttctaccactgttaaagggagcacttttcacttggctgtctcaaaatgatgcagcctctatggaaaacaatatggagagtcctcaaaaattaaaaacagaactatcagacgacccagtaattccacttctaggtatatatctaaaagaattgaaattaggatctcaaagagatacagtacttcttctatgtccattgaagcattattcacaacagctgagatatagtgacaacctaaatgcccactgatggctgaatagataaagaaaatgtgatgtatacatacaatggaatattactgtatctcagataaagaaaatcctgccatttgtaataa

SEQ ID NO: 474581 - DNA, 633 bp, Homo sapiens
accaatcagcaggatgtgggtggggccagataagagaataaaagcaggctgccccagccagcagtgcttcagtcctgaagccagcgagaccacgagcccaccagaaggaacgaacgactgcagacgtgccgccttaagagctataacactcacctcgaagatccgcagcttcactcctgagccagcgagaccaagaacccaccagaaggaagaaactgccaacacatccgaacatcagaaggaacgagctccagacacgcagcctttaagaactgtaacactcactgcgaggcagtggaatgagggggaagcccagcaaggcccatctgtttggagtcttcctggacttctggggcctgacccttttggaacgggggttttaagattcataatcgacaaacaattattgatgtggatgaactaactgacaccattttaagtcatctgtagaattctttttctaaccacttaagagaaaacaaaaaaaaagctgtagttcaaaacttatgaaactttaaaagaactcatccgcatcagcactaaaatgtcaatggtcaatgtctattttctgcaaatacaaaatttaaatttagaattctttttggtgactaaactgtgcattagaatttattt

SEQ ID NO: 474582 - DNA, 673 bp, Homo sapiens
accccgcactcgctcactcacatgctgcctctcaccgcagtcacagtggctgtgggattcgcgccagagacttgccctcaggcgcggctagaagtctatgggggagttttaatcaagcagttttcatgggaatttacatgtataaaagtaagaatacctcattttaaacaattgtatagtgaactaaccactgacctaaaagaaagagagggcagaaagaaaagcagatttaagagtgatggacagggaaacacagcagagagcggtcttttcagtactgctttgaaaagacacaagaagctgaaaacaactggagctaatctgaagggattggggatgattatactatttaattatgcaaatggtgaatgcggaaactttttgagaaataggacaggggtcctcaaatttgagaatgcacaaggattaccaggagagcttgttggacagcaaacattcctgggccttaatcccggacagtctaagcagctctaagctggtgctgatgctgctagttcacattttattagcacttttacttaacaagtgttgctctaggaaacagcggttatagtaagcccactcttggtaagttgggtgagaacagatttcaatgaatgtgactctggaactacttggatccatcatggggtgaaaccatgtgaccctacaa

SEQ ID NO: 474583 - DNA, 551 bp, Homo sapiens
ccacaggattagttgagtcgtgagttccgagtccgggtggggtgggatttatttacatgggtcatggttttgtgtatgggtaggtcattgctggctgtcctggtacaggaatatcttgtagaaatacttctattgcctgctatgcctgtcactcagcaccgtgacacagaaatcctgcaccagacactggatgcccgtgtcctagggtggctggcaccgtgggaatatgtacaaatggccaaaaagcacaagaaaagatgtctggcatcattagccatcagggaaatgcaaactaaacccacaaccagataccacaaccagatacacactaggatagctataataaaaaaacttggcaagtgttggcaaggatgtggagaaattggaaactttatacactgctgctgggaatgtaaaaggatgcagctgctgaggaaaagtctggtcattcatcaaaagattaaacatagagttatcatatgacccagcaattctactttttctcctatactgaagagaaatgaaaacatttgtccatacaaaatcttgtg

SEQ ID NO: 474584 - DNA, 850 bp, Homo sapiens
gaggacaagtcgacgaagagatcctgagtacgtctacagtcagccttacgtaatgttggaactgatgccacctggagaaggggcccaagagggagagcctcccacagttgaggccagatacaagtctttttctataaaaatgctaaaagataggaaagacggagtcaaacagtatggacccaactccccttacatgaggacattattagattccattgctcatggacatagactcattccttatgattgggagattctggcaaaatcgtctttctcaccctctcaatttgtacaatttaagacttggtggattgataggacacaagaacaggtccgaagaaatagggctgccaatcctccagttaacatagatgcagatcaactattaggaacaggtcacaattggagcactgttaatcaacaagcagtaatgcaaaatgaggccattgagcaagttagagctatttgccttagagactgggaaaaattccaagacccaggaaccgcctacccctcatttaatacaataagacaaggctctaaagagccctaccctgatttgtggcaaggctccaagatgctgctcaaaagtcaattgccgatgaaaatgcccaaaaagtcatagtggaattgatggcatacgaaaacgccaatcctgagtgtcaatcagccattaagccattaaaaggaaagtttcccgccgaatcagatgtaatctcagactatgtaaaagtctgtcatggaattggaggagctatgcataaagctatgcttatggctcaagcaatagcgggagttgctttaggagggcaagttagaacatttggagggaaatgttataattgtggtc

SEQ ID NO: 474585 - DNA, 1354 bp, Homo sapiens
aaacaaagcagttcggaatgcttacggcgttcactcaggagcccagctggcttcacccagtggatcccgcacggcggctgcaggtggagctgcctgccagtcctgcgccgtgcgcctgcactctcagcccttgggtggtcaatgggagtgggtgccatggagcagggggcggcgcttgtcggggaggctccagctgcacaggagcccatggctggggggaggctcaggcgtggggggctgcaggtcccgagctctgccccacaggaaggcagctaaggccccgcgagaaattgagctcagtgccggtgggctggcactgctggaggacccagtacaccatccgcagccgctggcccgaatgctaagcccctcattgcccggggccggcagggccggccggctgctccgagtgcagggcctgccaagcccacgcccaccccgaactccagctggcccgcaagcgccgcgcgcagcaccggttcccgcttgcgcctctccctccacacctccctgcaagctgagggagcggggtccggccttggccaacccaagaaggggctcccacagtgcagcggtgggctgaagggctcctcaagtgccgccaaagtgggagcccaggcagaggaggcgcggagagtgagcgagggctgtgaggactgccagcacgctgtcacctctcatgatgaaggtcaatggaaaactacaacaacccaatcaaggcagaactacaaatggcccagacccttcagaaatgaaagtttgggtcactccaccagccaaagcaagactaagcaaaaagaacaaatctgaaggcatcgcattacctgacttcaaactataccacaaggttaaagttaccaaaacagtacatgggtactggtatgaaaataggcatgtaaaccaatggaacagaatagtgaacccagaaatagagccaaatatttacagccaactgatctttgacaaggcaaacaaaaacataaaagtggagaaggacacactattcaacaaatggccctgggataattggcaagccacatggagaagaatgaagctggatcctcatctctcaccttatacgaaaatcacctcaagatggatcaaagacttaaatctaagacctgaaaccataaaaattataaaagatagcatcaggaaaacttttcttgacattggcttagccaaagagttggtgcataagtaattgtggtttttgccattaaaagaaccaatgcaccaacctaatagtaacttaaagtatcaacttactttgatcttattgtggctatttgggagctgtttttctctatcacatgtgcacacatatatgtattagcagtaactacaggagctg

SEQ ID NO: 474586 - DNA, 1317 bp, Homo sapiens
ccacatcaggcttcataaacaagaagcgtctgagttattgagagtacgaaaggcacatgggaggcactgagaagtccaagatcaaagcaccagtagactcagtgtctggtgagtgcctgtgttcccaaacacagtgcctctttgccatgtcctcactcagtggaaagccatgtcccaaccagtgctccaacctgctggagcatctctcagtggaaacaatggcaaacagagcatctggaaagtgggatgtccgcagtgggaggaaatacggagggagccaccagtgggatgaagcagcaggaccagggtctggaatacaactgggcttcctgtgtcttctcaggggcaaagaaacactgtcttgtatcagtgcagagtcttggataagtggatttcttgcctatattcctcccgtaacagcagcagatggcttctgccagctgtcagtgaagaattcttacaaggctgcagtcaaggcgtcagcaggtctgtggtcttatctgaatacacagttggaaggatctgcttctgagcttgagcagttctgcaaaccaatgttccaactttctcctaatacagaacctatttattttagcaggtcacgtctgaaatgtactgcttataatggaagcctttaatatagcaatgtacttttgaggagtatggagaagaaaaccaggagaatatccctgctatttcaaatgctaatatatatattatatatattataaatatattaatatattttattaatatatataatatataatatataatataatatattttatataatatatagaatatatagaatatatatattctatataatatatattatataatatatagaatatatagaatatatatattctatataatatatagaatataatataatgtaattatattataattatattataatatataattatattataattatattataatatataatataattatattataatataattataatatataatatgttataatataattataatatatgttataatataattataatatataatatgttgtaatataattataatatataatatgttgtaatataattataatatataatatgttgtaatataattataatatataatatgttgtaatataattataatatataatatgttgtaatataattataatatataatatgttgtaatataattataatatataatatgttgtaatataattataatatataatatgttgtaatataattataatatataatatgttataatataattattatatatatatatggcagaaaacaag

SEQ ID NO: 474587 - DNA, 836 bp, Homo sapiens
tctacaataagtcttaagattgcgaagggatccagagactaaaacattgataccttgggataccaggcacagctccacctgttctgtgaagacaaggggcagctcatctgctggcactgtgagcgggcaccgcagcacaaagggcacaccacagctcttgttgaagacgtatgccagggctacaaggaaaagctccagaaagctcctcctacagtaccgggattacagtcaacatgactctggatccagatacagctcatagtgaactaattctgtatgaggattggagaaaagtgacttgtggatatccccaggaccatcacagcacttcttccaggagatttagtgccttcccctgtgtcctgggttgtgagggcttcacctctcaggaagatgctccttcaaaatggatgctggaaaacgaaccagaaggaggaaatttggacagaaagaggaggacaacatgtgaagatgagacacacccgggagagtgccacatgaagagggaggcagagattgagtggtgcatcctcaagccagagaacaccagcgaagactggcaaccagcaggaactagcgagagccatggaatgtattcttccccagagcctctggagagggcaccgccctgtcgacgtcgtgattttggactcctggcctcagaactctcgttcttctgagcaacccatgaccatggtatgtgaaactcacaagtaataaccaaataaacactaggcacttttgctattattagctcaatttacggtaatcagaaaggttagctattatatctagcattttatttactttttaattctcagtgttctaagaactgt

SEQ ID NO: 474588 - DNA, 1017 bp, Homo sapiens
ggtaaaataaaatgtttcttgaccaaagcaaaaccataatgactacagctgctgcagtttactgggagaccactccagacccaattcacctggacctgaagatatcaccaggggaggctgcagaacaacaaagatggctgcctgctccttctgctctgggagctccatcccagagggccatcgagctgatgctgaccatggcgctactgtatgtggggtctggcaacccgttaggaggtttcactcagtcaggcagcgtcagattgggcccacttaaagaaacagcctggctgccccttggtggagtgggagtgctgtgctggggggactcacacttgtccggacttcctggcctctttagagacagctggcaggaaagactaggtcctctgaacgtgagaccatggctgctcctctccccaggggctccttcccagggatataacagttctgttcataaacccttggctggatttgctgcaattcctgcagcaaggcaccacccaatgaggagggatggatccaggaactcagttgtcttaggcagtgtccagtctgttgctgccagcggcaactcaagggggatgcacagctccgtgcttgggttccaaggccctggtggcatgggctcacgaggggttcttctgatccacaggatgcacagatctgtggagaaaacatggtttcctggagcaacaccattaatgctccctggggctgaagaagaagaagaagaagaagaagaagaagaagaagaaggcaaagaagatgcagaagaagaaggcaaagaagatgacgaagaagaaaaagaagaagaagaagaaagaggaagaggagagtgggatagtttataaagtgcaagacttgatctgatctgtgtcttcaaaatataaaaattctgtggtaggcctcactttcactagatgtaaggaagagggtgtcttagttcattttgtgctgttgtaacagaataccacaagatattctgatgaagttagaaatttatctcacagttct

SEQ ID NO: 474589 - DNA, 625 bp, Homo sapiens
tagagctcaggccatggcttcagagggtgcaggccccaggcgttggcagcttccacgtgatgttgagcctgtgagtgaacagaagccaagaattgaagtttgggaacctccagctagatttcagaagatgtatggaaatgcctggatgatcaggcagaagtttgctgcaggagcgaggccctcatgtagaacctctgctagggtagtgcagaagggaaatgtggtatcagtctctaccaggcccccacctagtggagctataagagggccactatcctccaggccccagaatggtagatccactgacagcttgcactgtttgcttggaaaagctgcagacactcaacaccagcctgtgaaagcagctgggagggaggctgtaccctgcaaagccacaggggatgcaatgatggttcaacattcacaaataaatcaatgtgatacatcatatcaacagaatgaaggatgaaaaccatatgattatatcaaatgatgcagaaaaagcatttgatatgtttcagtatatcttaaagaaatatcaattgtattaatcattttattaatattggctcgattactatttatttaaaataattaaaactctaaaatatgtgaaatagtaaaa

SEQ ID NO: 474590 - DNA, 479 bp, Homo sapiens
agacaacgcttatgctgataagatggctagacaagcagctagctttccaacttcttccgatagcagaccggcctttattactcaaatcagccaagcattttttcaggctcttggtattcagtgaaacctttatatcccttacggtcctcagtcttcaggaaagaattcaggcctgtccttggaatgctacagggtacagcccatttgagctcctgtatggacgctcctttttattaagccccagtctcattccagacaccagaccaacttggactgtgccccaaaaatcttgtcatcctatcttctgtctagtcgtactcctattcaccattctcaactactcatacatgccctgctcttgtttacactgctggtttacactgtttctccaagccatcacagctgatatctcctggtgctatcctcaaactgccactcttaactcttgaagtaaataaataatctttgctggcaggact

SEQ ID NO: 474591 - DNA, 619 bp, Homo sapiens
gcatcccctgaacctggtacattcgcctttggtccctctccccacccccgactggggaagtcaatgatttaccaaacacagcacacagctggtccatggcaaaggcagcaggaacccagcactatctgcctaaagatggtgacctgcttatgggtggccgtggacctgctttggaggagaacactgggagaaggtcagagagatcttcccgctgctgccctgcgttctccttcccctcctttgtctccacggaagcagccaccacttccaccactgagctggcattggcgatacgacaatgaacaagatacaaatggcctttacccttatggagcacgcaggacccctgaattggtagccagctggttagaagttagggtggctccggaggcctccaaacttgcagctggtgtctgccgtgaaggaagtcttgtaaagaactgtgcccttaacctgcggtttggcctaaatccagacagggaattgaagacaataacgcctaatccatatggttactgtgagaattaaatgagctaatacagataaagcctttgaatagtaactatcataagtacaaaatgaatatcacctatttttatttgtattgatttatttttat

SEQ ID NO: 474592 - DNA, 471 bp, Homo sapiens
cctcgcctgtcaacttaggataccgaagaaaaataatgctgaactggctctctgggagggtagggcagaggagaggaaataaacccctcatttgcagtgtttgccgattaccatggtataaatgccccctctggtcaatttcaggctgccaacatgaagacactggatgcggaatcaggaggagatgtatacagctcagtctccaaagccaggacaagccagctccaacacactactggctgaatctcaccaatcctgcaaaacataagccaaaatacaactcacctttggaatcagagaacttacaggttcataaaattgcgaagcccagatgtgcacctgaggtgagacttcgtccagcttctgtctgtgtcactaatctttcctgctttcagcggcatccctcgcaggcccgtgttgttcccaactggtgttcccacctggcggcaaactggcgactgtagttacaga

SEQ ID NO: 474593 - DNA, 650 bp, Homo sapiens
actgatatattcctcttcatgaatgtacaatagtgatacatcattttttaaaatctttgtcttaataagtctacctatctcaaagcaggaaacacagaggagtgtctgtagaaatgaagagatgggaaaacacgatatccaaaaaactgcaggcaatacagtccactgtgcagtattggctgttaccccgatggtcatggggctgcctggaagctgcggctcgctgcccctgcccagcagcaggagggagtattggacagcacgtccccagccccggaaaagatcaaaagtcaaaagtggaagtatggtttctactgaatgtgtatcactttggcagcaccgtaaagtcaaaaaattaagtcaaaccacgttaattcctatcctaaatttccctcgaggatataacaaggagaaacagtattaagttacagctagactctggtgggatttagattaaaaatataaaagtacatctagatgctagatgagactagtgacgtcacgaaccagactgaaacttaatcacattaagaagcagaaaccaccacaagcatccatatagtgtgtttactgtcaggtttattctgacttgccttcacaacagttgactctcagtttagcttgttgattcacagaaaaaaaaacctgaa

SEQ ID NO: 474594 - DNA, 829 bp, Homo sapiens
gggagtcgccagacttcagacagcagcgatcgtggctgttgaggaactggactcaaccccgccatgctggcagcatgcaagcttggaaatgagcctagcagaagtgtggcctttgtggcgggatcaaagcaatgggctcagggcccgaactcagaagaggctgcagaagaaaggggagcctctgcagccctgtcctgcagcagcagcagcagcagcagcatcttggaagtgacccggacaacacagctgcagctgcggcatggagagcagagtgcggaaaagagagcagcgaagctgttctgggagaaacgtcatgactggcagtttgaaacatctcctgggttgtcactgtcccaagcacaaagctcaagcgtttgtggcaaggccctatactttatgagagctggagcaaatgatagcaacccaaaccttaaaggaggcttcactccccaatattttactcacctcggatgctccacatcaaagcaggcctgtgctatcgctgtgaagacctgcctgcgaagccaggatggtacaaaaactactaaaattgagtaatgattttatcaaataaagtgaacgtaggtctaattctttacattgctgtgtgcagaatattaagccaagatttttttaaataaggtattttctaacatactgttctttctaaattattgatcatatttttgtgaaagcaaaaagtatttgctattatttgataacaaatattttaaaaatataatttcaccttcatttcatacttttcaaatttttatttttgcatgttttagataataaataatacattagtagagtaatactgtaaaat

SEQ ID NO: 474595 - DNA, 609 bp, Homo sapiens
agagacagcaaataagcattgcagaacggcctgaagtttcagaatgggttgtaaccttagaacattgcctgctatccaaatctccttggaacaaatccacctagcaccaggaatcaatttaatcgtggctctagaattcacaacaaaatcgaataatacatgtttatggcagcatctgagagagcttcctgtctcagcgcaggctgtgccagaactagacctcccacagaaccctcgacctatgctaaggccaacaaactcttccctcctcggaaagaaaacattgatcagtgatcacaagtcccctgttgacctgggggttgtacttctcattggagtggaaggaaccacctttctgattttcatatctcaattctatgaggtgattatatccactgagtacagctctgatctctgtgctgtcagatcaggttctcgatcctgcattctggaaaacccaaacctggtctgggttgaatttgccaagggagtaaccaaatacgagatgagaagaatatatgaaaacaaacaataaaattgaatatagtaatttagcaacttctcatgaattaatgaatgacactgatatttagatggctactgacacaa

SEQ ID NO: 474596 - DNA, 599 bp, Homo sapiens
agggtcccagaccgtgccgaagcatcacgagacctctccttgtctatgcacaaacgagtgtccaactctggagcccagactgttgcttcccggtctggtggtgaatccttcatagcctggcagaataaggaacagaagtgggccaactgcaaacaaaaatcagctgcagacatgagggctctgaggcctaacacaaagtgctcatatgtgaggcacgccaggaccgaagccaacaggaaggagacagaagctggggagggagcctgggaaacacaccgtcgtagtacaatggtgccccagctgtggcagctcagtgcttcattgtacaacagtcaagcctatagaatccgaagagagccaggtaatcgcagagtggagaaccagctccagggtgcccgcgtccacacagcggcaagagtgccatatcccagctttacagttttccagtcagatgtgcaattagagtcattcctttgtgtgaagacaattgaaggttggatttttctgtgacttttaaatcaaatgaacacaaaatccttaattgtcaatcagacttacatgaaatacatgtcatgtccagaaccatggatttatccctg

SEQ ID NO: 474597 - DNA, 716 bp, Homo sapiens
agcagcccacactcaagattgagagtcgagggaagcgtgtggtttatatgcgcgcaggaagcgtgtggtttatatgcgcgcaggaagcgtgtggtgtatatgcgcgcaggaagcgtgtggtgtatatgcgtgcaggaagcgtgtggtttatatgcgtgcaggaagcggaagcaaaaatgaggataaaagaaaaaagaggcaaagaagaagggaagcaaatatataagagtacatcgctgaccagccggaattcttctagaaaacgcagctggctgccaggtcagcagggatatcatctgagaggtgacatgaaatcattgcgtcctggaacaatgcaccaaccaagcagaacagacactggccataaagctgaacaaagtgtgcaggctcactcaggggcatacaagaacacgtcagtggctcgtatggagaaagtgggaggggcggaacccagggagaggccacggcggggtggggacactggcagggaccccataatcatgactggattcctgcgtttcttaaacgtggtgctactgacattttggggagcgttatcgctctttgctgttgggggctgctgtcctgatgtaggatgtttaggaatctctctggcttctacccactagttgccattttcacttccccctcagttatgacaaccaaaaaatgtcaccagatattttcaaatgtctcctgggaagtaaaatcaccct

SEQ ID NO: 474598 - DNA, 473 bp, Homo sapiens
atattgtacaaaatgtattgcttttcagatcatgttaatgcttactttttcacgtttccactcttacttaattgccaaaatagagaaaacctattcaaaaacacttatctgaaaaaaaaggaatccttgattgacactgggtctgtaaaagcacagcagtgggctccttcccatcacatcacctcaccaaaggtggattctgaaaactctcccaaggcccagtcccaggattcaccgggcagccctcacgacctgcgcactcactgcagaagctgcctgagagagcaaagccggagccgcatggttccccctgaggaacgagcgcagcatccgtccaacgtgccaacctcagacacgagctgggcagcgttttcagatgctgacagcagttcggtctcattagagacacagatattgtcatcaaagttcaaacaggatcagagacaaacagtttgaaacataacactgaaaac

SEQ ID NO: 474599 - DNA, 1065 bp, Homo sapiens
attgtaaaggcaccagttctgaggccatgggaaacagtgagcttataggtagaggttatcacagggcacagtcttccaaacatttcactcacagggcacagtcttccaaacatttcactcacagggcacagtcttccaaacatttcactcacaggggacagtcttccaaacgtttcactcacagggcacagtcttgcaaacatttcactcacagggcacagtcttccaaacgtttcactcacagggcacagtcttccaaacgtttcactcacaggggacagtattccaaacgtttcactcacagggcacagtcttccaaacgtttcactcacagggcacagtcttgcaaacgtttcactcacagggcacagtcttgcaaacgtttcactcacagggcacagtcttccaaacgtttcactcacagggcacagtcttccaaacgtttcactcacagggcacagtcttgcaaacgtttcactcacagggcacagtcttgcaaacgtttcactcacagggcacagtcttgcaaacgtttcactcacaggggacagtattccaaacgtttcactcacaggggacagtattccaaacgtttcactcacaggggacagtattccaaacgtttcactcacaggggacagtattccaaacgtttcactcacagggcacagtcttccaaacgtttcactcacagggcacagtcttccaaacgtttcactcacaggggacatggacaggttctaggtcctgttgtgtcagcatccgagttgcaggtggtggttctggctctatcagttgcagggaaactaagctgccgatataaagagaatccagggtggacagtgtggcctgatccatctgggctccatgaagatcatcaagggagaaggttccccactgcaccttccatcacaaacctgagaatggcctcttcactgatatttcataacttcaaatacatataaaatgaatatatttaatatatactctacaatctatgaataagataaattttctcctgattcttccccaaatatttagccattttttaaaatgctaaaatga

SEQ ID NO: 474600 - DNA, 561 bp, Homo sapiens
tgagaagaaagacctgaaggaaaagattatgatgtaggcacctgggaaagactattacagttacaatgagtattattaaaagacaaaaaataaaagatgctggtgaggatgcagagaaaagcgcactctcatacgctattgccaagggaagctctgagggactgtgccatgaggaatggtacattctggcccagatactaggcttttcccatggtctttgcaacctgcagaacaggagattccctcgagtggctacaccaccagggccctgggagagctccgactggcatctggtgggtgcccctctgggacaaagcttccagaggaaggtacaagcaggaatctttgctgttctgcagtctccgctggtgatacccaggcaaacagggtgtggagtggaccttgagcaaactccagctgacctgcagctgaggggcctgactgttagaagaaaaactaacaaacagaaaggaataacatcaacatcaacaaaaaggatgtccacagccaaaccccatctgaaggtcaccaacatcaaagaccaaaggtaggtaaatccac

SEQ ID NO: 474601 - DNA, 890 bp, Homo sapiens
ggctcgccctccatgggctgcacccactgtccaaccaatcccaggcatctggtgaccaagttgaagccaatgttcattgaccattctgaaaattctagggcccttaacaattacactaactttactctgcctgtgatctatggagatgaggaatttactggaagctggagcaaaggtcattcttgctatgctttagcaaacagactgacagcattgttcccctgctgtagggatctgtggagctttgaacttgagagacatgacttagggtgtctggtagaagaaatttctaagcagcaaagtgttcaagatggcagtgcagaggggaaatgtgaagttgaagcctgcacagtccccactggtgcactgcctagtggagctgtgaaaagacagccaccatcctccagacctcagaatggtagatccacagactgcttgctccgtgtacctggaaaagtcacagtcactcaataccagcctgtgaaagcagcttcaggggcataccttccagagcccatggctgcccaaaagctgcccatggcagtgggaggctaccccttgcaccagtgtggcctggatgtgagacatggattcaaaggagattattttagagctttaagatataatgactgccttgttgggttttggaactgcatggggcctgtagaccctttattttggccaatatctcttttttggaatgggagcatttacccaatgcctgtacccctgttgtatctgggaagtaacaaacttgttttggatttcacagactcacaggtggaagcagcttgccttgtctcagggacttttaacttggactttggagttaatgctggaatgagttaagactttgggtgacaattagaaaggcattagtgttttgaaat

SEQ ID NO: 474602 - DNA, 880 bp, Homo sapiens
cacatgaggtaaatatttcagccatgtgcagtgcaagaagacagctgtcaggagtcacatttctacagactggaagcccatccatatatttttattatttctttctagaaaattttcaggctgatgatgcagcagaaaagaaaaacccattttttgaagagaaattcaagccagctgcagaaatttgcataagtggcaaggagcctaatgttaatccaccagaccatagggcaaaagtctccaggccatgccagagaccttcacagcagcccctcccatcacaggcccaaaggtccgggaggaaaaagtggtttcatgggccaggcctggggtcctcatgctgtgtgcaccctagggacttgatgccctgtgtcccagctgctccagtcatggctgaaaggggccaacatagagcttgggtgttgcttcagaggatggaagccctaagccttgacagcttctatgtggtgtttggcctgtggggcagtgtggaagggaaatgtgggatgggacccccacacacacacagagtccctactggggcactgcctactggggctgtgggaagagggccaccatcctccagaccccaggatggtagatccactggcaggttgcattatgcacctggaaaagccacagacactcaaggccagcctgtgaaagcagccaggaaggaggctgtatcctgcaagccacaggggcagagctgcccaagaccatgggaaccgacctttggtatcagcgtgacctggatgccttcaaagtttccgctttatggttgattttccagaacttttgattttcaaaataacattctgaagattttgtcctgaaatagtattcaaaaactagtcttcccatatttaatgaaccctgg

SEQ ID NO: 474603 - DNA, 2306 bp, Homo sapiens
cagccagtcgcaagatgatgttctgtgtttcattttcaggaattctagctctgcagctagaggagataaaggacctgaaaggattggatgatgcccaatcacattccaagaagcccagtgccgaggggagctgccgccaaaccaacgaggtggggcagacactgtcagccaagaggcagctggagcatttgctttgctgccttgacaagcagaggagttacccagggaccctgggaaaaatgggtgtggcagtggcagcagggctccacctgtctgccattttactgagtggtggattcatagccataccctgtcagctggaactgaattctggacagcttttcccagacagcaggggtcctgctggagggggttttattcatatcttggttattgtggataatactgcactgaccatgtgggtgcagatatctacatctatattcctttggatatatgcccagaagtgggatcgctggatcatatgatagttctatttctattttttgaggaacctctatatgatttttcataatggctgtactaatttatattccccaaaatagtgtttaagtgtttcctttacctctatatgatttttcataacgtctgtactaatttatattccccaaaatagtgtttacatgtttccttttctctacaccctcatcaacacctgttatctttcatctttttgataatagtcatcctaataggtgtgaggtgacaccttattgcagttttgatttgcattttccgaatcattagtgatattgagcacattttcatatgcctgatgttcatttgtatgtcttcttttgagaaatgtctatttggatcctttgcccatgttttgtcttcctttgttttgatattgagttgtgtgagttccttatatattttaaatattaacctgttatcaaatatattatttacaaatattttctctcattctataggttactgttttattttgttgattgttttctttgctgatcattgagttcttattgcctggcaccttaaagtcagtaccgatttttctatttcttagttttgtaaccttggctaaattatttaactaatctgtgtctaggtttctgcaactgtaaaatgtaaaatgagaatcataattttatctattcccagggcaacacgtacaaaatccttagaatgttgcttggcacaagtcagcagtctgtatttgttagtgatttttattactatgtttcaggcttcatcctaagtacattacatatttaatctcatgtactttaatctactcattttacagatgagggaatcaaagctgaagctagttaagtgatttgggcaaagtcacaccatcattagaatagaggtagaatctaaattcagatcatagactgcctgatttcaaatgtgagcattttgggttttgtgactatactgttgaaaaacaataagccctcaccattttcttttgaactcagtaatgttctgatcaatagaacaaaatgttttttactgtattctaagattaaataataaattcactatatacaatgttctgaattactctaaaagaagcaaggaattaatactggggtgtaacaccccagtaaatattaaattccttcacgcgatatctatagtttaaggctttacttgataagcatttctttcttttagaggttttagaaaactgaatttttaaaagaatgctatttcctgaaatgatttcacctgatttcctagggaaacacactaactcacatatatcctgtcaatttgaaaatcagcttgccacttgatcacaataacctcgatatctaatttctcaaataattgaccaagttaaacctctgacatgccgttgattgtcacttaaccaacgaggtgtagcagatcaaagttatatcattagacatggcatattaattaaattttgttctgtagtttaattgaaaaaattctgtagtttaactgagaaaaaaatgtttccttagctgctagtgttttgaagaggaaaaatgataaagaacagatattgaggaggcctttccatttaaaaccttttgttactgtaaagtatatatcattttggttcaatttgaaaactaaaatctgtaaaccaaaatttctctgagattagctaaatgtaacccaatcaaagacacattactggaattatttctagagtcaattgtttaagactctaatctgggcatatgaagagatattcaactttgtattctttgtcatgtgtcatcttctgttactcctgttaatttaagttaggcacgcaactttatgatgaatatgat

SEQ ID NO: 474604 - DNA, 943 bp, Homo sapiens
ttacacctgatgcatgtactttctgccccccggctccttcggctatactcactctttgttgagtctcccacaattaccattgttcctggcccggacttcaatccagcctcccacattattcctgataccacacctgacccccatgactgtatctctctgatccacctgacattcactccatttccccatatttccttctttcctgttcctaaccctgatcacacttggtttattgacggcagttccaccaggccaaatcgccactcaccagcaaaggaaggctatgctatagtatcttccacatctatcattgaggctaccactctgcccccctccactacctctcagcaagccgaactcattgccttaatttgggccctcactcttgcaaagggactacatgtcaatatttatattgactctaaatatgccttccatatcctgcatcaccatgctgttatatgggctgaaagaggtttcctcgctatgcgagggtcctccatcattaatgcctctttaataaaaactcttctcaaggccgctttacttccaaaagaagctggagtcattcactgcaagggccatcaaaaggtgtcagatcccatcactcagggcaatgcttatgctgataagatccaaattccagtgaccccacaaggtcattccccttttctgactccacctgcctatagtggcctcctcttctttgctgaactcctactgcacttgtcagtaacattccactgagttctcaatgctagtgtgtcattgtttctctgtgctttctatgtgtacatattatgttctgtatgagatttcttagcctctgtaaatccttagaatacctagcagagctgagcgcagggtggaaggttgacacccatgaactattttttatctcgtaatatcacacatggcagccataatgcattgcaccccttgc

SEQ ID NO: 474605 - DNA, 1023 bp, Homo sapiens
cctaagccatttatgagtcgtgaatgccactttgggcaagttacctaatgattcccgggttgccgctgctgactcagccggcgtgctttattcccttatttggccctacccacatcctgctgattggtccattttacagagagctcattggtccattttacagagcgctgattgtccccacccatcccaaaagcccagccggcttcacctctcaccggcattcaccacaggactttgcggcacctagcctgaacactccgacagcccagagggagcttgtcccagacaatcaagaggaaaagacggtaagccataaagagatggagacctgctatcctggcgaagagggaatggtggtccacacacgggattcagcctcggatcaagcccagcaggtaccagctggccacgccaagtgtggggcttgccgagctggtgctcacctggaacccgcgccagcccaggagcaccgaatggcctctttctcggatcttcggtggtacatgtcttacggccagggtaggtgtcttctggttggctctcttcctgcttctgctgtcttgctgacacacgctgctgatgcaggtggccttgcaccttgggactgggcctgagcagggaggagtcactcatccccttaggctttcaggccctggggagaatcttacaagttacctgaaactaattatcaagcctctatgctagtgagtggggaaggatcttaaactcatcattttaactatctccatatcctgtttaatctgtttttcagctatttataacttacaacaattgggttaaatatacttttgtgagcacatgtgaatcatttagctttctctaaacctaatttctccagaatttggaaactatttgtgagtattcttaatttatggcaatataattatttacataagttcaataagaatcttttttttctttttaataaaaggacacagttagaggcactggttattttaccaaggctttgactggaatggcatattttcagacatgaacaga

SEQ ID NO: 474606 - DNA, 1803 bp, Homo sapiens
gatattggagcagaaccaggagtgggggcagagaaaagcaaaaggcgtatgaagttactgaagaagctccttctcaaacatagtaggggcaagagcaggtttagagccagcgagggcagtatcttcaggtcttcagaacaatctccagatgtaccacctctgttgcttcaggtcctgtggggttacagctttggatctggtcctctgtgctctggtagcactgcttattgccttagtccctccagccttgtggttccagcagcttcctgtgatagagtccgcaagcaggctgatccactctcatccaacctcaatgctaaacaagcaaccagagctctgggactatcgaatttccagacaagtgaaaaacattcacattcagaaagaaggtatagctatacttgccagtcattttcatactccagaattggtgaagtaaaagttcatgtgaaggggactatttaatcataaaattcacaaagtgattcatccaagagtgtaaaaaaattacactaatttatacataagcatatatttgaaactattagcctgtgtgtgtgtgtgtgtgtgcatgtgtaaaagagatgccagaactgtgctaaacacttactttttcgctacaaattctctcagggctattttgccataaccagaataaatgtgaaattcttaactaaactgctacaaatgtatgagtcttctttgagtgttgcaatgggccaaactgtatattaacaagaggtttaatttatttctctgttatggcacgtaagaaatgttcttgtacaatttttatcgcagattataattcaataaatctataaatgttaagaaagcatgttgattcattattaattcatgccaaaacaaacagatgctttcatttcaagaatatctgtaatgtttaaaaaatcaaattgccagacaggaagcaattataaaatggtcagaatagaaaataatgttaacaatctttgacgatttcttttttagacactaaactattcacatttttttatctatgtcttgattatatttaccattcaacatttacttagatgaaaagtttgctatgcttagaaatacaaaaaggaaaagaaaaagacatctatgaacacaagaaagtaaataaaattttattacaaatcatttatttaagaagataggacttcacttattctcactgctgaaaattaaatttattgatatcaattataaaagccctttctgtatgttaaaccaaaacatcaatgtattaacacagtcaagtaaagtttattaacaagcattatgtagttagaaagatagtttctcttaaatttatttttctaagctaaacaaacaaaaatttaaattttgtttgtaaacgtttgcttcagaaatttaatgaatttttccgtttctttggcaaaatatggaaaaattaattgtgactagtacacctcaaagttgatgaaaaataattgttccggaagataaatttcataatcttttaaataaaaatatatatagtatttctaaagttcatatgaaaaatatttgtccaaaggacttctttgtttaacgttactacaaggaacagagccagctgatccctgaatccatcgcaaataaaaaaaggaagttccaattgacccaggaggggttgtatagagaaagaaatcgctttcttttgacgtattctttgatgcaagtgcagactaacctgttatttatatctccaaaagaggagctgggtcattcaggcctgccaggccatttgtaaaaatgaagaaagctcacaattaaagggctaaaattatt

SEQ ID NO: 474607 - DNA, 2244 bp, Homo sapiens
ggctcctgctggaggcagcatggcaaagagccaagggcagggctctggagtcagactggaagacctctgctccttaccgactctgcaaacccccatgtggctgcttactccatatatgaccatgggctcattcttgagtctatctggatctcccgcagctcaacaatgtcattaccgagcaggctttttctagatttccactctgccatcctcagtgggctgcagctgtttggagtgatccactcggtgttcaccaacctgcttctgtgggccaatggcgtcctcaatgagtcaaagcaccaactcaatgagcacaaggaacggctcatcactctgggttttgggaacataacaacagatgaccacacaccgcagtgtaactgcacgcccccaactctgtgcactgccatctcccacgggatctactacctctaccccttcaacatagagtatcagatcctggcctccacaatgctctacgtcctgtggaagaacatcgggcgcaaagttgacagccatcagcaccagaagatgcagttcaagtctgatggggtcatggtgggcgcagtcctgggcctgaccgtgctggccgccaccattgctgtggtggtggtatacctgattcatattgggcgctccaagaccaagagcgagtcggcactcatcatgttctacctgtatgccatcaccctgctgatgcttatgggggctgcggggctggctggaatccggatttacaggatagacgagaagtcactggatgagtccaaaaatccggcccgcaaactggactcggacctcttggtgggcactgcctcgggctcctggcttatctcctggggctcaatcttggccatcctctgtgctgagggccacccccgctacacctggtacaacctgccctactccatcctggcgatcgtggagaagtacatccagaacctcttcatctttgaatccattcaccgagagcctgaaaaactctctgaggacatccaaacccttcgggtggtcacagtctgcaatggcaacaccatgccccttgcttcttcctgccccaagagtggaggtgtggccagagatgtggctccccagggcaaggacatgccaccagcagccaatggaaatgtgtgcatgagagaaagccatgacaaggaggaggagaagcaggaggagagcagctggggagggagcccaagcccagtccgccttccccgtttcttacagggcaacgccaagagaaaagtcctgaggaatattgcagccttcttgttcctctgcaatatttcgaggctgcctgccacagccagggagtggaggaagctgaagaaggctacagccggaagcgggagtgaggagcctgacaactcaagaggtggcacagggggagagaactgggacacaaaagagtctgagaagcagggaacactttggatacctcccgcctttggctgtcgacctgagtatgacaatggattggaggagattgtctttggctttgaaccctggataattgtggtcaacctggccatgcctttttctattttctatcgaatgcacgcagctgcctccctctttgaggtctattgcaaaaggtgtccaaactctacagacccacagaatgtaacggatgtctctcgattcctcctcctcaaactctcagaggatccagaactgcagccggtccttgctgggctgttcctgtccatgtgcctggtcacggtgctggggaacctgctcatcatcctggccgtcagccctgactcccacctccacacttccatgtacttcttcctctccaacctgtccttgcctgacatcggtttcccctcccccacggtccccaagatggttgtggacatccaatctcacagcaacgcccagctgcacaacatgattgccttacaaatgacctgcttcaaggatgtggaaattcctaatttcttctgtgatccttctcaactcccccatcttgcatgttgtgacaccttcaccaataacatcatcatgtatttccctgctgccgtatttggcattggagggtacctcagttcagatgtgtcatcttccctgagaaaggctgcagtggcctcactgatgtacaagatggtcacccccatgctgaacccctccatctacagcctgagaaacagggatattaaaagtgtcctgcggcagccgcacggcagcacggtctaatctcaagaccttcttatctgttccattccttttgtagtgtgggtt

SEQ ID NO: 474608 - DNA, 718 bp, Homo sapiens
taatatcttcctaggaggatccagaactgcagccggtcctcgctttgctgtccctgtccctgtccatgtatctggtcacggtgctgaggaacctgctcagcatcctggctgtccgctctgactcccccctccacaaccccatgtacttcttcctctccaacctgtgctgggctgacatcggtttcacctcggccacggttgccaagatgattgtggaatgcagtcgcatagcagagtcatctctcatgcgggctgcctgacgcagatgtctttcttggtcctttttgcatgtatagaaggcatgctcctgactgtgatggcctatgactgctttgtagccatctgtcgtcctctgcactacccagtcatcgtgaatcctcacctctgtgtcttcttcgttttggtgtcctttttccttagcctgttggattcccagctgcacagttcgattgtgttacaattcaccatcatcaagaatgtggaaatctctcattttgtctgtgacccctctcatcttctcaaacttgcctgttctgacagcgtcatcaatagcatattcatatatttcgatagtactatgtttggttttcttcccatttcagggatcctttggtcttactataaaatcgtcccctccattctaaggatttcatcatcagatgggaagtataaagccttcgccacctgtggctctcacctagcagttgtttgctgattt

SEQ ID NO: 474609 - DNA, 973 bp, Homo sapiens
ccgcctcctgcaggcgaggctcacatccagcactgtcccttacagtcgccatgcccctggcgacctcagccatgaagggagacagacccaacatctggacaacagggtaccaaacagcccacaggatggctgtgatgcacccacaaatcccctcagagatgggcaaactgagactggctggaggtgggccagagcaggtgcgccgggctgtgtggatgcaggtggtcccgctccgcaccacatgcgtggcctcaaaagaagaaagctctgtgcttagtcatgtcctgtccccaaccccagggagcatcctggagctgaacatgggcccacccgctgccttctgcaaacagggccctgttccccagcagcccagacctggtgcctggactctggtactgagcagactgggttggggctgcaggcctgctcctctctatgcaaaggcccatgtctgtatctatgccgtggatgtacaacaggccacttgctcctaccacatgctccgtgaggcagagaccaaaacatctgctccaagtgtcacgaaaactatgccagtgcccacagctatactcactgctgagttcagtcttgttcagggtgctgcccacgccccaaagggcagctgccacacagaggatccagctgtgttgcaggacccgaggcacaggggcccagaaaaagaggatgaaggaggggaagaggggctggctcttattccccgcatcgcgggaagtgtgtacaacccctgcgatattggcagtaatatcatcctctccgcctgaacctaagaaacaatatctcaggaacatgtacaccccctgcgatattggaagtaacatcattttctccccctccggatattcggaacaatatcacagtgggtgtgtacagcccctgcgacattgccgctagtttcttcctctccctcccaggatagaaggaagaatgtcacaagggggtgtacaccccctgc

SEQ ID NO: 474610 - DNA, 1376 bp, Homo sapiens
gaggcattgcctcacccaggaaattcaaggggtcagggaattccctttcctagccaaggaaaggggtgacagacagcacctggaaaattgggtcactcccaccctaatactgcacttttccgacagtcttagcaaacagcacaccaggagattacatcccatgcctggctcggagggtcctacgcccacagagcctcactcattgctagcacagcagtctgagatcaaactgcaaggcagcagcgaggctggggaaggggtgcccgccattgctgagccttgagtaggtaaacaaagcggctgggaatcttgaactgggtggagcccaccgcagctcaaggaggcctgcctgcctcagtagactccacctctgggagcagggcatagccaaacaaaaggcagcacaaacctctgcagacttaaatgtccctgtctgacagctttgaagagagtagtggttctcccagcaacgcagctggagatctgagaacggacagactgcctcctcaagtgggtccctgaaccctgaatagcctaactgggaggcaccccccagtaggggcagactgacacctcacatggccggatactcctctgagacaaaacttcaagaggcacaatcaggcagcaacatttgctgttcaccaatatctgctgttctgcagcctccgcagctgatacccaggaaaacagggtctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggggaaaaaacagagcagaaaaactgaaaattctaaaaatcagagtgcctctcctcctccaaaggaacatagctcctcacgagcaatggaacaaagctggacggcaaatgactttgacgagttgagagaagaaggcttcagacgatcaaactactccaagctaaaggtggaagttcgaacccatggcaaagaagacctgatggagctgaaaaccatgccacaagaactacgtgacgaatgcacaagcctcagtagccaattcgatcaactggaagaaagggtatcagtgatggaagatcaaatgaatgaaatgaagagagaagagaagtttagagaaaaaagaataaaaagaaacgaacaaagcctccaagaaatatgggactatgtgaaaagaccaaatctacgtctgattggtgaacctgaaaatgacggggagaatggaaccaagtggaaaacactctgcaggaaattatccaggagaacttccccaatctagcaaggcaggccaacattcaaattcaggaaata

SEQ ID NO: 474611 - DNA, 472 bp, Homo sapiens
aagaagagccagaaagaatttgaataagtgaagtcaggcttttttgtaatgtattctcagaaagaagggaagaatttggttcgggactcccctgaagactggattctttcttgtcagaaggaagaaactctgaacacatctgaacatctgaaggaacaaactctggacacaccatctttaagaactgtaatactcaccacaagggtccgcagcttcattcttgaagttagcgagaccaagaacccaccggaaggaaccaattctggacacagttatagatcctcagctgcaggtctgttggagtttgctggaggtccactccagaccctgtttgcctgggtatcagcagcggaggctgcagaacagcgaatattgttgaacagcaaatgttgctgtctgatcgttcctctggaggtttcatctcagaagggtacctggccatgtgaggtgtcagtctgcccctactaggggg

SEQ ID NO: 474612 - DNA, 714 bp, Homo sapiens
caccactaaagaatttactcattatgatactggctgtgggtggatcggcaggtcaagaaataaaagaaacacagaaaatagtgaaagctgggtccaggggggtcactgccttttggtcctgtgatgctgccaatgcactggatatgccagcatttgttattaagtttagtgagggcaggggtccctcagctgcaggtctgttggagtttgctggaggtctactccagaccccgtttgccaggttatcaccagcggagactgcagaacagcaaatgttgcagaataacaaatattgctgccttatcctttttctggaagcttcgtcccagaggggcaccagcctgtatgagctgtctgttagcccgttctgggaagtgtctcctagttcgtctacgtggggaaaatgccctgagggagagtgcacctgcacaccagtagctcacctctcagaggtctaccctcatcagaatcgtaggcttctggtctatggtacttctacaactcaatgaggtctttaaaaataggatcttgttacattttgcctgaatttctttttaattattcatgtagaaatgtggtcttttgtaaactactcatttcctctagagccaaagccatccaataagtaattaatttcttggtaatttcattcaaagttggtaacttttacctcctaagtactaaaaactgcaaaatgttttggaaatttttaac

SEQ ID NO: 474613 - DNA, 1138 bp, Homo sapiens
ctggctccggcctgggccatcccagaaaggggctcccacagtgcagcggcaggctgaagggctcctcaagcatggccagagtgggcgcccaggccgaggaggtgccaagagtgagcgagggctgcgagggctgccagcacgctgaattgagctggatcctggggctgccggagcaggattggtagtggagtgggcctggagcctgaggccattagtgcctgcttggaacctcagagaatccactgacacctgccctcactacgtaacatcaacccaatttccacttgttaattgtgataagtcaccccagcagtgcctctctcagtcgttgctctgcaggagagagaggcaggactgcggccggcactaccgcgctgtgatttgcgcagagctgaagaagcccctgacggttgaagaggtggccccccgccccgtcaggcctcacgagtgatggcagcagctggagccacaggccttgtagtgatagatgtggcaacaaatgctcttcaggccaaggtaatagctgctgctggaagtggcgagaagtgcaacctggtgatgcagaggggcacacagttcagcgtgaactatagtcagagcagcctgaaggatgcagtgaggaagctggtgggcaagggtgggatgaatgtggccatcaacatggtgggaggagacgtcttcctggaggctctccacagcctggcatgggagggcaggattgcagtggtgggatttgctggagggagcattgtttcggtgccagccaaccttctgctcctgaagaaggtctctgtgatgggcctgtactatggtcaatacaaagaaatgaactttcccgtcttctccaggagcctgtcttcagtgcttcagtactgccaacaagggcgcatccaaccatatgttggaatggttttcaagctggaggaggccgctcttctgcagggctgccgcgtgttttggggggtccactccggaccctaatcgcctgggtccctcccacacctgacggtatcaccagtggagattacaacacagtaaagatggcagcctgctccttcctcagggagctttgttccagaaggctgccacaacttattattattattattattattattattattatactttaagtttt

SEQ ID NO: 474614 - DNA, 806 bp, Homo sapiens
tgcagcttcagcagacttaaatgatcctgccttctggttctgaagagagcagcgcatctcccagcatggcactcaatatctgcttccagaggaagaagcaggcagcaatctttgctgttctgcagcctccgctggtgatacccaggcaaacagggtctggagtggacctccagcaaactccagcagacctgcagaagaggggcctgacagttagaacactaacaaatgaatccaataatattaacatcaacaaaaaggacacccacacaaaaaccccattcaaaggccattggcatcaaagatcaaaggtaaataaatccatgaagctgaggaaaaaccagtacaaaagtgctgaaaattccaaaaaccagaatgcctcttctccaaatgattgcaactcctctccagcaagggcacaaaactggatggagaatgagttggatgaattgacagaagtaggcttcagaaggagggtaataacaaactcctctgagctaaaggagcatgttctaacccaatgcaaggaagctaagaactttgataaaaagttacaggaactgctaactagaataaccagtttagggaagaacataaacgacctgatggagctgaaaaacacagcatgagaacttcgtgaaccatacacaagtatcaatagctgaaatgatcaagtggaagaaaggatatcaagtgactgaagatccacttaatgaaataaagtgtgaagacaacattagaggaaaaagaatgaaaaggaatgaacaaagcctctaagatatatgggactctgtgaaaaaacaaaacat

SEQ ID NO: 474615 - DNA, 1403 bp, Homo sapiens
ggtctttgatgattgtgacgtacagatgggattttggtgtggatgtcctttctctttgttagttttccttctaacagtcaggaccctcagctgcaggtctgttggagtttgctggaggtccactccagaccctgtttgcctgcagccagtggaggctgcagaacatcaaatattgcagaatggcagatgttgctgcctgatccttcctctggaagcttcatctcagaggggcaccagctgtatgaggtgtcagtcggcccctactggaggtgtctcccagttaggctactcaggggtcagggacccacttgaggaagcagtctgtccattctcagatctcaaactccacactgggagaaccactactctcttcaaagctgtcagacagggacgtttaagtctgcagaagtttctgctgccttttgttcagctatgccctgccctcagaggtggagtctacagaggcaggcaggcctggttgagctgcagtgggctccacccagtttgagcttcccggccactgtgttaacctactcaagcctcagcaatggtggattcccctcccgtagccttgctgctgccttgcagtttgatctcagactgctgtgctagcatctgagaagaatttctgtctttcattgaagttccaaaggcttcttattttgatgactttgcctaaagaagggattctacagccaaatgctttctttttaacataccgaatgagtaaaagtgcaaaataagtacagaactatcaaacagcaacaaatgtgcttctgctgcctaccacagaattttccttggtaagaagaaaaccctacattacatttctttttggcttctgtctctgcagcctcagagttgatgatgaatgcagtcctgctccactttgattccatctggctctggaaggtgtttctgaagatttgtgaacagcatttgaatttgtttgtttttatttatattgtctttttactatgatgtataaatatgtcctgtaatgtcattgatctatatgatgagtgagacaatcaagtgttaaaatggaacttgttgattaggatatttataccatagtttagttttcttaagaaactctgacagacacgatatttaaaatgactaaatttacactttgacataaggctactaaaaggtagaatataccattgagatatgccacttgaaaaaactacttttaaaaaaatggcattactggtgtcatgaagaaaagaaatgcttttatctcaaccctggtttcaaaaatttgtgtaaaaattttcacctcaataaataaatttatctcagtgtttcctcacaatcagattcaggttaaacatttttggcaagagctctacaaaagtgtatttcccatagcctcataatgacaggttcatattttc

SEQ ID NO: 474616 - DNA, 709 bp, Homo sapiens
agctcctccccaccactccccaagggcactagcagtgggatctatccttgtttgcacaagccagcagcagcagcagcagcagcagcagcagcatggcggggtgcacactcattggctgcagaaggttgctaatggataccaaggtgtctgtctctgtgtgggcatttgcaacagcagtggtggcagcatggctgagaggtgctggtgtgggggacttttgcaccagtggcaatgacagtgcagggatgaggcactggtggggtcatggctggcagactctgtgtctgccaacacttgacagcagtggcagtgtggtgggggaaaggggcagcgtgcactcatgccagcagcagtggcatgacagggtgcacacgcacatgcctgctggactgctttgccgatcctcaactctaagcactttaccattctttttctctgatttggtccccaaattccagagactttgtatgattatgtggactgaatccacatcaaggtcatatcacccaacctctgcagtgcatattgatacttcttggcagtgctttgctttattactagtggactcctctcatcacagttggctgctccgacctttctgttcttcagcccggtcttaatcccctttgagtggatgacctcaccaagaggcagacatcattgaacaggcatgtccatagctccttgttctaacagagcctctctccat

SEQ ID NO: 474617 - DNA, 847 bp, Homo sapiens
ctgctgtgctagcagtgagcgaggctccatgggcgtgggacctgccaagccagatcccttgcacttcccgggtgaggcgatgccccgccctgcttccgctcacacttcatgggctgcacccactgtccaacaagccccaactttcccatgtatcaacttccactcacttggaattcttggtggcaagttcggctatgatgacctggtgatgggcaggaatgagtcctttcttcttataagcatcaccaacaggaaagatcatgtgtttgacaactctatatcttcctggtgggaccctgatccaacaggactttggccttttaagaagagagagatgcacacacaccagggatgcatgtgtatagagaaaaggccaggtgaaaacacaggaaaaaaagcagccatccgtgagtcaaggagggaggctttacgagaaccccgccctgctagcaccttgatcttggacttccagcctccagaactgtgagaaaataaacatctgttgtttaagctgctcagtctgtggtattttgttatgacagccctagaggactaatgaagcaaattatagggtctagttggtttccatctccatctaactttcctcgtaaataattaattcaagtgtttacaaatagaaactgaaataacatgctaagcatgtggaccctgcggcccccctcccattttccatgaaagtgttccataaaaaggaaagataggtctcaaaaggttaacaccggatttctatggatggtgtaatacttatattttcttttttatacttgtctaaattttccacaatttttataaatggcatatactttcatgggaaaaacactttctt

SEQ ID NO: 474618 - DNA, 627 bp, Homo sapiens
gaagagctgcagctcctcctgtgcggttcacgatctgcttttctggagagatgtaaagaagactgggtttgtctttgccaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccaatcaaagcctacctggacgtagacattactctgtcctcggaagctttccataattacatgaatgctgccgtggtgcacatcaacagggccctgaaactcattattcttctctttctagtagaagatctggttgactccttgaagcaggctgtcttcattgtcccgattgtctatgagaagtacaagacccagattgatcactatgttggcatcgcccgacatcagaccaagtcaattgttgaaaagatccaagcaaaactccctggaatcgccaaaaaaaaggcagaataagtacatggaaccagaaatgcaacagttactaaaacaccatttaatagttataacgtcgttgcttgtactgtgaacgaacatactcagtgtcagcttgagcctgcatt

SEQ ID NO: 474619 - DNA, 536 bp, Homo sapiens
tgttgctctttctctctcctggtctttattcagttaacttattaccccccagccggcaatttcttaagataagacaacaatgaaggttgccacattgattgattcttccttcatgaaagatttctctgtagcatgtgatgctgatctgccatcctacaaagcacaagggcaacagcctgatgtagcattcacacatccactggacttcgtttctacctttgcacaatggagcagtcatttcctaagagccccagaaaaagaaaattctagcaggaataatccaacctttggctccatttgtggcagggccagcttccagcgggtttggctggctgtcctggctgggcctttcatctccaaggtctctaagcagactggcttgggtcctcacccatgtagattcagtgctgggaaaacagacttaaatcctttgtgtaagttcactcagagattccacaaaatggactcaggatctgtaaagactcttttaaaaaaatgaatcttgttctgtaagatttttagcagctcctgttgcc

SEQ ID NO: 474620 - DNA, 1184 bp, Homo sapiens
agctctcagctgattacaagcaagaagcatgaagagattttcttcctacactcacgatgagaacctggtggagctcctaaaggggactgaaaacatgcagtttacagctctggctacaaccctgaaggtcttctctctgccatcccctgaacacattacctctgtcctcagattggctctcctgatggttgcacgatggctgcagcagttccagatgtcccatcgagacacaaaaagatcccagatggaagatgccatctcctcctatgtgcctctttttaagaaatatccagactgggtaattacaaacgatagacatttatttacctcactgttctggaggctgagaagtccaagggcactggtatctgatgagggtcatcccatggcagaagaacatgagagcaaaaaatacaaagagaagaaatgtggccaaactcatccctttatcaggagcccactcctgaaataactaacccacttctgtgataacagcattaattcatttatagggcagagccctcatgacctcttaaaggtcgtgcttctaaacactgctacaatggcaattaaatttcagcatgagttttggaggggactttcggttcacagcactaatcattagggaaatgcaaattaaaactacagtagatattgcctcatatccatcaggatggttactatcaaaagccaacaagcaagacactctacattcagcaaatatcaagtgttggtgaggatatggagaaactggaacccttgtgcactgttggtagaaatataaaatggtgcagctgctacgaaaaatagtatggcagtttctcataaaattgaaaatagaattatcatataatcctgcaattccaattctgagtgtatatccaaaataattgaaagcaacatctcaaagagatatttatacactcatgtttatagccgcactgttcacaatagccaagaggtggaagatgtctgtcggtaattatttttcccaatcacattcatgatcacttttttcatttcttctaagactctaatatccattttttaaataggaactttaggtcatttgaaaagccaaatagtaagtattgaaaaaccagacactacagtaaggcctgaaagctcccaccatattaagctaaagcagaaacatcgagagcaaaagttaggggttgtgatgg

SEQ ID NO: 474621 - DNA, 822 bp, Homo sapiens
tttaatggacttacagttcgacatggttggggaggcctcacaatcatggcagaaggcagaaaggaacaagtcacatcttacgtggatcgtggcagatcacattgcaatcaaactagaactgaggattaagaaactcactcaaaaccgctcaaatacatggaaactgaacaacctgctcctgaatgactactgggtacataacgaaatgaaggcagaaataaagatgttctttgaaaccaatgagaacaaagacacaacgtaccagaatctctgggacacatttaaggcagaagaaatggatatattcctgaacacatacaccctcccaagactaaaccaggaagaagttgaatctctgaatagaccaataacaggctctgaaattgaggcaataattaatagcctaacaacgaaaaaaagtccaggaccagatggattcacagccgaattctaccagagagaagaggttttggaaacatttgccataactaacaatgtgcaggcacggtttccacttacacaagtctgaagagacttcagtattctcttatgatttcatgaaatattgagtcggttattccaagaaagaagacaacagccaacaggtaaagtgagctgcttcagtgaatggaacgtgaaccaagaaataaatctttttaatttcaacattaaattactttcaatactaaaaatggaagacatttcttaaggatttattaagtgtagaattcacaaaaatagtgttaccttagcaactcatgacacagaaattaagctgtcaacatcttgatcattcaaaagcggtcattgatctttgtgtca

SEQ ID NO: 474622 - DNA, 895 bp, Homo sapiens
tgcctgggtttatatcccgatccttgtctctcccgctgtgctctcaggcaatagatgattggctatttctgtacctcctgtttttgcctaattagcattttagtgagctctctgattggtcgggtggaagaccacagcaagaaggcccttgaaagctgccagccccttgatattggacttcttagccttcagaaccataagccaacaaatatattttgttataaattacctagtgacaggtatccagtttttaacaacaaaaaatgcattaaaagacaagtatatgcagctgattctactggcagtggaggttctgtatgctatatttcaagtatatgccttaaattggtttcccagaaacagaaactaagaaagagatttggattcagatgtcttattgggaatactctgaggaaatcacttttatataatgagagaagcaggagtgtgcagaggaaggaattaagttacaatgcagttgcaacagagattccagccacccacacagggacttctgaagctgggatgatctttccagaatgactcaactgacacagttgtgacagccttttaaaaaacagtattcaataaatgacatgagctattcgacactttattataaaatgggctttgtgttaggtgatttgggccagttgtaggctaatgaaagtgttcttagcacatctaaggtgggctaggctaaggtatgatgtttagtaggctaagtgttcggtattaaatacattttcaattgtgatattttcagcatatatttatcagtatataacctcatcgtaaggtaaggagcgtctgtatgtgagaacatgaatacattatcccgttcttttttggcctgtaaggtttctgctgagaaatctaatattaatctttcagc

SEQ ID NO: 474623 - DNA, 688 bp, Homo sapiens [sequence omitted]

SEQ ID NO: 474624 - DNA, 2392 bp, Homo sapiens
tgagggtttggtgtacagattattttatcacccagaagaggacgggaacatgtgggaaagtttggaacgtcctagagactttttgaatggctttgaccaaaatgctgatagtgatatggacaagaaatctaggttgaggcggtctaggatggagatgaggaacttgctgggtactggagcagatgtttgcttcaaggtcagggccctcatgggagcttctgctagggcagtgtggaagggaaatgtggggttgaagcccccacacagagtccccactgaagaactgcctactagaactctgaaaagagggccaccatcctccagaccccagaatgatagatccaccgatagcttggacagtgcacctggaaaagccacagacactcaacaccagcagctgagaggggggctataccctgcaaagccacagggcagagctgcacaagaccatgggaacccacctcttgcatcagtatgacctggatgacatcacttatgaggtataaattattcatgttatgcttctcatctggagtgttttctctccagtccatagcagtgttcaaggcctaaaagcagaggtgacaaaaacagtctgcctgcaaatgaaacatggctcaaagacatgttttttatggtccacacagtagccaataacttaaaaactgaaaatttttatataaaaatccagattttcatctttacctgaacacctagaacatgtggttgcactgtcccccgtggcaatagttggctggagctaagcagctctggaaccttcttggtggggcagtgtatgtactccttggtctagcccagttttcatttcttcttatttcttagcctgggtccctataggcacttcaacttttgatctctgacatgcaagaatgaaattatatagcaaagagtagaaaatctttgaacactcattcacaagggaaagtttcaacattattatagcagtacctaatctaaataaagtcaaccacaaatttatttatgtttaataaactttattactacaacttattcaacatttattgaatcctgttttgtaccaagaattagatgaggaaatgtggacaaagagcagagtaaagtatatttctgccttcccataattaatcatgtagtcaatataacagaaatcattttaaacaaggtattttaatacaatgcaataacagagatatatacaaaaggcactaaaagaaaatatctgagcatcagctgtattatattcaaagagccaacttatccatagatgttattaatgaatagatgacagatttgatggcttacatcaatttagtttttacaagaggaatataaacacctgtgtcataattgaggactgcaaactactcaaagtcataattgtaattttgcatgacttgtaaaatgtctgcttcagtaatcatgaagcactaagaaatcagtatcacactttagaatataactaaactttttattcctaacctattatttacctgcctatcttaaagaaatatcttggatgtttgagttaagtatctgcttgataaatgttatataaatcagttgctacaggcatcagtgttttggatatttttcaaatatagtgcgactgtttatttcaaatttaattcaaataagatgtattttgaactgtctcaggttaaatttctggaactttatggtaacttgaaggaatttaaaagtaggaattattacaattcaaactcatattaatctaaagacaattctgagctttagttttgggttttttatcaaggcaagatcaatctccccctgaatttgacccattaatctgtcttccccccttaaccacaccctttcaaattttgcatatttgaaaagagctatcataccttcctcacaaatatacttattcaataatttcctgtttagattactcatatggctctattatttttctgcgaactttcttctcaaatgttgccctgtttttaaacattccttgtaaaacatagcacttagaaacaaatgaagtattctagattgtggatgatcagatccaagtttggcacaattatttttcttgatgtagacaatattatttttgagcaagctttatatccaataacatttctggtagcatatcatacttcagatgcacattgaacttaaattattcatttgtttcttctgagtgccatatttggcttcatccactaaaccatatgataattatttggtacatatgataaacctatagttctaatgacaacatttctgtaaaagctatggatttcagattccttgaaataaattttcagtccacctttcaagcactgtcttcattgagtataacactcactcagtacaggatacttttcatggtatagagtccctaaggaccaaggag

SEQ ID NO: 474625 - DNA, 870 bp, Homo sapiens
tcctcctgcttcaaagccagcaaagacccttcacagtagttcctcgattcacagaagagtgaaattcagagcatgaagtcatggttgtgaggaaatataactattatgtttcaggacaagaacctgaaggtaaagatttgtatgacagtcccagtgctctttcccttcagccacagctgcctcagaggaagaataactccagagcaccagaccttctgagtcctcctgttcctatcaaattaactaccctccatttacctcagacaatttgggagtttgttgagacgttttggccaaagtcagagactaatccacagcaaaacaccctcagagccaaagaaaccacaactctgagtaacaggctgtggtatctgtcatgtcatctaaaagatactgaaatttcttggatcattgtagtcagtggtcatagaacacagaagcaggcaaagcctcagatggccaaagctggaggagatatctattcacttctatgcatgtgcttcccttgataatgagaaatggtttatcatgtcattttaagtcaacattaaaatactttggtcactggaaatatatgcatccaatataactattttacttttttaaaccagtgtgccacagtggttacaataattctttcaagtcttttaattaaaaactttttaccctaacccttgaaaaaggacttgtatttatttttgccagaaatccatgaaaaagtaatctcatagatttactagaaatgatacagatcttattatttgtcaactggccgtaactacaccgtacataacaacttacagctaacgatattgcagtcagaaatgtaaaggaagaattgtcacagttatattcctgtagaatctagtt

SEQ ID NO: 474626 - DNA, 5217 bp, Homo sapiens
gcagaggcggagcggggaggctcaggcatggcgggctgcaggtccggagccctgccccgcgagaaggcagctgaggcctggcgagaaatcgaccgcagcgccggtgggccagcactgctggcggacccagtacaccctccgcagctgccggcccgggtgctaagcccctcatttcctggggctggcagggccggcctgctgctccgacccacgcccacccggaactccagctggcccgcaagcgccgcgcgcagccgcggttcccgctcgcgcctctcgctccacacctccctgcaagctgagggagccggctccggctctggccttggccagcccataaaggggctcccacagtgcagcggtgggctgaagggctcctcaagtgccgccaaagtgggagcccaggcagaggaggcgccaagagcaagtgagggctgtgaggactgccagcacgctgtcactatgatgtgtcatggctaggacttcccaaagctgccatggaagaataatggcttctgtcttttccatcatcctggtctacatttggccattcattggtggaatctgatgaaaattctcctggtaggtgagttgggaaaattgagttttcaggctctgtacctccatggggaaaagggaggagctttaaaaagcaggaatggcattgttttcaatgaaataactaaaaaacactggacctctctttttaccatgatttcacatctgcttgtttaaaggaaactttatgattttttatgttgattaatgttcttataaatcaagtaattacatcttggtgtggttctttatgtaattttacatattcatggagtatatacatctttgacaaatgtagcttaggcttaatgttttgacatttcactcattctaacaatttgatgcaaatactctattgaaattcttcctgctaaggtcaacaaggactagttgtcaatgcccatggctcatttaaaattcttgttacattttctttttctgtgttattattagtagtaacagttcacattcttgaaatcattgttcacttgacctttgttcagtagggttgaactttattatgagccctgtccttactcagcctccatttctattactattcctttttttgcctccattttactcctttttctttaccaacatcatgttttttcctaagtcttgttttcttctcccttacagctctataaattatctctgtctagcattactctgaatagctctatttaaatagctcacaaaaatgataattcataatctttatatatataagaataactttaatattcaatgacttctctttctgtattctctcttttggttacttcattatttattcagtgaactaaaagatcaaattcaataccacagttaaaggcacacatggaaactatgctttctttgactttttaccctggtctagaacacagcacaatgtcaaaaatgatggttaaacaaataagatatttatctaaagaaaacaaaaaacatatatcatgtaaataaatttgagaaaatgaagtggcagcaaaattgttcaaaacctcatctgttagaaactcatttcccataccagaccaactcattccaacagaagcatgtggtgtacatgataaggaatctctaagtgatcaagacagaaataaaaagcgatgcaagttagtgaatataagttttcatatgtcgatgagtgacaagtatttatttaagaagatgtactagtctcggaagtgtttacattaatgaaataaactggaaggttatcaaaagctaactgcaaaatcacaaagaagaccaatcaccttgttcgctaaggcggctgtctgagaacgtctccagattaggaagcacacaggcaccttgcttttcgaatttgcaggagccacatataagtatatttaacataggcattaggattatagacaatagcaaatctattctagtgatgtaaagtatatgttccttaatatatcattcagaactcaccctttctaccacatctaatgtggattgcgtgccttatcccacctttttattttttacattcctggagcacctggtcacaacttgaacatcagtggtatcactgactgcatggaaattacctggctacttgtatgccttcaaacagaagactgaaccatttggagggatgtgtgactatacttttttttaaatctttatatcacttcacatggctcttattagttgttcaatagttgctgaatattgacactcgtatgagtgagaagtcctgacaatgactgcaataaactcaagtcacccttgaaatagacagaaatgcttgagagatgccactcagtgaatcaatttgataagcaagatgtaggatttgtagaacagtaaaggaaatggaatccagatttggggtgttgatggggagattctgaacaattggtaagtatgtatattaaatgaaagattttcaaatttctaaatgagctttttaaaagtacaatttacatacaaagaaaattcacttttaatgtagttctgtgagtacagatatatgtatatagtagtgtaaccatcaccataatgaaaatttaaagtggttctaacccccaaattcctgcatgtctgttgtagacaactcctccctcacactctcaatctttgttagccactgctatgttttctatctctatactcttaccttttccatgatgtcatagaaatataatcttactagactctcagattgtctactttcacttaacataataaatttgagattcttgcacgtatgagtttttttttttcctttttgagtattattgcctcatttaaagacattgtagtttgtttattagctcaccatttaaacatttcggttgattctagtttggagtaattattttaaaaatcaactggaaccattcaaatacaggtaggttttgtgagaatgtaagtttttatttcacttgtgtaaatactagactaaaattgtgatgccacttagtgtttaactttctataaaattgccaaactgttttctaaagtggggtgccgttttttttctttgtaggatctatgagaattccagttgctccacttgtagacactaagtattgtcaatttttaaagctattctaccaagtgcataattatatcttattgtggttttatttgcacttatctgataactaataatattacatattaccatgtacacattttccattcacatatatatctatgaatggaaaatatatttatatttcataatatatatttcattatatatatattccataaattgtcttcaaaagttttgcctattattacacttggttattttatggaggtaaagtgggattttcttgaggtaaagttaatataacataaaattgataattttaatgtgcacaaaagcatttagaacatatacaatgttatgtaactgtcacctctatatagtaccaaaacattttcatcaccccaaagaaaattctgcattgattaagcagttaccctgaattccaatctctgccccagctgctggcaaacatcaatctgtctgtctctaaagatgtacctattctggatatttcaaataagtcatatctcagatcacatacaatatgtgatcttactggctggcttccttcactaagcaagatgtttttgaggttcacccatattgcattatctattaatacttcatttattttttatggctgaataaaattccattaagattatatattgcaatttgtttttccattcatctgctgatggacagctgtgtcatttctatcttttggctattgtgaatatcgcactgtaaactgtgaacatacgtatacaagtatttgagtacctgtttttaatttttgggtatgtatctagaagtggaattactgggttaattgttaattctaattaattttttatgtagccaccaaattgttttctatactggctaaacaattttatgtatttctatatattttcaccattgccgatttcattttaaaaagaattatatccatcttagtagatgtgaagtagtacctcattgtggattaaatttatgttttcccagtgagaccaatgggattgagaattatctcctatgttttttgtctatttctctattttctttgaagagatgtctattcaagttctttgcccatttttcagttgggctatttgtatttttgttgttcagttgcaagagttatttatatattctggataacacatattcagataggtgatttgcaaatgttttttctcattgtgtttgtgatttactttttttttacaatgtattttgatgcacacattttttattttgaagtcaaatttatctgtttttaaaaatttcattgccaatgcttttgatattacatttatgttattgacccattttgaaatcagaaaatataagtcttccaaatttattatttttttaaagattgtttttgctactcaggaccacttgcaattcattatgaatttaagaataggcttttccattttttcaaaataaaaggctattgatattttgatagagattgctttcagtctgcagattccttaggaagtattgatatgtaaatagtaatgtcttcctatccggaacactggatttatttccatttattaaggtcttccttaagcaatgctttcttgtatttattgcacagattttacctttttggaccaacttatttttaagtataagattctattggaacctactgtaaataaaattgtttctttttttttttttttttcttttgatggagtcttgccccgtcgcccaggctggagtgcagtagtgtgatcttagctcactgcaacctcccgatcccaggttcaagtgattctcctgcctcagactcccaggtagctaggattacaggtgtgtgccaccatgccaggctaatttttgtatttctagtagagacagagtttcaccatgttaggcaggctggtcttgaactcctgaccttaggtgatccatccacctgggccccccaaagtgctgggattacaggcgtgagccaccgcacccggcctgcttattcattttcttttgggggtatttgctggtaatttaaaggaaaacaactcattttttgtgcattgatcttgtatcctggactgttaattcgtttactattattaaataacaaattattaataataaattaattatcaattgtg

SEQ ID NO: 474627 - DNA, 1248 bp, Homo sapiens
ctcagccccatggcaacagcccccagggcagcagccttagggagggctcctgcttgtccctggctcctgctagctctgtggaggggcaagtggaagaaatttttctctctgctgatgttttcttccacatggaaggagttcatctcgcctagcactccctcctctttctgccctcttcactcttccttgatcagattggtgactttggaaagagaagaagaacctagaaaagaggctgagataatctacaggctcatgtcccccaaaagggagatgaaaaccagttcacaagaaagaacaaagaactgcctgaataactgggctttctgtggccagagaggaaacaaccatcttgttctcacaggatggcagagtggaagtatgcgtggatattgggttttggttaacactgtggagctacaagttaaacggagagatagaaagcaggaagttggaaagggaattctgatagtgatccgttccttgattccaatttttccagagtcctaacttgagacttcttatccccttggactttgactcagcaagatgctttggtgcgttgttaatatctttgcttccttcttcagctaagtttacttggcctatttaaggacagtcacaaaagagagttaatggataccaaagtttggaagagacagcactatctcactgtaacttggaactgaaccagatggggtctcgttgtgctgcccaggttgctcttaaactactgatctcaagcaatcctcccacctctggctctcaagtagctgggattacaggcaaataatgatggaaatctggggattcttgatgggccgttgagattctaatgggatctggtataaacacattttagcagagacttacttcctctctgaagttttcctgacgttgaaatataccacaacaaactcagtactgtcaaaagtactggttcttaaatacagagcacatatatcactccagtggaagagttcatcagatagtgagaatctcacctataaatctcaagcatgcctgccaaggagtctcaagtcaggaacagaggagaaaatagccatcaaatagggcgtcttgtcagtattattcaaatgtaatagaaaatcaaattataataaaacatttaacataccaagaaacattctatgggaaatactgagacagcttattcctgaattagtattgtgagatcataatgttcacatcatttaaggatctggttgatctgataaagattctatc

SEQ ID NO: 474628 - DNA, 753 bp, Homo sapiens
cactctccaaccagtcccaatgagatgaaacaggtgtctactgttaaagtgagggcattcattggaaaagaatgggaccctgcaacttggaatggggatatgtgggaggaccctgatgaagctgcagatactgagtttgagaaaaaccctgcactgcctgaggcaacagtgatgccctctccaaaggcaattgccaggcaagataatgttgattctcctcagaagtcacaccgaacacctctgtttgcttctagacctgtaactagactaaagtcctggtgggtccccagaggccatttgaaagctgaggaacgaggaagccaatctgagtcccaaaacctcaaaagtaaggaagccagcagtgcagcctgcagtctgtggctgaaggcccgagagcccatggcaaaccactggtgtaagtccaagggtctgaaagctgaagaacttggagtccaatgttggagggcaggaagcatccagcacaggagaaaaatgaaggccaagaaactcagcagattctaaattgtatgtttgttatttcagccatttcagcctggttcagaaccatttctggggagcgagtgtggtcatttggaggctgatgatgttcctttaatgtttgaatgtttgaaattgccatctcttggatagttttattttttcttgcctttatattccttgatgcccttgagggtttgactgtggtataaggtgagtttggccaactgatttcatttagggaagatttcaggg

SEQ ID NO: 474629 - DNA, 1754 bp, Homo sapiens
cctccacttccacttattctcctctcctccatggtctacggaggcttatgctccactacctgcttcggcttattcaattcaggcggtacttttgcagatttgttacctaagtatattgtaacaagtgatgctgaggtttggagtacagaagatgccgtcactcaagtactgagcatagtacctaaccgtttttcagcccctgctcacctccattccccaccccagtcatccccattgtccattgttgccgtctttatgtccctgaatacccaatatttatctcgcacttacacatcagagctgaactgtgttgtggttgcagcacgtatttcagacgattggatgagcagctctgaaacagactgtttttcagatttatccccagtaaggcaagggatccaagcctttgcactctttcaacattcaaccactggttgtaagctacctcccgaaggacggtgatgtgaacttctgttccttttgttcctgatgaggatggaaaaaatgcatttataagattaatgggcacatattatgtacctgagagcatatttacctgctgcagcaaaattcttttgatatgttcataaaaaataagccaactaatttcctctcaaaaaactaaaagacactgaaaatgttataaaataaactacataggatccacgaatgatctttactaaatagaacatcatcaaatattgaaaatgctgtcatgtggaaaaggaattgaactgatactgagtgagcacaaggcataaaatcatgaccaatgtacagagagatggattttatttcaatacatggaggaattttgtagctgtgttgtacaaggatggaatgggtgacttgcgaggtagatcattccctgatatttatttgtcactttttaatttctaccacatttaattgcaagcaccttttaactcccttatggcgctgaaaattcaaatgttcatctctgtatcctctgtcaaacagcacctgaatatatatagaaatggactcagggctcttttgaaacaggtaatttagccaaatacagagtaataagaaagtagtctaatagtttatccagaaagaaaactttcaagatttttcatattccagggatctctatcagataaaagaagtatgaatgcatcttcatttctacacacattatctttatgtgtatagatgaaaatgaatgaaatgaaaataaacactaccatttcaagatcaaagataatggatacatttcaatataatttcttaaaaatttaaagttactattttataaccttaaaaataactcaatttacattttctcttacagtcttgttattatatttaacaacaaaatttaccaacttacaactctaaagtgatggggtaaaaactcataccccaaagtttgttgctgatgacattcgtttggtttgtgaaactacagactttctccaggcattatcttttcagttgtaaaccttttaaccagttcatatgaaaatatctgctaacacagcaaaatcatgagtgcatgtctttcaaattaagttccattcatgtcatcatgtttttaaaaatataaggtaataaaagtctttctaccctaaagtaaagtctttcactatctttgtagcaattgaactattctactgaacccaatatatgaaaacctttccctactgctcccctcatctggtttctaatctagttaggccttctttataactccctacttctgtgcctttgaatatctaaagtggatt

SEQ ID NO: 474630 - DNA, 2869 bp, Homo sapiens
atcaatgtggcaccttcgcctccagcgaaaccatgccatcaccttcacaaattcctggggcttctgaggcgatccggcagtgtcagtcttcagccacgaagccgagaagatctgggaaggagtcagtcagagagccttgggccagcattccaggggctctgggagtggctgccagggttgctgccgaacgagccatgaactgggctgggtttttcatatttgatgaaaaagagcctaaacgctatctgatttgggataaagaaaaaggagcattaaccttgactatgcctttagctccagccacctttttaagagcaaattgctgggcagcttatgactatcgatgtagaaaaccaaagaagttctcatctacactcatggaactgagagacttcagcaatgttgctactcataagagccacatgaaaaaattaataaccttccaaaagatcaatgaaaaaacaatcaagatacgtaattaaaagaaacatttctcttgtaacaacaacaaaagacattggatagtcatagacctttaagaaaagatgtgtaagatctatgaggattagtgaaggttttacagaaagacctaaattaaggtgaggtatgaataggaaggtgttaaagcaagaatataaattttccaaaatgtatgccaaaaattattttctgaaatatttcccaaatctcacagttcaatgaagtgccaatcaaaaccatatcaagatttttttctgtggtgattttttaaaacttaatttgaagtgtcgttaacagagagaaggtgaatttctcacagagctatccaaagaaaatctgattatatatcatcttgccaacttcaacaggtaggccttattatatttaaagagggtaaggaggtttaagagtgccatggattgaattttcttggtccctatcaaattcatatgttgaaactgaatcctcaatgtgagtgtttatttttatgtgaagtttttgggaggacattctgtatctaaatttctaggactttctaagaagggagaaaaaggaacatcatacacaattattttaaataaacttcaaagtacagttagaacagaaaaaaacttttcattattttatacattttattatgtaacttttgtccatgttgagttcactctaagtcatgatgctgttcctcacgtttctcttaattatattctctaatagtagaatgtgtacagttttaatattctctaagctttagtcaagggcagctttgttctttaagccttcatatattcaacagctatcaccaaaataatattcaatctttaagccaattttctatgtcagataattctttaaaatgtcatggttggttgctttaatttcatcaccccttcgaaagaccgtttgggctctaaaatggttacatatgtcttggttaatgtcctcagtcatggtgccttcagctgtcttttcatttctggacctaggagacttattcaatttccattatattgtatggctaatcaaaagaaggtctttacaccctacttatttagctgtcagaagtacctgtatcaaaagaaaaatacaaaccaaaataatctaaataagcatttcttaaggttatgactcctgcactgaatttacggaaatatttttggtcaatttctggcttttgagtataattagtacaagtgatcagagaatatgaatcaagttttcataaatcgttatcacttgtggaactctttccagagctaagaggatacaactgtttgcatacctagttcctagtaatattcataagtggacaactttcaagctctagcttcaagtttatcatcatctgatttacaataatttattctttggtgccaaattaaaccttttgttcctaactgcaaagagttattaagattaatagtttgtccccacaaaagattttcaataaatttcccttttgtcttccttttctgatgggtgagaagggagggaacctttcagaaagagtgacaatggatcagttacagagataaaatcaacagcaactctctggatttacttccagtaaacaacatcaaaatgatacagggttggaattttgtgaatctattagttaatggtggtttttttttcttaaaaaattttaaactgctctatttctacctcctggatcctttcaaattctatcaccatctactttagatccattggattaattattttacctgctcagttttactaattatttatattattggagaaaaaatattgccaatactttaataaaactcagcatatgtacaatataagtgggaaattaaagcagagaaacagatgcattcagattaatttataaaatatgctctaatatatgtcttaatgatatattagagtgaaaaactatagttaaaactttaggagtagcaaaatattaccaatcatttgcagagatatgaaaagaaaatcagatgcccaattactgaagcattgttaaagcagactttgtctcctttaggaatcactctctttctaatcccccaatttttttttgtttcttggaaagttacaactctgtatgtaatttacttagtattttcttgaaaaaaaaaagaagaaaaagtttggaaccttagatttaactcatttctggatagattattcacatttttaaccagatataattcttgcttaagttctttgaataagtttttcataaaatactgtgccttttttctggggtaatgttccagaggggagtatggctgcctctgctgtgcagtatagtttgccagggaagttgggggtagcaggtagtgaaaggcctcacccagctcccacacagttggcaagcctggtcttgctccctcagtatcctattaacagctcc

SEQ ID NO: 474631 - DNA, 810 bp, Homo sapiens
gccgccaaagtgggagcccaggcagaggaggcgctgagaccgagcgagggctgattatagagagctgccagggaagcatgggttatgttccacaaacttttccaaagttacatggtgatgatgatggtgatggtggtagtgatactgatgactatggtgatgatgacagtggcaatggtgataatggtgattataatggtggtgagggtagtgatgatgatgagaataagaatggtgatgatgatgaagtgacagtcttctcatctgtgaccactgaaaaattcaaatacctcacacacatgatctggagagacctgtgggatactttaaagacacttaaggactgctcatgtcccccaagaacttggtgtgtgtatatgggtgtgggagtgagggggttcaaagaacccatagattccattattccccctcccccaaaccctcgctcacaccctctgatgctagttgactcattcattctctatgacccatcatctcctttggaacctgtccatgttttccccgccttcccatttcctctgcctggagctctaactctaagacagagaaatgctttcctaaagagatgagtgatatcacatccttttctaaactgttttttttatccctagcccatgctacacccagcaagcttaattccctttgtgcaagtgatctcctcaacatttgtccctgaatcaaatgttttaaatgcatgatggcaacttgctactgaaaacagttctctgaaaaaatgctttaaaatatagaaaacaaagtaaggagttatttctgtctgcccactgtcac

SEQ ID NO: 474632 - DNA, 667 bp, Homo sapiens
agatattatggttaaaataagggcactactacaattgaagtgtcacccagtgaaactgctagaagtcaaaaatacagacaacgccccagaccacactaataaacaggttaacccactggcatggcatactgggaaaccggggaaggctaaaacagcagtgccagtcaaaatacagcttaaagaccccaactatttttccaatcaaaaacaatacccaattaagttggaagcaagaagaggcctagcacccatagttgagaaaaatcctaataccagagaaaaacaacaatacacttggatagtgctccctcagggattttgcgatagcctccatttctttgcccaagccttagagagggatctgagggatctgcaactggagaatgggagtgtactccactgcttggaatatggacacttggctgcatctccaagaatcatactagaccatgaactagtcctgaatttgggaggatacctccccctttttgaaagcttttaagattttcccttaaggcatattgtcataaattttagatattattttaaaatttagcatatctgtattctattctcatatgaatcattaacactttcagggtgacgatggtaaaataagtctaaatcactgaggaaataagatctcagggaaataagcatgtttatg

SEQ ID NO: 474633 - DNA, 1127 bp, Homo sapiens
caaggttttggcttgtgccaagtaaaaagggcctggggtcctcccttgcattttgaagaagacaggaaaatgtgggaaagtttggaaattcctacagacttggctcagaatacaggaagatgtgggaaagtttggaacttccaagagacttgttgaatggctttgaccaaaatgctggtagtgatatggacaataaagtccaggctgaggtggtctcagatggagataaggaactagggaagtatgacaaaggagactattgttgtacaaagagactggcgacattttgctcctatcctagagatttgtggaattttgaatttgagagagatgatttaagatatctagtagaagaaatttctaagtggcaaagtgttcaagaggaagcagagcataaaagtttgaaaaatttgcagcctgacaatgcaatagaaatgaaagacccgttttctgaggagaaattcaagccagctgcagaaatttgcataagtaacgataagccaaatgctaatcaccaaaacaatggggaaagtgtctccagggcgtggcagagaccttcacagcagccccttccatcacaggcctggagatctaggaggggaaaatggtttcttgagccacgtctgggtgccccccaccctgtgctgtgtgaagcctagggatttggttccctgtgacagccaatctagctgtggctaaaaggggccaaggtatagtttgggccatggcttcagagggtgcaagccccaagccttggcaactttcatgtggtgttaggcctctggtgtacagaagtcaagaattgaggaggttaataatgctgtaaggacaaacttctacaacaagaaaatgtccaggtgccctgatactagcaaggcacattctttgccagtcatgacccatggtcataagatgtttataactgatgaaatagcttaataatttatgtgaggacaaacccctacaccaacaaaatgtccacatgccctgacacataaaaatataatgcttttaacttgctgttgtaaatgttttgtgactgaatattgtcctgcaaccatattcatattccatcatatctttcttttattgttcgtaaatgaagattgagtcatcatttcaacact

SEQ ID NO: 474634 - DNA, 708 bp, Homo sapiens
gggtatggtggaaggatgcaactaacaaataggaattaggcacagtctgcattcatgccggtccctaatgatgataggtttccagctcaaccggaagaagaagaattggatgtggaccgtaccatccttaacaaatgattcttatcaagtacataatgtgttcagtagcaattcttttcaacttctcactgttaaacttaagcctcttgaggaattgagggctcctgtcactactaacagcaataaaacaaaaggactgccagactgcccaaagaaacctacaaagggaacttttctactgaattcaattttatggaatgattgtaatgctcccaaggccattgtgctgcaaagtctagccatgggaactgttattgattgggctccaaaagagcattattcgcaggattgctccagcaaaaatacctcatgctcggagtataattatttgttagattatataaaggatggatggcagtcatacaggttgagacaataggtgtctccttacccatttaaatggatggacgcaggcattgttcctcctagaccaaaaatgattcatcccattgttaccccagaacatcctgaattatggaaattagctgcagctataacaggaataaggatatggaacactacttatcaactccttcacactaataccaaaacacccacattcaacatcaccttgatatctaaacaggt

SEQ ID NO: 474635 - DNA, 648 bp, Homo sapiens
gagcgtccgagcgtccgtggcttcattcttgaagtcaccatggctgaaaggggccaacatagagcttgggccatggcttcagaaggtgcaagccccaagccttggcagcttccacgtggtgttgagcctgcgagtacacataagtcaagaattagggggtggggtgctcatggagaaactctattggagcagtgtgaaagggaaatgtggggccagagcccccacagagtccctactggggcactgcctagtggagctgtgaggagagggcaactgtcctccagaccccagaatggtaaatccactgacagcttgcaccatttgcctggaaaagccacagacactcaatgccagcctggaaagcagctgggagggagactgtaccctgcaaagccacaggggtggagctacccaagaccatgggaacctacctcctacatcatcagcatgacctggatagccaacaggcaggaatgtttaagtctgctgaagctgtgcccacagccgccccttcccccaggtgctctgtcccagggagataggagttttatctataagcccctgactgggggtgctgcctttcttttagaggcaccctgcccagagaagaggaatctagagaggcagtctggctaaagtggctttgcc

SEQ ID NO: 474636 - DNA, 621 bp, Homo sapiens
ttccatttgtaagaccatctgtagctttatggcctcaatcctagaggaaacaaatttgacaaggaggttaaaaatacagagcccgaagtgcacaagttttgacactaagtacacaagttttgacactaagtacactcaaacattgtatcgtctctatccatttccatcctacaagatatccaatttgctttcaaattctgtcagttctacctttaacatatgtccaggaccatttcaaggacaaatacagaatgtgaggtcccgttctagccaacggaaaccggacatagcagtagggtggacatgtcagattataaatgaccctatctcctttgttcggtgtactcacgtggcaaaattcctgttgattttcagcaaacattcagagggcaaagcggcagttttccctccactcctacaatgtcagcatcaatgtcctgctcctgatggcatgctgtaattgtataagatgtagccattggaggaaactggctgaagggtacaagggaccacttggtattgtctttgcagcttcctctgactctataattacctcaaaattaaaagcttatatatatgataataaagttatatatcatgtatatgttacatatacatata

SEQ ID NO: 474637 - DNA, 574 bp, Homo sapiens
aacatcttagattaacatttgtgatgatgactgagccaatattgacacattattataaccaaagcccatccattgttcagatttcatccgtttttacccagcgtcctttttctgtcccaggatatcaaccaggatatggcattgcattggatcccaaccaggatatgacgttacattggatcccaaccaggatatggcattgcactggatcccaaccaggatatggcattgcactggatcccaaccaggatatggcattgcgttggatcccaaccaggttatggcattacattggatcccaaccaggttatggcattgcattggatcccaaccaggatatgacattgcatttactcatcacgcctccttaggttcctcttggctgtgacggtttctcagactatccttgttttttaggaccttgacagttttgaggcatactgcacatctcaattcagacttagccgcatttcaagtgctcgatagcctggatctagaagatgctgtagaacttggctccctgatgtctaaacccctcccttctctcctgcccattggtgatctccagaccttc

SEQ ID NO: 474638 - DNA, 547 bp, Homo sapiens
cgcccgcttccctggtagtaaagagctggcatctttctaaaaaaaaaagggagcttgctcaggtgccagcagtgacagtgatgggtcaggtaggtgggcttttctttaagcccgtgggtggtgagcatgcaatagctgtagtggtgatgggccaacgcttgggcctcaggcaacatgtgcaagtgccagtggtgggaggtgtgtgcatatgtcagacatcagtgctggtgagtggtgtaggctccggcaaggtgtgcatgagttctggtggcaacgagcagtacagattgatcatctggtctctggacaacatgctggcccttgcaggagtggctttgagtaaggtgagtttgtctttaggccccccaatgctttgcatgggtcaggctgtgatgggcaagagttgggcaatttctagtccccagagagtaggcttgggtgattgtggcaagtgggttgggtttgtttttaaggccctttatagttcaagcatgtgccagaagtggcagagagggtgggatgatccttaggcccccagacagcatat

SEQ ID NO: 474639 - DNA, 766 bp, Homo sapiens
aaactatatgaggtttctttctgccatgccccctagctatgcaaagaaggttcctcataaaatgccactacgactcataactgtacgacttgcctgctttacaactagatatccaaaaggacttggatcttttgatctaagctgtatctactttagggggcaccagaagcataatagtgctgtggttttttgtagattcctagaggtcctgaaaatctataatcagcaggtggcaaagccagtcaggcctgtgttcttcccttcagggcagagaggtcccccaagccccccagaagaggaccctcaccccacaaccactaccaacccaggccatgaggagtactgccagatgaactccaatattcccttaaggcccaagatgcagacacagtcctccctctcctctttcctctccacttctcaagcagaaggaaggggtctcttttggagcccagagctgtgcagtactgcagatgccagcactcctttggctgcctctgatggtgtctcagtctgtgacatgtcccccagtccattgttcctgagcctaattcagctctaggactcacctaagagttgtagtccttgtggcctagactgccttttaagtttacgtggagacacggagtgccatagccctcagtggcaaggtttgcagacactcaagttcagacggctgggatcagtggttcctgtctggctagggctgatttaaatgctccctctctggatgggcatcagatgagtttgatctggttttctgctc

SEQ ID NO: 474640 - DNA, 1599 bp, Homo sapiens
gtttgagttaatgctgaaatgagttaagactttggagaactgctgggaaggaatgattggttttgaaagaactcagcttggagcctgtaagcggctcggaccctcagctggactgacagtgcagagtatctgcgtatcagtgtactttattcatctgtcgctgaatcagggctctgcaggaacagaccccctgcagctagtgcccccaagattgaacgtggactcttacctttcaccatatacaaaaattaactcagaatggattaaaggtttaaatgtaaggctgcagactataaacattctggaaaacaacctaagagatactattctcaatatcagccttcacagagaatttttggctaagtcctcaaaagcaattgcagcaaaaccaaaaatagacaagtgggccctaattaaactaaacagcttctgcacagcaaaagaaactatcaacagagaaaacagacaacctacagagtgggagaagatattcacaaactatgcttctgacaaaggcctaatatccagagtctataggcaacttaaacaacaagcaaaaaacaaataaccccaaaatggccgcaaatgtatagtagatataaatgaaaaagcatacaaaggggaaacaacttagaattgtaaactctttcatgagattgataactaaggtgtaaagtggtatcatattgtggttttgattagcatttccctaatgactaattatgttgagaatttttcatatacatattagtcatttgtatatttgaagaaatgtccattcaaatccttgcctgtttttaattggattgtcattttctttttgtgctgtaacagttctttacatattctgcattcgctacacttacatattattacaaacattttctctcacactgagttgtcttttcattttcttgatgttctttgaatcacaaatgtattttcttattttaatgaaatttattttaactgtttcttttctcaattgtgttttagtgtaagatctaagaaactattgccagctcaagttcataaacatttattcctatttttttctaagacttccatctttttagttctaatatactggataatttcaacggaccagccttcaagttcaatgattcttttttttaagaaaaaaataagttcaagtctgctgtttatcctctctagtgaatgtttgaaatttcagtcatagttctcaatgtttgagccgagagtttaaaccttttttcatctttccttggcatgtacacagtcctgcatgtgagtattttcttcttgatttccaggaatatgttagagctttcaaaggcctgtattaactcccttacttttacgtttttttgttagcctctctattagtctgttctcatgctgctaataaagatatacctgagactagtcttgctagcggtctatcaattttgttgatcctttcaaaaaaccagctcctggattcattgattttttgaagggttttttgtgtctctatttccttcagttctgctctgattttagttgtttcttgccttctgctagcttttgaatgtgtttgctcttgcttttctagttcttttaattgtgatgttaggg

SEQ ID NO: 474641 - DNA, 474 bp, Homo sapiens
atctgaaataaaagcttaggtgcgatggttttctatgatgttgtctctgctgtcttgccgcaaatgttaacaagaaatcaacacttccagtattttaattttttcctattggttccccttaaattacaggctcctttggcctgtattctaacttctgagattcccattattacagaaagtctattggacaaatctgtcatcatagtgaggcaggaggatggggagagattgatcaatgggtacaaagctctcactgcctggcttctcaagggcacttgctcggatctcagagcagggatggtgctgaacctgggcgctgtcacagccctgctgggtgtgcactcttggggcactactgacatgccagccccctaccgcctgggtcccctctggaatttgagcactgaggagcttgagtggggaagctgaggggcaggtggagggtggctttgtgatggcctgaagatgttcctt

SEQ ID NO: 474642 - DNA, 2426 bp, Homo sapiens
ccagttcccagcaaattccttatcttgatctgagactgcctcagtctgagctttattgtccatatcactatgagccttttggtcaaagccgttcaacaagcctccaggaagttcaaactttcctacattttcctgtcttctgagccctccaaactcttccaatctctgcctcttacccagttccaaagtcagttccacatttttgggtatccttatagcagcactccactctaccagtaccaatttactgtattagtctgttcttaccctgttaataaagacatacccaagactggggatgccatccgtcagaaaacatcttgcacgacaaatctctttggaaaaggaaaagtcagagaaattggaagcctgagattgacaatgctattcttgacatctgatagtgagaaccataagcaaggactggagagtggcctctacgagctaagagcataccctggcagacaagcctccagagcagagtccatcctgccaacactctgatatcagcaatgtgagaccagtaacagagatcccccagttgagtctgccctgccttctgccctagcggacattgagaaaataaatgagtgttgtcttaagctgctaactttgtagcaactgtcatacagcaacagataactcatactaagatattttgaattgaattccttcttagaaattgttatagatctaatgtaattatctaaaatgccataattttcattaatttcctttggaataaatgtaatgaatattttctctatattatcaaattaaaacaatatccattacttaagatatctaggatatttcagtttgtagaccttcaataattatgttaatgtgtgttggtcaagtgtaaagtaagcaataatgtaatatgagtggtggctataaaacatcatgtttcaacttttaacaaatattaaaaatgaaactttttcattttgaaagcttcagctttttaattttgtcacccctggtttccactttacgtctaagctcagataaattacataaaatggcccttataaagtcaattcaaattgttttttattttttaaattctggtataaaacataatttcataagaaaagcactacaatatagagtatatatttactctaatctttctagaatttgagtaaatcaatttcaaaatcatgtacatcaggcagcactgtttattatgtattaactcaattctaatattacttctgtggtgccattaacgtcttttgaaaatcagtttgaattataaattacgtgtagtgaaaataaatttactttgaaaaaaaatcatctgtttcattcacagtagtgttaatctatttcctatccctcatttagttcttcaaaggtcctttgtcctttgtttctcagattcaagtatctttaatattggagaattgatgatataatggctcagaaaccttagtgagacacatatcactttttaaataattattatagatttctaggtccatgaaagaccatttaaaacttttatcccattggattagtatttttaaatgtttgaatcatcaaatcaaataattagttcattgtatcttgtaactagtgcataaatgattatttctttttctatactgtctttcaaactagagtaatctttggtgaggttaggaagtgcctacctagacagcataattttaggaatgttttattactcctaaatatttctactgtctccacaattcccacataacccctctttctagaggagtttttcttggagagatataaaatgccatttatttatttatccattcacttatctattcattctctcaataaatatttattgagcatttgtaaagtttgctgaggctaaattactgaatgagaaatctttgctgcattttgaagataatgaaaatgattataataaacttgtaagtgtgctaacttgacagacgaaaaatgagtaatatgggaacattaatattgtctgaaaatattaggacagccttccataagatgtgaaatttcaggagaatgctgaaaaacaaaataagtttgataagtgaattgaagactaattacatttatttctttgaactttcttggggtttcaaaaggcaaacttatgtgtgcttctgcacataaataggggaagttagataagttataatacctttgaagaataggaagtttggtgcctttggggaatacacaaagcaatttggtccatgtggatggagtgtagagtgtaaaactgaatttgaggttaaaataagacatgagccatattaaaagggatcttgccagtttaagattcgagtatagattttatgcatattatttaataatttattttcagattttacctctttagattcttatcacagtgtttaatattacaaaataaaatttttcatgatgtagaaaattttggggag

SEQ ID NO: 474643 - DNA, 786 bp, Homo sapiens
ggaggggcagggccataagtggttttggaaaagacaacatttgatcaggaaaacagggatgataaaaagtatatggaaatatgtaagaccttggtcagaactagaacatcagcacttcagctgcattctattgggcaaagacacaaagaaagatctaagaaaatgagtaaagactcatactctgatggcttacttcccaggtcactaaaggagctcagagaaaaagaggacatgctggcaggggtagagatttatacttggactttacagaaccttctcttcatcaagataggttacactagtgccaaaactgatatttcagtgtgccaacctacagatcagacaagtgctaagcccctgatgcagcactatggtataggggctattagagcaaacaagaaacaaaaaaagttgatcttttctgctcttctgctatgtaaagaagagtgtttctcctctccagaggatgcagtatccaaggcactagactggaagcagagacgaggctcttatcagacaccagacctactgacacattgaaattggacttgccaggccctaaaactgtgagccaataagtttctgttcattataaattagctagtctgtggtattcagttcttgcagctcaaaaggattaagacatatggtaattctatttttagttttctgatgaaactccatactgttttccataatggctgtattagcttagattcctaacaacagtgtacaaggattcccctttctctacattctcaccaacactgttgtcttttgtctttc

SEQ ID NO: 474644 - DNA, 459 bp, Homo sapiens
tttttaatttccaaagggtacatgtgcacaacgtgcagaggggatgacagaatatttatgttattatttaatggcaaaattcacttctttctaggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgac

SEQ ID NO: 474645 - DNA, 811 bp, Homo sapiens
actgccaacactctcagctgcctgtggcctcacatagcccttatagttgcgttcccagtgccccatcagaatggtactgaaacagcagctcccacccttgcagcaagcagcgagcaagggggctgcagagccacaggacacagaagaaagaagaaagaagaagaaagaaggaagaagaggaggaggaggaggaagaagaagaagaagaagtagtagaagtagtagtagagagaaggaacaagaggaggaggaagaagaagaagaggaggaggaggaagaggaagaggaagaagaacaggaggaagaggaagaggaagaagaggaggaggaggaagaagaagaggaagaagtggaggaggaagaggaagaggaagaagaacaggaggaagaggaagaggaagaagaggaggaggaggaagaagaagaggaagaagtggaggaggaagaggaagaggaagaagaacaggaggaagaggaagaggaagaagaggaggaggaagaagaagaagaggaagaagaggaggaagaagagaagaggaagaagaggaggaggaggaggaagacaaagaagaagaaagggaagagggaagaagaggaggaggaagaagaagaagaggaggaggaggaagaggaagaagaagaggaggaagaggaagaggaagaagaggaggaggaggaagaagaggaagaagaggaggaagaggaggaggaggaagaagaagaaaaaagaagaagaaggcggcaaataatacatgtctccttttactactgtgatcacaattccatagagaattgcctggtatagcaggaa

SEQ ID NO: 474646 - DNA, 475 bp, Homo sapiens
acaaataagagaagcaaaaaatgaagatatacagagaggttcagagatacctgatagaacaagggcctgggcaggagaagatggcaagttcagatttgagtggaaagagcttccctacaactacatggatccacaaatggaaatcaggcactgatggaaaagcagaatggattctggagacaaacacaaatgtctgcagaatactccttaagctacccaatagccatacatattctcctttaaacacatgtgcacaatgcaaactgtcgatggatctactattcttgggtctggaggatggtggccctcttctcacagatccactaggaaatgctccaatggggactctgtgtggggactccaaccccacatttcctctctgcactgccgcagtagaggttctccatgagggctctgaacctgcagcagacttctgcctatatgttcaggcatttctatacatcctctgaaatct

SEQ ID NO: 474647 - DNA, 740 bp, Homo sapiens
taggtaaaggaaaaaggggggttgttctctggcaggcaggagtgggggtcacaagcgtcacacccagaagcgcgtgctgtgctgcaaggccagttcaaatgtcatgtgggaggatgctcaggtgcttatgcccaacaggagttgtcaagggcatcaggctcttgacattgagattgccagtggccacccctcaacatttgagtttcccaggaagtgtcaccaacgatcatttgagataggacatcaggctttttttcctactacttctgactggcatctttataagagtgatgttcacagaagaagaccatgtgaggacacagtgagaaggcagctggctgcaagcccaggagagttctcaggagaaaccaaacctgctgccatcatgatcttggacttcttgcctccagaattatatgtacacacaattgacaaattctgtgaatatgtttgccacaaaatgccttctaccacagctgaagtagagtttgcatcagcacccctaacattcatgggaaaagaaaatctagactgaatgtggccttgaacacaactaataagaaaaatgtcctgtcgtctatcatatttagttcatctttgctatctcaactgcagatgagctccaaagctgttccttttttaaattctgtattaatagtatttcattgcttaactacttcagttcacaagcataacctggagtttcctcaccccttgaaatctattaagataaatgtaaa

SEQ ID NO: 474648 - DNA, 701 bp, Homo sapiens
gctgctgtcattagtgctgctgccaacactgcaagccctgctgctgccagtgccaattctgctgatgccttgggctctccatgtcccagggactcaagcttaagcccatgaagcctgggatagaagacaattggagcaagatgaccaaatggaaacctccactgacttgtctacacaaaaaagcacctacatacgaactgaaaatcaggttaaccatcctagtttctgactataagcactggctcctggacagcatctctggacccacctggggcctggggaccttgcaacccttcagaaaagaacacaaatctggctgggttcgctacctgctgattgtagagccctggaccttgagcaaacatagagatagcatagtcccagtgggggtgaccacaggggtgcttgtgtcaccccttccccagctgcaggcagctgagcacagagagaaggacttcatttgtttgggagaaagtaagaacaagagtctctccctggtcatccagataattcttccagatcttatcccaaactgtcaaggtggtacctctctaagtatgcaagaactacaacataactgggcttgggtaccccctaatgcagatatggcttcagtgaacaaaactttagaccatatgcccaattctcttctaacacctggaaaaccttcccaagaagggtaagtacaaacaagcacagat

SEQ ID NO: 474649 - DNA, 598 bp, Homo sapiens
ctcttcagcccttgggaggtcgatgggatcgagcgccgcagagcagggggcggagctcattggggaggctcaggcccgcgcaggaccccacggcgggggatggggggaggctcaggcatggcgggctgcaggtccccgagccctgccccacggaaaggcagctgaggcccagcgagaattcgagcaccagcacgggctggtctgcactgctgggggacccggcgcaccctccacagctgctggccctggtgctaagcccctcactgcccgggacgggctgctgagtgcggggccctccgagcccatgcccaccgggaactcatgctggcccgtgaacacggcgtgcagccctggttcccgcccgcgcctctccctccacacctccccacaagcagagggagccggctctggcctgtgccggcccagagaggggctcccacagtgtagcagcgggctgaagggctcaacggcggccagagtgggcaccaaggccgaggaggaactgtattcacgaagaagactctaaacttttgaactgtagctatcttctccagttgagaaaaccagatttcctccctggatggctagtgatgttttt

SEQ ID NO: 474650 - DNA, 898 bp, Homo sapiens
attggtcttcagttatttttcttgggtcttctctacagctgacaggccaactcaacctactgccaaccaagacctgactggcacgaggaaaggtgcaataatgaagagttttcttctagttgtcaatgccctggcattaaccctgccttttttgtgccatgagaatgatgaaagaccattctatcagaaaacagctccatatgtcccaatgtattatgtgccaaatagctatccttattatggaaccaatttgtaccaacgtagaccagctatagcaattaataatccatatgtgcctcgcacatattatgcaaacccagctgtagttaggccacatgcccaaattcctcagcggcaatacctgccaaatagccacccacccactgtggtacgtcgcccaaacctgcatccatcatttattgccatccccccaaagaaaattcaggataaaataatcatccctaccatcaataccattgctactgttgaacctacaccagctcctgccactgaaccaacggtggacagtgtagtcactccagaagctttttcagagtccatcatcacgagcacccctgagacaaccacagttgcagttactccacctacggcataaaaacaccaaggaaatatcaaagaacacaacgcaggacttgctgaaaccaaattactacttcacactctccttcagccatttgtctgccttcagtcaacagaaaatgtgattttcacagattcagctcttctctccttacattttacattcatgccacattcaatattttgattcttgcacaataaagccaactgattgcaactgattctttgagaggagtttgcaaaggtacctcagggatctctgaaactttgaaacgctatgacaaatttagtgtgagtt

SEQ ID NO: 474651 - DNA, 545 bp, Homo sapiens
gctctgcagttcctgatgtctccaagcttccaggtgccaccacattcccctcatccagatgtgggtgactgcagcagaagctgtgtgcaagaaattgacttccgcaccatcaacatttcctccccgacccaggattcattcagcctttccaactctgaggatattaaatttacacttgctgaggcaataattatggcctcccccaagggagttgtcaggcaagacaatgctgattctactcaaaacccatacccaccactcctcttcacttctagatctgtaactagactcacgtcccagcagagccctagagatcttacagtgggaaccacagtcactcaattggaaaacttaaatgcaatgggaataattgaatcccaaggtggcaggggccaagtggtagcactcaattgtcaaaagtgaggtgggcatagttacaataatagcacaggcaaagcagcaatcagaatagtctgactcgtgtagacctctggcattggcaaattattttttatgtttttagaagtgaaataaataggaagcct

SEQ ID NO: 474652 - DNA, 737 bp, Homo sapiens
caaacaggccaaggattaaccagtaggaatgcagtggcactctgctacacaacaagaacttatatttgttttggctgtgtcctcacctaaatctcatcttcaattcccacgtgttgtgggagggactcagtgggaggtgaagatctgcttctggactcactcacgtcactgttggctggccacagaagatctatttctaaacgtactcatctgggtctcacttcagggctactgcatgtcatggcagtggctttctccagatgcaagggatctgagagaggaagaaagaaccaaagcacgcaagatggaagccacaaccgtctataatctaatctcagaagtgatgtctcatcacttctgccatattctacttattacaaatgagtcattaaatccagcccacactcaccaagaagcttccttgaaattaaaagccttttcattgtgccgcaaagaatttgtggataaggatgaatttgcaggtcaataacaattttaaaatgctattttatgtctgtacttgtgctttgtctatcaaggttcaataattaaaaaccaaatagtgctgcaactttacatatttttatctgcattatttatttttagggtttttttaaatcaaggagtggaatatttaacatatttcctggaaaaaagcggagatttctcagaactgtgatacaatctatttttataccgaacgtttgtgttttcagacaccaatcttaaggggtgag

SEQ ID NO: 474653 - DNA, 685 bp, Homo sapiens
acagctgggctgctgggggtgacatcacatatcggtctagaggcctagagggaaaaaatggtttcatgcactgggcccagagcccccctgctgtatgcagcctggggatttggtactctgcattccacctgctctagaactggctagaacaagccaaagtacagctcaggtcatggcttcagaggttgcaagccccaaaccttggcagctgccatgtgatgttgggcctgtgggtgcacagaagtcaacaattgaggtttgggaatctccgcctagatttcaaaggatgtatggaaacacctggatgtccaggcagaagtgtgttgcaggggcagaggctttatggagagcctctgctaaagtagtgcagaagggaaatgtggggtgtgagtcctcacacagagtccccactggggtactgcctagtggagttgtgggaagagggccaccatcttccagacctcggaatggtaaatccattgacagtttgcacaatgcacctggaaaagcaagacactcaatgccaacctgtgaaagcagccgggaggtggggctgtgccttgcaaagcagagctgcccaagaccatgggaaccaacctcttgcatcaatgtgacttggatgtgagacatggagtcaaaggagatcattttggagctttaagattgactgcccccactagatttc

SEQ ID NO: 474654 - DNA, 622 bp, Homo sapiens
gagggtggagactgagaggaatgtgaggatcgaaaaactacctcttttctgctctggtgtatccccatctttgtggttttatctacgtttggtctttgatgatggtgacctacagatggggttttggtgtggatgtcctttttgttgatgatgatgctattcctttctgtttgttagttttccttctaacagtcagatccctcagctgcaggtctgttggagtttgttggaggtccactccagacctgtttgcctgggtatcaccagtggaggctgcagaacagcaaatattgcagaacagcaaatattgctgcctgatccttcctctggaagcttcgtctcagaggggcacccggctgtatgaggtgtcagtcagcccctactggaaggtggactttggcaaccaaaagggccagcgagaatatgaagctcatgtggtacctcttatgctgtgtctttggtctctgcaacttttcagaaatcctgagagctattcaaccttttctaataaattccgtttctacttgaattagtcaaggttgtttcctgtcatgactgagaatcctgatgaacagagctctaaaatgacaaccttgaatttctttatcaatattccacatat

SEQ ID NO: 474655 - DNA, 848 bp, Homo sapiens
ctggagaagaaggccgtgcggctgtgtgaatctacctgatgaccctcggctgcttgggtactgccatggatagcgcatgtgttggctttgtccagctttgggctttttcccacattgattttaaaaagacaggagccacagattttggaggaataagacgtgtgatccatggcccgatggccctgatggacgtgaagatccactgttgtgggaggagtggaacactaacactgaatgatggaggctgtggtcagaaacaggtaagtgatggaggctgtggtcagaaacaggtcaatgatggaggctgtggtcagaaacaggtcaatgatggaggctgtggtcagaaacaggtcagtgatggaggctgtggtcagaaacaggtcagtgatggaggctgtggtcagaaacaggtcagtgatggaggctgtggacagaaacaggtcagtgatggaggctgtggtcagaaacaggtcagtgatggaggctgtggtcagaaacaggtcagtgatggaggccgtggtcagaaacaggttgaattggaggggcacacatttggtcatgaaaatggtgggactaagaagaatgaagtggcatgcaagagaccattatagaaatgatgtggaactcagggagtcccccagtggtgtttttgccatctttatgtccacgagtacccaatgtttagctcacacttatcagtgagaacacgccatatttgatttttctcttcctgcattaatttgcttaagataatgaccaaatctatttcttattataccacagatatatatataaatcctgtagctaaggactcatctttgtaccggtaggcagtatttacaatgcac

SEQ ID NO: 474656 - DNA, 541 bp, Homo sapiens
ccagttttcaaagggaatgcttccagtttttgcccattcagtatgatattggctgtggagatgccctgcccagagaggaagaatctagagaggcagtctggctatagcggctttgccaagctgcggtgtgctcctcccagtttgaactttccgagctctgtttacactgtgaggggaaaaccacctactcaagcctcagtaatggtggatgcccctctccccaccaagctcaaacgtcccaagtcaacttcagactgctgtgctggcagcgagaatttcaagccagtggatcttagcttgctgggctccatgggggtggaacccactgagctagaccacttggctccctggcttcagccccctttccaggggagggaacggctctgtctcgctggcactccaggcacccctggggtaagaaaaaaaactcggtgtctgcccaaacggctgcccagttttgtgcttgaaacgcagggccctggtggcataggcaccagagggattctcctggtccacaggttgtaaagaccatgggaaaagc

SEQ ID NO: 474657 - DNA, 548 bp, Homo sapiens
ctgagaggggagtgtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttcgctcagactacatcagtgatgaggcgctggagtcattgcctggtttcaaagagattgtgagcaggggagtaaaagtggattacttgactccagacttccctagtctctcgtatcccaattattataccctaatgactgctataacctttgtaaaggcagcgagaggctctcagaaagaatttagcaaactatccagggaggctgctaagaatgcactgttattgctggttatgcgggactcagctatgcactctgagcacagagagagctctgctaattatgttaacagaaagaaaatgagatctctgatatctcatggacctccacagaacactaaagccaaaagagtctaaaacagacatttatatctctgactttg

SEQ ID NO: 474658 - DNA, 764 bp, Homo sapiens
tgctcttacccacttctagcttcaattgctggacacctcgcctaccatgcctgcttctttaggcagcttaatcgaggctcattacagagagtatagtttaagtggaaaaaatgttgttaggtgtctctgggaagtatatgacaaaatgttgacaaaagttaattcagaagatcttgcagctgtggcatctgttcaggctcttctttcgtattcactcatcagccaatcagcaagttctgcctcatgggtgcccttcaaattcaactctccccctcacttacagcccatcataaaggatagatgcggtgaagtctggagtggaacaggaggggaggaggagcctgttggactatcctttgatgcaggcttaggccctggccagttactgtgtgagaacgggacctctgatgcctactcgcctaggcgctggccagttgctgtgtgagaacggggtctctgatgcctgctcccccatctcagctctgccacgacgttctttggtgcctgaaacaaaacattgaatttccctgcactttatttactagtgtctaaatgttgaaataataataatatactgtggaacaaacttatttcagcatctgttcatctcttggtagtttactggcagtaaagataaaattctagactggcttccccgctactcagaatgtttctgggccactttcctcaactgcttaaccggaagtgtttgaaaattgcaaacaaatgttaccattagccttagcaaaatgatgctaagttac

SEQ ID NO: 474659 - DNA, 537 bp, Homo sapiens
gaaattcctcctgcgccctgcatggcccattcaggagcgtctgtgacccaacctctctggctctggggagagggcaaagtgtggcatccagccctagccaggccagcgaggagccgcattcctgccacagtgaccgtggctccaggatccaggctgggcgggaggattcttcatgctggaggaatccattcctctcggtggccgagctgggaagaaatgtccccatgtgaagacatggccccaggaagagacgctggggctacagccagggccgcggggagggcagcaagggaggattctatggcagaaaagctcttcgtctggggctaccaccgcagagaatccaacttcagaagcagcacctttggccaacagatcaaggcctctccaagcatcgtcttcatcgttacagctaacagtgtgccgtattgcatctccagtgggccgcagtgagcacacctcctgcggcactgaactgcaggagggagaaggcattgctaaggatcgagtcctaaacaccaactgaacggggccacc

SEQ ID NO: 474660 - DNA, 1642 bp, Homo sapiens
gggaaggactgacgttccctaggctgagcgagtcgttccacatgcaacgctgcactcagacgcctgcaaatcagaacaagtgaactgtgtttcagggtctctccttgaggcagtggctagaccagcgcatgaatgcgggaaggcccttctcaggctgctcacctcctcctcctcctcctggcgctccacctggtctgccctgctgggcccaatccttccctgggcctgcccttccttcctcagtgccctctgtcctccgctgacctgatcaggagatttcaaccagggccggggccgtgggctgtcaggccacacactatttcatcctaacagtcctcagtgccttacataaaggaacgatgagtacgggattgtaccccagggtgggacccagtgaagaagaccttgttgctctcaagggtgaagaaggttccttcccacggagagtgccatctgacctggagcaggcgctggtagcagcgctcaggacctgggtgaggcagccctgccacctccctttgcctcctaccttagttaggccattggacttgacgtcaggctccctgggaagccttggctgctccagactcctgcagaaagaggggtctctccagagaaccccaggggaaaggctgcccccgatccgttccacagggctggggaaatggagtctgaaggagcacgcagaggaaagtgagtggcggggctgccgtttggggctgtctgtcccgtcccgcctgcgaggtccctgcactgggacctggtttctggccaggtctggagagggcctggcactgctggggctcctgctggccttcccagctgtgccagcccaactccccagagcacagtctgggggtggtagatttggagggaggagtcctggcaaagtaacgaagagggctccagaggagaatgccagagtctgaggtgtttgctgtagatgaaggggtttgaggtacgatggcagctacagctgtgaaagctgtaaattgcacaggatgccacatctatggggggcatcgtccgtattgtagacgttacagatttgcatatttgtgttgacaatttttggtccaagccaaaaaagtgttataaaaaaataagtgtatcaaaataattttctaatgggtggaagttatatgttttgaagaagaaataccttatcatcatcattattattattattttgcacaaaagcctatgggtttagtgacagctgtcattgattgtcctttaagttctcactaatgctctattttccaatcaggatgtagaagactgcccgagatgggaatacccagcaagaaggcagactctagacagagataagaggaggtcctaaaaactgagccctaattaagggcatttccctgcgatgttccctgggaatgatgaggaaacaagacagaataaagctaaaccacgccctcaaagttgtcatgaaaccaaaatcttgccccaagtccctgattaatgtttgaaattgtgaaaggcagcccatcgcccttgttgccgccttccccacagatccctgaggcagagattcagaaagccctgctttcctcagtcatgttggggggacttgcaagatctcagctgaccagattccatgctccctgtggagccatgaaaatggccc

SEQ ID NO: 474661 - DNA, 659 bp, Homo sapiens
tgtctggcacatagaagccacccaatccatgtttggttcagtcattcgacaagtatttactgagcagctgctaagggtggaaagggggcctcggggcaggagccacgtgacaattaggaagcgaaaagtggttgagagagaggacatatgcaggtgagagggagcaaagagcctgtcctggggaggaacagctgctgggagtcaggacgagggcagccccagggagagtggcctagtggagccagggagacctgccttcaaccccagccctacggcagaccagctgtgcagcacttgtactccccacaactgtccaaaaaccaaggaaagtctgatacattttcacagccaagaggaacctacagagccgtgatgactatgtggtattccagatgggctcctggggcaggaaagagacattcagaaggccaggagattgggcaggttcaggacctcggcagcaataatgaagttgccatgttgtggtcctgctcagggcatgtggatgccacggggccagtagagccaggagagcttcaagggagagctcttaaagtttggtcacccctatggagcaggcttccagtcctctctgccacctcctcattgtgggacagtcccactgccttgcctctctagagcatgattttcttctctgt

SEQ ID NO: 474662 - DNA, 679 bp, Homo sapiens
gctgcttaatgtttccgagtctgattttcctcatctgtgagatggcgacagtgatcctaccctgtgtagcatccagctccacatgggcatcctcacatcccattgctttggttaagtttttctggtcaaagcaagtttccatcttgaactatcatctctgccatcagctctcgctttgcatcccctccaaactctcaaaggatgaacaattttctccatggagtgtattcaagagaatattccccaggggtcattggcagctgccaaggatgtctttccccaacttttggaaaaacagtaatattggctggtacttaccagcaccaactgtgtgcagacactgcagccttcattatgccatcattgtgctgctgctgacactattttgggactgtgtctcctgtgacagtcacagtgccaggcactttgtgaacaccgtcttgacgccttgcttcaatactatgatcaccatttcacagctgagtaaactgaggctgagtggaaaactgacttgcccgacgtcacacgactggtgagaggttctgcgggatccctaggcatccgaacaacctgagtgtcctttttaataccacattgccattagtgatgacaatggagtctcactccagcggagtatctcagtattgctgcattgatcacagtgcctaatattttctgt

SEQ ID NO: 474663 - DNA, 561 bp, Homo sapiens
tcctgtgttctggggcagagtgaggaacagcagcggatgcagaatgaagtccatgcatcttctctttcaaggggctggcactccaatgggtttttgtttgtccttgcggctgccagaaggcctttttttgtcttttcctcctcaagaggctagcagaacttggaaacttggagtcttgagagtatgtattttgttacctttggggcagatggaagaggtccctgttcctgaaagcttacttaggagcctgagggctggaaggaggttgggggagactaggaggtgttgggaggtgctggaaggaggttgggggacactgagagcggttgggagggggctggaaggttgggggaggctgggaggggttgggagaggctgggaaggggttggggacactctgagggttcacagtatccacagagtatcacacttattcagcacttcctttgtgctgagcactgtgccaaggatttgatatgaactcatttatttttcaatctgaccctatgaggaggacacaattgttttcattttatagataagaaaatggaagcactgagc

SEQ ID NO: 474664 - DNA, 485 bp, Homo sapiens
ggcgtatgcttttgagtgggcaggcttgcttatggggtggataattcagacagggggatgccttccacagtcagaatcctgttctgctgtgtttttcaggtgcagcaggtggtccaggaggattgccaaggaccaaaggcacctctcccaggatgctgtgatgctggtggccaagccaaccaggctcaggttccccttgtgcgtgatgctactggaacctcctagccccagccgattagtccagcgtgggcgtctgatggggcagctttcaattcactggaagcccagcttggagtggcaggtgtctgaagaacagcagatggattggcagcaaagtgtggaggcccaggcaccaagccccaggcggggagagggttggggttcaagtgagtgttcaggacagtacgaaggacacgagaccctcgactgcagcaggctcaacctactccaactttctccttgataagaatcccctgggggagggc

SEQ ID NO: 474665 - DNA, 660 bp, Homo sapiens
tccctgcaagggtatagcctttgggatgtgactctgggcaggcttcttgatctcttgaagtctcaactataaaatgaggttaataatactcaccaaactcagaacctggatttgctggcactgtctttgtatatatctaggagccatggaccctggtcaaactgttttttcgaaggctaatgtcgccgatcacaaaggtccttatagaagggaggcaggagagtcagagtcagagagggagatgggtaggtggaagcacagagagagagaaaagaagaataggaaggaaggaaggaagaagggaaggaaggaaggaaagaaggagaaggaggaggagaaggagaaggaggaggagaagaagaagaagaaaaagaaaaagaagaagaaggagaaggaagaagaagaagaagaaggaggaggaggaagaggaggaggaggggaagaagaagaaggaggggaagatgaaggagaaggaggggaaggggaaggagaaggagaagaggaagaggaagaagaagaagaaagaggaagaagaagaagaagaaagcgggaagaggaggagaaggtgtagaggagaaggaggagagagagaaggggaggagggagaggaatgggaagggagggggagggagagagagagatttgaagatgctgtgctga

SEQ ID NO: 474666 - DNA, 746 bp, Homo sapiens
agatttcacaggatgtatgaaaaaggctggtatacaggcagaagtctgctaaaggagttgagccctcacagagagcctctactagggcagtggaagggaaatgtgggtttggaggccccacacagagtgtgcactgtctatgaagctgtggaaggaggtcactgccctccggaaccccagaatggtggtagatccactggcagcttgcgcccttcacatggaaaagccacaggcactgaactccaacctgtgagagcagccagagaggctgaaccctgcaaagccacaggggtggaactgcccaaggtgttgggagcccatcccttgcatcagtgtgtcttgaatgtgggagtcagaaaagattattttggaactttaaaatttaataactaccctgatggatttcagagttgtgtgggctttagcactggcctcactggagccaggacgtatcctaatgtggaaggcagggacctgctctgctattgacatccccatcttcaatgccttaacatatgttttatatttaaaagggacttaataaatattatttattttcacttataaaatacaatttatgatgtattaaatatgtattttgaaattcataagcattttatttacttttataaatattgcatatatgtttacttcaataaatatttaaagttaccaagtaaaatgtactcagtaaaatccccccctttcaaagttattctccagactataaaaaggtgtaacttgac

SEQ ID NO: 474667 - DNA, 487 bp, Homo sapiens
aataagctcacaactcaagccgttaaagatgtggaaaagaggagtgatgtcagctgatgtatatttcggatggaagcagagggaccacttaggaggtggttttgtcaagggcattccagagaaacctgaaaaactcgttcaggtcgtgatgggaaaggggacatgcttcattacaccttcctctctctggaattcaggcacaactgaccagcccctgcatgaagaccccagggtgggcaccacagccctttacagtcacttagcacctgctgctgaacacgagcatgcagacctggttggtgctgatgatatgataaagctcagcacagaaggccttcaggtccagtaccctggccttgacctccccataggctgtcttatctcacttttgcaccaacgcctggtaatccattacatgggtctccttggaggccttggccacagcatccccgtgttctgagaagtatttggaaatggttgtctggac

SEQ ID NO: 474668 - DNA, 2183 bp, Homo sapiens
agacactttatataattctcccatttaattctccccactacttaataaagcaggaagaagtccttgaatttgttcgtgtgcttttttttttttttgtccccttctgtgggcccggctcttaggtgtttgaccttgtctgcgcgggtcccgcggggtctggggttgtgagccgcctgcgcctttggggtgttgggccacgtccttgctttcgggggcctgcctcgcgggatgagaaaagatcttagtttatttacattttctaaaagatacacacagttgcaaggtttaagaaccactgagactatagatgttgtgatatctatttacctcactacatattctgggtaccacaaagataccagagatttcaaaatagaaaatgtacgcctagccttaacattggcccgtaaaactcctcaaattgcatcttgtaactctttttcaagtgagtccattgaaaagttccagtgcaaccaacaatgtggctgccgtagacatgaacgattgggggacatggtgatgttgattaaatttaagtctgatcatcgagaatgggttcagggagctagattcttctgtgcccaatacagtacatatttgcactttcctcagatgctgcgttggaaatttaatgttagttttatgtatttgtttgtgaactaggtgttttccaatatcctgagagactgctaaaaaaaaaatacaaacacaggtacttgtacatagtggagagacaaatagaccaaaacagcactgtctaatggagcatttggatgtattctgtatctatgccattcaatatggttgccactggtccaaatgagtaactgaatttttaattttattttattttaattttaataaatttaaatttaaatagccacacatagttaacaactatcagacaggacagtgcagctctagaatatgcctttctagttatcacatccagcagtacaatgcaatttcataaactccaaatttactattttggaaaccacagtcttttcacatggattgaactagtttaccattgacatttgtactttgaagaaaatgtcagataattgcattaataatgtaaaaaccattatagattaaaagtttaactttcataagggcatgagctagttataagaactagcataaaactattagaattatttataaattaatatagataattgataataaatttgttagataatgaatcacattagtgattcattaatgtgaagcaggtctaaaggaaacttgaagtcatcctttatttatttatttaaactgtatatgccagacacaggactagtgctgcagatttttaaaaaagactagccatcaagaaactcatttatatttttaaagatatcatcagtgctttatctaatgtattttatatttcatactttttatataaataggactgaacttttcccaaattagtacaaaataatgatgtttttaatattgtatttaattgaactttgcagtgattattatttatgtgactataagttattttagtatactatattaccatatagtacaatcctatggtatatctgtatgtttacaacacatatataattgttttaaattttctttacagatttaggtaacagttaaaaaaattttccagtttttaaaccctgatttagttttttttacagcacatagcatttatatattaatataagtatatatactaatataaatacggcattacttataattggaaaactcacaactttttgtactttattttgaagagtacatatttgacaaggagtcattacagaagatgtgtcccatgctgaaaacaatttttttcctggcagacatgtatatgaaattgaaaatatgggctttactcagtatgcctataaaaacaaagaatgaatatattaaacagttttaaaacttctaaggaaatgcttttgcaaataaatacaatcctagaaaggatgtaatatttgagaaaagctctgatccaaaagcatgatcagagattttcaagtagagcattgaattagatttctaaataccgccatgtattctgtaaacagatttagctgacaacacaaattaaattggaaaaactgaacatctcagttatgtcaatttgctcaggcctcaaagatatacatctttgaagtaatgtttaagtcaatactacggaatac

SEQ ID NO: 474669 - DNA, 1477 bp, Homo sapiens
ggcgcgccttcgccgacaccatagaggtgggcctctggcgacgtcagaggcgtgggtgttcggctacgtcactggggccctacggtgcctggagctgggcagtcttctcgtcagagtggggactggtaagagcgacctccccgccaggtcctgtgtgttgccagccgaagaagggtagctgaaaaattcagacccagcacagtgtttatgttggtcaaaaatagaaaactatgtctggcgccgccgaggcgggaggacccttcaggccaagagcagcctagcaacatggcgcaaccccatctctgtagtcctacctcagctccccccagctgaggggggctcagccccccagccctcaagtatgaacccaacggttcaaggctccagtgagctatgatcccatcacagcattccagcctgcgagattgaggacacaaagaccaacgagccaccacagccaccagtcccagaacccgctaatgctggggaacggaaaatgagggagttcaactctggcaagttctcagcgaaatccacgaccttttcctttatcttctggactctcaatgtgactgatgaaagttaccacatgctctgcagggggaaatggtttagcatgtattactacatcttaatcacatctttgtaaagccaggagcattttgaaagtcacgttacagacattcagacattgtttaaacatagtctgtatataccaaagtataggacgttgtatcatctcatattaattagttagttggctcaaaattagtgctaatgacttagtaattcagtgatttctgttagctttaaaacctttatttcagaactatttcacctcttggttttcatttttgctgtgtgtcactgcctgccagctgctaatttattaactcccagtgaatcacgtgtcctgtgaagggactgaatattagtggcaaattatgttgatgatttatattttgaataaatacagaccgttgtctccttctaggccctcacaatccagtggaggagacgaaactcatctgcctctgtccctctgggcacgcctcatgccaggtgcatctgtggacaggggccatgctcctgggcttccaaagttggagaaagctgccaggctcaggtgggtacatcacagcagctgctgccctctggacacagtaacaaaagaacactctgggcctggagccctgggcctggtaattggctggctctggcctgcatctggccccgagggtgtaggctgtctcctggttgtccttctgcctcgaggcctggctcatgctgctccccctcccactcaccaagacccacaaggaccactccacacccagctcagccccatcccctcagatagtcctttctctttcctcaggtggccaggtgcatatcttggtgtgaggaccttcactgtatctgggaatgcctactggtcacctcggtgacagagaccaaggcatttacctgatatgag

SEQ ID NO: 474670 - DNA, 1408 bp, Homo sapiens
gctgctcactctttgagtccacactgtgtttatgagctgtaactctcaccatgaaggtctgcagcttcactcctgaaaccagcaagaccacgaacccaccagaaggaaaaaacaagctgcgagaccaggaagaaactccgaacacatccgaacatcagaaggaacaaactctgcacacgctgcctttaagaactgtaacacccaccgggagggtccgtggctttgttcttgaagtcagtgagaccaagaacccaccaagatctttcgctatgcgagaaccttttggctctcgtatgtgcgcatgcgtctggatccggagccaggtgacccgctcagacgtggaccatgtgcgggggaggggggaaaggagccgcgaagggggtggtagacggaacaggtggagccgcggcggggctaggcggggcggggagtgaaacagcataggctccgcccctcgcggcgcttcccccggaatagcgtcatcagttctataagagagcgtgtgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaactgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctaggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggctactcattgttccttga

SEQ ID NO: 474671 - DNA, 441 bp, Homo sapiens
gtctccagtcctgcaccttcagtggggcccaaaggagggagagactaaatggataaacagattatagggactgatctcactgggaaggtgacagggaaggtttccctggagaagggagaccaggagggaatactcctggaacttgtaggtggacggggagacgcaaaccatgccaggtctattcctgtcatcgtaaaggccacactttgtcccattcccctgatgcacagcacatgggatatttactgtcgtattagcaaaagcaagtcgtacaagctccaagtcaatgtgggtggggactggacaagagtatggatacaggaggaagccctggctccattggaagccatcactgtaactgccaacccacaagggaagtacatcttaaatggacttggacaccctaagctcagtgggatgcaaaccatgtgaatcagagtt

SEQ ID NO: 474672 - DNA, 810 bp, Homo sapiens
caagggccccgagggccaaatgcagcatgccacttccttttgtaagtgaagttttattggaacacagccatgcccgttcatttatctattgcctgtggcagcgtttgtgctacagtaacagagtggagtactcatctaaaatacgtgctgtctggccctttacagggcatagtttgccatcccctgcgttgtatgctggccatagtggagaagagagcgcaacagagcaaagcagtggggaggccccaggaaagcccccgatctgtcacagccaggcccatgtaagagagcatcctaaagtttcccttgctcctgcctccaaaatgggcacaaaatggccaaaagagggccgcagacctgagcagagcttgaggttgggacaagaagacacagtggagatggagggctttctaacaatggaggacttggcagcctccaagtatggcccctgggtgccactacgcataggtgctgatggccaaagaccaggtctgcttcaggctaaggatgcctgtggaccataccaccccatccctctctcagtcccccagaaccccgttttctacacctacaccatcctatatttccaggatcttaccagcaaccccaagaagaagggaagggcatgaaattttgaattgagtgactgaaaccggcatgactgcataaacactgaaataccagacactgttcatttaaaatgtatatattaactcatttaatcttcataacacacctttaaggtacttacctattagtatcaggagcatctgtatttattaagcactaggtactgaataaatcatcatc

SEQ ID NO: 474673 - DNA, 699 bp, Homo sapiens
ctcaggcatggccggctgcagtcccgagccctgcctcgcaggaaggcaactaaggccgggcgagaaggcagctaaggccgggcgagaagcgccggtgggctgcactgctgggggacccagtacaccctccgcagccgctggcccaggtactaagcccctcattgcccgggccggcagggccggccggctgctccgagtgccgggcccgccaagcccacgcccacccggaactccagctggccggcaggcgcagtgcgcagccccggttcccgctggcgcctctccctccacacctccctgcaagctgagggatgccgccaaagtgggagcccaggcagaggaggcgccgagagcgagcgagggttatgaggactgccagcacgctgtcacctctcaccagctgtgcctgaagcagcaggcgctaggggatgcgtgcagcagccccatcaagggacctgggtggggcaccaatagcatctactacgggtggtcagaaaagcactagagggctcatctgccatctttcccacccatataactgcactttcgaagcatgagatatattgacattagtggggaagaggaaggagttgtcctaatatgggttactgaaatgttattggcccatgttaaatacagaaatggagggtttagaaatgtttaaggtgattttactttgccacagtgtccaagcacctg

SEQ ID NO: 474674 - DNA, 794 bp, Homo sapiens
gtggcctgtgtcgtgctggacctcctggcctccagtactgaatgtgtggcccattcttccagcccaggcagtgccccgagtgggctgcagccccagagctctccccgtatcccccaatggctctccagtctgttcctggggaggtccagcccttgggcgtgaccgggcggtcaccttgtctcataacagcaagctcactgctatctatctctactctcatcactccccagcacacctcagtccaccctacatacagtatcgtctccagtcctgcaccttcaggacacacctgtgagtgccacatcggggaagaatgtttgacatccctgaactcatgctactcagcagcagagggcctgcagcatggtcgttacttattaaatatttaagttcattaacacacaagaaaagggctcctgaaaatagtctggaagcactcaggaccgactttatctctttcccagttttgccttgggccagctgtgtgctaaatttattcacttatttactcagccagtcaataaatgcagctctgtaaatcatgtgattgttattattgtaaacagtgtttctcaaaaagcaagtggaaagggcaattcctctaatgctttttccctaagagtttttgttccaagtagaaacttcaatgcccttatccaatcagcacaaatcccaaatgcactatctggccaagcgcatcgagtttttagctcgccaccccctccagaagtttggagaacatttccctgaagaaagccctacctcatcccttaagtgcattggcagttgcttac

SEQ ID NO: 474675 - DNA, 922 bp, Homo sapiens
tggagtgggtgggaggctcaggcatggcgggctgcaggtccccagccctgccccgcgggaaggcagctaaggccctgcgagaaatcgagcacagcgcaggtgggccagcgctgctgggggactcagtacaccctccgcagccactggcccgggtgctaagtctcccattgcccggggccagcagggctggctggctgcttgcagtgcggggcccaccaagcccacgcccacccggaactccagctggcccgcaagcgcggcacgcagccccggttcccgctcgtgcctctccctccacacctccctgcaagctgagggagtgggctccagccttggccagcccagaaaggggctctcacagtgcagtgggggggccgaagggctcctcaagtgccgccaaagtgggagcccaggcagaggaggcgcccagagcgagcgagggctgtaaggactgccagcacgctgtcacctctcaacaggactcacatgatttggcattagtttcaatactggcaaaaagtaaaaagaccaactgtatactctagatttcagcttgttacctattgattttagctacaattttagatcattctttgaaaaactgtaacatgaaatgactgtagtgaaagtcctacatagttactatacctacatattcataatctatcttattagagattgaagttttagagacttttaatctaccaagttttttttccttattcatcaagggaagccaagtagattatcgatcttatttaaatgtggaaagtgatcatttcagctgttcactgaccgtagctgccccctttttggtggaatttcccttggctaaacagtagccacctcaccagggacacttcatttcccaaaatgctgatgcaacctgccgccagctaatgaccaatggacatgggttata

SEQ ID NO: 474676 - DNA, 499 bp, Homo sapiens
gaacagccagagtgaagagcaaaattattagtttttttcctatgaagttgtttgagctccttatatggagctcaacttgtattctggttatggatcttttgtcagatgggtactttgaaaatactttctcccttctttgccactcttttgcagggctgctggagtttgctggaagtccactccagaccctgtttgcctgggtttctccagcagaggcagcagaacagcaaagactgctgcctcctcattcctctggaagcttctctgctgaagctgtgcccacagccaccccttccccaggtgctctgtctgagggagatgggagttcgatctataagcccctgactggggctgctgcctttctttctgagatggcctgcccagagaggaggaatctagagaggcgatctggctacagcagctttgctgagctgtggtgggctccactcagtttgaacttcctggtggctttgtttatgctgtgaggggaaaatcacct

SEQ ID NO: 474677 - DNA, 1338 bp, Homo sapiens
ctcgcctgatttttggttcttatgaaggtgtttttattttctgtgtaggttaacttggtgttaacggcagggggttggcttgagtcaggctgcgggaagaagacaggcacccccatcaaacaggcccagcgcacctccttcttgctttaagtgtgcctgagtcagagagttggggatgagggagaggttaagtgtggacctaggttccaccactacaactggcttccttctctaagtttgaatgtgattccctaactccctacaatgtccgaatgtcttggcgataatggcagctgtagcaagcataggaccacagccactgcttatgcgattgtgcagattccccaaccagtggagcatcctagcatggggaatgcccagaggaagagcagtgcccaatgtttaattaccttcagcagtagtttttacccgtggctgcacattagaatcactagagaaggagatgcatcagaggaaggtacctctgctggcttagaagtaagcaaagtttcagtcttccttttccaggatcctgtggtcttcatgaacaatttctactcgggccatagactccctaaagaacaaatatataatttgcatgcttggagcagtggtagactgcaggtccctggtgttacatgtagtttttggaagagaaccatgaatctatgtgtaccaagcattatctgtagactaaatgaattaataattattgcacaaatttgtactctgaaaatatatggaaatccattgtaattaaaggaacatttatttcaatgcattacttaataattagtagctctctgccatgtattactcaaagagcacataccacaaacagcaacatctggacgttttgttaggatgtttgagtcccttggtaatttactaaaattatatctaaaaaatcatttcagaaatctcctctctctctttatgttttcatcagaaaatagatagagctactggcctattcaagaactataatcaagaactgttgattcaagaactaaaagcaagttttagcttgaatatatcaaacgtttttaatattttaatatttttagtattggcaaaaactaacaaatatcagctaaaaacaaagcaataagtaggaagtatacaaatataaaataggctaagatgagagatgaacattattacctagatataaaatgcagattctgaaagtagtcagacctacgtatgaatagaaattaccaacttgtgtaaactctggcaagttacttaagccctctgtgccttcatttctttatcttaaaatagttataataatacttctttgttgtaatgtttcaaggattaaaatagatctgc

SEQ ID NO: 474678 - DNA, 828 bp, Homo sapiens
tcctccccagccatgtggattgtgagtccatggaacctctttttctttctaagttacccattctcagatactaatgatactagttaatgtagaagtagtagaagtagaaagcaaactaaaaatgaaaatcagagaagaggtttggaattttgaggacagtgacatatctgacagtgatcaaggaaagagggccaaaaaagaaaatgaagccaagaaacagattcaaattataaggcagcatgggggcccacttgagctcatagttgtgaatttagtaaaactagtcatcatggttatacattgtactttagccctgttaagctgcatgagaatgaatgtgactgccaacaaaggaagtatacaaataaacaaatatgttcttgcaaaaaacaaaaagtccagagaatcgaatgatcagtgcctcagtcgttacttccttttcacttatcatttcaagctgcgttattttgatggcttttcagctgtgagactacttggtactgatgcagaaataatgaaatactgaaaaccccaaacaacagaaacgtctataactggtaatgggcatcctccttcagtttattaactccagctgtgctgtttgactgttttttgtgaagaggtgccatatgagttgaatatcgaatggaagatagaggatctaatgtcacaagcaactggatcacccaaactctgtattacaagacaggcagtttgaggaaattgccctactttgaaacacagttccatgctcatcaagataaaatgtgaccaatataaattccttttggtggaggtgtgtcaccttcagtgttcacaatgacactc

SEQ ID NO: 474679 - DNA, 1016 bp, Homo sapiens
tgtcatttcaaagacggtgaggatgattgaccttcataaaatagcatctggatagaaacttggaaaagttcaaaaacaaagccatttggatttctgaggaaaatcgggacactgccacctaaacactgtgcttttccaatggtcttagcaaacggcacaccaggagactatatcccacgcctcgctcagtgagtaccacacccatggagccttgctcactgctagtccgagatctaactgcaaggaggcaagcctggctgggggaggggcacccaccattgctgaggcttgagtaggtaaacaaagcggccaggaagctccaactgggtggagctcaccacagctcaactaggcccgactgcctctgtagactccacctcttggggcagggaatagcctaacaaaaggcagcagatacttctgcagacttaaacgtccctgtcagacagctctaaagagagcagtggttctcccagcacggtgtttgagctctgagaacagagagactgcctcctcaagtgggtccctgaaccccctgtagcctaacttggagacacctcccagtaggggctgactgacacctcatacagccaggtgcgccttgagatgaagcttccagaggaaggatcaggcagcaatatttgctgttctacaatatttgctgttctgcagcctccgctggtgatacccaggcaaacagggtctggagtggacctccagcaaactccaacagacctgcagctgagggacctgactgttaaaaggaaaactaacaaacagaaaggaatagcatcaacatcaacaaaaaagacatccacaccaaaaccccatcttgcctcttctcctccaaaggattgcaactccttgccagcagcagagcaaagctggacggataatgactttgacgagttgacaggagtaggcttcagaaagtcagtaataacaaacttctctgagctaaagggggaggttcaaatccatagcaaggaagctaaaaccttgaaaaaagattagac

SEQ ID NO: 474680 - DNA, 595 bp, Homo sapiens
ttggtggagagtgaggaaaatgccctgagagaagcagacccgaaataaccatttgagggcgggtagatctttctgaggtgatttcaggaaatatgcatagggaatggaaaagtcagatggaaagggaagtggccaagaagcgtatgtttctaagcaagttaccagcgtggaagctggagtgtaagccctccagggaaactggggacacaggggacagtaattccccagcaggtcctgcctgccacacaagggcagagaaagctctcaggcaaagctatggtggcagcgggaagttgggccagcgtgtgctgaagtgggaacacaaagtgctcagcaaatatgatctcattagtgctcacgacagccctgagggaagaagttggcaagaattcccaccctccttggagaggagacagacaaatggatcaaaatctgaattcagacccactttccggtcaggagcagggtctgtcagcagcattctgtaccttcagcttctcatgccctcttatcaatggggctggacaaatgaagggcacatttgtgacctgtggtgaattcacagaggcgggacattggatagttaccataggaa

SEQ ID NO: 474681 - DNA, 1202 bp, Homo sapiens
aaacggaccaatcagctctctgtaaaatggaccaattggctctctgtaaaatggaccaatcagcaggatgtgggtctgcagtttcacttctgaagctagtgagaccacgaacccaccaggaggaacgaacaactccagacgcaccgccttaagagctgtaacactcaccgcgaaggtctgcagcttcactcctgagccagcaagaccacaaacccaccagaaggaagaaactccgaacacatccgaacatcagaaggaacaaactccagtcacgtgtcctttaagaactgtaacactcaccgccagggtccacggcttcattgttgaagtcaggcagtcagccatacctcttcctgaggtcactacttacgatggcctcctcattgctctctctgtgtcagtgagcctgattcctgtgtgccttctgcacacaaaacagccaggaggatttttcaaaaagtgtgaattatatcaagtcattccccaactaaaattctataggaacttcccttgtgcttagggtaaacctgaagttcttactgtggacatatgtctactcacaaactgtgaagtggttattgttagtatagaatctaaccgggggattgtattaatctattcatttcttcaactttatggacaaaagactttcagatgattgctgaaaaccaagaaaagctattaaaaagcaaacttgaaaaggattatactcttgttgtagtaattccacccctggttaggaatgcatacttaataactaatcagaagcaggcaagttttattcacacagacattaatcatcaagtaatttatgatagtaaaaaaattggaaaaaaaagagagaaatgattaaacacccagaattatggtacatccataaaattgaacattatactgccattaaacagtgtgtttccaaaggatttttagtgatctgtaataatgctcatgttatttgtgaaaaagctggatagaaaactgaaaatataccaagatcttaaattatgtaaagggaaaaaaacctcacacataaatagagaaaaaagaaaggaacatattaaaacaaactcttcagtgattgtatcttgagtgccttttttgttttttataatttttggtattttccaaattttctacaataagcatcttttacagtcagaaatataataaaatattttcaagttcgagattttagctgtgtt

SEQ ID NO: 474682 - DNA, 1487 bp, Homo sapiens
ctcccacttatgagtgagaacatgcagtgtttgtttttctgttcttgtgtttgtttgctgagaatgacggtttcagcttcatccgtgtccctgcaaaggacacgaactcatgtttttacagctgcatagtattccatgatgtatatgtgccacattttctttagcctatcattgatggacatttgggttggttccaagtctttgctactgtgaacagtgctgcgataaacgtacgtgtgcatgtgtctttatagaatgatttataatcctttgggtatatacccagtaatgggattgctggtcaaatggtattcccggttctagatccttgaggaattgctacactgtcttctgcaatggttgaactaatttatactcccaccaacagtataaaagcgttcctgtttctccacatcctcgccagcatctgttgtctcttgactttttaatgatggccactctaactggtgtgagatggtatttcattgtggttttgatttgcatttctctaatgacccagtgatgagctttttttttcatgtttgttggctgcataaatgtcttttgagaagtgttcacatcctttgcccactttttgatggggttgtttttcttgtaaacttaagttctttgtggattctggatattatctctttgtcagatgaatagattgcaaaaattttcccccattctgtatgtttcctgttcactctgatggtagtttcttttgctgtgcagaagctctttagtttaattagatcccacttgtcaatttgggcatttgttgccattgcttttggtgttttagtcatgcagtctttgcccatgcctatgtccttaatggtattgcctaggattccttacacaaaaattaactcaagatggatgaaagactttgattcttgatggctcgttctataagcatccagtggcatgacacatccagcaaagggatacttctccgttcattgccctgatctaccaatgaaggaagaaaatggtcctggaattgaaaaagggcctggaccagccatgcaagcagctcctccaggaacttcaacctgtaagttgtctctggccctccatgagccagaggtgtcctggaggggttatgtgcgtacatgcggtattgcattggcaggagctacagcctgcccttttgcagctcctagctataaggatgaagaactggatgatcaaagggatgtggctggagaatctggttcctgcccccctggtggtaggggatcagatgctgaagattttagccatgggggagagtgtcccctttgcattgcttcggatgtgcaggatgatgatcccattgcctgtcataggctaacctctgagcatccatgttggagactgaatttgctgttggctgaactccctgttcttgcaggccgcctgcactgagtcctgtactcaacccaccctctgaccttcaattctgtcagacttgagttacttgtgcatgaagagagctg

SEQ ID NO: 474683 - DNA, 471 bp, Homo sapiens
atgatgacacgatgctcattcagaccatcagctgcagacggattgcagaaatacgtgagggctgtgtcctcagaggagaagtctgctgtgtcctactaagaagattttcttcactggttaaagatgagagacacatcaagaaaagcccccttgacatagcttcctccatcttgctcctggagtctgaacttggtcatgatggctggagctataacagccatcctgtgaccatgagtctccaagggtataaagcagtaatattcaggaaggtggagcctttggacaaaaagataaaaggaatctggggcctcagctacatcactgagcctttccaagcccttgccttcttcctcttaaatcctgttatgttagataactaaatgtctttattgcaaaagccacaagtagtcaggctttctgttattcacagctgaaagcatttcccttattttcaaataatttcagacttat

SEQ ID NO: 474684 - DNA, 813 bp, Homo sapiens
agggctgaggaggtgtataatagaaatgaaggcagacctttctcgcggaacgttttaaactgtctgtgcatggtgctatgccaggtgctttcctcctggcagccgtcatcattcctgggcttcctgggcttgcggccgtgtcactccgatctctgtctctgtcttcacatggctgtaccctctcctgtaaagagtgtcaagatggcaagaggtacgcaaaggaacagtctggcataatcatcttgagagagaaaggcagtcttgatatagtggctttgctgagctgttgtgggctctgctcagttcaaactttcccgtggcttcgtttacactgtgagggtaaaaccgcctactcaaacctcagtaatggtggatggccctccccccaccaagctcgagagtcccaggtcgacttcagactaccatctggcagcgagaatttcaagccagttgatcttagcttgctgggctctgtgggggtgacatccactgagctagacaacttggctccctggcttcagccacctttccaggggagtaaacggttctgtcttgctggcattccaggtgccactggggtatgaaaagaaactcctgaagctagctcagtgtctgcccaaatggctgcccagttttgtgcttgaaacccagggtcctggtggcataggcagcctagggaatttcctgaacactaagttcaaagttgccatcaagggttacatggaaagaaagtcctattaagtataagacaaacagagacattggaaaaaagaagactgaataaaataagcagagccagtgcatgaaaggatg

SEQ ID NO: 474685 - DNA, 1148 bp, Homo sapiens
aataggaacagctccagtctacagctcccagcgtgagcgacgcagaagacgaacgatttctgcatttccaactgaggtgccaggttcatctcactggggattgtcggaaagtgggtgcaggacagtgggtgcagcgcactgagcatgagctgaagcagggcgaggcattgcctcacgcaggaagtgcaaggggtcagggaattccctttcctagccaaggaaaagggtgacagatggcaccaggaaaatcaggtcactcccaccctaatactgcgtttttccaatgatcttagcaaacggcacaccaggatattgtatcccgtgcctggctcggagggtcctatgcccacagagcctcactcattgctagcacagcagtctgagatcaaactgcaaggtggcagcaaggctgggagaggggcgcgtgccattgccaacgcttgactaggtaaacaaagcagccaggaagctcgaactgggtggagcccaccacagctcaaggaggcctgcttgcctctctagactccacctctgcgggcagggcatcgccaaacaaaaggcagcagaaacctctgcagacttaaatgtccctgtctgacagctttgaagagagtagtggttctcccagcacgcagcttgagatctgagaacggatagactgcctcctcaagtgggtccctgacctccgagtagcttaactgggaggcacgccccagtaggggcagactgacacctcacatggccgggtactcctctgagacaaaacttccagaggaacgatcaggcagcaacctttgctgttcaccaatatctactgttccgcagctgccgctgctgacacccaggcaaatagggtctggtgtggacctccagcaaactccaacagacctgcagctgagggtcctgatgttagaaggaaaactaacaaacaaaaaggacatccacaccaaaaccccatctgtacgtcaccatcatcaaagaccaaaggaatgcagctcctcaccagcaatggaaaaaagctggatggagaatgaatttgatgaattgagagaagaagccttcagaagatcaaactactccgagctaaaggaggaagttcgaacccatcaaagaagttaaaaaccttgaaaaaagattagacaaatgac

SEQ ID NO: 474686 - DNA, 628 bp, Homo sapiens
cgccacctgaggtgagctttcaagattggagacatctcaaagtacagatataatcaagttatgatgaggtcatcttgggtgggctctaatccaatgacctggtgtccttatcagaagaggcaaatttgggcacagagatgcacaaagagaagacaatgtgaagacacagacggaagaaggcatgtgacaacagaggcagaaactggagtcatgcagctacaagccaaggaaagccaaagattgctgtcttttgaggagttatggtcgagggcgccactggagagactcaactgtgcccttatatcttcaggagcaggccctgaaaatggaaaagccagtcagttcattgatgggaatagagaaaaggggatggctatgggaaacattctaaaggaagacccctacagcaagttacggctagcaggattggagagatggaatagaatgagtccaagatggcccttgctgcatggctggagggtggtggtactggaagtgacaggaggttaggagatatgagtttggtgagaagagcatgggttctgttcagaactgtgcatcattcagagtttcctgggagtacttgagctcttgggaaggaagattagtgcttactgggaacattttc

SEQ ID NO: 474687 - DNA, 774 bp, Homo sapiens
ataactctagggtaaatgtccaagtgtgcaattactggtcatatggccccacctccaacaatggggattacaattaaacatgagatttgggtggggacacagatccaaatcatatcagtcacaaactcaaaaaatgttctagagccagacaactacatcctgcattttcagcaaaacctatcaactcagatgctcttacaaaagccaaatacattttggggccccatggctgacgtagcttatttgggaattgaggtagataaagaaaatggaagcaacagttctgtcagatggaaccggccgtctggaattatcactatttcttttaacgtgatggcctatgaagatgtgttgcttggggttgctgcagcttcttgtgaccgtgaaggggacatgaagagaattacagagaagcttgctcagaactttgatgttgttgagctgctgagttaatagtgcaattttcagacttattttcagacttattacctggggaaaaacacattcttagggtttaaatcaatttaaatttaaatcaatttacatatattttattgcttattctccatcacagcttaacaaatgtggataggatccttgatttttcatcctcttttggtgaatgctggtgctccttggcacaagtctctcagcagagactttgggaacactgattcttttgttttccctgaaaacctgtataagatgaaaacctgaaataagatgacatacctgtgatggtgaattttatgtgtcaacttggctaggctatgg

SEQ ID NO: 474688 - DNA, 440 bp, Homo sapiens
gagttaatgggtgcagcacaccaacatggcacatgtatacatatgtaacgaaactgcacgttgtgcacagaggaagatcagagaatgttttcatgacctgcttcaggggaaaatggcagtaaagaggactaagaaaccaattgtaataaatagctccaaaacagaaacgacatttaaaaaacgttggggccatcttgcatcgaagttggcattggggagtaaagcgacagcttatacttcctcagtcttcccgctagccccttcagcctggagggggctactagcttcttccaggtgttctggccacagctcaaaggaagcaaggaccgaatggggaggtggtgctccctgtgagctttctcgataccggctgtttttctatatgcagtgggtcagagcattgccgttcctttattattcccaaacaagcaaataaaatg

SEQ ID NO: 474689 - DNA, 669 bp, Homo sapiens
tccccgcggcagcagcatgatggcagcagccattctggacagcccaccactgccatcacttccagaagatcaaaccaactacaaccttcccttaagccaaagcctaatccagaccaaggccttaactctcttaagttgtctgaaagctaagagagatgtggtagaaatagcaaaagaactagaattagaagtgaagtctgaaatgggattgagttgctgtaatatcatgatcaaacctgaagggatgaggaagtgtttcttatggatgagcaaagagaacaatttcttgaaatggaaactactcctggtgaagatgccaaattaccaaaaccactccaatcttcagcaaccaccatcccgatcagtcagcaaccatcaatatgcagaaaagccctccatcagaaaaagagtacaacttgctgaaggctcagatgaccactagcactttttagcaataaagtgtttttaattaaggtatatataattttttagacatagtgctattgcacttagcatactatactagggtataaatataacttttatatgcatgagacaccaaaaatttgtgtgaattactttattgcaatattcactttattgtggtggaactgaaaccccaatatctctaaggtttgtcaaagatcagacagttgtaggtatgtggcg

SEQ ID NO: 474690 - DNA, 2033 bp, Homo sapiens
aatactacttcagtgcgtgattatgggcaagtctctttctatgatggctgagaaacatgaaaaagctgtagaagaaaaattagaagctagcagaggttgggtcatcaggtttaaggaaagaagccatttccataacataaaagtgcaaggtgaagcagcaattgctgatgtagaagctgcagcaagttatccagaagatctagctaagattattgttgaggagggggtgaaaatatcgacattaacaggaatttgggagaagtggattccaaccctcatggaagactttaaggtgttcaagacttcagtggaggaagtaactgcagatgtggtgaaaatggaaacggaactagaattagaggtggagactgaacctgggcctgaattactgcaatctcatgttgtcctttcaccccttccctcacctgtcctgtggctggtagcccctgacactgtgacacttattcccctcaccctggattcctcagaatctgtatctaagtgtcagaccagctagacagctgttggcctaaagaattctgaggtatgcattactaatctagttgacatccaacacggattctgtcatacagaatgcattcaatgtatcttttatgattgagaaaatgattataacagatatagctactactaagagctatttcttaaaatatttatttttcattgcatattttcatcttcacttgtcgttatgtaatattgcaagctaggagaaagcagtgtatgagagcttccaacttttacagtgtatgggagtttccaatttttacagcaaaactgggttttgtcaagttttagaacttggaccattgatggatatgaaatggcattcctttactgctttaattcataagtccttggttttagtaatatcaggaatgtttctctgtgtttactgggaatttgggctttcttttctgtgactttcttgtttgtattcaatactcattgatttagttgtttcttcttttatcatttatttttagtaatatttcatatattttgaattcacattcttgcctattatgtgtttgatatatctcattctaggtcatggcttctctttgaactttgttcaccatattttatattgaagaggcattttacatttaaatgcagccaaatacatagaatgttttctttcatagatccataaacatttcaattaactcccaattactagaatcttattatatggacacatatggagcgtaaaaagaatgtaaaggaatgtaaaaagaaccatcaagtgtattataggttgaataatgaataaatcagataaaggtgaagaaaaaggcataatatactttaatggggaagttatggaatgatttaaattggtttaaggaaaggagctatataaatgcaaggtattattaatcagaatgattaaaaatgtcatatattgttcagagtgcacaccttagttaccctttttgttttatatattggatattggggtgcttgatattttaaatatcacatactttccttgatgttctttgacattttctacaaacctagaatccatttttttaagcaggacaaacttagattgtgaaatgtcacttgctttactttcttgaaatgtataacttaagatacatgaggtatatcactgtggtgcatatggatacaatggatacttacaaaatacctgcttcaaaagcttaatactttttcttgtacctaaatagtagtggtggcatttgtcaaaattcacttcttatacaaaggaaaattaaagaaccaagagttaatactcccaagaggtaaatctaatgaagataagagtgaattgctattgctatgtcaagtaaggatggttttgctctttcatcccccactctaataacagagcattttagctaggttgtagcattcataatgtctttacttgtgttatctcttctgattctcagagctttgtgagattgactgcagaataattattatcactaatttagagatggaataagtgaggcttaaaaactgtgccttgtggttcc

SEQ ID NO: 474691 - DNA, 530 bp, Homo sapiens
gctcatgttgctgccttggagggtgcaagctatttcagaggatgtatgaaaaagcctgcatgtccaggcagaagcctgctgcaggggcagagccctcacaaagaacctctactagggcagttgggcagggagatgtgggattggattctccatacagagtccccacttgggcactgtctagtgcagctgtgagaagagggccaccatcctccaggtcctgtgaaggtagatccactgacaactttcactctgtgtctggaaaagatgcagacactcaaccccagctcatgagagcagctgtgggggctaaatcctgcaaagccacaagggcagagctttccagggccttgggagctcactcctcacaccagtgtgccctggatgattcagaccttagtggagaaggtgtagttgcatccaactggatggtggagaacttcactgggttgtcccaggcctgtgttttttcagtcatggattaaacagtaaatacctctgatggtatatggactaaggtagcaaaaagggaa

SEQ ID NO: 474692 - DNA, 680 bp, Homo sapiens
ctgctgtttgctctaaggagggtggtcttttgagctgaggaaaatgggttcctccacgctgatatgtatgagaaatctaaaaggcactgtgtgactggctgttgccaagaaagcaagcatagtaatgaggagttccaatcaaggaacctcttagaggcagtgaggtgccatgaaatgagcagtagccttggaaccagagacctgggcttccctgctatgtttgcccctttgtttactgtggaagctctaccatctagaaatccaatccccagttctcaaattctaccccgacagctgttcctcaaggctttcaaagcttcaaaagatggtgtctccagcagcaggtttaaaactccatgttctatggtagacagtaggcatgcagagaagatcaaaccaggtcttggacttaggagctcacattctgataagggaacgagtcaagcaaatgaaaatattatagttcaatgtaattgatacactcatggatttatttccaagaaagtccacgtggctggcctccttacattataaaaagcatattatgtttctattacatgcacatatgtgcattttgtgtatacatgcatttttgagtgtttatattgatgtacacatactcctactgtgagtcagttgaactgtatgatactgccatttctattggttaaaaaatggtc

SEQ ID NO: 474693 - DNA, 500 bp, Homo sapiens
ctttaggtaacctaatgactatgtgccttggtgatgatatttttgacatgactaacattcgtggaactcatagcaagaatacaaatggaagcacatacgtgggctcaggagaagacagaaaaatgtgggaaagtttggaactccttagagacttgtcaaatggctttaaccaaaatgctgatgatatggacaatgaaattcaggttgaggtagcctcagatggagatgaggaacttgttgggaactggagcaaaggtgactcttgttatgttttagcaaagagactggtggcattttgcccctgccctagagatctgtggaactttgaacttgagagagatgatttagggtatctgatggaagaaatttctaagcagcaaagcattcaagaagtgacttgggttctgttaaaggcattcagttttaaaagggaagcagaacataaaagttcagaaaatttgcagcctgacaaaataataaaaaagtaaattccattttcc

SEQ ID NO: 474694 - DNA, 585 bp, Homo sapiens
ccgaccttccttggtcctctttgtggtctgggaggaaaactagtgtttctgctgctgtgttggtgagcgcaactattccgatcagcagggtccagggatggttgcgggttcttgggcaggggttgtttctgctgctgcatcaatgagcacacctattccaatcagtagggtccagggaccatttcaagtaaatgatataatgacagctgaagaaagggacagattccctactggtcagcaagccatccccagtatggatcctcactgggaccttgactcagatcatagggactggagttgtaaacatctgttgacctgtgatctagaaggactaaggagaattagagaaaagcccatgaattattcaatgatgtccaccataactcagggaaaggaagaaaatccttctgacttcttcgagtggctatgggaggccttaagaaaatatactcccctgtcacctgaatcactcaaaggtcaattgattataaaagataagtttattacccaatcagccacagatatcaggagaaagttccaaaagtaagccctgggccctgaataaaatttgcaggcattattaaa

SEQ ID NO: 474695 - DNA, 539 bp, Homo sapiens
tccactaggtgaagccagctgggctcctgactccctgtcaaaatggaccaatcagctctctgtaaaacggaccaatcagctctctgtaaaatggaccaatcagcaggatgtgggtgggccaagggaagctgtgacagactgcacctggagaaacaggacactcctaaccaaatactgcactattcccacagtctaagcaaccatcagacctggagataccctcccgtgcctggcttggtaggtcccatgcccacagagcctgatccttgctcactgctagtgcagcagtctgagattgacctcaaggcctactgcctctatagatttcacttctgggggcagggcatagtagaacaaaaggcagcagacagcttctgcagacttaaccatccctgcctgacagctctgaagagagcagtggttctctcagcatggcatttgagctctgagaatatacagactgcctcctcaagtgggtccctgacccctgtgtatcctgactgggaaacttctcccagtagaggctgacagacatctca

SEQ ID NO: 474696 - DNA, 887 bp, Homo sapiens
ccggcctcttgtgccttgctcctgtcattcgaagctgcccatctgaagccctctagcctcaacctgaaggttattgccatggatctggcccagatgcacgcctgtcaaggacctggaaatgacctttacattgaagcatctgctgctctgtgtgcaggctctgatttcagtgtgtcaggaggactgcagtgggtccagcttgtagctcatggaagtgctggtgatgataatggctggctcaggtgccacaggcctccatggcaaggtttaggagacaatgaactcgatggttgcagtggagaagtcaatgtcagccaggatttctgtgggaaatacacagatgtggtcaaccacatcacacaacgactggactatgtactctgcagaacttatgcagctcaacgtacttgtcactcaggctctgttgtaaaagaagtgccacaacacttggtccccacacccaatgcctatctccagccagccagagacctgcagatgtgtctaaaacttttttccatcctgtccaaagtgctgctgaggccaaaggacaccatcacctcccaaaggcagtttcacagctaccctgagacagtgataaaggacatctgcaaaggcatgtgggaggacagccattgtgtcctgcctctgggtgctccctagctgcaagacaagtatgttttatcatattcacttgaccaaacccttaaatgccttttaaaggttttaatgttgtgctttaaaaagaaaagaactgtgtatgattccagagtatgtaagagaaatataaaatgtgtgaagtgttgtgttctttatctttcagtttatttaaaaaaatatagttaaatgacccaatcatttatattttctgtattaattttataggattt

SEQ ID NO: 474697 - DNA, 707 bp, Homo sapiens
cacgaggaccggggtgtaggtgtgggaaatggcacccgtggtggtggtgctcaccacccactccaagttcatggtctttaagggcaccaggaccatgctgacattgtcccccagctcccggaagctctcagggtacaccagatggtactgctctgaattccttgatggtattgttgatgatattgggcttcttctcctgctggagcctcagccaccattggtaggtgttgtcctccaagagcgcgttctgggcagtcagcagcagctgcactatctggttctccaagagctccaggaccatcttcttggggaaccaggtggtggccaccatggcgtgggagtagttcaggaaggaggtgaggaagatgaagagcacgaggaagaaaataaagtagcctattcttctgcaatccttaaagagctgataacgtctcttgataaagctttaaccagtgatttccattcccatccgaagaagctaagaggaagggtcttggtatagcagggagggaagctgtctctgccgccctcctccgagtgtggtttctgatgatccttaattagggctttgtctttcatgctgtcaccagagacatggtgggttatatgacaagcttgatgaaggccacagaaggttggctgtcattggctgtgtgactttagtggagtctcttaacctctctgagcctcagtttcttcatctccat

SEQ ID NO: 474698 - DNA, 3157 bp, Homo sapiens
aggggtttgtggccccttttttggccaatttctcccatttggaatgggaacatttacccaatgcttgtaccctcattgtatctttgaaattcatcatcaaataccattgtgtccactaatcgtaaggacagaacatctggacctgctcgaggcattccttcctcatccttatttaatgttggagaccacatcgattaatagtgaaacccagctggaagctggcctgcaaaggaatcctgataatactatccataacagtcagacaattgggcagagaagattgagcatggatctgttgaaaaagggcaacagaaaagccatccagagactcctttctattgattccaggtcagaatctggcaaccaattgccagtcagaaagtcttttaatccacctgtgaagtattatctaaagagaaaccagaaaaatatgggtcttgattcatcactgtaacaaaaaacagtcacaataaaagcaatgtaaacacttgaatcaagcataaataatgtccctgagagactaatactgaaatagttttcatctaaaatcccattatgatgggtactaagtaaattatatttcaactatgtgatggggaggtatagtctaccaaaataatatttataactggtttagtggcttaagtgataattttaaggaaaattatctgaataaaaattagatgcatttacctgtgatctcatactacatacaaataaacaggtatatgactgaaataaaatgaccatatggattttaccagtgcttatatctactcaggagagccttggtatcaacagtttttttgttaaaataaaaaataataataatcatacaatacatttatgtggagaaataaaataacaatatctgatgtggtacagatataactggctagttaattttattcttgcagataaacaacttgaataatgttccaatagagcaaaatggtcaggaatgtgttttctacagcgagaatgtgtgggcttaaacttttggtgttgacaatgggcaccatgaaagttacatttcagatggtcagaatataaaatttttgacaatcttggcaaaagtgagagtaagagatttaaaaaaggcagttatctgcttatgtgctgtaacttagatttcatgcttggatccttgaattttccaccaaataaagtagaaaaatttggctttgagtttccttaaatgcaatacaaactccagaacataatcagctctacattagtgctatttgaaataatgaataaataaaggaatagatgctaaatggggtatgactccattgtccctaaaaatatccagttaaaatatagaagctatatataaatttattttttgattattttatcaatctaacattaataaagtactaaagaattaagacatcagagcaagcgaaatttgatcagtaaaaataaatttggagaatcccaaggacagtttatattaactgcatacctgcgtagggaggcatatttaagtgtagaagattgagcacacttaaacaaaatgctatagggccggtcatgacttgaagcccagtcatcaaaaacttgagcatttctgcaaatcagtattagtatatttcaattacctttaatgttttgcttagttgtcccccttagatagttatatttgtacattttagaatttaggttaaaataaaaaataatacattcattttattaaaaaggtaaactaaagtcaaataacattttaaagagtttatttgagtaaacagcaatttatgagttgggcaactccaaagcagtaatgatttaaagtaaaggctctagtgaaaagtcacaagggaccggcttttacagggtgaatacagaagaaaatattagattgtttccaattataaagttaccttatttggtctatcttgctggaaagttgtgagttacataagtttgctggctgcttctgattgattgagcttaagttctgttaatatgataggatgctattctaaagtaataaataagttgttttctggttgttttttgatacaaccatttacaaaaaaaagctcaagttaagtttcacctgtatttgcaaaccaagtaagattaaattcacttgtgcagactaactagctttgtctgctcaaggattcttcatgtctggtctccattgtaacttatattagcaacctttatatatcatgaaatatgcactgaattctattctgaacattttaattgaaatacatattttactctgatattcactctatgatctattctttttttgtagattagaatattgaggtacagaaagacttagttacttgtccaaatcccggtggagccagcatttgatcccacaaattctagctgtagaaaacacattcctgaccactttgctctattcttgcattctattttattttactgtctgattaaaaacattggcaaaatgaagttctgtgtaactcagcatgtttgaataatgcatgctccttcgtacaaatttttagttacattttagggaattgtttgtaatgtagaataaatggaatattcagatgatctggaattagatatattcaatggttacaatcaaacaatcttgtatttttgaattttaaaaacctccaaaatctgtacattataaagcttttattttttttaaactgactatacctttttaaaagaaaattaagagctattttctagcttgcatttcaaacaacttgttgttttctcttttcaaattgttaaatttcaaagacctacttggagaacaaagcagctgttgctttagctaaaaatctttcagttcaacttcaacctacagaacattacccatgagattaagtaaagttctccctaacattctagtgtgttgaattagaatgtatctaataaaagaactttttcttagcattttagcaacctaaaaagaaaaagagagaactaaatatttttaatattcagtgtgatagttaatactgagcgtcaatttgattggattgaaggaagcaaagtattgatcctgggtgtgtctgtgggggtcttgctaataaaagaactttttcttagcattttagcaacctaaaaagaaagaaaaagagagaactaaatatttttaatattcagtgtgatagttaatactgagggtcaatttgattggatt

SEQ ID NO: 474699 - DNA, 590 bp, Homo sapiens
tctgctgctgccatcacaatacagatgaggaacttgtgggaaactgaagcaaaggctgacaatgcaacagaaaagaaaaacccattttctgggaagaaactcaagccagctgcagaaatttgcataagtaatgaggagccaaatgctaatcaccaagacaatggggaaaatgtctccaggcatgtcagagaccttcacagcagcccctcacatcacatgcctgaaggcctaggagggaaaaatggttccctgggctgggctcaaggtcattctgctgtgtggatagtaaggaattggtgccctgtgtcccaactgttccagctgtggacaaaaggggccaaggtacagctcaggccatggtttcagagggtgcaagccccaagccttggcagcttccatgtggtgttgagcctgcaggtgcacagaagtcaagaattgagatttgggaacatccacctagatttcagaggttggacggaaatgcctggatgtccaggcaatgctttgctgaaggggcagagctctcacagagaacctctgatagggtagtgtggaagggaaatgtggggtcagagcccccacacagagtc

SEQ ID NO: 474700 - DNA, 852 bp, Homo sapiens
cctgccttctgcattggtctccctgggagctgcagaccggagctccacttcccggagagggagaatggcagaagaggcttctgaatggcttggtcctgctggttctccgaggccccggactgcagacctgacttttcccagaagacacgatgcccctttgggagacatgaaattcacacaatatcccttcggtgtagcaatggaaagggtagaagtatgttttgaagcaaaagaggaggagagaagagaagacaaagaagagaagagaagagaaaaggagaggagaggagaagggaagagaagagaagaggagaggagaggagaggagaggcagggaggagaagacaaaaagagaagagaagagaaaaggagaggagaggagaagggaagagaagagaagaggagaggagaggagaggagaggcagggaggagaagagaagagaagaaaagagaagagaagagaagagaagaggtgactcactataaatccctttcacattgaatgaaattatgattttataaaattaggaataaaatactaaaagacctctcttacagatgtttatactgaaataaaacgtaggcagtttctagttaaaattcatcatattataattgtccagagaacattctataggttagagctgtttaaaggttgaattggacttcttcaggaggtatcttcccctttgtaatgtcgtattctagctctcccatcaagagtctatttatttatttgtgaatctgggcttggccatcttatttgctttgtacaatagatccttagcaaatgttgtaagcagaggtttgcaaactgcctgtgcattagagcttactcttttgataatctc

SEQ ID NO: 474701 - DNA, 619 bp, Homo sapiens
gaggctccagagcctgccgctgctgcagacactggagctcagagacggcatgtgtgggacacagtgccagctggcggctggagaaggctccctggagagtggagggggagccaccccagcagctgcccatgtctccccaagggcttggctttcgaagtggggagaccaggtgtcactcttgttgccgccagagccttctgcagacgcgccagttgatgaccaggcctcccctctacggctgctcccacccaggcccgagtacccaggccccggggcttctgaggctgcctggtctgctcagggccaagggtgcctccaggatgtcattggcatctttgtgctggggctggagctctgcagacaagtggcagggggccctgccctggaggccttaccttctaagcgggtccttgtttcccaagtcattcctgcccatcgcaccctccctacacccccatgccctaactgaaaaactaggtggcttgcctcagaactctgaacatatattcttctcagaccatggggtcattctcagggtatgcttcagttatgctgtttctctcagggtcatctaccacccactgctccgcaaccttccaaaaccccaggggtagctgtt

SEQ ID NO: 474702 - DNA, 701 bp, Homo sapiens
aaaccacgactcaccagtgtcatgttctggagattgcatcaacagcccgagtcggcgctctgccccgtttgcttagcaaaacttcctgtcaccttcattggattgaaggatgcaaagtattgttcctgggtatgtcttcgagggcattgccaaaggagattaacatttgaactgcaagttcttcagcttttggactcttggactaacaccactggtttgccaggggctctcgagccttcagccacggctgaaggctgcactgtcagcttccctacttttgaggtatggactcagactgatccactaccggcttccttgctcctcaacatgcagatggtctatcatgggactttacttcgtgatcatcaggggaatacatgttacatctatgaagtaaaccaaaatttactgtgcaccaaggcacagggcagcaacgataacagtggagaagaaccatactagaaacaggaattaaggttcagcaaacattttctatacttttagatcctttagaccatcgtgcctaaatttggattgtagacttctggtttccaggtctatgagagaatatattgttgtggttttaagacatcaagtttgcagtaatttgttacagctgccctaggaaatgaatatacttgattaaatatctttaaaatttaagtgtagcatataaattaatttgaaatgatgataatggt

SEQ ID NO: 474703 - DNA, 4218 bp, Homo sapiens
ctataccatacacagaatctcctttatccaatatgactggtgttcttataaaagaggacattttgaacagaggcacgtacaaaggagaagactgggtaaaaacacaagaagacagctgtctccaagccaagaagaaaagctgtccaaaggaaccaaccctgctgtcacttttactttggacatctagcctccagactacatcaatgaaagggcccatgacagcagaggtgatgcttgtttgtgccatggctgtggtctggtgtcctctggcactaggaacagcctcagagctcaagagtacacaactaaattggaagaaaggcctggcactgaatcatattttgaaatggggattactggagaccttcctgtttgtacagcttgcctcgttccacaactatacgcgaagaacaaatgtttcaaccactggaaagtcaggctccacatggagtaacagctgagtggtgggaaggaaggagacccctttattcatcgcagcatctccagacataacataatgcatgtagccaatggtactcaataaatgtagcattaaatgaactactatatacacctgaccccagaacaccttctctccctagtaaattgtgtttctaaagtcagaatttgtattatgcccaagttaaaataaatatttcagttgtcacccagaagtaacttttggtatatttttagcagttattacctaggcatgggcaaatttaaccatatgaagttaatgtcaacctacacagccatcaactgcattgaattttttgcatcaacatcaccacatatgcatttccacttaaattaacataacccaaaattgctttaagtgttttaaaagatagcaccccatggtgcagtattgaatgaattataggcctgaagaagattgccatcaaccaggcaaagcaactaaaggcagcagacatttcaaaatcgttcaaaatagagcgcagaaatgtcatggctagaagcccatgttattgaaaacaaccaagtttgaaaggacaaaagtaacagaaagatgagagacaggcaaattgacagaattgggcaagtgggcaaggagtgtagagagtttcaggggtgacatcaccaataaactgaagaggtaactaaaatggttaaagactgctactgtaaaacaaaacaagatagacttgtttctaaatgtataatataacataatacagtgcactgataatttaagaaatgtagaactataattaaaatatattaaaaatattcatctgcagctttcaaagaggtaaccacattttgtgaattcatcttaaaatattgacacaattggaaactcttactaaaacgcattcatgattaacattaagacagccagttatgggtaatggaaagaaaaccctttgttaataataaaacaaataatgaaggtaactgaaacaattacactatatattattggaaagatgaattaacccacatgtactggttgaacagtgtgtgtgtcattatgtggattatagaagtctgtgccatgttgacaagaaagtaaagttcttacctacataagattcaattgtaagtgaattcttatgatttgggaatggggattagcattaagctctgtatgtctatatctagaatatgtaaagacatattaaaactcaataatcaaaacataaataactctataaaaatcagcaaaaatcagaatagatattttcctaaagaagacacacaagtgtctaaaaagacacatgaaaaggtgctcgatatcattagcagtcagggaaaccttattggaaaccccaatgaggttctttacgcccacaaggatggctttaataataaaaaactgataattacatttgttggcaagtatgtggagaaattggaacctgcatacctcatcccagttgggactgccatgttggaagacattctggcagtcctcaaatggttaaactgtatgacctagaaattccactcccgggcatacaaacaaaataaatagaaaacatatattcaagcaaaaatttgcacaaggtatgcatagcagcattatttataagtcagaaagtcgaaacaaaccaagtatctatcaaccaatgaaagtttaaataaaagtggagtatctctgcaatggaatattatttgccaataaaagaaaattaaatattgatacatggtacaataaagattaaactgaaaacattattcttagtgaaaaaaatagtcactaaggaccacatattgtattattctatttatatgacatatgcagaaaggaaaatctatagatagaaaaagtaaattaatggttgtcaagcgttggggaatgatggctaagtggagtaaaatttctttttggggtaatgaaaatgttctaaattgattttgataatggattcacaacttcatgaatggactaaaaccactttatggtacaatataaatgggtggattgcatagtatgtgaattatctctcaggaaagttaagtagtgtgtttggatgaatgaatgaagcactgactttgccctgtgcacatcaccaaattatatctcagatttgatatgaagattttgattgggaatacactttttatataacatggcataaaaatggtaattaccaaataatcagtggtcttgtcactctaagtaagaaaaaatagattaaatggcactacagtaggtggttatgttaattataagcagaatgataaataccaacttcgatgcaggattttagactgaatgaagtagtgtaggttttaaaatagaacatcttattcttctgaagttcttcatgacctaattgtagttcaatttgttgtgtttgcccagattgagttgtcccaagatttcacattggaaatccataccatgggatttttaggtatgcacaacccatgggccatattgttgcaataaagtgtacgggaagtttgcatgcagtatcttttaaacaataataattctaattttcataataaatactttttaaagttctacattttactattagtttctaaatattttattttaaaattttatcatacatctgctgtagagtaacgaccatatccaaggtttttagctttctaattttccatgtgtcaaatgaacaacttgggattgtgttaagcatcaaataaagtgtacaattgcccttcaattgtgaattagtaaaataatacggtaaagcagattattcatcaccttgagtcactaacattgtatgatttttataaaaatagaattttttttgcatatgatttggactgtttgaagtactggaggacaccaactcccctcactttatggctggttaattttattttgggcagctttccatgaaaacaattatttcgtttttttccttttctctattgtttttgttttacttgaaagttctagattccacatctatccttccaaatgtttgttgataatttaaatatatacacttaacttttattcttaaactaagaattaatcaaatttgatatttttttgtcctagaaaatcaatagattttcaataacttttaatctcactgttacctatcaatatttgttgatattaatggtaatttatacatatataattctagatataatttattattaacatttagagttaaaatgtattttatttattttcacctttattatattttatgttttactttctttttaccatagtagttcttttcaaatagattttattaaaggaagattttgcttatacataagctaaatttattattttcaaatgtttgtatttcactttcaagcttgagtaataatttttttatatatgaattttatataaagtttttatatgtagccctttgaagacattttcttatttctctttgtattgaatagtacggaaagagacaagatgcaaatagtctcattttcgttccattactggtgttttgtctttcactcgttgaagcttttagaattttgttagtcttaatgttttttgagcagttggcattgttctgtgaaatgataaactacaaactagagagcctgagcatattttgttgaggagcagaattcaatttagttcacactttaggacccagaggccaatacttaatacttaattcctggttcatcctctccaaaccacaggaaaaaagtgtagaaaaatttagagcgataatatgtcagtgaatcagagagcccctgggatagggagagcactggtta

SEQ ID NO: 474704 - DNA, 1571 bp, Homo sapiens
gctatgacactggctgctgaggcactccagggatctggcaggagtcaggaataggaagaaacccctccccgttccaagttggagggatgggatccctgccctcccaggcacacctgcacctgcaggtggctacagacctgggcatctcggcattctcgtgggccaggaagcccctgctgctcccacaggatcggatgtgcctgctcctgctgactggcgtctcccctctcctggtgcctgctctagtttcacagcaaagttgtggccagacccaggcgctgtcatgtgcccactccaatttcagagaaaagttgtggcccagcccagatgctgtcatgagccagccaggacagggatggcctgaggcctggggtccaggctgccagttcagcagaccagagccagaaattatggtgctttttctgggcccacccatagctgcccatggaccaatcagcatgcacttccttccctctgaagcccataaaagtcctggactcagccagattcaggcagatgagaggctacctgcctgtggagagaagctatgcactgtgggtctcctctctaatgagagctgaatactcattgggatgacttgcctgcagagagggtgtgcctaccatgggtctcctctgagctattctatcactcaataaagcacctcttggctttgctctcccaccacttattcacgtacctcattattcctggacgcaggacaagaactcaggactcgctgaatggtggggatgaaagagccataacacaaacagggctgaaacacactccttgctcaccaagttgcgggtaacaaggaggaagacagaaggagagaagagctgcagcccttcagggagcccagacctaggagctccccaagccagggctgtgaccttctttggggctctgcagttcctggtgtctccaagcttccaggtgccactgcatttcctggtgccagccgtggaagctacttgccatatatctggtccagccacagccttgcagggaacaagcacccgtgccagtgcctggagctgcctgccccaccacagccggcatgcctggttgtgtgcagtggccagaccccaccctcgctcactcatacaccccttgcttggcttgcccttggcaggtgtgggatccaggccagtggcacaagccaaatgcagcctgccaagcttggtgggcagaatgagcccagcaggccagagcaaaactcgagcaaaggctccaccagccacagaggtttctggccagaaaaatgacaccgcaagaatcctgtgacattaccagtgaagtgaaatagtttatcacattttaaatatctgtttgaaagaatgatgagcaaaattctatggctattttcttcaagctgtagggggcttaagatttttcttacctgtgtctaggaagcctttatattttcaggagatgagccttttttttggtcatatttgctataaaatttttcttacttgattgctctttactcatttgctgtttttaatagtaatagttttgttcttttcaatttttatgtagctaagtcacttttttctttgtga

SEQ ID NO: 474705 - DNA, 1138 bp, Homo sapiens
ccttgggaacctacccctcgcatcagtgtgacctggattgaggacaaacctctgccctttccatgatgcaagaggtccaatataacctgctaccaggtagctggcttattgcccccaggaatggtgccatatcacgggctcagtgttggactctgctgatggcaaattgggcactcagtggtggccatagccaggtcagccttgctgaaggcacattgattctggtgggccttatggacaggaatggagaaaaaggcattttccaagtcaatggctgcataacagatctgacgtacagagaagaccaatcgctggctcgtcaaagatgcaagtgctgccctcacaaatctgtttcacaaggcattggtcaaatgcatatcttctggaccctccaagctgagatgaatggtaaagttcaagccacaggagaaaatggaggatcaagaacagatatcaattattgtaaggaggaacagaagaaaagggcctggggaaagaatattagatttgatgagaagaaagctattcttgggaatgcaaataaattaagatatggaaagttcttaaagatggtgtgtccagagtgtgatccttcagatgttcagatgtgtcaggagtttcttccttctggtgggttcgtggtcttgctgacttcaggagtaaagccgcagaccttcacagtgagtgttacagctcttagagttggcgcgtccggagttgttcgttcctcccagtgggttcgtggtctcaatgacttcaggagtgaagctgcagacctttgcgatgttcagatatgtccagagtttcttccttctggtgggttcgtggtctcgctgacttcaggagtaaagccacagaccttcacagtgagtgttacagctcctaaaggtggtgtgtccagagttgttcattcctcccagttggttcatggtctcactgacttcaggagtaaagctgcagatcttcacagtgagtgttacagctcataaagctagaaatttgcatatgatgaggaaacttgctagaactgtctcatttgtccaaatcccttcaatttaaagatcagaaaagaaggacttgagcactaagaggctttgccaaggttgtacagccagttagtgagggagctgaggttgag

SEQ ID NO: 474706 - DNA, 1711 bp, Homo sapiens
gccgcggccgccggagacgtcccgccgccgcgatcgcccgcgctcgcctctgcctccccgcgccgctcctccactcaccaaggcacagccgccgagctcggcagacacagtcccgggcacaacctacccccctccgccgccgccgccgccgccaacaccgcgcccgcctccgcctcctccccttcctcctcccggcccccgcctcttgcgcgcctgcagcctcctcctccccactgagcccgcccccgacctcccgccccgacgccggagttcctcgcgttcattggctagagggcgcatcactcagtgccaggtggcggcctccccgcttgtcccgcctcccgctcctcctcattgtccccgccccttgctctgttttcttccagctgccggaccagcgggcctgccgcctctacggaccagtccctgctcaggtgtcacttttgctggcaggccgagattagggcaggagagtgggcaaggcgtcgcggccaggaggagaagggctctaccacgccaccctcctttggcctccgaacgcggaccccgcacacacacacccgcgcctctttggcaagcgtgccttgtcggctgggttaagccgcagtgcgtgcacaccgagcggcggggcgctgtggaacgcgggagcggactagcggaggaggatgcggaccaagccccagcgacccagggcaactcggagctacctcgggcagccctgcgggtctccgaggagaaccgaggagacgggagaaacatgggagagggtggccttttccctgttcacacacacatgcacgcagccactggccgggacagttgacacccatcttccttccctgctccttccagtcattctacacccgcttggtgctgccagtgcgggcagggccttggagcccaaagcggatccccacacttgtccctacggtcggaaggaaagtagaggagagaaagtcaggcgcggcagggctaagagcaatagtggcccaaatgttcctggcccgcctgctgcgccacagagtctgaaaagcgggtctccgtctaccagaaggtgacctccacacagcccctctccccgaccaactgcagcacccaaggactggcaacgtggttggagcttttggggggaattatgaagaaatctgaataaatttctcacccttcatgtttcctgttttatttccaaagtccttcatgatcagcactttcactacaagttatttagattgtataaagaatttggaagtcctagtcagaggaactaggcaagagaaagaaataaagggcacccaaattggaaaagaaaaaaatcaaagtgtctctgttgccaatgatatggtcatttacctagaaaaccctaaagactcctccaaaagattcctagatttgataagtaaattcagtaaagtctcacgttacaaaatcaatgtatgcaaattggtagcctttctatacatcaacagcaacaaagctgagaatcaagtcaataactcaatcctttttataatagctgcaaacaattttaaaatacctaagaatgtacttaaccaaggaggtaaaagatttctacaaggagaactacaaaacataactgaaataaataatagatgtcacaaacaaatgtaaacagtttccatgctcatggattggaagaatcaatatagtgaaaatgaccacactatccaaagcaatctacagattcagtgca

SEQ ID NO: 474707 - DNA, 559 bp, Homo sapiens
ggcctgacctgtgaatttcagacttgccagctcccacaattgatgtttgcgcttgggatttacccaccatattgtgaggaagcctatactacatggagaggccatgtgatgttccagccaacagtaccgtgtcagatgccagctgccagccagcatcaactccagacagatgctatctgtttgccaagtcctctggggatggtccctgcctcttcttggaagagacctctcttctgtgggctttaactgctcactgccttctctctgctgttgtcttttgtgggtgcaccttggctttctgtgtgtccattatccttcgtgggaattcaggctcgtttgagaataaggaccgccagcatcatcctgataccaaagcctggcagagacacaacaaaaaagagaattttataccaatatccctgatgaacatcgatggaaaaatcctcaataaaatacttgcaaaccgaatccagcagcacatcaaaaacttatccaccatgaccaagttggcttcatccctgggatgcaaggctggttcaacatatgcaaatcaataaac

SEQ ID NO: 474708 - DNA, 667 bp, Homo sapiens
tcccaagtgttatgggtggaacctggtgggaggtgattgaattatgggggtgggtcttttctgtgctgttctcatgttagtgaatgagtctcatgagatcacttgtgcaggagtttccctgcacaagatctctcttggcctgctgccatccatggtacatgtgcacaatgtgcagagagcacccagtgaggactctgctggactgtggctccacctccatggctggtgcaaagtttgctgccccttggctgcaaacccctccatagcttcccacttacatgcctgtacttctgtgttccatcactatgcacctgcggctgctaccactactgcttctgctaatgctgtcgttaaaactgatggctaccacgcgtggtcgattatgtgctacgtcttgtgcaaggtattctatgtgcttacatagatgtttacaataagcatgtgaaaagggtacatgtgcacaatgtgcagaatgcatacttatgtttgaaattgaatattaagatattaataataaattagaatttaatttatgttaatttcatggacactgttattcatattaaatgtgatggtaacctatgtaattatgtaataattatccatgcaaatatcagtgacaccagaaattatattaaaggactagttagttacttagtttttaagg

SEQ ID NO: 474709 - DNA, 621 bp, Homo sapiens
gagagacagtgctatctacgaggaatgggctttccacacatggaatctgccagtgcctggaggttggactttctagactccaggacgatgagaaagaaatgtttgttgcatacccagtttacagtacttttcattgtagcagcacaaatagatcaagatacccaccctcagatcctggcaaattctgagctgatcctgaactgggtagaaaatgtgtcagcaacctcagctcccctgcatgagggggtctggaagaagccttgctgctatggatacagagtcacaagcaacaagaatgagccctgcctcaatccctctgagggaccgtggttgcttatctctcttgcttctctcttccagcccactctgctcacgtgggagctcttggagggctgcatgggagggtggtgtggcccagtggaagcagccaaagattttgagtcacactacctgaaacttaaatctcagtccatgcgttaaagttcatgatactgacttacataagagatctgaagtgtttttaaacttctctaattctaagtaccacagtgagttggtgccagtcacagtagaatagaagctgtaaaccaggagggcagcaaaggatcggccaaatgacac

SEQ ID NO: 474710 - DNA, 695 bp, Homo sapiens
atctgagtgaccaaagaaaggggtcgctttctctgtgctgggctgcctacggttggaggatgggtgacacaagcactcccatggccactagagctgacatctcactgggtcacgttcgctccaagtccactggctgtggtcccactgcagcaccaggacttgcccccagttttcttcatttccttggtgctcttcacgaaaagccaaaggctaaggatcctcgatggaataacggctgttttgccgtgtcctcacttggcagaagcagggaactctggtattttcaggctcttataagggcactgattgacagagcaggagtatcaccatcttggacaagcactgtcattttaaaaatcaccttaatcaaataccgcctaaatccaaagggcatcagcctaatggctaagggaaatcagagttcctataagcaaactctaactcataagacccaggaaagctgagctagctctaagagttgaccttgatagaagactgcagactactgagtttctctattgaaatgatggctcctattgtttaaggactgaataccactttatttcacttgtatgcttcagaattggaatttgtgaacacaacttatttccttacaccaatgtctggggaaaaactaaatatgccttgatctctcataaagaggtggttttaaagagtgccttgccatggactga

SEQ ID NO: 474711 - DNA, 629 bp, Homo sapiens
gcggcagagggctctgagtgttagaaggaaaaccaaaaaccagaaagcaataacatcaacatcaacaaaaaggacgacaatgcaaaaactccatctgaaggtcaccaacagcaaagaccaaagggaaaaaaactggatagagaatgagtttgacaaattgacagaagtaggcttcagaaggtgggtaataacaaattcccccgagctaaaggagcatattctcacccattgcaaagaagctaagaaccttgataaaaggttagagaaattgctgagtagaataaccagtttagagaagaacataaatgacctggtggagctgaaaaacacagcacaagaactttgtgaagcatacacaagtatcaatagacaaattgatgaagcagaagaaaggatatcagaaattgaagatcaacttaatgaaataaagcgtgaagacaagattagagaaaaaagaatgaaaaggaatgaccaaaggctccaagaaatatgggactatgtgaaaaggccaaacctatgtttaattggtgtacctgaaagtgatggggagaatggaaccaagttggaaaacacattttgggatattatccaggagaacttccccaacatagcaagataggccaacattt

SEQ ID NO: 474712 - DNA, 524 bp, Homo sapiens
agtccaggaaaaatgaggtagcatgaacgaattgaaggatggtagatgcagaggattttcttgccaccgaaagtggctctcagcagatattccctctatggaaggcaaggtcttcctatatacaagacagctggccttctggagaaggctggagaaggggcagagaaatttagagagacatcactctaagacagggatgtctaaccctcaagctgtgaaccatactgtctttattagtaacaagtcagaaattgctattcaaaagaataatgcaagttttggtttctggctttataacaaattggaagtcctcactgtcatcttcaagatgataaaaaagctgaacaaattgaaaatcagcatttattacatccatcagagatctgaggtcacagggcaaactgctgcccttcagactagaaagatagacgggggagtacagagcagcacaattttccaagagcagaagccctggagcagttgaagccagtactgaaatagtctgtgtcttgcaagtctttcag

SEQ ID NO: 474713 - DNA, 533 bp, Homo sapiens
ccctcaagtataggacatctctactccttccctggcaaccgatcacatgcccattaccatcccattaaaacctaatcacccttaccctgctcaacgccaatatcccatcccacagcacgctttaaaaggattaaagcctgttatcactcacctgctacagcatgggcttctaaaacctgtaaactctccttacaattcccccattttacctgtccaaaaaccggataagtcttacagattagttcaggatctgcgccttatctaccaaattgttttgcctatccaccctgtggtgcccaacccgccccagtctcattccagacgccagaccaacttaaactgtgccccaaaaaaacctatcatccctactatattctgtctagtcatactcctattcaccgttctcaactactcacacatgccctgctcttgtttacactgccggtttacactgtttctccaagccatcacagctgatatctcctggtgctatccccaaactgccactcttaactcttgaagtaaataaataa

SEQ ID NO: 474714 - DNA, 659 bp, Homo sapiens
tcattctaaaaggtgaaggacaacaagtttataatgcgaacgaatgaaatactctgtacaaagatcaaataaaccacaacaatctggtgaaaatgcaaacaacaaagctgaagccagtacaactcagctgccagtgtggctagaatataagcaggcagaaaaatgtgaaaagagagactggcctagccccctggcctacatctttttcccatgctggatgattcctgtcctcgaacaatggactccaggttcttcagttctgggactggaactggctctccttactccgcagcttgcagacagcctattgtgggtccatgttattgttcaggctatttcagggaagccttttgcaaatataagaagttgccataagacctttaaaaacagtcgctggctaatgaatgcaatatctgtgaaaccacttgtactactctgcccctgtagagattaatgttactaaacatactgtactatcatgagaggaaaagtgatgtatgtacgcgtgtatttatcatatataaacttaatgctggaatagctgtattaaaacttgaatagcattttcccaagatgacttagactttgtgtattttagcaactttctggttttatgtcactttcaggtagctgatacagacttccgaatgttaatatta

SEQ ID NO: 474715 - DNA, 750 bp, Homo sapiens
agctcctatgcaacccaaaaggacagtctcactcccaccatgcttcctccaacagcactgagtttgtttccaggcagtgggcgagcaggactgagaacttgccccaggctacaagccccccagcttagaaagcaagcagggctttcaggttttgtccctccctgcctgcccacttccatactccagatttatcccctcccctgggttctgtccaggaaacttcatgttcagttggaattgttacaaagtttagctggaggtttccttctccctgaggtctttttcctgttcctttggcagccctccccaaggacccctgtgagacaaatcagaaatgtcttccctgaggaccaagagagcttcctctactcttgtatttcactgacctctctaaattatctcagctccagaaatctaacagagaactcaacagagaagtcacaggaaatacctgaggcactggagaacaaggaaatgaatggcagatcatctgagattagccaggagccccaagggactcagtatggtagcgaaaggctaagtgggagaacatcagtggtttacatccccagaagatttagtatcaagcaaggaccagaaagggaaggggagaaacgggaaaggcagactcaacaagcaattgatgaatactgaccctatgtaaatatggtttgggaattctgagaaacattccgatagtttgttcaagtaaaatattaggtatatagtaggttgttaataaatatttgt

SEQ ID NO: 474716 - DNA, 504 bp, Homo sapiens
gaatgagaagcaggggatggcacggagagcctttcctgagggctccctccccaacgatcccacaccaccgcccccccgcccccccgcaccaggcccgactgcaacgctggtgaatcacatttcaacaccagctttggagggggcaggcatccgaaccatatcaccacccctgagggcggggggatggaggttgcactgcagccagagggcaggaacaggttcgctcacctggggtctgctctgtgggctcttctgggggcacccattctccctgagtttccatacccagactccatccagccgtcatctgtgggtcctggggtggggcccatctgcccgtggcttcacctggaccatggaggacaaccttgttttgcacagcgtccctggggcggctgctggaactgagcacaacggattcatattcatttattgaaagatgggctccatattgtataactggaaggtatggccacagctaggccttgtcagaaacacacaacc

SEQ ID NO: 474717 - DNA, 686 bp, Homo sapiens
gggcgggtcccagaacacagaggggaagctgaagtgatgaatgtctgttgagcgcctgctgggaacgtggcatgtggcttcatgcggtgttcccttccaccggaatcagacccttggcagaaggtccgatctgtccccccctgtcacagccccagttctggaactgggcaaacacatctgcttgtcaacatttgaagctgtatctagcccgaatcctagtgcagagccggtcttcaggctgcacgtgactgcaggccaggctgctattaccagtgacacaaagctggctcaggctggttctgggcagccaagcctgaactcagatgttcctccatgcaatcgaggaagtgcaatctggcatctcacccatgcatatgggcatcgctcccatgactggacatgcggctgctgccaatgctgccagcgtggcacccgattttcattgcaacgggagaaatccaccttgctcatgatgtgagcacgccactttcagacccgggctggtacgagctcagctttgcactgcccttctccctctctcacatgggggaggagcatttccccacaagccttgctgggccaactcagtccctctcccaagaaattatcccacatctctctttccaatactttagtcattatagtggttcccacaaatggtgctgatcaattgaacgtctctctgc

SEQ ID NO: 474718 - DNA, 693 bp, Homo sapiens
acacgggggaatcagggtgtgggaggactcggctggtcccaggcatgtttctgcccctcacctcagtgtccactctctgctcaaactgccctatcctctcccatgcaaggaaactccccactgccctactccccttctggaattcccagcccctgatgggggcacattgccctccagtgggtctcactagggctgttctgtggacccaggtgatgaaggagcagagcagaggctgcaagaaactggaagccttgggctcccctccaacagggcctgtcaaccttcctcgtggagcagagctagaaggaagtcaggtgctttgggtgtggagagctgcccccatcttgaggacttattctacgccgtgtaccaacccactcaacactagtgtggggacagggacgccgaccttacatgtgaagaagctgaggctcagacatgtcatcggctttgcccggtgtcactcactgagcgagtggtcaggcaggaagctgaacccaaacccagctgattccaacgtcccaggccttcactttggcatgacacccaaatgcaggaggccccagcaacgatgtggtatgggcccttgtgactccctgaggcccatgctgccaaccagcccacctcacgtctgagggcgactggcacgtttgccaatgttgcagacaggaggaccaggacctctgccctcct

SEQ ID NO: 474719 - DNA, 812 bp, Homo sapiens
ctgcacagtaatgccctgctggcctaaggaaccaagagtggaggtgcaagagctgtcattttcctttcaaaccgagggcggttttgtcacttccccagtcgatgctgctggtggcagcgtggggtgctggttgagcccacagaagctggcggcagctcctggatttgactctggctctgctgagcgccctggcctggaaggagtctctcaacctctccacgaggctgtcatcctgctgctgagtgcacgcaccaagctcatctgcatcatctccccaggtccccaggcccccttgggtggggcggcctgggacagcggagaggctggaggcgctgtgacccaggccctggtcaggggccagccaagcttccgcaggcccagtgtccggggcaggaagcgctgccggccggaggtgatcaaggaaacggagacttccagggaaggaacattcctgaggtctctcagtgaacgcttggcaagctagggtgccccctaggcacacccccaacacctctcccaccacgtgtgttccacagacgtggactcgcggccgccatggacaggacgctgtcctcagtgctggcacatctgtgaacaaggctcgctgccacagcctgcaggcgctcaccctcctgcgagggagaggaatgtgggtgctgaggctgggggtgagaagatccaggcacaatattttcaaggtccagtcacgtcataccatgtgtcaataccccattcctttttcatggctgagtaatattccgtggtgtgaatagaccacattttgtgtattccttcatttgttgatgaacaat

SEQ ID NO: 474720 - DNA, 1995 bp, Homo sapiens
tcgactttaaccttccagcagtgtgagtgagggccctgaccctagaatcaacgcccaaagagctgtggcgctacagcgggcggggacatggggtgcgcatgcgtgcgggggggtacgcgtgcgtgcaatggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatgagtttctccttgatagtggtcactgtcaaatggaggagaattgcttctgactcacgagttgttcaaagcctgtagcccagggtggggtttgagctgcagaagaagaagaaggcagacctagagtaggaaaggggtgcctcatgaagccata

SEQ ID NO: 474721 - DNA, 1325 bp, Homo sapiens
accccgcccaagcattgcatacagcagcatcaagcatgggcatgaatgaatggatgaaccaacaaacgaacaagcgagaactggagagaacacaggaccagcgcagctccccctgcaagggtgaacgcagccgtggggagctgccacttgacgtttatttctggaacgcagcacactggcgggtgctgcacccacacgcgtgctgtcagctcctggtgccgcctgctctgcggccccgttcacagagaatgacagtgccatcctcctgggacaccaccagcaccctggcatcaccggccctcatcccagcactggaatgtaagctcctccaggccctcaggcctcttgcccagcccagcacagcacagggcctggcagaggtgacgccctgcaacgctgatgctgaatcggctgcctgtggggctcctagacctactcccgtcaacctcaacccccgctctgccaaccaccaggccccagcccatgtgcttctagaagtctccttcccaggccaggcctcctccctggagcctgggtggtcacccactcgtgtgtgcaaagccctgcaggctgccctgggctttactgtctgcatggcccctgatacccagcaggacacacatgggccctcggaggtttgcagttaccactaataacagcagtgcctgatcctggcagcctcattaacgacggcacctgatctggggtggccatcggcacagcttccttcagtttgacggccccattgcatgctggatgacgagggatgggagaggggttgagggattgttaagtggacgacaggaagctccctgtctccctccttgtcaattactttccaggaaaaggcctttgacaactccccacatgctccccactaaggtaaagggttgaaaaactcaaggaagcatcctttagacaatgtggcaggaaccacagggatgttcaccaaaggacagaaaccttcatcccttcactcccacttacttacagctccctctcacagatgcaatgaattcagcccagagggtcctctgaatccagggatcctccaaggccatggactgccccacaaggggagaagggagctccaggggcccggggcccaccactcagttcacacctcaggctgtgtagacaaccagaaccccacccacaaaccccaaaccccacacagccggcaccagcgggcctgcatcttccggctccagcttcctcaaggctctgccctcaagtaagcaggtgttttgtgctaagaattgaaaatcagcatccacgaatttaacgcttaggtaaaacagggaagaagtagttataccagaagg

SEQ ID NO: 474722 - DNA, 588 bp, Homo sapiens
tcctgcagcagctatgacgtcaggcggctgctgtgtacctggctgtggggaggtgtggagggagaggcgcgagcgggaaccggggctgtgtgtggcgcttgcgggccagctggagttccgggtgggcgtgggcttggagggccctgcattccgagcagcaggccggccctgccggccccgggcaaggagggacttagcacccgggccagcggctgtggaggctgcctttccgcggggcagggctcgggacctgcagcccgccatgcctgagccttcccccgactccgtgggttcctgtgctgcccgagcctccctgacgagcgcgaccccctgctccacggctcccagtcccatcgaccacccaagggctgaggagtgcgagtgcatggcgccggactggcaggcagctccacctgcagccccggtgcgggatccactgggtgaagccagctgggctcctgagtctggtggggacgtggagaatctttatgtctagctcagggattgtaaatacaccaatcggcactctgtatccagctcaaggtttgtaaacacaccaatcagcaccctgtgtctagctcagggttt

SEQ ID NO: 474723 - DNA, 2657 bp, Homo sapiens
gtcgtccacagccagtgagtgctggagccagggttggagcccaggtctttgccagccccgcctgcagcatctgcagtgcagagacgcggccacgtgggcacctccatggctgctgtaacagatgagcacaccgaggctcagagcaataaacattctatccgctcatggttctgcaggctgtgcccacagcccagccctttctccacctgccactcctctccacggtggagagtgtcactatggatgatctccccagcggctggtgtctggaggcctcctcagtggaggatcagcagcacggggcagaggtccgctctgtcttccactgtctcagcagctccggctgccgaatgggcaggcaccctgactgctcctgcgctgtgtgctcccctgcccccatgcgctgccccactgtgcgctggcccctgtgcaccgtcccactgtgtgctggcccccgtgtgctgccccactgtgcgctggcccctgtgcgctgccccactgtgtgctgcctcactgtgcgctgccccactgtgcgctggcccctgcgcactgcctcactgtgtgctggcccccgtgtgctgcccccatgcgccgccccaccatgcgtgcctcactgcgtgctggcccctgtgcgctgtgccactgtgtgctggccctattaagcccagcatccattagctattcttcctgatgctgtgccttcctttgctcccccgtcccgacaggccccagtgtgtgttgttcccctccctgtgtccatgtgttttcatcattcagctcccacttataagtgagaacatgtggtgtttggttttctgtttctttgttagtttgctgaggataatggcttccagctccatccatgtttctgcaaaggacataatattgttcctttttatggctacatagtattccatggcatatatgtaccacattctctttacccagtctatcattgatgggcatttggattgattccatgtctttgctattgtgactaatgctgcagtgaacatacatgtgcatgtatctttataatagaatgatttatattcctttgggtatatacccagtaatggaattgctgggtcaaatggtgtttctggttctagacctttgaggaatcaccacgctgtcttccacaatggttgaactaatctacattcccaccaacagtgtaaaagtgttccttcttctctgcagccttgccagcatctgttgtttcttggctttttaataattgccattctgactggcgtgagatggtatctcattgtggttttgatttgcatttctctaatgatcaggaatgttgagctttttttttcatacgtttgttggctgcatgaatgttttcttttgaaaagtgtctgttcatgtcctttgcccactttttgatggggttgtttgtttttttcttgtaaattgtttaagttccttgtagactctggatattagacctctgtcagatggatagattgtaaaaattttctcccattctgtaggctgcctttcactctgatgatagtttcttttgttgtgcagaagctctttaatttaattagatctcatttgtcattttttgcttttgttgcaattgcttttggcattttcatcataaaatctttgtccatgcctatgtcctgaatggtattccctagatattcttctagggtttttatagtttcaggttttatatttaagtctttaatccatcttgagttaatttttgtataaggcataaggaaggggtctagtttcaatgactagctagttgtcccaccaccatttattaaatagggaatcctttccttgttgcttatttttgtcaggtttgttgaaggtaagatggttgtaggtgtgtggtcttagttctgacttctctattctgttccataggtctatgtgtctgtttttgtaccactaccatgctgttttggttactgtagccttgcagtatagtttgaagtcaggtagcgtgatgcctccagcttttttatttttgcttagtattgtcttggctatttgggctcttttttttggttccataggaattttagaatagctttttcctaattctgtgaagaatgtcaatggcagtttaatgggaatagcatcgaatctataaattatgtttagcagtatgggcattttcatgatattgattcttcccatccatgagcatggaatgtttttccatttgtttgtgtcctctctgatttccttgaggggtgggttggtttctcactgccacgaacatctgttggaattttgactgtgataggattaaatgtatagattaatgggggagcattaagcacctttataatatcaaatcatctcttccagaaaaatgatatcatttacttttattcctgtcttcttaaaaggtttttagaaaaggttttgctgtgttcctgcacatctttttctttagagttatcccagggcaactgtcactatcatttcctgtgggtgcctgtggagatattttatataacagtcatgaatatgtatacaacacccacgttttttcacaaatgttgcattttattcaggcttttctgctcctcattttctttcccttttactacatgagaacttagctctattttttattttatttatttatttatttatttattttttgttttttt

SEQ ID NO: 474724 - DNA, 780 bp, Homo sapiens
agcagctggggaccttgcgttgtgatgtggaggtgaggaggaggtgaggtggaggtgaggaggaggtgaggaggaggtgaggaggaggtgatgtggaggtgaggaggaggtgaggaggaggtgaggaggaggtgatgtggaggtgaggaggaggtgaggaggaggtgaggaggaggtgatgtggagcctccatttcgtcacctaaaaacaatgggggacatcacaggcccccaggacattgcatgggttcagggagtgacagccctgcacggggctcatagtgcacactcagtggtagcgggcacagttgctagtattgctcctgaaagggcactgtactggggtgaagacgtggacaccctgttccaggaatgtgcgcacattgagaagctggcatctccttcaggaaaggccctggcttttcccactgctccctgtaggccacggtcccaggccctgcagcttcctcctggtagagtggggaggcctgtgctgagctgccagggaaaccacagcctctggaaagcaaaccccaagccactggcgaggctccttcggcccaaccacgggagtgtccgagcaaagatccagccctccacctcccttccgaccccccacagacagagccccgtccccaggaaggcctgaagaggggcatatatttaagcccctggttttagcgtcaggtttttgttttaaattgtggtaaacacctaacataaaatttaccatcttaaccatttgtaagcatatagttcagtgaaattaaatacattcacg

SEQ ID NO: 474725 - DNA, 1350 bp, Homo sapiens
tctcatgttgaattgtgatccccagcgttggatgtggggccggtgggagaataagtgacgcgtttcatctggaggagacacagaagggtccgtttccaccccatgactctgcagatgcgccactgacagtgtgtggtttccttcttggcagcgtccagctctccggcaagtggctgcagatcaaagaaagcagcggaaacctctaggggacacagcctcccagggactgtgaagctgaacagggcgtggcgggaggagccctggctgacagaaatgcaccccctccccttttccagggtcaagccccactcccagccctgtgggaggagggagcaggaagaacccagtgtgtggcgccagagtgcctggctcgaaattaatcctggttcccactgtgtggccttcggcaggtcattcgccctctgcaagccacccttttctcctctgtaaaactggagttttagcacccgggactgaggggcctggcacacatgggtgctccacaggtgccagtttcttcctcggtgccccctaaaatcagctgctcaagccataccagaagtatggtctatcagaatgtgaacttcagtgtcacagctgggtttggctgggatgggtatggcgatgtgggaagaaacgagaatagagggatggctggggcaccttgaatgcttcctggcggcatctggatttcaccctggaggcagcagggggcacaaaaacgttgtaagcaggggcaccatttgtgtcctgggcaagcagtggtctccgagttggatgagctcactgtacaaatgtgaatggagcactgggctgctgactgggcatgggtttggcctggtgcagggatggctgagctggggtcctgtgcaggccactgccctcctctgccctgagtgtccttgtctggagaaaatggagatcacccaccccagctccagcgtggcaggaggggcagctgagtctgagtctaggctgaaggcaggtgctggtgatgaggagaggcctgagctccgggggcggaggctggaggctgggttggctgtgggtgtgaggagcctgctgttcctgggcctccagggaaggtgcttggtggaccctcagggaggcgagtgccacctttggctgcacccatacctttaccctttggtgaatgcgcggctactaggagttctgcctccctgaatttgctgctctgaatggactgcaagctaggacacaggtaagtgcctttgttaaccgtgagatgccagcggctgggctctggcgtgcgggcctgagtgctgctgcttgccgccaagtgcagaggttctcggaggctccgctggctatttggcacttttccatttc

SEQ ID NO: 474726 - DNA, 962 bp, Homo sapiens
ccctgagggcagtggctgcctactccagtggccgcccacctccgaaggacgtctttggtgcagctgagctgtgggagagtgagggcaggcgtgagaatgtgggagtgtgccagggtgctgcattcctgtgcgagcgatggcttccgtgtgttttggcagggctacgcaggcccaagggccctcagcgtccaggaaggccagagttcagcccagtcagcccactcggccccactgttcgggctgccctctgagcatgtgtcatcctgccagggtccctcccactgcgacctgtcttcctggcagctgctgttcaggagttctgcaccccgccctgggtgtcctgccaaagccaaggtggccgtgcgactcccaccctactgtcacaacctgccaaagaggcactgctccaggcagctcctggactcgcccagatgcagccagaccctctgctgcgctcactgcatcgtcgtggatgtagctgtctctctgcctttctggacatcctgactgtggcagaggtccccagccccacgggaggtggggtgggcagggtcggggggtccatgtccccttttcttagctgggcccaaagcacgaacacccacgggcgtgggctgggaacatcttttttttcctgagaatccctttctttctgaattcaaaagcgacatttgttcataataaaaataagattggaaaagctaggaagataccaaaattatatgaaaaaaaaaatcacaaaatcaccccatccagcccccctgagacgaacgctagtaatatgttggtgaacagtcctctggctgtttttctgtgcaactttcaacctggttgggaccaagctatgcatagaattttgtgttgggttctttttgtttaacatatggtatgccatcacctagaattatgtttatggtttctttctgattacaaaattaatatgtactcactgtgaaaacaaa

SEQ ID NO: 474727 - DNA, 1100 bp, Homo sapiens
cagctccagccatggctaaaacgggtcaaggtacagctcacgttgtggcttcagagggtgcaagctccaagccttggtggcttccatgtggtgttgggcctgcaggtgggaaggagtggagctgtgagaagagggagaccatccgccagaccacagaatggtaaattcactgaccagcttccactgtgtgcctggaaagtgcaaactctcaatgccagcctgtgaaagcagccatgggggctgtacccttcaaaaccacagggcagagttgcccagggccttgggagtccaccccttgaatcagcgtgtcctggattatctacgtttcaacaaggtagacaatgagatcaataaagtccaccctggaaaagtggcaggccattttgttgaggcatggaaaataacagaccagttatgcctaaaatgggacctggggagtctgctccaaacaatggggccagtgagaacagatcttagggtcaggaaagaacttagcgtcgttaatttcaaaactttgttacacaggattggaggatctgatggttttataagcgtctggtgtttcccctgcttgcactcattctctttcccgctgcccctgtgaagaggtgccttccaccacgactgttctagcttctgcatcaagccaagtccccctccttgtacctgtcagagaatggtcagccaaaaatcaaataagcacatctcatttttattacaacaaattccttaggttatttaaagaagaccgatactaaaaattaaaatttcattcggaatttaacctttcatttttttttattttttgcctcatgagaatatctacatcttagaattctgctaagaaatcaaacatctcattgaataaactaatgatgataaatcacaaagctataacaaattttaagatgtcttcagaccctttcaatgtatgcagtgaggactatttacacatggacccaaaaggattgtcagtaatttaaaaataaagcaaaataaaacaaaacaaacctaaaactacatgaggcaaatacttactatctgtctttattattaatgaagtagtagtccataatccttgatatgacactaattactac

SEQ ID NO: 474728 - DNA, 566 bp, Homo sapiens
ctttatgaagctggggctgtgaacctcaagttcctctcctcaaatatagttactcttcgtatgaggacctgtgaactaaaaagacaaggacatttcagagatcttcacagcagcccctcccatcacaggcctgggggcctagggaggaaaaaatggtttcatggaccaggtcaaaggccctgctgctctgtgcagcctcaggacatggcaccctatatcccagccactccacctccagccatggctaaaagaggccaaagtacagctcagggaattgcttcagagggtgcaagccccaagccttggtggcttccatatggtgttgggcctacaggtgcacagaagacaggagttgagctttgtgagcctctgcctagatttcagaggatgtatggaaatgcctggatgtccaggcagaagtctgctgcaggggcagagccctcatggagaacctttactagggcaatgcagaggggaaatgtggggttgaagcccccacacagagttcccactggggcactgcctagaggagctgtgagaatcctccagaccccagactggtagat

SEQ ID NO: 474729 - DNA, 744 bp, Homo sapiens
cagacagtgcctctcaggccacatctgtagcatagcagcgccgggaatggcacagtgccccatgctgtgctctgcagcagcggctgtatggacacgtgctaggagactaaacgtggtgacggatgagcaggcatccacgggagcgtttccagtttctaatttgggtacctggtgggatggtagaatgaatatttgttttggacaaattgacttgaggttcctttgtaaaggaacagaaaagaataccatcaacatcaacaaaaaggacatcccctcaaaaactctatttaaaggtcaccaacatgaaagatcaaaggtagataaatccacgaagatgaggaaaaatcagctcaaaaaggctgaaaattccagaaaccagaatgcctcttctttaaaggatcacaactccttgccagcaagggaacaaaactggacagagaatgagtttgacgaattgaccagaagtaggtttcagaaggtgggcaatagtaaactcctccgagctaaaggagcatgctgtaacccaatgcaaggaagctaagaaccttgaaaaagggttagaggaattgctaactggaataaccagtttaaatgacctgatagagctgaaaaacacagcacaagaactttgtgaagcatacacaagtatcaatagctgaattgatcaagtggaagaaaggatatcagagattgaagattagcttagtgaaataaagtgtgaagacaagattagagaaaaaagaa

SEQ ID NO: 474730 - DNA, 515 bp, Homo sapiens
caatggtaattgtgggacttaacaaagagtgagtacagctgaaggagccggggagcagaaagtatatgcatcaggtatgaggaagaaaatagattttggaagttatgagaaatgtagagacttggcatccgtgatggtctacggggcttccgaggcgacaggacagtgtcagtcttcagccactaagccgagaaggagtcagagagccttgggccagagttccaggggctctgggagtggctgccaggaggaatcctgggctgcaggcattccttggcctggtggtcagatttctggcacttgtagcaagctcctgggggaggaggttttggaggaacacctggctgctgcagttcaggcgtttggaagttgttgtgtgctggagatgtggctgggggtggaggagcggaggctgaggaagaattgggaccgggctcggcctggcgaggagcagcctggggaggaggggagaggtcagattggtctgtagaaaaggaagattagaaagactcagc

SEQ ID NO: 474731 - DNA, 513 bp, Homo sapiens
taagtcgggatctactgctcaatatgctcccagtgggggtgctcagcagtctgctgagtcacagccaccagctagatcagctcagacttcaggaacttgaggatgtagttgtagtttttatgcaggaagatggtgctcagaagcacctggtcaaactcaggcttgctgtgcttaggccctgcgggatggagaagacagtaagcaccatggaaaagttgtgtcaaatgatggcctctgagcaggagacaatactctccccttcaggtatcagcccatccagcacatcctgtatcagagtcaaaggtcttctcctgatggtgctcagcgatgatgtcagccagcaactgacactcactctaggtcagcttgacaaaggtactgacacagtgaacgtaggcatcagtcttcatgtccaccatctctcctggccagcagcctatgcttgtcattcaaggcctcggacaggtgcttaactttgaaattattctcttgaccttccaaaggaaggaggtt

SEQ ID NO: 474732 - DNA, 706 bp, Homo sapiens
atatagatttgtctttggagcctacttgggtggcatcaatatttgctttcagatggataagtatatccacaaaaagaaaagtggtgatatctatacattaaacctaaaatggatctggagaaggttctttatgaatctcaggccattgtaacaattgaaaacccagcagccattattctccaggacagctcctcctatcacagacccagagacctaggatggaagaatggtttcaagggccaggctcaaggcactgctaccatgctcagcctcaggacactgctccctgcatccagttgctccaactccagctgtggcttaaagggccccagatatagctcacgctgccacttccgaaagtgcaagcctccatatgccttggtggttgctatgcaaaaccctgctggggggatgaagcccccacagagacactctaccagggcagtgctaaggggaaatgtggagttggagcccccaaacagagtccccactggggcagcccctagtagagctgtagaaatggggccactagctacagatcctagaatggcacagccaccagcagcttgtaacctcagcatggaaaagccatgggggcagagctgcccaaggccttgggaacctgtccaggacactaatgtgcccaggatgtgggacatggacccaaagattgttttgaaactttaagatgtaataactgccctct

SEQ ID NO: 474733 - DNA, 555 bp, Homo sapiens
gtgtgtctgtgtggggtgttgtggtctgcaatgacggaaggactatctcaacaggcatggaggcgaatggtaggagatcctgtcacagaaaagagaccagggtctaacacgggaagcttcaggagacctgcaacaagaagcacagactctttgccagagcatgataccaacttggacagtgatgaatgtcagctgggtgtagatcatatgctgaacggatacagttacaatgggatgagaggtgcagacagtgaatcaagacagagcggctgcagatgtgtgccggccatggataaaggagagcatatccatgcgggggtccccagcagacttttagactgccatggtgcctggatcctcagctgtcacactccacagagagtgtcggagctgttggcactggtgagaagcaggatgctggccaggatggacaaacaagcagctgggaatggcagctcctatatttcagccagcaaaagccttttcaaagcctactttgcataagacagttccgctgaccacattagagtcacaggggaatagttacctctggaa

SEQ ID NO: 474734 - DNA, 779 bp, Homo sapiens
ggtggagccgcacgaccacatggcaaagccacaggctccctctcgcctagcaaaagaccctattgaattttctatgttctcatcccacttccagccctactgttgcggtggactcactagtgattgtcctgtctcccctgcctgctgccaagttggtaaactctacagacacagtgtgctgcagagaacatttccagacaacaagagaaatagctccgtgctagtactcagaggagagccagggctgagagaaaaaagcagagccctgatcagaccattcctgaagactgaaatcaccctggactttttcatttatgtcatccaacagctctatgagggcagggacttgacttactctctgctgtgtcccagtgtctacgtctttaactcagcacaatgggctgctgccactcatgtgagcttgctttttcttctgaagattattctgcagttccattcaaatggcctctgtatagttgggcgtctgatgcctgatgctagacagagaagggctccgtggctaatcgcctacattcctgtgaagactgaaggaaaagataaatttcgctaacagtcaacatttcagggaaggcatttttttttaacagaaaatggtaaatatctgaaaatatagaaacctcaggcagtttgaaatttgcaaggaaggagtgcctggcagttcaactgctttaaaattccacttccgaagataccatatgaatctaaataaaacctgaatgattatggtaattattcacactaataaccttgctctgaaa

SEQ ID NO: 474735 - DNA, 563 bp, Homo sapiens
tctgagagctccatgagtattgtgtatgtgtgtgtgaagagggaaagtgatgtgttaaggagctggacaaatatcctgtcaaacatccatgattttttttattctcggaaatgttgccttgattctagaaattatgactttgaatacctactaacatgtactgggcacttctatgtgcccggagctctgccaagtgttttacattcattatctcatttgacctttatgagggccataggaagtagatgtgacttagagatgttaaataacacctctattccagcagacaaatatgtttccttcatgtttctttgcctgcatgcagcaaggagcatgacttcaaagtctcagatctcgcatagaaaaagaaaatatgaagataggcaatgcaaacatcaactataatcttatgcccaaatattactattattattgggcatatttttcagcagtgttttttctatgcatgttaatgtatacatgtgtaattttttggttctgttttattgcttgcgaatgtattatattaacagttttctatgcaacttttctcaccaaagcat

SEQ ID NO: 474736 - DNA, 664 bp, Homo sapiens
gcactagcagaagtctgagacaaagaacattatctcatgctttcctttactagcggaaatccaatttatgttctaaataaaagctgctttgtgttgaactcacagcaatactcagaacccagcaaggattttgcttggagtattgttttaataggtagtgctttacaaggcttgcatggaatttccccatcgcatcttctggctgtcagacttaaagagtatgaacagctggcagggaacatggctatgctgacccactttgctcccaccaagagccactcactggaggtggtggacctccagagaccctccatcctgtggcctgctccagaaacaaggagcctggaggagagaatgaagccatgctccccggaacaggtcatgtcccaagggatagaagtgagcagatgggcagagattgtctggtttcttcttcctttgctttccagttctgggaaggttaaatgaggtaaagggagtccaggaggtcctcgttacatcacagcccattacctcatataaagaagacaatgaggtacaagctactaaagataatagcaggaatgatatacatgtatctgtacacatgtttcagatattcagtatcagaatacatccgtaagcaagaacttagattattgagtgtaaaccacctttctgatgt

SEQ ID NO: 474737 - DNA, 1764 bp, Homo sapiens
cctctttcttttgcaaattgccatctcagccatgctctcgctttgccttccgccatgagtaaaagctccctgaggcctccccggaagcagaagctgctatgcttcctgtacagcctgcagaaccgaaccactacaatcaacacagttttgccaaggagaaataagtttgtttattcctgtagcataaaaatccatgctttgggatccgacgaacccttggaaagcattttctgcatcctgctggttgtggaagcattttccctgcaaaaagttgttgagatgcttgaagaagtggtagttgaatggtcgacattgactccttcagcaacttttcatgcagttgtaagagcatcagctttgatgattgctctcaattggtcactgtcaacttctgatggccggccactacgctcctcatcttcaaggctctcgtctcctttgcaaaacttcttgaaccaccactgcactgtacggctataccaaaaattaaaacaagatgccgtggttgtgaatgactgggtggctgccataatttgggtgaaggaccttctgaggtattgacatctgatttgcaagaaggaacttgtgtcatactcattttcataaactgaataatcaataatcacaaagtaatggattaggcctggaggaattgacaatctggctcaagatataaagaatatgtgaacagtcttccttctggctcttgttagaggcaagaaatttcaggaaagttttcaaacattaaccatttgttcactcaaatcaatgttctggaaccaaggtaatacttgtaaaagaataaaggtgaaaagtgatatttctatgtatttataactttaaagatattgtcaaaaggacacacagagaaggaatatatttgacttcaagcaaatgaaagcaatagtttcaacaattagtctatttttctcactcagtgagaagcctagaattaagctaatgatagaagcaatagctctgcagtgttatcaaggatttagcctctttctaactttctccaccatcctaaatgtgcaactgttatcctcatggctgcaccaaaactagatattatacctagctatcaagcagaaagaagtaaaaataaaaagcaaaagaagctttgcctttttatttcgaagggatgccctctttttgggcaagcactggcatcacattggttagagaaatgagttttcagtgggacaccttactgtcccaatcaaaatctaggttttatttataaggaatatggggaaatagatactggataggtaataacagtgtaagacacaacagtattcaaacttggcccccatacagtttagagccacactctggggatctgatcataactgtatttaatcatcatatttttggtggggggagctctcagagtactcacttgtgtactgctcaaatatttgatgcatactaagcatggcataggcactggtggcacaaagattaatgtgacgctgcagcgtgagtatgcattttaattaacatgtttgttaaatttgtcataaattttattcaattgaattacttactaaattatagtatattattagcaactgctggttggtgcctagcttcctataagaacataacttcaaataataagtgaataattcagttcagtataacaaataaatatacaaaaaaagaggtaacaaatattgaatattatgttttcaactagattttggggcatcatgaaatgcagactttgtttctaaaatctgatagtctttgccagtt

SEQ ID NO: 474738 - DNA, 1818 bp, Homo sapiens
taagaaacctagaggcttaatccatctctcctctccccaaagtatatttgtttacattcacaggtacatgtgcacaatgtgcaggttagttacatatgtatacatgtgccgtgctggtgcgctgcacccactaactcgtcatctagcattagaggttacatttctctaccctagatgctttctgcagtcaatgataactgatgcaaagcatgagctcccttgccttacattgagatcaattctgacaaaattttacaataccaaatataccatttacaataaattatgcaacactgaagaatcaccgatttttttcatagaatataatgaaagagctgtatatacaaagcagcccccaaatgttgaagttgctgagaaaccaacgaacaaggcagacgaatccagtttgtcgacaaagggtgtttgcagattggcaaagactcaaaaacttgcaaacagcttttattgtggaggttgtgaaaatataagaattctcataaatgctgttgggaataaaaaattttataaagtctacagagggaaatttttcaaaacagtggcttcttgctatcagcaagggatcggcttcagaatccctgtggttaccaaagtctgaggatgctcaagttccatatataaaatgacacagtgtttgtgtataacttatgcacatcctcccaaatactttaagtcatctttaaattacttgcaatgcctaatataatgtaaatgctatgtaaatcattgttatactgtattgttttaatttgcattttttgtattgttatttattattacttttttttcccatccactgattggtggggtccatggctgtggaacctgctgatacagtgggccaaccatatctaagaaaactaatatgcgctttctctttgattaagaaatgttatttctgagaatttatcctaatgatatatatccaaaaatatgaaaatccatatatacatttcatgttttttgtgatggcaaaatattagctgttacttaaatttccaaacacagatttctttcaagcatagacataaacactgaagtacttattacacacaatggtgtattatgcagcagtaaaaacaaaagaaagcttgctctatgaactttatagggtcattaccaagatatattaaatagcaattattaaggtgaaaaaagtgaagagtagatgtatctttctatatcaatataaatatagatatataatgctatcttttgtttaagaaagatgagtaaatgaaaaactataatctgataatctttacaaaaatgaaccaggaggataaataagaaaacaatgaagttgcttacctatagggaataatgagaaaacttggtggagggatgatacagttctggatataacttttctatactttgacttttggaagcctgttaatgttctacatattcaaaacataactttatatcataaggctggaaaaatactcagaaaataagctgaaaacaaactcattcttttcaaataaataaaataatcacactgaaggaagaaaatgtatgaaagagtaaattcaaggacatttttacacaaaatttgactaaatactcactcttgcagtcagggaaaaagagtaaacaaaacctggaatcttttgggtgggtttgtcatagtggtgtaggtgcagcaattctaaaattattgtaggtatattagtggagtaaataataaatgaatgttgaaattattagaagttctattttttatgtttaatttttaacttttgtggttacatagtaggtgtatatattcatggtttacattaggtattttgatat

SEQ ID NO: 474739 - DNA, 486 bp, Homo sapiens
atttgttttcgatggagtcataatgagagcaaagcaggagctggaaatcaagtgtgatactgaaatgagaaagctaaacaaaaaagtgctgcaggaaggagtaagacggttgaatgagcagaagaaacacttagagggcagtgcagatgggaaatgtggggttggagctgccacacagagtccccacttgggcattgcccagtggagctgtaaaaagagggacacagtcctccagacccagaatggtagacccacagacagcttgcactgtgtgcctgggaaagctgcagacactcaatgccaaccgatgaaagcaaccaggaagggggttataccctgcaaagccacaggtgcagagctgccaatgctgtgggagcccacctcttacatcagcataactcggatgtgagacatggagtcaaaggagaatactttgaaactttaaggtttaatgactgccctgttggattttggacttgcattgga

SEQ ID NO: 474740 - DNA, 861 bp, Homo sapiens
ttttttttttatcaacctttcttaaatatgaggggacaaaagtacagaaaagtccagtaacaatgccctctctggaaagaggcaccaagcagttttcagagagaggggaagtaactcagagaagagaggaaaaggggaaaggaggggaaggggaaggagtgatggaggaaatgaggagagaaaagagaagacaagatgaaagtacaacccctaagaagtctggggaacctgtggagaaaatcacagttccttctcttggtcctggagactgtgctaaacccatcagagttccaggactcgcaaggaagaaaccagtcctctgggaagccttctcagaaaagttggggcactggatatataaactgacgctttctttcccctgggtgaagctggtgctaggggatcttatggccttccaccagggacacgatctccactaccgccatgtaacatgtgcctgtttccccttccaccatgacgtgtgatttttagcttcatctcaatcaatttgatatatagtgtttcaaaggtatttaattctaaatataattaaattttctttacattttctgtttatcccatgatttaaagaatgttatttttagttagatttttgtaattcattttatttaatatacatttttctgtcattaaatgccttttataaacattttttataattactacatgttatatgatgcagaacatatatttaattataattctaaagtaaaatatttaggtatcctcaatttttaacattttaaataaaaattgatttatatttaattgcttatttctagccactttattaaagtatgaatgacatataaaagctgtacatatttaatgtatacatat

SEQ ID NO: 474741 - DNA, 699 bp, Homo sapiens
tcctcaaggttcattcacatacctcctgctgcacaaccagccatggtaacaacaactcaggaacccaacaataaaactaggtacacatcatcaatcttgatgttaagcttgagaagctcacatggcatagtctattctccaggtgtatacaacagaatcatcaatcgtcaacataaagagtcttctgaggcccagattaccagaagttggtcaaagagtgggaacaattctaatatttatgtcatagtgttgttaagattaaatgaaataaagcctatagtgtcctgcacatctacaatttcagagtccatggaaagtggaggtgtctttctccatgaaaccagtgtcttccatgaaaccagtccctgctgccaaaaagatgttaaaataaagtttctctatgggcttgatggatcacatgggcaaaaaatctatataaagtatgtcattaaatatatatttttctacattgtttaggtatcaacaggtagatactctttggtcatacaagtgtacattaaattgaatccagttgatagaatgtttgatttaatcaactgaaagggctttgaataattaacagaagttgtgctcttctggctgggtttattgatgtattttgcagaagaaaatcaaatgcctctgtgatggttaatattgactgtcaacttgattggattgaaggatgcaaagtattga

SEQ ID NO: 474742 - DNA, 661 bp, Homo sapiens
atacattacccagtctcagatcctaccatcttgtaggttacctgtcattgggtcatcggcccgctgtgaacctactactacatgtggttttgggggtggtttatgaggtacagaacagggccatgcctgcagctttgctcaactagtaatggaaatggaggagtttcccagagaacagccacagtgcacatctacaattctacaattcagtggtcaagtcaatgctcctggtatccccgatatctctatgaccacaactgcacctcatccccaatgatgctggtgacaacaccagccacatgggccaggcagccacagagtcctgtcattgccatgacctgtcacagatggcctatgtctgactttcacctgccaatcttggcacaagtaatttctacctccatccagacacaagtatataactttagaaaagacaaaaatgatcatatactcacttcagattgagtatgaaaacgctgtgttgtcacagaagttctgcaatcagattgtaaggaaaatgctttcccagcatcattctcagcctgtggaatgtgctacatccgtgtacaattaaaatgtttatagatataaggtagttaatatgattttcaataaatcccatatggactctttcatctatcataattttatgtttgagtct

SEQ ID NO: 474743 - DNA, 930 bp, Homo sapiens
ctgcaacgaactcattttcaacaaagcctggccatctgatatggtttggctgtgtccccatctaaatctcatctcgaattatagttcccataatccccatgtgtcatgagaggtacccggtgggaggtaattgaatcacgggggtgtttaccttcgtgctatttgtgtgataggattcccagagccacctcacaactctgctctctgcattccggtgcagtgtacctcaatgtcccagacaaggctcaagccaacacagttgcagatcagtgcattgctccagagggtgcaaaggataagctttgggttggggccacaacggacagccctgattatgacaatgtccaagaactctgggattacagctgcaacagagtccctaaaactttagagctacccatgtgcaacatcagcgtggaaaagctacaggaatatgactccaactctagaactgctgcatgggctgactatagcaaagccataggcatggggctatccaaggtcatgggatcccaacccctgccccagtgtgtccaggacgcaggacatggagtcaagaaaaattattctggagacttaagttttgatattgtttaccctcttgtgttttagacctacttgtggcctgtttcctccttttttttgtctattactcccttttggaataggaatatctgtcctatgcctgtcccatcattgtattttgcagattatttataataactaatacaatgtaaatgctatgtctgtaggtattatattgttaggaaatgatgacaagaaaaaagtttgtacatgtgcagtacagatgcaatttttttctaatatttctgatctatggttggttaaatctacagaagtggaagccatggatagagagagccaattgtttagttattcttactaatatatttctggaattacatacac

SEQ ID NO: 474744 - DNA, 557 bp, Homo sapiens
gcctcttgataagctgccaaagaggccctctggatcctccatacctttttccattgtgacggttaatatgagatgtcaacttgactggattgagggatgcctagatggcagtgtattccttcttaaaattgtaaaacagcttcaggtaggtctttcaggaggtattacaggagaaggcattgttatcatagatgacagctccatgcacattactgtctgtgatgaccttccagtggggcaagatgtggaggtggaagacagtgatattgatgatcctgaccctcaagacaaacttccccctcttcctcttcttccttgtcatcctactcaaggtgaagacaaggatgaagacctttatgatgatctacttccacttaatgagtatcagcaggcaacatctgagttgcagctttctgataataaagcagcttccttggctactcagttctgtggtgtggctctgggagccatgcctggacacatgctggaggctttttcttccctcagttctgtaaaccatttgacaggcttttaagtttcttcctacttttatgagc

SEQ ID NO: 474745 - DNA, 491 bp, Homo sapiens
cgccgcctttaagaacttcagatggatagcaggaaaacggaaaaacgtctaggagagaagccagcactaaggagggaaccagatcgtgagacaaaagaattggaatccaaggccatgaataacttttcagttgtcatgggattagtggctaacgaggtctttgggggcatcccagtgattccctttcaagaaagggcttgcagtggagctatgaggagagctgttgacggaccttctctctgtggtgccctgggcagctcccagccatctcccactctggagctgaacaggaagctcagaccactgtgcaccccacagattgccagaggcaacagagcttctcccagtaaacaaagatcaggtatatgcacatctgcattggctgcagctggcttttacctgtataagatacctactggcctggaggttgaatggcacaacacaatagaaaatctgcagacacaagtgctcaacagtggggaatgagaaaa

SEQ ID NO: 474746 - DNA, 688 bp, Homo sapiens
gatgagagttagtgtctaaattccctggctcccttggcgctcaggcatgatggagcagatattgtgcggaaaggaccccagtggagaagtgaaaagagaaaggctgtgtccctgtggtgcaatcctttgtggagcaaagttccccatttcttcagggactcagcccacttgcacccaggtgattaaaaagttttactgctcacacaatgcctatttggtggtctcttcacatggacgcgcacaacattgggattccaagacatgtcccaaatcttcatttaaagttaagagtggcaactctccacacaaatacttactggcattgttcaaagtccagtcagagacttttcacaaagggaaggaagatgttgcccctacatggagaagtggccacgagacttctagcttgatagcctgtttgcagtctcccattgtctgggtgccccatagcagcacacctggccaaccatgttctttataaccccctttgtcacctcttctctccaaccgtttctctttagtttctaacaaccagccattttacttttctcctctcagtgccaaaatgcttgcttatgctcatgtcattgtggcatttattgtcttcttttgctatttgggcaattgtttaaggaaggatgctttcttgtgagaggtcccccattctattgaccctaggatgcgagag

SEQ ID NO: 474747 - DNA, 547 bp, Homo sapiens
ccgcgagggtccgcggcttcattcttgaagtcagtaatcatgtctccatactatgcgacactcccctcagatgcatcctccaaactgggaaaactcaatttcccaaaccttaaactggttggcttaggattgggcctggggaatggaacccagaagactgacatcctggcaaaaggagttggtggttgttaccagattccaacatatgtagacaatgaaatcaacagaaggaatgtggacttttggaacaccaaccaaactcagaaaatttcaaggctttcctccattccctccaaattcaagaagaagggtactgagttctcctttcccttgatcccagaggcagctgcaataagaatacaaatggctatggggctttgttgtcacttcaccaatgaaacagcacacaaattcttatttgcattgaccgggtcctctgactggcagagaaagctctaggtgcttatctccatcaaggtcctttctaggccgttataagtggcacctgttagcaatgaaggataaccatcgatctataaggtactct

SEQ ID NO: 474748 - DNA, 615 bp, Homo sapiens
acactgacactgtgaaagagctgctgaataaagccatgtctcatctacctgctctctctcgagtaagatcaaaccacctacaacattcccttaaaccaaagcctgatccagagaaaggtcccaactctcttcaattctatgatggcagagagagaaatatattttgtaaggctacagaagccatagataatgattcttctgatggatctgggcaaagtaaattgaaaatctggcgaggctacagcatcctagatgccagtaagaccatttgtgattcatgggagacggccaaaatatcaacatttacaggagtttggaagaagttgactccaaccctcaaggatgtctttgaggggttcaaaacttcagtggaggaagtaactgcagaggtgatagaaataagagaactagaaatgcagcttgaagatgtaactgaattgctgcaaccacctgataaaacttgaatggatgaagagttgcttcttagaaacgagcaaagaaagtggattcttgagatagaatgtactcttggtgaacacagttgaaatgacaacaaagaatttagaatattccatagatttatttgataaagtagcagcagtgtgtgtgaggacc

SEQ ID NO: 474749 - DNA, 576 bp, Homo sapiens
agttccctgaccccttgtgcttcccaggagcatcaagccccagatgccattctcatcagtggaatttttattggctttcttttcttccctatttattgaagattgggatccccaggcagctgactctgagaagggcattagtgttcaagagatttactggaaactgagggaaatttttggagagggcaaacaactaaggagggctagccagaacccccagcagcttgagaataagcccttcagtcacgaagagggatctaggcagtgcatcaaggcatccactaaagtccactccttgctccattcagattcacttcatctgagttttggagaagctcctctagaattctggtgggcctcctctcctgtggaatactcttattccagaaacctgagaggcccaccaggggatgatctggcatgttccagcccactggctcctaaaaaattcctggatagggatgactcctgaatcttcatagctttcattttaccctttctggaggacatgtgtcttcctaaggtcatgaacatacttgccacttgttgctcaaccagtcagattagcatgatgcc

SEQ ID NO: 474750 - DNA, 539 bp, Homo sapiens
aggtagataaatccacaaagatgaggaaaaaccagcacaaaaatgctgaaaattccaaaatgcttcttttcttccaaaggatcacaactctttgccagcaagggaacaaactggaagaagaacgagtttgacaaattcatagaaggaggcttcaaaaggtgggtaataacaaactcctctgagctaaaggatcatgttctaacccaatgcaaggaaactaagaaccttgataaaagattaaaggaatttctaactagcataaccagtttagagaagaacataaatgatctgatggagctggaaaacacagcacaagaacttcgtgaagcgtacacaagtatcaatagccgaatcaatcaagcaaaagaaagtatatcagagatagaagatgaacttaatgaaataaaagaaaaaagaatgaaagggaatgaacaaagcttccaagaaatatgggactacgtgaaaagaccaaacctatgattggttgttgtacctgaaagtgatggggagaatggaaccaagttggaaaacacttcagg

SEQ ID NO: 474751 - DNA, 826 bp, Homo sapiens
tatccacagctctgcatcaccactcggcgtcaccactgtgcaacccatcagtcctgtgatgataccactgtctgactgcctgaagtctctggcttctctgagctttctggcccttctgagatctgaaggaaacaatatcttaagcataccctctaatccattcccagtacaaccactgggaaagtctgccctacatgtgaccacagctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagaggaagttactagtaaatgtgttccaccaaaaaaacaaggaaaaaacatgggatccaggaagcaggtcgttcagcacatgagaatagtgaagagaattcccagagcaataaagagaaatcctggaaaagatatttttaagcttttctataaatctggcaaggaaattcattcttatcaagttgtcactatttgactctatttttcaattgagaataaataataagaaagactaaactgtttctccatgaaagctttattttagaattcagtgttactgttttctataatttttaaaacttcaaatgtgtagttcctgaaatactttaatagcagaatctttcccctccatcaaataaagccataaggttctaggcactagcatctaatattagcaacgaaaataaagaagtctattttgtgagaggcaacagaccatcaacaaaataaaatatagtat

SEQ ID NO: 474752 - DNA, 1587 bp, Homo sapiens
gagaacgggccatgatgacgatggcggttttctcagtggtgatacacgaagaaaaagatactgttcctataaaagaaaaactacatctagattcagaaagattaatcatgtcacaatcaaaattcactcaaaagaataaagttaatatatattcaaatgaggacatggatgaagctggaaaccatcattctcagcaaactaacacaggaacagaaaacaaaacaccgcatgttctcactcataagtgggagttgaacaatgagaacacaaggacacagggaagggaacatcacacactgggtcctgtcacgggctggagggctaagggtgggatagcattgggagaaatacctaatgtagatgacgggttgatgggtgcagcaaaccaccatggcacgcgtatacctatggacattgatgaaattggaaaccatcattcacagtaaactatcacaaggacaaaaaaccaaacacctcatgttctcactcatagaggggaattgaacaatgagaacacatggacacaggaaggggaacatcacactctggtgactgttgtggggtggggggaggggggagggttagcacgagatatacctaatgctaaatgatgagttaatgggtgcagcacaccagcatggcacatgtataatatgtaactaacctgcacattgtgcacatgtaccctgaaacttaaagtataataataataaaaaaaaataaaaaaaattaaaaaattaaaaaataaaaaaagaagaaatatgcaaatcgaaggtaaattaaggagaagaaaatttaaggttgactttgttttttgcttttaattcacatttatttgctcttctttcggttttacttggatatacatacataaagtaactgtttagtttctagtggaaggcttttatttggttctctgaatagtcattttgcttcctaataatttccaacaattcattattttctgttcatttaaaacataagctacttttgtcaataaatgatagagtgtaccagccacttaaaaatggattggtttggtttacatctgataatatagagagccgtaagagctttaagtttcctggccaaaaattaaagaacagttctgttactagaatgctagcaattggacataagcaaagagtaatctaaccactttaatacaatggtttgatgtgctgcaggcaataactactagatgtgaaactagtgttcaatttgtgatgtgttagaataatagggctttctgtagtattagtaaactgaaccactaatttctaaatgttatgtctaaatattcgttgaacattggcttctgttcttagcataagtgcctatattatacttgatcatttatattgtagatagactactttgctgtaagataagtttctgctcacacattatcaatagagtgctcttttactgtaattttatttctatattgctcttaaagtcttttgattatcactttggttaaatgaatattattttgtaatgacctgtgattccattttgagcaaatgttttgaggctttcaacatctttgataaacatcttatcaactaatccttgtgttgtaat

SEQ ID NO: 474753 - DNA, 589 bp, Homo sapiens
aggccaaggtggctttctggcatagcatgactcagcgggtttggagcacaggcacacaactctgcacattatgtggaactcttccactgtgattcccagtgatacagaaaatgcatatcttctatcagcaactttccctgattttcccattgtctgctttacagcatattctaatagaatacctcagccccataaacactctccttatgcaaaaattaaagtagcttttagctacttcttgaccaagtgcttcacaatgggtctacgggaaacaagttactcagcctttgtcatcagattggagtgcagttactttttgggtgttgccctacacccagctgccacggacatgacaccctcatttgttgacccaagaaatgttgtgagtgaaggtcaataccagccagaggcaaactctcccttgccatcgcagccacgtctattaaaactttctccatatcagcaaaagggctgttcacattcttatcattagtgtgttaactaaagtagcatctggaattttctccgaaagcttcttttgtttcacaagttggccacatgtactgtaaggagcagacaagatggcacc

SEQ ID NO: 474754 - DNA, 1457 bp, Homo sapiens
cacttctgagaatcttgaaaacttaacgatttgtgtgcctaccggccatgtgttttaatgcctgtttcactttattctcagccatatatttcattaagtgtccctcagctgcaggtctgctggagtttgctggagttccactccagaccctgtttgcctgggtatcaccagcagaggcttcagaacagcaaatatggcagaacagcaaatattgctgcctgatccttcctctggaagctttgtcccagaggggcagccgcctatatgaggtgtctgtcggcccctactgggaggtgtctcccatcaaaagagacaagcttacccgttacatcagctacaatattcagctgaaagggcagcaacaccctaatggacaagagacatcacttcaaagggagctgagatatgtttgcaaggttcttgacaccttctcagaaaagttctcactaaatgctaacagtatgacgctatgatgataaaaatcacaattttgcaagtagtgtgatcatctatttttcagttcatccaacgcaccacttgtagattaatttcctggaggttgccacaatatgcttaataccagcaaattgacttcatttcttaccactacttcatgaagcacatggactccttattcaccaaatggtcttaattctgtcatccttatgtgtaggtacatgtgttgtgcttgttcggtcatcactgccttaatatctacagctcattcttcaagtgctatgttatcctttgctgaatcctataactaaatttgaacttttatttttctctgaacccccttagcctcagtgcatattttttaacagcatgtattcagccttctgacttgcttatgtaaacatttgtgttgttttctgcctcccaacacaacttagccattattataaactccttgagtgtcataactataacacatatatttgggagctttttagcacctagcaacatgcttgtacatagtaatagagcagtggtttttaatttgaatacaggaaaatacattcaattaccatagtagcatcatactgatgttattctctattttaatacaatcctatgaagaaagggttaattttcctcatacaaaatagttataacaaaatagttaacatattttgttctctatggatggcagaataaagactactaccatcccactgatattcattctggtttttttcttaatgaagtttctagctgagtacatgtctgcccaaataaaggctagacttttccatttcccttgctgccaggtgtgtcaacataatagtgtttgggccaatgaaatggaaacaaagtgatatgtataatttccaggtcatgcccttcaagagaagatatgcaccctcccttcccttggattcttttccagtggctggaatatagatgtgaggatgagatttcttggaatgtgcacatgggggcaatacctaggggac

SEQ ID NO: 474755 - DNA, 642 bp, Homo sapiens
gagggctgccagcatggtgtcacctctcaccggcaccccagcacctctctgcaccatgctgctgctgccagggactcctcatgagcaccagggctgcctgattgtttgggtagagttgcagactttccccactgatcccagcattacactggtgcctctgttgaaagaaacttcccacaagtggaaagttctgggactcaagccctaccatctggattctcttgtcccagagggtgatcccttgatgtggtacactcttccctcccctaggagtgggagtccctatggtataatggactgtgtacctgcagatgctgtaatggaatgtgttggctgccctccagccaggaggtggcacttgcaaaagagtggcagctgcagggtaccaatgggatttatgcctgccttattttaccctgaagaggttctctggtgtctcagtcaatgtgcagagccatagagctcccaaaagtttctgtcctttgtgttagctacaaggataactagttcatgaagataagacttgtctgaaaaaaaaaacctgaatgtttgattctagatttttgttgttgttgttaaaagttctagacttcaccaagtagtcttttaaaatattaccagaaagcttagcatcacttttct

SEQ ID NO: 474756 - DNA, 645 bp, Homo sapiens
ctagttgatgggtgcagcaaaccaccatggcacatgtatacctatgtaacaaacctgcacgctgtgcacatgtaccgaagaagaagaagaggaagaggaagaagaggaagaagaagaagaaggagaaggagaaggagaaggagaagaagaaagagaagaagaaggagaagaagaaagagaagaagaagaggaagaagaagaagaagaggaagaagaagaagaagaagaagaagaagaagaagaagaagaagaagaagaagaagaagaagaagaagaaagagaagaataagaaggagaagaaagagaagaagaagaaagagaagaaagagaagaagaaggagaagaaagagaagaagaagaggaaagaagaaagaagaagaagacgaaacaacttccaggctgtctttcaaagtggctgtaccattctggattcctaacagcaacagtttgttgaacatttactgcctgagcattggaagttactgtgcttttgatgagattggagtgttaatatttgtgcagaagctgcaaggacagggcttaaggaaagatggggaaatcagcactaggtttcagcacttccctgggcagtgcctctctatttttgcttgatggctacagctgctgcttcttctgctactgcca

SEQ ID NO: 474757 - DNA, 541 bp, Homo sapiens
tgcctctcccaccgcagctgatgtccttgcagtggctgctccatttgggccgccaccaccatcacaagcaaaatcttttattttctttgttctgtttacttcacttttctgggcccaaagaaacaatcaagaaaaatttttatgataaatttcttaaatatcataaagtggaaagaagctggttgctagcaagagtagggaagcatagtggagaaatatatctagcagaaaagaggatgtcactaactgctgagcaagaattgtcaggcaaggtgtgcagaaagccagacaaatccaatatacgaggtgaagaagcagtcaacacaacaaagaagaaaggaggaaagcaagtagaggaacaaggaggcaaaggcttaattcctgtatatagcttcgcacttctctttgctaaccccatcctccaactcacacaaagccaaagatgaaacaaaacgtgtattcgctaagtttttctgttcctgaagaacgtttagttcatttacatttagtgtaattactaagagggttgttatttgatttt

SEQ ID NO: 474758 - DNA, 710 bp, Homo sapiens
agacttgtggttcaagagtttgaaatgaagaggctacacgggggtcaggaacccgcttgaagaagcagtcggtccattctcacagctcaaacgtcatgctgagagaaccactgctctcttcagagctgtcagacaggtatgtttaagtctgcagaagctgtctgctgccttttgttctactatgacctgaccccagaggtggaatctatagaagcagtaggccttgctgagctgtggaaagggaaatcccccggccccttgtgcttccgggataaggcgatgccccaccctgcttcagctcgccctccatgggctgtacccactgtccaaccagtcccaattcttccagtgaactctccaataggctctagtactctcctcttaacacaatctttgggctatgatttttcccctgcaattttgcttcttccttctgatgagaactggtccctgaaatctctagtcagccatctggagaagctcttcaatgccttaggcaatggattggtctgcaggatgtctagtggcttagggtccaatcttagctccagatggctacaacgttgggtgctgctggaccaggctgacctgtccagcaatacccaacatgtgggtcacagagaagtggcatggactttgtaagatttcctgggttataaatagccttacagtggtaactttctcaattgccagttatagtaataatgtat

SEQ ID NO: 474759 - DNA, 861 bp, Homo sapiens
aggtaatgtcaccagttaaggcagaaacaggccattttcacttcttttgtgattattcagttacttcaggccatctggataggatgtatgaaaatgactggatgtctagtcagaagtctgctgcagggtcagagtcctcatggagaacctctaacagggcagtgcagagggaaaatgtggggttggagcccccacacagagtcacctctggggcactagctagtggagctgtgagaaaagagccaccgtcctccagaccccagaatggtagacccactgacagctctcactgtgtgcctggagaagccacagacacagaaggagctcttgtggtccacatgccggcacagtgcaggaatctggaagagtttatgccccagacgactcttgctgcgtgtatgtgtatgtgtgtttgggtggggatatgtgaagtgagaggggcattaacagaagttaagggcatctttcagagtccaacagcccatctagtgtctcctaccccgctgctgatgccttttggtgacttctacaagctgataattgttttcttagttgtacattcacttcacagtagaagtccctggtgttctgggcttttcagctgctcataagctaccagttgccattctgatcttcaggtcacaaagatattgttctatgcttttatctaaagattttatacttagtattttagattttgtaaatccatgttccattttgagttaatttttgtataaggtatgaggtagagatcaaattccttttttctgccaatggatctccaattgtctaccactaatttgctgaaaagttatctattcaccattgaaatatctttgtacatttctcgattgaccattt

SEQ ID NO: 474760 - DNA, 904 bp, Homo sapiens
gcgtttctgctgctgcgtcggtgagcacaactattccgatcagcagggtccagtcagcaagccatccccagtatggatccccactgtaaccttgactcacatcatggggactggagtcgtaaacatctgttgatctgtgatctagaaggactaaggagaattaggaaaaagcccataaattattcaatgatgtccaccacaactcagagaaatgaagaaaatccttctgccttcctcgagtggctacgagaggccttaagaaaatatactcccttgtcacccgaatcactcaagggtcaattgattctaaaagataagtttattacccaatcagctgcagatatcaggagaaagctccaaaagcaagccctgggccctgaacaaaatctggaggcattattaaacttggcaacctcagtgttctataatagggaccaagaggaacaggcccaaaaggaaaagcgagatcagagaaaggccacagccttagtcatggccttcagacaaacaaaccttggtggttcagaaaggacagaaaatggagcaggccaatcacgcagtagggcttgttatcagtgtggtttactaggacactttaaaaaagattgtacaatgagaaacaagctgccccctcatccatgtccactgtgccaaggcaatcactggaaggtgcactgccccagaggatgaagtttctctgggtcagaagcccccaaccagatgatccaacaacaggactgagggttcctggggcaagtgctagctcatgtcatcaccctcactgagccctgtgtaagtttaaccattgagggctaggaaattgacttcctcctggacactagcgtggccttctcagtgttaatctcctgtcctggacaactgtccgcaaggtccgttaccattc

SEQ ID NO: 474761 - DNA, 492 bp, Homo sapiens
tggcacccatatgcatctccttaaaccatacttaatttccaaataatgacagtaacgagaggtggagtctacagaggcaggcaggcctccttgagctgtggtaggctccacccagttcgagcttcccggctgctttgtttacctactctagcctcggcaatggtggccgcccctcccccagcctcgctgccaccttgcagtttgatctcagactgctgtgctagcaatgactggagtcttgctcctttgcccaggctggagtgcagtggatccactgctgtctttggagctggcaagcaagaacctttaagtccgctgaagctgcgcccacagtctccccttcccccaggtgctctgtcccaggtagatgggagttttatctataagcccctgactggggttgctgcctttctttcaggcatgttctgccctgtgaggaagaatctagagagaaagtctggccatagtcactttgccgtgctgtggtgaatt

SEQ ID NO: 474762 - DNA, 771 bp, Homo sapiens
tccaacaacaggactgagggttcctggggcaagtgctagctcatgtcatcaccctcactgagccccagactcatcaatgaggcagatattcctctatatccagttgtacccaacccctataccctgctctctcaaatacaagaggaagcagaatggttcacagttctggacctcaaggatgccttcttctgtattcccctgcactctgactcccagtttctctttgcctttgaggatcccacagaccactcatcccaacttacggggatggtcttgccccaagggtttagggatagccctcacctgtttggtcaggcactggcccaagatctaggccacttctcaagtgcaggcactctggttcttcagcatgtggatgatttgcttttggctaccagttcagaagcctcattccaggaggctactctagatctcttgaactttctagctaatcaagggtacaaaatgtctaggtctaaggcccagctttgcctacagcaggtcaaatatctagacctaatcttagccagagggaccaggaccctcagcaaggaatgaacacaatctatactggcttatcctcactgtaagatattaaaacagttgtgggcgtttcttggaattaccagcttttgccgactgtggatccccagatacagtgagatagccaggcccctctgtactctaatcaaggaaacttagagtgcaaatactcatcctagtagaatgggaatctgaggcagaaacagccttcaaaaccttaaagcaggc

SEQ ID NO: 474763 - DNA, 1014 bp, Homo sapiens
agcaaacggcacaccaggagattatatcccgcacgtggctcagagggtcctacacccacgtagcctcactcattgctagcacagcagtctgagatcaaactgcaaggtggcagcgaggctgggggaggggcggccaccattgccgaggctagagtaggtaaacaaagcagccgggaagctcgaactgggtggagcctaccacagctcaaggaggcctgcctgcctctgtagactccacctctgggggcagggcatagacaaacaaaaggcagcagaatcctctgcagacttaaatgtccctgtctgacaactttgaagagagtagtggttcttccagcatgcagctggagatctgagaacggatagactgcctcctcaagtgggtccctgacccccaaatagcctaactgggaggcaccccctagtaggggcagactgacacctcatatgtctgggtactcttctgagacaaaacttccagaggaacaatcaggcaacaacatttgctgctcaccagtatccgctgttctgcagcctccgctgctgatacccaggcaaacagggtctggagtggacctccagcaaactccaacagacctgcagctgagggtcctgactgttagaaggaaaactaacaaacagaaaggacatcctcaccaaaaccccatctgtacatcaccatcatcaaagaccaaagcaatggaacaaagctggacagagaatgactttgacgagttgagagaagaaggcttcagacaatcaaactactccaagctaaaggaggaagttcgaacccatggtaaagaagttaaaaaccttgaaaagaaattagatgaatggctaactagaataaccaatgcagagaggtccttaaaggacctgaaggggctgaaaaccaaggcacgagaactatgtgacgaatgcacaagcctcagtagccgattggatcaactggaagaaagggtatcagtgatggaagatcaaatgaatgaaatgaagtgagaagagaagttt

SEQ ID NO: 474764 - DNA, 1156 bp, Homo sapiens
ttcacacattcactcaccacttccctgggaggggacgttcccctgactctgtgtcactcctggaggccaggataccgctaaaatccacttctgttgaaggcggcactgctgccatctggcggacttcgaaggagagacccataaggggagaagtcggttcaattctggcatcttgccgctactttctaggaagtcgggaattaaacaggggaaacagacctcactcagaagaatatgggaagtttggctctaatgggagggccaagagatagtggaatccactaccatgaggagtgtcaggaaaagatttacagaagaggcaacaccgaaggctctctggaaagaacttgctgtgaagcctactcaggttttggcaaaattgagtttcctgagttggggataagggagaataaatcacttcgtgctgatggatcccatggaaagggtactgctacattccaagggaaggagaaagctatttgtctgaggagaaaccctcagacaaatcggagaagcaggaatctcaagcaggaatcccgtgtgaccaactttcccatacaatcccaggagctaagggaagacttgttcatcacttttgctgtccagctaatgtatatggataatttgtctgatcaattgcatatcaaaattgacctcaattagaacacagttcacataaatacttcagaaaaaaagattatctagtgttcttgctgtgggcactgccagtattgcgatacatactactctggatatttattttctgccagtgtggtgatacatgaaatactatgaaaaattagaagatctatgaggggaagaatgtggatccttatctttttccggaccaaagagaattttgaaagctaagaatttatttatttgaagatgaaactaatgtaggccccatgaataacttaagactgaattaatctaatcattatctgttcaatccacactgaaaatcttgtcttctatttctttttcaatattctttattcaaaagtgcttataccatttcatattcttaccagctgtgagcgttcaagttgtttcacatccttgcctacacacttggtgctatgggctgaattgtgtctgtgatggttagtattgagtgtcaactcgattgggttgaaggatgcaaagaatattt

SEQ ID NO: 474765 - DNA, 540 bp, Homo sapiens
cagcacgctgtcacctctcactattgtgagacttcacgttgtgatggtgtatatctcctaatgctatccatcccccagacccccaccccacaacaggccctgttgtgtgatgttccccttcctgtgtcccagtgttctcattgttcaattcccacctatgagcaggaccctcagctgcaggtcttttggagttcactgaggtccactccagaccctgtttgcctgggtatcagcagtgggggctgcagaacagcaaatattgctgaacagcaaatgttgctgcctgatcattcctctggaagcttcctctcagaagggtacccagccgtctatgccctgcccccagaggtggagtctacagaggcaggagatgaattaatatcatccagagcttctacagtgtttcatatgccatgtgaagtattcaacaaaagtttatcagacatgctaggaaataggtccaaacgattggaaacctagaaaacaaatgctagaagtagaattgcagatgactcagaaattgaaataagacatggactt

SEQ ID NO: 474766 - DNA, 1637 bp, Homo sapiens
ggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagaaaaaacggtgcccccacctgtcgcccctatggacttcccagtctccc

SEQ ID NO: 474767 - DNA, 618 bp, Homo sapiens
aacagaccaattggctctctgtaaaatggaccaatcagcaggatgtgggtggggccaaataagagaataaaagcaggctgcccgagccagcagtggcaagtcgctgtaacactcaccgcgaaggtctgcagcttcactcctgaagccagtgagaccacaaacccacaagaaggaatgaacaactccagacgtgccgccttaagagctgtaacactcaccgtgaaggtctgcagcttcactcctgagccagcaagaccacgaacccaccagaaggaagaaactccgaacacatccgaacatcagaaggaacaaactctggacacgctgcctttaagaactgtaacactcaccgcgagggtccgcagcttcattcttgaagtcagatcaagaacccaccgagtccagacacaatatcaatcatcattcagcaggacggctgtaggcatggagcaggagccatttaaccaagctggtggtctaaccaagaaggggacactagagcaaatctaaagttatccttgctaaagaagtagaaattacttattttagtagtcaagataagagggatcttttatatctggggtaacgcattgaccttatttttgtctgtgcttagac

SEQ ID NO: 474768 - DNA, 527 bp, Homo sapiens
taggctcggacactactgccatcatgtgtgccatgatgaaagccacagcagtttggtgctctgcgctatgtcatgactccagccttactctctggaacctgttctctcgctgtctcagtagaggaggaagtccaggtgaggttagtcaacgtttggaaatacagttgacccttgaacgacatgggtttgaagtatgcaggctcattacagggtactccatggaaacgattgtcaacactatggaagagaatcccaacagagagaacatcacgaaagtgctggaaggattacaccatttaagatgccattttgttacagaaaaggttgtgaaagccatcaagcccaaaacaataaattcctgctggagaaaactctgtccagatgttgtgtgtgacttcacaggatttacaacagaaccaattaagaaaatgatgaaagcgactgtggatatggcaaaaaagaatttttttttaagtgaggggtgaaggatttcaagaaatggatcttggaaaaattcaagagctaat

SEQ ID NO: 474769 - DNA, 734 bp, Homo sapiens
tcagagcaaaagataatagacaaactggcttcgtgtttcccatgggcctaactcctaaattttctgatgggttctcagcaattggtggtttccagatgcatttaaaatgtgttaattgcctgcaggaattggcttttaaagcatacacaattcttcaaattcttcaatctcaagattctactattccatgtggatggctcatgaacaaaaatgagaaacacgacgataaactggtaatgttcaccaatcaatctgaagattctgaaagggaagtgggaaagaagaataaagacaagaggcgagagccaacaggacaggaagagaataaaggcttcagagtttatgctgaaaacatctctgagttgataattcaatatacagaccctccatggcagtacattccatttctgtggcttaaatttgaagcagtttcaaagccagttaatataatagaagctacacgaagggactgggaacgtgccatcagagatgagaagggacgttaacgctgtcctatgacattttgtaagctgttatgacgtcttccaaatatttcaagcagaaagaatgtcttcaataatttattccattatttcttaacattccttaacacccacagacagttcaggcgtcgattgagattggcaaactgcttcagcggtcagacttggctcggcatctcttttttgtatgcacacgaacttaaaagactctggtgaggtagaatcaagact

SEQ ID NO: 474770 - DNA, 446 bp, Homo sapiens
tggcttcaggctttagactcatcatgatagaccaaaacaccaagctaattccagtgccaggttggcccctgcgactcaggctcaagatctacctcagcagtaggtcagcctctttggactcaggctccaggtttgcccctgtggacacaaattttatacctgtccccacagaccgaggccatagccatgcccctgaagacccagttgacaggctaacctcagtggacccaactaaaaaacacaatgacagtagtgaaaaaaatgtcgtggagagcttaagcagcagattgaatcaatcagaagaaagaatcattgacctaaatgacaggtcatttggaattacccagtcagaggaacaaaaaatgaaaagaataagaaatagtgaagaaagccatggaagttttgagtcaccatcaagaaagccaatgtatgtattatgagagtca

SEQ ID NO: 474771 - DNA, 677 bp, Homo sapiens
aattaccagagcacagaagtaaatgaattcccgtgttctgagtctcgtggcttctgtcactatgccagaatccttggctgctgccgctctgcccacagcagaccacagtagtggaagaattaatgatatgtctccagaagagttagacatcactgtctattccatcttctgccataaattgaatggctaccaggaaggtgtttattcctcagtgcttaacattcccatcccaaatatacacatgcatttcttcttgaaggaaattaaaggagtctggggagatattggcagacacctcagtcacaatcaaaagacaaaggtgctccttgattcagacacggagcacagtggtgcagaaagggtggacaaacagaaaatatccagtgcttgtgtgcctgaacatatgttaatcatggaaaatgatgagaaaacaggaggagatagtggggaagatgagagcgaatatggacaggaatgagtaaatatgatgggttaatctatgttgtaaggcacagataatagggctggacacagtaggaggtattttattctcttagtagcaattgtgaataggagttcactcatgatttggctgtttgtctgttactggtgcacagaaatgcttgtgatttttgcacactgattttgtattctgaaactttgctgaagttgcttat

SEQ ID NO: 474772 - DNA, 819 bp, Homo sapiens
ttctctctcctctcctcaagcaaaaggaaggtgtcatttttgttgctgcaagctgcgctgcctggggttgtgggaaaggcagtataagcattccctttcctgtgacatctgttgtcacactaggtcccctgatgggaggcacaggcaacagccctgagggagaacccagagatgtgcctagttgtggagctgggaaacctccttgacccaagctctctgcatgaggatggggggcagcctaaactcttactccaagagagtgggtgctccagaagcttggagatctgcctgggtgtggagtagagagagcccccctgtaccaggatctctgaacaggaagggtggagtgactcaggctgctattccaaatgagcaggtccttcagatgcctggagatcttcttgagcatgaagcagaaagagaccccctgcacctgtgtctctgcacaggaagggggagcagcctggggaacccagcaatgacacacacagactggttccaggtgacctggaactgcacatctggccctggctgcacatctcatctaggaaaaactgctgctgtagcagctctcctcccaccccaggcttatgacagggagagcacaattccacaacctaccgctgaggcactttccacagttctgtctatggaggcccctaccacactccagagcagacattccaatctctggcccaagacaaatgtctgcgtggccatactgctgaggcaccaaagaatggctgactttgtatcagcctggattaaaagtggccttctgcttttggtcctaaatcttggaaattgcctgtagctttt

SEQ ID NO: 474773 - DNA, 793 bp, Homo sapiens
ttgcctgtaaaggattcacgtgtttattatgtacctgggtatcactgaaagagctcttcagttaacaggtaatgaatgctgccagaactggattctttccttcaaggcagcaggttcccttctggcccagagtgtgtctggaaatattgtcttctccaacatgaatcccaaagctcgcacaaaggcactttgtcgctcggtagctgccaaattattgttgctgattttcaaatttgaatttcctgctgtgagctctcttgctgctcagttgaaattagagcaggatgaacttcttgaactgtcaccaacttggccacaagctgactccaagacctcctgcaaggaaagttccctgaggggacatcatgaaatgtctctgcaggagagattaaatggtttaataatgttctattaaacccacagctttcaaacaaaacccagcctttcaataacacttatcaccccaaagctcctatttaagtgatttttatctcagataaggattttaccaccaggaaagaaggtacatgctacattatcactttttagcctttttggggtgaggctttaattgctcttttttatctagtttcctaaggtagaaatttatggcattgattttaaatcattcttcttttctaatatacatgtttaatgttataatgattccttccagtactgttctagttgtttctgataaattttgatttgttatatttttatttttattcagttgaaaatgttttctaatttcactgtgatttattctttgacctttgggttatttagaagc

SEQ ID NO: 474774 - DNA, 1708 bp, Homo sapiens
ctctctcccctgccaccttgtgaagaagttgcctgctttcccttcaccttccgccatgattgtaagtttcctgaggcctccccagccatgtggaactctgtcctggtgcctcctctggtgtcctgcggagccttcatcctgtgccatctttctgcctggaggtttcacatgaccctgtgtgtgtacacgtccttctcatgtgctattgaaaatggagatgcctttacacttaaccctattatccaacccacactggcaacttcccagaccctcaccttcaaatgtgctaataggagtgtgcttcctgtccctgaggacctgccgtatgcctgcacattgcctgaccctatgtttgccattgggacacaaagagagtcttgctgccccggatgtgatgacgtgctactggaagcttccatccagcagacagggaaccacagggcacgaacaaaagaggtcatgtggtggcaggcacgctacgctttcagaaatgagctcttgaattcgaccttgcatgaagttcttctgggaatgctgggaatgaacatcacagcaacagtaagaagatttggctgtgtaaagtggaggataagggacaactactgtacatactaattggctttcttttctatctcactttgtgtattaggcagatgttcctgcaataattctgtgtaacaaacaactctaaatctcaatggctacagcagatctgatgcttaaaagccattaattagagccttgttaaacctacaacactcaatctctacgaccctaacaggcctctgctgaaatctcctctgacgtcaacccatcagcagtggatttctaaaactcttaggaagtcgttttgacttgctcagaatttctcttggctgctgaattatttatgtgccttgatggattctgaagtcagcctcccccataggaggtgggtttataaatgaggcctggagcagtctgatgttccagtctagaaggtggtgcagatgaatgtgtatgtgtataaaagacggtgaaaatatgtgatatggagtatgtaacataacattcttgtttatgtacacactatccctgaaaggatatataagtaaccttctgtgcagggaggtgaggggaaggggaggggaggaaccatttaccagatttcagcctgacagaacagttcaggcagatccttggtgtccccaagggataccacattttgttggatttggggactttggttgccagacactgtggctccatgtgaacatgccaaagtgcccttagacattgtgagcccaccatgtggtaccctctctgctaccctcaccctgaatctgattttgtgttaattttgggtgggcaccttggaagcttgcccctaaatttcctccagatttcatcccatgcacgtttccttttagctgattttactttgtacctttcactgtcataaatcatagccccgagcatggctatatactgaatcctctaatgaatggttaaacctggagttagtctcagggaccccaaacaggtactaatagatgctgttacagataaatgccaagatgtcagaggctcaacacggtagttattgccataaagatcaatgacagacagtgttcctgagggagtaggtggccttctccctggtccttcagggctcggatgccttccatcttgaactctgccttcctctaaggcctctgactcctctgca

SEQ ID NO: 474775 - DNA, 771 bp, Homo sapiens
gaggagggggatcctcttcctgctggctgcaaccacaccttttccaacaagatttcagaggatgtatggaaatgcctggatgtccaggcagaaatttgctgcaggagcagagccctcatggagaacctctcttagagcagtgtggaagagaaatgtggggttggggtccccacacagagtccgcactggggcactgcctagtggagctgtgagaagaaggccatcatcctccagaccccagaatggtagttccactgacagcttgcacagtgtgcctggaaaagccacaaacactcaatgccagcccatgaaggcagctgggaggggggctgcgccctgcaaagcaacaggagaagagctgcctaaggctgtgggaggccacctcttgtatcagtgtgacctggatgtgagacatggagtcaaaggaaatcattttggagatttaagatttgactgccccactgggttttggatttgcatggggcctgtagtccttcatttgcgccaatttctcccacttggaatgggtgtatttacccaatgcctgtacccccattgtatctaggaagaaaaaaattttaagtattagcagttatcaagctcatgatgtcagataaaaggtttccaaaatgctaagattcacttgaaatctgaagtttatcattggcaagaatatgtttgccaaataattaagtctgaataactgtaatttgtctgtcagtcatcctcataaatatgaaatttttaaaaaatggaaaagtagctaattcc

SEQ ID NO: 474776 - DNA, 778 bp, Homo sapiens
ttttctccctggtcgccgctgcctcttctcgctcccctcaggcgacggcggcagctacagctgcttctttatacaagagatgaagaagaagatgaagatgaagaagatgaagatgaagaagagatggcagaagaagattaagatggtgcctcttgctgcatcttcacatggcagaagaaatgaagaagaagatgaaaatgaagatgatgaagatgaagaggatgaagatgaagaagaagaagagatggcagaagaagatgaagatgatgaagaagaagatgaaaatgaagaagatgatgaagatgaagaagatgatgaagaagaagaacagatggcagaagaagatgaagatgaagagatgaagaagatgaagatgaagatgaagaagaagaagaagagatggcagaagaagatgaagatggtgtctcttgctgcatcttcacatggcagaagagatgaagaagaagatgaagatgaagaagatgaagatgaggaagatgaagaagaagataatgaagatgaagaagagatggcagaagaagaggaagatggtgcctcttgctgcatcctcacggtcatggccaccccactggcatcctgtgagtctttcctgtttgctagagagatcaaaagctcaggtggtggtagtggtggtagtgcggaaataagcataattctcttacgctacaggaagtatgttcagcatacatatgaagctctcttactggccaaactaggtgtcctggggttggagcttatcacataagcccaggcgtct

SEQ ID NO: 474777 - DNA, 688 bp, Homo sapiens
gtatgttatggtgaaagccaaatttgaagaaggatcaaaagaatttgttgctgacgaagaagaggaaaatagtgattatgatgtggaactattactgaatttagatttgtgcctagtgataaatcaacattggaggcaacattcactgcaatgtgtgaatgccagtacttgcatccagatgctgaagatgaagattcagatgcttacgatggagaagaatatgatgtggaagcgcaagaacaaggacatggggacatccctacattttacacctgtgaggaaggatttatctcatctaacggcagagggccaaacatgttggagattagaaggaacgctttctcagtctgtaagctgccagtatcatatggttggggtcaggacagaagactcaataggagatgatgaagctgggatggaggtggataccacaccaacagttgctggacagtttgaggatgcagatgttgatcactgaaaatgatttatgcaggtttaagattggcctcctctgtggctttcagatataggtacttaccactaattaaagtgattgtgttcatgtatttgtttcctagttcagtgcctaacattcctcactgaattgtaagctccagagaataagttccttgtctattattcaactgtttatgcccattgcctagattagtgcctgactcatggtggg

SEQ ID NO: 474778 - DNA, 525 bp, Homo sapiens
acccaacagctcactgagaacgggccatgatgacaatggcgctcagccctaaggtgacacagtcttgtatcatgactccaggggagcagttcccaacctttttggcacgagggactggttttgtggaagacaatttttccatgaaccggggtctaagaaacaaagttcagatgcaagttcttgggtgtcagtttcagttcccagacattgctccaccttctccttattcccaagaataccaaattatgcacatcctgtctgctctccccaaacttactgagcatgttgaaattaaattgtaccctgacaacttgaaaatccttttcatgattaaacaaatatttatggaacactttccagggagaatgcctcatgaagactggagtgatgctgccacaagccaaggaaataccaagcctaggagatggcctggaacggatccttccctacgccttcagagggagcatggccctgcaggcaccttgatcctagacttcaagattccagaacggtgagacaagaaat

SEQ ID NO: 474779 - DNA, 1266 bp, Homo sapiens
ctttctctctctctctctctctatcacctatcacattttctttatccattcatctctgttgggtacacctcccagacggggtggcggccgggcagaggggcccctcacttcccagatggggtggccaggcagaggtgccccccacctcccagacagggcggctgccgggcgggggctgccccccacctcccagacggggtggctggccaggcgggggctgccccccacctccctcccggacggggtggctggctgggcggagacgctcctcacttcccagacggggcggctgccgggcggaggggctcctcacttctcagacagggcagccgggcacagaggctcctcacctcccagacggggtggcggttgggcagagacactcctcagttcccagacggggtcgcagccgggcagaggcgctccccacatctcagacgatgggcggccgggcggagatgctcctcacttcctagatgggatggcggctgggaagaggcgctcctcacttcccagactgggtggccgggcagaggggctcctcacatcccagacgatgggcggccaggcagagacgctcctcacctcccagacagctgcagggcctgagctggtggcatgctggcacatggctgcagggccagatgcaagctcagtgatgagggtgaggactggtaggcgagaatggttgtgtgcttatatgcagctgttggggcagaggccagctgcaagcatgtgtatgccatgggttgcaagctggttcctcgaacctgtgtaaggactcctagagctatttctgttttgtctgtgacatataaagaaaagtcttaccctgttgtcaagcttaatactggggcttggacccatttccagttgttaaagtactgggccatcagttctaaggccctggccaaggagccaaggcttggagattgtattgctgaggggaacaatgatgaacctttagcccgaatgggagtggcaatgggtgcctcactggatcaggagcacagtggacaccctgccagatctggagggtggaagtcagtggtgggtctgcaacagcggcaaacagcagtggtggatgtcttctatatccagaggacttccagtcactaaaaaacacaattaaaagcaaagtgtcattaatgcaacattggtttttgagaagctctagtgcaatgtgaggattgagtccaggtaaacttagatgaaattggtgctccttaagagcaaaagttattgcttttaaaagctggaggtatc

SEQ ID NO: 474780 - DNA, 625 bp, Homo sapiens
agctccgcctttcacctgtgaaatttccggcgtttaggtgttcggagaaagcagcagtttttttttttggcggggggagaaatggctgttgctttagggaagaaaagcatgggttaccgccctccttgctcctgtggggtaactaatatgcacgaagcacatatcgatcacactgccaagcattgtgtttgggatggagagtcacagatgagacgaaatggcctttggggaacatggagtctcatgggagcaggagaggtgaaagcagttgcagccgatgaaattcggggctggacaccacaaaagatgccagtatttgtccttagaacaggtccagttgacaaaggcgctgcaggatatgaaagattctcattacaatgtcacggcaacatgactgaaattattaactctccacgtgggatgatggatggtatagggtggagatgtccttggcagaacatattgcttaattatcttcttttatagcattctggttttccagatgagaagtacattttatgaacaggaaaaaccgaccacagggagcttcaggagtgcccatcccaggcggtttccagggaatcctgaagtaaagtatcagatccagaaacagcatagctctgcc

SEQ ID NO: 474781 - DNA, 783 bp, Homo sapiens
ggaaaggagctgctgatacatctacaggaaacagtaaatatatgttttctatatttgagcaaattggtgtagagcaacaaatcccctggctgcccaagactgcagcttgcgatttaacattcaagagcctaacaaatgcattcagtgaaaatcgagccttattaagccctcctgactttgacaaagtgcttcgggtgcagagagatgcctctgacactagacttgaggcactgctgtctctgataatgaaagaagagcaacacccaaagatgtataaacacaaggaacttttaaaagagaaactctgtaactttctatttcaaaaaagtctttgtcttcgaagtttgtctatcacgtgtttctacatgttccatgaatataacaatgcctacattcagtgctgcaaagaaatcaaaaacactaaaacgttgaccctcagagtttctcaagtggtaacgccaataatcttcactagcagatatagaaaataccacagagcaagaaggcctttgtcagatgccggcccctcaattctggattttccagcctccagaaatacatgactttgcttctatccctgtaaagttgtacctggttgatctccccttctattctaacctaaaaatctcattctgaatatctacctcttcagctgtcattatccaataagcatactgttcatattttatataaattgttcattttctttttcaatatgtattgagtactttctctttttttattatactttaagttctagggcacatgtgtacaacgtgcagg

SEQ ID NO: 474782 - DNA, 543 bp, Homo sapiens
gaagcgacgctcgcatacttgtgctcagtgagatgaagagctcggagccaccagaatctggaagaggcgaggaagggctctcctctggagcctcgagagcgagcacggccctgctgcacctgactccacacttccagcccccagcaccgggagaggggaaactgctgttttttttagatgctgaatttgtagtatttgttgtgccaccacgggaaaccagtgcagcagggaaagccctgaacgatgaggacggcatagtgtggccagggtccaggacagccgctgacgccagatcccccataagtaacatctaccctcagggacgtgtctgcaccagtgagactgctgctctggattcgggagtaattgaattcttattgaaaatacatcattggcgatgtattagaaatagcgggagaaagaatgaagttagtaggtggaaacactaaaaattgagacaaaagaacggcatgaggcataagaaaataatttagaaagttgtcacttgctgtaagttctattgcatttcaactgggagattag

SEQ ID NO: 474783 - DNA, 553 bp, Homo sapiens
cacatgcactgtgacagctccatgcatgttatcaccctgaagaccttccagtgggacaatatgtggaggtggaaggcagtgctattgatggtcccgaccctgtgtaggcctaggctagttgtttataaaggggtgtacaatagcgtcccaggcctccacatccactcgccattcactcagagactcaccccagcaacttccagtcctgctagctccattcgtggaaagcatgtatgtactgctgctggtgcctttgcagactttgagtgtgtgtgtgcgtgtgtgtgtcaaactgtgggagtcaactgcagcacagaaatcaccacccagagggggcttctccaagtgcgcaagctcagcagaggaagcctcagccctgcggaagctcagggagggccaaaagtcaccaagggtgcaatgggagctggactatgctgtcccctttgacaacatgatttcacagagtgcttcctgcgccgatgcagagaactgtcgccagattcgtgagcaataatggtatgaacagccattaattagagagggagattagctt

SEQ ID NO: 474784 - DNA, 1568 bp, Homo sapiens
cgggctctgacagtgattctcaggaagcgaggcccattagtttctcacctgaaagggtgaatacattcatgcagtaggtgtccaggatcctcatgtggtcctccttcatgcttaggaacagacactcatcttcactacgcaaaccagagcctgcatgcctttcgtggtccttcatgcttagggacacagtcgctcatccacactatgcaaaccagagcctgcatgcctttcatcactgggtgacagctctgacggaaacgaatagcagcttggtgcattttgaagttgggttatatgatgcctgcggcttggtgcattttgaagtcggactgtatgatgcctgcggcttggtgcattttgaagtcggactgtatgatgcctgcggcttggtgcattttgaagtcggactgtatgatgcctgcggcttggtgcattttgacatcgggttatatggtgcctgcggcttattgcattttgacgtcgggttatatgatgcctgcggcttggtgcattttgatgtcgggttatatgatgcctgcggcttggtgcattttgatgtcgggttatatgatgcctctggcttggtgcattttgaagtcgggttatatggtgcctgcggcttggtgcatgttgccgtcgggttgtatgatgcctgcggcttggtgcattttgaagtcggattatatgatgcctccggcttggtgcatgttgaagttgggttacatgatgcctccggcttggtgcattttgaagatgcctctggcatggtgcattttgaagtcgggttatatgatgcctccggcttggtgcattttgaagtcgggttgtatgatgcctgcagcttggtgcatgttgaagtcgggttatatgaagcctgcagcttggtgcattttgaagtcgggttatatgatgcctccggcttggtgcatgttgaagtcgggttatatgatgcctccggcttggtgcattttgaagtcgggttgtatgatgcctcggcttgggataccaacgtgtcataggtatggtctctttacacaatcccatatttcttggagattttgttcattctttttcttttccttttctttatttttgtctgactgaattgatttgaggtactggtcttcaagctctgagattctttcctcagcttgctctattctgctgttaatatttgtgattgcactattaaattttgtagtgaattttctagctctatctgatcagtttgattctttcttaaaatgcctaatttgtcttccagtgcttgtattgttttattggataccttagtctccttggattgggtttttactttctcctgaatcttgatgatcttcatttttatccagattctgaaatctatgtatgttattcgagccatttcagccaggttaaaaatgcttgctggggaatgagtgcgattgtttggaggtaagatgacattctggctttttgagttgccagaattcttgtgctgattttttctcttctgtgtagtctgatgtttctttaaactttcaagttaccaaaactaagctcatcactcctgagctgcaagctctaaa

SEQ ID NO: 474785 - DNA, 654 bp, Homo sapiens
tctgctgggtcacagaggggtcatggacgtggatctggcaattttatgcattgtggaggaaactttggaggtgatggagataattttggctgtggtggaaactttggtagaagaggaggctatggtggtggaggtggtggcagcagaggtagtcatggaggaggtgatggtggatataatggacttggaggtgatggtggcaacttcccgcagtggtcctggttatagtagtagagggggctatggtggtggtacacgaggatatggaaaccaaggtggtggatatgttggcggtggtggaggatatgatggtcacagtgaaggaggaaattttggcggtggtaactatagtggtggtgggaactataatgattttggaaattatagtggacaacaacaatcaaattatggacccatgaaagagggcagttttggtggaagaagcttgggcagtccctatggtggtgggactggtgttggaagtggtggatatggtagcagaaggttttgggtgtaaagaatgtttaccgccctccatttaaattctgaaaagggatagtggatgttttccctctcctgtattagaaaccattcttaaagtcttttcaaaatatagaaccattaagcctgctatatctgagcaaattagtgggt

SEQ ID NO: 474786 - DNA, 1749 bp, Homo sapiens
tgtctgagattcttaatagagggggagttcctcctccgaggcttagggagctttctccctttcccaaaggaagggtggggcggcgccggccagtgcaggagctcctgcgggccactggcatctggcagcagcgactctcccgggtcagtcagcagagcgaggcgcccgcctttccacctccgtgagtgctgccgaggggaaaactggggaagtgggtcagcccggcggcttccatccacagaccctcccccgccccggccgcccgctctccctcggagcttaaggcgtctgctcccgcccggcagtgttgcaagagtggccctgcccaggcgtgggtcgggccggtgtctgcgccaaggcgctgcgcccgccggctgcccttgctcacgcttggcgcccatcctgaggcgccgttggccctcccgccaccccctcggcggggcccttccctttactatggtaatagtgacattcagaggaaaaggctagcgcggcgacggcgccccggctcccgcagagcggaggctcgggctgcggacggggctgcgcgcactcgcaccgctggacgccgcggggcgggcggccgccgagctctccccgcccggcccagcccctccgccgcagccgcggggcagccccgagccacggccccggctggcgggcgggctgcgggcaggatcctggcgctcgggctctggcaaggggaaaggacagaaacggcgcatcgggagggaccctgcctcaccgcttgtatatggcaaagtttctcgccgagctcctgggctgcacgttgccgagcaagggcgcctctcccatgtttgaggtaggtggagggtgtgtcccctcagggacccctggcgggcctgggggtcttccgctagttgacacgtgtgctggctcacctgcctggtttccacctggccatcgggcgggacggggcaggggaggagggctaggcggagacctggacctctggagacgggtttctcactcctggacctcagagacggctggctggctggctggctttcctatattgaccactcagtcgggagagtttcatactgtacaacccttccccgccctccttatctctacactgagctcctttgtctgtttacgtgaatcttatacactctcatccacttggttattccgatgggcttcaagcatctagaagatgaaccatgtgatcaggctgttttgaaagcaaataacttggacaagtatgactgtagcttctctgattggatgctggtgggtgatcataagagagaagtttactttgagaataatagctcctattgccacagctgggctttctgtttaagaatgaaattctatcaacataggggaggagagatatccgtgacagaagaccaattgcaaggaacggctgctgggctagacccagaaagagaccaagtgccctgtgccaggaaaaatagcttaacatatcatgatccaagccaccctgctacagtgccctttcagagagcagaatcagaggaaagagctttttcaatgcaaggggagcactggtggcctgggcagagcggtcatggggagtttgctgcaggggtagtctaatctgtgttttatccagttcatagttgctaggctagatggcttatgcattggaactattattttgctatatattgtgtgagagagtgtggtgataattttttctatttcggtttgcatctagaaaacccaattggattatcaattcaatattagctcttt

SEQ ID NO: 474787 - DNA, 657 bp, Homo sapiens
caaagccctaacttcaccactatggaatctttgcacataactaaattgccctttcttgctctgtcacccatcctggagtgtagtggcacgatctcagctcactgcagccgctgccccccgggttccagcaattctcctgcctcagcctcctgggtagctgagattacaggcacactccaccacacctggctaatttttgtattcttagtagagacgaggtttctccatgttggccaggctggtctcaaactcctgacctcaggtgatccagctgcctctgcatcccaaagtgccgggattacaggtgaatggacagttggagacaactgggagttaaggtttaaagagccatgcaggggaagtagagaagacctacctacccaactgtggattcaggctgagatcatagcattaagtgggcctaaggcgtaattgtgtatgttttagcttttgattctatatgtctgattttgttctatatggaagaatgtttgtgtaagtagattttatgtcgacttttaatttaactgtatttgtaaaaaattgcttttggaacttgcggggtttgaataagcctctgagataatgtgtttaggatggtactcagagctgagagtaaatgtgttgtgcttgatatatgttttctgtttagcagta

SEQ ID NO: 474788 - DNA, 669 bp, Homo sapiens
caaagtacagggctatgcagttggaattccttacacaaaagccaggaccgtgccctgtagcctttctgtccaaacaacttgacctcacagttttgggcaagccctcatatctctgtgtggcaaagggactatgtgtcaatatctacactgattccaaggcctcagaccccattgctcaaggcaacaattatgctgataagatagctaaaaaagcagccaatattcctacttctgtccctcatggccagtttttctcctcatcagtcactcctatttactctcccactgaagtttccacctatcgatccctcaccactcaaggcagatggttcttagaccaaaaaagaatctccttccagcctcacaagcccgttctattctgtcgtcatttcattacctcttccattccaataatggaccggactttattagtcaaatcagctaagcagtttctcaggctcttggtattcaatggaaatttcataccccttaccgtcctcaatcttcaggaaaggcatctctccttggcttgtagatggctgtcttctccctgtgtccataattttccctctgtgtcctaatatcttcttaaaaggacactaatattagaatagggcgcaccctaatggcctcattttaacttaattacctctttaaagaccctatccc

SEQ ID NO: 474789 - DNA, 837 bp, Homo sapiens
tcctcttttctgaggaagaatgaagtatgattcggagggctgctatggcactttgggaacgtgagcaccctcctggtcaaaatgttctttctgtgggctataaatttcccactcaagacccccattgggacagtaacaatgcaaatcactgggaaaatatgcaggacctaagggagatgataataaaaggaattcaagaatcagtaccccaaactcaaaatctttctaaagcatttgatattcaacaggaaaaagatgaggaacccactggattcttaaatagattgagggagcaaacgagacagcatgcaggccttgatttggaaaacccctcagacaaggaatgtgaaaacttcactttggaggctcaaaaagtatatgcaagaagagacaaggaaaaacaaaaacaaaagacaaaacttatgttatccaccttccaacagatagctccaaatccgcatatccctaagcaaggctttcaaggggccagagattataaggggcctaaaccctccttgagaggatccaagcctccatctggagggtcaaggccctcatttaataagccccctaaggggtataggggagcaagggcagagaatgctaagactgagaaggaggaaggacaagatagatattacagatgtggaagaacaggccacttcaagagggaatgtcctgaactaaagaaagagagagaaactttcacactcatgactttggaagaacaataggggagtcaggggctctgcctcttttattttgagccccaccaggagcccttgataaatttggaggtgggacctaaacatgaatttatcacctttttacctgatt

SEQ ID NO: 474790 - DNA, 1961 bp, Homo sapiens
gtgtaggtctaaaaaggcagatatttgaatagggcaaagatatggcttcaggcttccatgacctgtatcttctcctttttttctccctcatcaatgctgtaaaaatgagtgcatctgtcaactactggagcatgttaactcatgtatgttgggatttgacagccactggctgtgaattttctcaccataacaaccaaatgaaaatgtcagaaatgaatctttttgctaagactactgattgtttggggacatccgaaatcactcaggattgtggtgaccagttgaacagagatatgccaaaagcaggcagtgatttatatccctgcagaaggagtctcgccctgtcaccaggctggagtgcgatggtgcaatctctgctcactgcaacttccacctcccgggttcaaatttctcctgcctcagcctcctaagtggctgggactacaggtgcctgccgccatgcctggctaattttttgtattttagtagagatggggtttaggctggtctcgaactcctgagctcaggcaatctgccctcctgagctcaggcaatctgcctgcctgggcctcccaaagtgctaggattacaggcatgagccaccgccctcagccactatcttattttttagcctatctgaattaaaaacataaagtcttctctatgtatgttgatgataaactttgggtttcaaggaaaagagtcactcaggcaacttccaagaatgggaggggagaaggggttgttataggatacagtggaaataaatctgggaggaatctcaatcatgttccaagagcttgcaggggcccagagaaattctcacaatgaggcctcacaggaaaagcaagaacaccgacagcaggaaagcttggaggctaagagttcccttggaagttgaactactgcctgagaatattaaaacaaaaacagaaacacgtaaatagccagccctgaaacgagcctctcaacttctgataggttatatttacatttatgtactttcctatcacagtttataatcaagctaaggctagtagccttgaatatttttagggctgcaatttgtacatcatctaagctaacagatgaaaagtgcaagtgtagttgcctaagcacaggtacattcgttcaacaacaaatctttacctgaatgtccattgtatgtccgacgctgtcctgtatcctggggtggcagcctggggacctgagaggactttgagtggagctaaagaaacagaaaataacttcaactaataaatgtcttttaatatctcttgcaatggaaattttcagtggcttaatttttttacttgtctacttcgaaggtgaagttactcacaggcaggtttcttagtttacagacttagcttttcttccactcccagcgtattatcatttatcaactattgtcattgaatgtccttacaccaggcatggtagatggcttttcagcttccaggcatcatgttgtgtctttttattcttcaatggtattgctttaaattgtaggcatccttgtaatgggttttcttctttttctgacccataaaaaatttctgataatatttgttgaactctgatcccattaaattaaaattttagttattaaaagacaaggtgtcacttttctcaatcttagaaacagatgaggtcagctgcactccctgccctcagaggcatatgttaatcaaagtagtacaaagttagatttttaagccacttccaatggacaactggtttaatttgagcagtcatcaaactgattgtcatgtacttgatcataagcatttctgaataaagttcagtgctggtcttcctttttttttcttgagctgtgccatccattgatgtaagacttgcactgcgacttttgcagagaagctaagagagagggagcatccataattagggaagcagtgggttgtgcatatacaatttatttaagacacaattgctgg

SEQ ID NO: 474791 - DNA, 629 bp, Homo sapiens
ctcctcaagcatggccagagtgggcgccgaggccaaggaggcaccaagagtgagcgagggctgccagcatgctgtcatgtctcataaggacttgctttatgaatctgggtgctcctgaatttgctggaggtccactccaggccctgtttgcctgggtatcagcaatggaggctgcagaacagcgaatattgctgaacagaaaatgttgctgcttgatcgttcctctggaagtttcatctcagaggggtacctggccgttccaaacaaatgccacagaagaggagaccaaggcagaggttagggaagcacctaaagacaagtctggactctgcggatattcttttctcttctccattttggagaagtctttccccatcgctgcctggatttctgatgcctcctggcaaatagaagctgcctatatatacttattaaagaacctcaatcatttcaccctgaaatccccagtgctatattgacccatctgaagggtcagaaagttgtccagcagcagcagaaactatttaaaactcttccctgtttgtgattttttatggctgattgacaaaaggagggcagagaacagcaggcgaagtgaattctgtttgtgattggggtgggggcagggg

SEQ ID NO: 474792 - DNA, 969 bp, Homo sapiens
ataactggctctgagatgtattttcctggcatgttagcctttctgcagatctggtggtaacaaattccctcagttctgggatgagctcaggctttatgttccctcttcaacttgggggaagcagggacagggaccttggcagtagcaatggcagagggcctttcacttctctcttggggctccaccccagagaaatgcagggccgctaccaatcagagcattctgccaaggggagactgtggcatgctggaagtgtgagtaaagcactcagtgcctttgctccttcccagtctgagggcagcaagggcagtaccattgtggtggcagtggcagagggactgtcagttgcttctgggagctcaaccccagagaaatgcagatctgcagccaatgggaaggttcagccagggaggcagcaagggcaggactgctgcagtggcaatggcattggcagtggcagtggcagggggctgtcagttgcctctggaaactccattccagggaaccagagccaccagcagtgggaatgctcagttgctggggtggggcagctgctctgcagtctgatgaagagtagtgggcctggagccggccacttagagtgtgaagagtacagtgacaaagatgatgatggagccgcaggagaaaacagcatatgtatgctatttagagacatagacctggatgagatcacccaggacgtgaatgttgatagacaagaagttcaaagactgaatgctgcaacatgccaatgtctgagtgtttggaaggcaagaagaagcaagcaaaggagactgatgaagagcaaccagtgaagtaaaacaaaactaaagagggtgacttggtgctaagtgaaggaagtgtttcagagaggaggagacgtatggaataaggtgaggactgggaagtgaccatgggatttgcattatggaaacagttgatagctttgacaagatggcttctgtggag

SEQ ID NO: 474793 - DNA, 707 bp, Homo sapiens
tctaagatctcaaggcatctgaaaggcagctttctcacaatagtaaccctggggtggagatagagaggtgggcgggacagctgaggccggaaggatgagaggaccagggaaaggtgtaggagagaagagaatggggtgggaaaaggaggggagggaggggaaggcatgggtagaggaaaaagaatcagcaaatgagacaaaggaagaaaaggacagagatgtaggaggagagccagagggagaagggtcatggatgccaagggaagggcctagaagaggacaacagccctgcagcaagcttggaaagcagattgcccagattggagcagaagagcagagaacaccaggagggatgacttcagagaaaaagggagctgatagaatacctcatggtcttgatggtcctgaggttttacaggactggaggatagcagctccagtcaatgaaagggcacagagaggatactggagctgggccattcctccccagtgccagatactctaataggctcccttgctgcctggcagagatgtttgcagagctgacatgtaataactgtacatatttatgggataaagagtgatatttccatacatgtatacaatgcataataatcaaatcaaggtaattagtatacctgtcacctcaaatgtttatcatttctttgcattgtgtcttgtcttcttatgaaaagaaaagtagtctc

SEQ ID NO: 474794 - DNA, 980 bp, Homo sapiens
tttctagaggagaatttaagatacttgcatccataatgctgaatattggccctcactctcttctggcttgtagagtttctgccgagagatccactgttagtctgatgggcttccctttgtggtcaggaccctcagctgcaggtctgttggagtttgctggaggtccactccagatcctgtttgcctgggtatcagcagtggaggctgctgaacagcaaatattgcagaatggcagatgtcgctgtctgatccttcctctggaagctttgtctcagaggggcacctgccagtatgagtgtcagtctgcccctactgggaggtgtctcccagttagtctactcagggatgccaattatagcggccatggaccaggtgggtgggtgagttccctggccttaggaagccagtgtggtgtgggcaatgacagtagcagtggcaggataattctctgggtcccaagtgatgtacaatgatgttggcagtgactgcagttagctgggtgggcgagtctccaggcccatgggtgttgcttgcaggagtaatatggaatcaaaatagtaagaactatagtcttcatcatagtcagcctcatcaggatattacttttgaatgtttaaaatgaagaaggaaaggataggcagagagacagaggaagaaacggaatattttaaattattagcattcaataaataagagtctctttattcaccaaagaaactattaatactttgattaatgcagcacaagtttcacttggtgtgtctactgctcctatttttatgactatgtgtacccaatatttagctcacactttctctgataatcattgttttactctctgcttctatgatatcaattttttgtttagattctatgagtgatatcatgaggtatctgtctttctatgtctagtttacttcagttaacatgatatcctcaaatatattaaaaaggaaagaaaaaaatttccttgaaacaaa

SEQ ID NO: 474795 - DNA, 625 bp, Homo sapiens
gccacagcttaaatccgtcaaaaatgtttcaccaaaaaaaagttcatagtgtgggccttccaggggaagaagaccctttgacatcagtgaaattgtctgtttcacgactttctgggacacccacagagccagcagcacgaacgtttaagtctgctgaagctgtgcccacagccaccccttcccccaggtgctctttcccagatgccctgcccagagaggaggaatctaaagaggcagtctggctacagtggctttgccaaactgccatgggctacccccagtttgaacttccaggcgactttgtttacactgtgaggggaaaaccacctactgaagcctcagtaatggcagatgcccttccccccaccaacctcaagcatcccaggttgacttcagactgctgtgctggcagcgagaatttcaatcctgtggatcttatcttgctgggctccatgggtgtgggatctgctaagctagaccacttggctccctggcttcagccccctttccaggggagtgaacagttctgtctcgctggtattccaggtgccactggggtatgaaaaacaactcctgcagctagctcggtgtctgctcaaatggccgtccagtttggtgcttgaaa

SEQ ID NO: 474796 - DNA, 740 bp, Homo sapiens
ctcctcaagcgcagccagagtggacgcccaggccgaggaggcaccgagagcgaggcagtgggctcccctctggcccagatcaggtccagaaatgccgtctgagagtcaggtcctggaatcggggacccaaagagcatgtttggtgctctaccccactatggccatgctggcatctgaagccaggaaagccatcacatttctgcaggctccccttgtagattctgatctctatgatgagaaaaccatggctcaggacataggcatgggcaaagacttcatgactaaaacaccaaaaccaattgcaacaaaagccaaaattgacaaatgggatctaattaaactaaagagcttctgcacagcaaaagaaactatcatcagagtgaacaggcaactacagaatgggagaaaacatttgcgatgtatccatctgacaagtctaatatccagaatctacaaggaacttcaacaaatttacaaaacaaaaaacaaaaaacaaaaaaaaacaccccatcacaaagtgggcaaaggatatgagcagacacttctcaaaagaagacatttatgcagccaacaaacatgacaaaaaactcatcaccactggaacaccaaatttaacaattgtctataccaaagcaatcaccttcacaagaaccaagtcagatgagcactcacaataactggttttaacttaatattgatgaaagaggtattgaagaagataggaaggaaagttgtaaatc

SEQ ID NO: 474797 - DNA, 794 bp, Homo sapiens
ctataccctgtaaagccacagaagcagagctgcccaaggccatgggagcccacctcttgcatcggcatgccctagatatgagacatggagtcaaaggaggtcattttggaattttaaggcttaatgactgccctgttggattttggaattgcatgggacctggaagccatttatacctgagactccatttaccccctctgtataacggacgtgaagacctacatgtattattagtccgttatcacactgctgataaagacatatccgagactgggcaatttacaaaagaaagagctttaattggacttacagttccacatggatggggaagcatcaccatcatggtggaaggcaagaaggagcaagtcccatcttgcatggatggcagcagtcaaggagaaaatgaggaagaggcaaaagtggaaactgctcaaaccaacagatctcgtgagacttactcactaccaggagaacagtatggggaaaactgcccccatgattcagttatctcccactgggtccctcctaaaacatgtgggaattatggcagtacaattcaagatgagatatgggtggggacacagagccaaaccatatcaccacataaagggtgatgagtattataagcaatgtcctttaagtgcctagtatagttcctatcttacggtagatggagatattattattcattactgcaatggttaatactgagtgtcaacttgattggactgaaagatacaaagtattgatcctgggcatgtctgtgagggtgttgccaaaggagattaacattt

SEQ ID NO: 474798 - DNA, 1151 bp, Homo sapiens
agcaccttctgaattaagtgtggcccctgaggttaggggatgcgatgtttgctgaccttggagagagagggaaaagtgcaaagaccaaaacacaaaaagacctcattctttttgaatattttaagcagcagcaacaaaacgctaatcatctcaataaatattttgccccacagatgttgagtgttaacaggagctcaaagttggaggaggccaaagacctgcagagaggacatatatgtgagaagcaggggccattgcccagtggcattgtccttcatcaaggggatacatctgtggaacatggctctgcccctgttggaaccctgacagccagaaataatggtaacgtggggctttgtgaaaagggattgtggcttcaagcaagcatggaggttggtttggtcacagaaggacacttctcctcttacctggttttgctgactcagatcttggcagaagagctgtgctggagtccatgttgtcctgaaggatgacaaagcattttttttactcatctgttttttaatttttttttttaattttccaactgtcttgtgacagaagtagcagtgcttcatcttacagatcaggaaattgaagcttagagccaccatgtgaccatgggtggcttgcccatggtcacacaagccaaatgcagcaaagggtggattatgaggttgatataattatccccattttacagataagtaaactgaggctcagcgatgctgaaaaagtaatacaagggaaaatggtgagtgaatgtcagagctaggtcttaaacacaggtattctaactattttaagaattgcatctgattaaagacacattcaaagatattagaaaagatttgcaaacttagcagacaaggctagaacctgagctgcaagagtttgatatattgccatgattaactactttcataagaaaagatgatgacgatttgatcacttcattttaagaagggggaggtgcctttgctatgaagacaaacctgcccatctctactgaattgtaacatcttagtgatactgaacttttcatgataaagaaagtggaattcacatttgtgctgaaaatgtccattttgctatttactaacatccaaataattccaaattcttagtctgtgtgggtacaaaggttgctc

SEQ ID NO: 474799 - DNA, 888 bp, Homo sapiens
gtgagatttgaaggagacaaatatgcaaactatatcaaacaactctggtttgcggtccatgggagtgactggttgtatatggaatgttcctgcaagtatgggacaagcagtaaaggccacagtctcaggatccaagtccacgagagaagaggtgtgctcaggagggctgactggaagtctgaagacagcatggcatacaaccaatgggtggagagcaggagccagagatgacatatgggatgaggccttcattaaagtccatgggtattatccatcaggctttcctccactttcattggcaataaaatccccctcatttaccatctttcaatttgttcacgcaacctcatttttctggatgccagacaagagctcaggagccgcaagtgcagatacaaaaggctgtcacactagccctttgcccttgctggcagggggcagctgtctcacgcaaaaaggcagaggacccataaaaaatgatgagttcatgtcctttgtagggacatagatgaaattggaaaccatcattctcagtaaactatcgcaagaacaaaaaaaccaaacaccgtatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaacgtgcacatgtaccctaaaacttaaagtataataataaaaaataaataaataaataaataaataaaggcagaggacccactaagctgttaacacttaagccgtccatggatggcagagct

SEQ ID NO: 474800 - DNA, 572 bp, Homo sapiens
ctgggagaaggctatgcttagtcattcagatgaaagaatactgaagagacttttagtcactactctttggagtcctggttctctaactttactccttcttaaggctcgtctcttcctcatttcctcttctccctcaattctgttagttactgtgtctaattcagaaagagctgatttgggcaattctgaacttgaaaaatgggtgcttcgtgccattagaaaccttataaataagcctgcaccaaatagttctggaccacttggtattatatttattcaagaggtaaaactagtaaaggagatcaagaagatagagcctaagaaggaagatactgccaatttgtttgaggtccagcttgcaaaacttttttatggagtaattccaggtagtatcaagaaccagcaggggacctgtctctgatctttaccctaaaatcctggtgcagttcctgaaagttttgtccatgaaagtgtgaggaccttcctgtgactgtggttcactgagattttttattctcacactagtccacattccacgtctaggaatttgtcagaattaccatttaaatctt

SEQ ID NO: 474801 - DNA, 838 bp, Homo sapiens
ttctgtgtagccttgggacatggtgctctgcatcccaactcctccaactccagcgatagctaaaaggggccaaggtacagcttgggccattgcttcagagggttcaagccccaaccttggcagcttccgtgtagtgttaggcctgtgggtgcacagaaggcaagagttgaactttgggaagctccagctggatttcagaggatgtgtggaaatgcataatgtccagacagaagtctactgcagggaaggcaccctcataaagaacccctttgaggtcattacaaaggggaaatgtctggttggagcccctataagagtccccactggggcactgcctagtgtagctgtaagaaaagggccaccatcctccagagcccagaatggtagattcactgacagcttgaactgtacatctggaaaagctgcaggcactcaatgccagcttgtgaaagcagctacagggactgtaccctgcagaaccacagggacagataattccatggttagtggcttgctcagagatgagaatggtgaacactgtgaaactttatggcattatgaaactgctttcccaattcaactctagaacattacgaacttggcctctcaaagcttcgatttatttacttttataaatggagatagaaataataatatagtggatgacacacagtatgtaagagagcttcatgtagtggctagaaaagagtttaccctaaataagtggttgcagtagttataggagtaactagatcttcttaaaaaggtatttctcttaaagaaatacttatattaacaggctgtgagttgaagacctagcaaatatccaccaaggtac

SEQ ID NO: 474802 - DNA, 2123 bp, Homo sapiens
aactaattgctaaaaatagtcgcctatggagcagcccctatatccttccaggaatgtccttctagttctaggatcagaatatgcggtggaaaataagacaaaatccccatcattgttgagcttgcataagcagttggtggacaaatacgtatacaataaactgtcagagaatttgaagcaacaccatattcttggtgaaagactgtctacaactagccctattactacaagccaaacatatgaggtcagagtttatgatacatccacattactttgcaagcacaaaagaccccagaatgggaaggaatggatccatgacccagttgtgaataagccaggtgaatcaactttgactctgctagaagaggatcaactgctggagatcacaaatgatggtggccttaaaagtatgtttaagacaacttcaaatctctatactctctggattaaagtcaaggtggaatatcctgagattgccacaaaaccactgaaaggcctgctttcatttccagcatcctatctttgtgaagaagggttttcagcagtgacagcaaccaaaacgaaattacagagtagactggacataacacacttctggtgacactatctccgatctcccccagatgggaccttctagttgtagcaaaacaagctcaaggctcccactgattctatattatggtgagttgtataattatttcattatatattacaatgtaataataataaagtgcacaataaatgtaatgtgcttgaaacatcccaaaaccatttctcaccaacctctggtccttggaaaaattctcttctatgaaaccagtccccggtgccaataaggttggggactgctactctaggctattttattttcagttttcagtgataattagttaaatgctagaaccatagaatgtttgcctctggggatgaggtaaggagagtgaagaacaataaggaagtacagtagagtacaggaaggtagagtaaagtgagcaaaagagagtccagcgtaaaataatagtataaggtgtaaattaagggggaaagtgaggggagaggagtggaagggaggacagaagagcctagaggagggaaggggagagaagggtgtaaagaagaaggaattggaaggaaagagaaaaaaaaggagagggagagaggaaaggagaggaaatgaggggaagaaagggaggaaaagggagaggaagagaagggagtacaagggatggagaaggaagggaagggaagaggagaagaaaggagaagaggggaggaaagcaggaagttgagagaataccctttcctggaataatgttgctaatgccttacgaattgaggaatataattaacctagcctttgccacctggagtctaaaacatgacaaaaacataatttcatacatttaattaaataatgatggcaaatgtgtatagatcataacaaattgttacagagctatttgttttaacgtatgttctaaggttcaaatgaggtattctctggtttctttcatatttggacataaaaatatgtcccccacagtctattaacatcggggaatatcttcctcttcagaactttattaaaagctttgactaaacaacacttctcacacaagcctttggtagaaaagcacagataaacttaactttttttttttgaaaggcaattaattaaagaaaatgtacaatgagaaatgattcttacactaactgtttattaatgtgttccattataatatctacctagtaatgtattccatggcttttttgcatatttcatgcatacaatgatctctatatgtctttactttctttcatttacttttggagagggatccatattatttatcatgcatgatttactttttgggagggcatccattttttaacatgcatgatattacaggttgaaatgcaaaagagaaaagtaacaacaaaatacctttgtcttttattaaaaccatgctctatatcttaccttaaattgtgtacctatctatacatagattgtaaattcatgtataggttttatctataaatgaatatgttactttaaagtagtcatcatgcgaaaagtttctacttgttaaaataaccacactattggctaaataattttc

SEQ ID NO: 474803 - DNA, 740 bp, Homo sapiens
ccgcgagggtccgcggcttcattcttgaagagttcaactttatgctccttagacagtttctccttgtgttatatctctgtggtttgaactactttgtaatttcagcaaaggacaaacccacaaccaacatcatactgaatggagaagagttgaaagctttacccctaagaactggaacaagacaaggatgtccattctcaccactcgtattcaacatagaaaatagtactggaagtcctaaccagagcaatcaggaaagagaaacaaataaaaggcatcccaaatggaaagaggaagtcaaattatctctatttactgataacatgatcttatacctggaatactctaaagactcctccaagagatgtccagacttaataagtgacttcagtaaagtttcaggatacaaaatcaatgtaaaaaaatcaatagcatttcaattaactaataacgttcaaacagaaccatgtcaaaaactcaatcccatttacaataacaaaaacaaaaaaaggttaggaatacatttaactaaatatgtgaaagatctctataaagggaactacaaaacacttgtgaaagaaataatagataacacaaatagaaaaacatcacatcttaatggatgggaattgttaaaatgaccatacttctcaaagcagtatacagatacatcacaattcctatcaaattagcaatgccatttttcatagaattaggaaaaaatatcctaaaattcatac

SEQ ID NO: 474804 - DNA, 3221 bp, Homo sapiens
agcctcatttcccagtgctcctggcagtcaggttggggccatgtgaccatctccagccaatgacacgggagaagaaatgagcgagccccctgggagggccactcagggtgaccaggacatccatggcttacgcgacccatgtggcctggcttcctggactgcagcagagatgcagaggccgtgctgccagaccccaggaagtacttacccagcacacggaggaccctggagtcctgcagcaccgagttcccacaggcggcctgcaccgtcacacgcacgtcgcccgtagagggcctgcaggggggctgtggggacccaaaaaggccagggttagatgatatcagggcatggggcatttcagaggctgcttagtgatcactgtcaccagcaacttcattgctatcatcaccaccaccactaccactatcatcaccaccaccaccaccaccaccatcaccactactaccaccatccattcccaccaacactatcaccaccatcaccaacaccaccaccatcaccactactaccaccatccattcccaccaatactatcaccaccatcaccaacaccaccaccatcaccactaccaccaccatcaccactaccaccatcacctccaccatcatcactgccatcaccaccaccatcaccaccatcaccatcctcaccagcaccatcaccaccatcatcaccaacaccaccaccatcaccactactaccaccatccattcccaccaatactatcaccaccatcaccaacaccaccaccatcaccactaccaccattatcaccataactaccaccatcacctccaccatcaccaccatcaccatcctcaccagcactatcaccaccatcaccaacaccaccaccatcaccatcaccaccaccatccattcccaccactactatcaccatcaccaccaccctatcaccaccatcaccaccaccattgtcaccaccaccaccatcaccaccatcaccatcaccaccaccatcaccaccaccattgtcaccattatcaccaccaccatccattcccaccactactatcaccatcaccaacaccctatcaccaccatcatcaccattactaccactactgttaccatcatcaccatcaccctatcaccaccaccaccaccaccattgtcaccattatcaccaccaccaccaccaccatcatcaccatcaccaacaccaacgtcaccatcatcactaccacctccactataatcatcattagtaccatcaccaccaccaccagtactgctatcaccatcaccaccatcaccaccaccaccacgaccatcaccaccaccaccaccaccaccaccatcaccaccactatcatcaatatcaccaccagctaccagctctgccctactattgtatgggtcatcagggtgtaaggttcacgtacatggccttgaagccgtccccaaggtctacctggtacttggtagtcaggacatcaccctgcagagaaacaccatgtggccactcaggagtgggccttgaagctgaggggccagagtggttcattcactcactcactcactcactcattcattcattgccgccctcccttccttgacatgagtgggctctggggacccacaggagaccgggcctggttctgccctggagattcttcctggagtatggggctgaccaaggcagctggtttaactaggggctgtggccaagggatatttcagaacaatcacccagcggcagagagggagagggagaggcccaagggtgtcatcagagagcagctggggggcagtcagggcccgggggagacccacagaggcccgtgctagggatggagccaggaaggggcacgaggaaaccgtttcctagtgatgatggaggaaacagcgtgattactaaccacttagccatcttctcagtttataccagccaaacgttgtaagttgatagaaaacttttacgtaaattctgttcacttaactttctccacagatgtgtttgagagtgaatacatgagcgtgtaagcatgtgtgtgtctgtgtgtttgtgtgtatgtgtgagcgtgtgtaccagccatgggaacaacatgtgcaaaggccctagggtgggtctgagcctggaggaggagcgggtgtggcacgaggctggagagaggccctgggcaaccttttaggagatccctaaaaggggtggcctcatccagcttgctacttgtgaagctccctcaggctacactatgcgtctgtgaaagtggcattgctgccaaggtgctgggggtacctgtctccccaaggctgatcccccctcttgccctcagggccaaattctcccagatggctctgccactgaataagcattcagaagttgatcatgcacaggcccatttcattagtgctttgaaagaaaatacccttctctaagggccacccacccatggcacctacagcgtgcagatggtatgagatgaaatcctttgtcttgatcaagatcctggctctgacacttcagacaagagtccctgttgtcaagcccaggtggatgtgcaaccactgcagcttcatgatacatagcagtatgtccagcctctggtggaggaaaagcatcgtaactgcttgcacttggtgatgccttcccctcatgcacagcttgtattcagcaaaccacagactgaaggaacacctactgtgtgttgtggagcttacagttcagcaaggaggacaattagggaagtggccgccatgctgtgaggatgctcaagcagcgcctgaggcctcgtggccaggagcccgtcgctcaccacaggaagtccgagtcccggcactcgcacacgcgggacgtgagcgccgacgtgaagctcctccccttgatgcaccaggacgtggactttcttttccggaaacttctctgctggcccatgatacagcggtcgccctgcagcaggaacatcagggcttcctcatcccccactgccccccaggtgatgtcaaattctctgatgcctggtgtttcctcttagtcagtttccacccactgaccttggctttgaactcccatttgcccatgctgaattcaagttgagcccaatctctcctttgagagggtccctgtacccaccgtgatggtcttgagtaaagtcttccaccccgcgctttaacaagtaccattaaatcatttcttcaacagggccacccacccccgagcagttccaggccccca

SEQ ID NO: 474805 - DNA, 1046 bp, Homo sapiens
ccttcccctagtcaggcagcagaatgaccaacgcccggatgacagagtgcattttggcccatggcgctgagcagggaggaagggggagctgaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggagccagactgccacctgcacctgcacctgcgctgggcagacaacccctacgtatcaggcaccgtgcacaccaaggacaccgccccaggcctcatcatgggtgcagccctgagcatctgctgggagcaggaggaaaaggcgcgtgggctggcttcacatctgctggcccgacatggctgcctgccctggcacaggtcccagtgccacgtgaccgcactgctggaggtggctggggatgatggctacctgtttccacagggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaatgtggacgagggcctcacctggagcacgcacaacttcaccagcacctcggtgtttgtggacgggctgctgagtgagccaggggacgagacgctggtcatgacccacctgggaatcagggacatctgccacctgccccaggtccccttgctgctcatcatgggccaccccaagtatccatccccagttgggggtgctcagacagggaccagactggagcagcgtgcatcacctccccgacccagatgcttggcctctgcggggccactgggggccaaccagagcgactcacgcagtgcaattgacaagtcatagatcacaggtggtagttgtgggaatattcacgccga

SEQ ID NO: 474806 - DNA, 1008 bp, Homo sapiens
cagtcgcgagtactggggatagggatgttgacgaatctttttggggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagtgtggaatgttcttctcccctcgccaagagcggtggcttgttcttccccagatcagcatctcctcctctgggagctgtgtccatggggttcagcagggaactgaggctttgtcccccggctctctcacactgtctgtcaggcccagacagaaaaagaagtacaaccaatggctggagctgcagaatgcacttaccagcccctgccctagagtcaaacgtgttcattcggtcagcaaatgggccttgcgcacccggcagccacggattccgggctaccgctggtgccgcagctgtgcaggcgtgagctccgcacagcgcacacggggccggcaggctggggacagtgccgccaagatgcaggcagctgagccggggctgggctgggaggacttcaggggtgggggtggaaggcctggggcactgacccaaggagcccctggctccattcattcctcccagacctggggcactgacccgtgggcccccgaccccgcccactcctcccagaggacctgtccagctgcctgcacaggcctctctcaggccctgtcctcctctccattctgctgctgcccccagctgggcccaggcctggcctcctcagggctccctgcctccacccacagcctctggtgtgggctacttgaaacgctgtctgaccacggaccccctgagcgcctcatcttatccggccttgaagcagcttattcctgacgtcctgaccaagcttttgtttcttttttctgccctaaagctctacgtgtcatctgacttggggaaaaagtggacacttctgca

SEQ ID NO: 474807 - DNA, 1236 bp, Homo sapiens
tttttaatcttttgtttgatttaaacattgcttttagtatgatgcctacaccagctgtgcagaaagggctctggagagatgttcatagcagcataggcttccagctcttcttcagttctggaggctccaggacagccaatattgctttgtcaaatccattctttagatcttgctgtgtgggtacaggaccgtccatatacttgacagccttcaggttgtgggccggcttttcagcagtctctggagtgataggcttctatttgttcttggtaattttctcaataatagaccctctgagatcaatttgggttgtgacaagcaagaaaggagcctttggacagtgcagcctggcccccaaatgccagtcttccctcctgtctcgaaagaagacaccaagaccacctcctgttctgagaccagaggagacttcggcctctgtaggcttgccaaagaagggcgaaaaagaacagcaagaagcaattgaacacattgatgaaatacaaaatgaaatagacagacttaatgaacaagacaatgaggagattttgaaagtagaacagaaatataacaaactccgccaaccattttttcagaagaggtcagaattgatctctaaaatcctaaatttgggggtaacaacatttggcaatcatttacaagtgtctgcactgcttgggaaggaaaacgaagagacattgcattatttgaccagagttgaagtgacagaatttgaagatattaaatcaggttacagagtagatttttattttgatgaaaatccttactttgaaaataaagttctctccaaagaatttcatctgaatgagagtggtaatccatcttcaaaatccactgaaatcaaatggaaatctggaaaggatgtgacgaaacgtttaagtcaaatgcagaataaagccagcaggaagaggcagcatgaggcaccagagagcttcttgacctggtttactgaccattctgatgcaggggccgatgacttaggagaggacatcaaagatgatatttggccaaacccattacagtactacttggttccccatatggatgatgaagaaggagaagatgataatgaggaggaggaggaaggattagaagacactgatgaagaaggggatgaagatgaaggtgaagaagatgatgatgaaggggaggaaggagagaaggatgaaagagatgactaatagaatactgatggattccaaccttcccctttttaaa

SEQ ID NO: 474808 - DNA, 1077 bp, Homo sapiens
ccatacaccattggtattgccataatctggagcacacattctagtgaggggacactgacaataaacaagtaaaaaaaagcaaacaagttattttagacaatggtaagtcccactgatgacaacaaaacaggaaatattggagaatgtctgggagcttctccagaagaagacagggaaatgtgggaaagtttggaacttcctagagacttgttgaatggctctgctcaaaatggggatagtgatatggacaataaaatccaggctggggtggtctcatgtggagatgaggaacttgttgagaactggagcaaagttgacccttgttacattttagcaaagagactggcggcattttgcccctaccctagagatttgtggaactttgaacttgagagagatgatttagagtatctgacggaaaacatttctaagcagcgaagcattcaagaggtgactttggtgctgttaaaggcattcagttttataagggaagcaggacataaaagtttgggaaatttgcagcctgagcatatgatagaaaagaaaaacccattttctggggagaaattcaagccagctgcagaaatttgccccccacacagagtcccgactggggcaccacctagtggagctgtgagaaaagggccaccatcctccagaccccagaatgccagatccactgatagcttgctccgtgtgcctggaaaagttgcagacaatcaacaccagcccattagagcagccaggagggaggctgtaccctgcaaacccacaggggtggagctgcccaagaccatgagaacccaccttttggatcagtgtgacctggatgggagacctggagtcaaaggagatcatttaggagctttaaaatttgactgccttactggatttcagacttgcatgggccctgtttagcgagttgcggagtatataatgtaaaaacatagagaactagggagttggtggggagtatctgtgacaatgttcctgcaatgattgaataaagagtctaggctgtgtaggaaagaaaatgaggcctggaatgtgggctaataaagggtaaaaatgaagggg

SEQ ID NO: 474809 - DNA, 664 bp, Homo sapiens
ttatagtttgaagtcagaaggaatggtaccagctcctctttgtacctctggtagaattcggctgtgcgtctgtctggtcctggactttttttggttgtcaggatcctcagctgcaggtctgttggagtttgctggaggtccactccagaccctgtttgcctgggtatcaccagaggaggctgaagaacagcaaatattgcagaatggcagatgttgctgcctgatccttcctctggaagctttgtctcagaggggcacccagctgtatgaggtgtcagtcagcccctactgggaggtgtctcccactgtggtgggctccacccagttcaagcttcctggcagctttgtttacctactgaagcctcagcaatggcagacgccccttccgcagccttgctgccaccttgcagttggatctcaggctgctgtgctaacagtgagcgaggctccatgggcatgagatcctctgagccatgcgcaggatataatctcctggtgtgccatttgctaagaccgttgtaaaagtgcagtattagggtggaagtgtcccgattttccaggaaaaaatttgaaatgtctgattgtaccagctttcctatatgcaggtattgcacatttataacagttcacccttaagggccccttgtttaaaagtcttgctagc

SEQ ID NO: 474810 - DNA, 645 bp, Homo sapiens
acccaacagctccgaagagacagcgaccatcgagaatgggccacgatgacgatggcggttttgttgaaaagaaaagggggaaatgtggggaaaagaaagagagatcagattgttactgtgtctgtgtagaaagtctgcatgttgcctgttactcatctgatcttggacatgataatgcttttggctgggcttgcctggactccaaactccaggttcagattaggtctgctccacatgttctcatcgttacttttttgagtagatatgagttatcatcattaacttttcagtccagaagctacgtgaaatatcttcttctcaaggttgaagagcaaaagtgcaagaggctaaaccaaatcatgcaagcacacttaaagtctctactaatattttactggccagagcaggtcacatggccaagcccaacaacaatacgatgggaaaatatacctactctattgagaggaattgcaatgacacgctagggagaactgatgaggtgtgtgaacagaaattagccccaaaagtcacttcccaatacttacaaatatttttctatattacttaatattctgctttaatagaaatttgtaacctaaaattcaacatcccctcatgttaaaaactgtcaataaactagatatt

SEQ ID NO: 474811 - DNA, 648 bp, Homo sapiens
tgcctgcaatcccaggcactgggcaggctgaggcaggagaatgacgggagcccgaggcagggaggttgcagcaagccgagatcacggcagtacagtccagccttggcaacagagggagaccgttgaaagaaagaaagaacgaaagaaaggaaggaaggaaggaaggaaggaaggaaggaaggaaggaaggaaggaaggaaggaaggaaggaaaaattgactctttaacagacattggacagaatgggaagagtagttcacaaagacaagcatgggtaatgaattcagaaggaggtgcagcagagagccctgctgttcaggaaatggtggaaggaggctctcaagttgggagcctcagcagctggatggataaggtcataactgaaattgggaaaacctgtggggaagtgaatttggagagcagagagaaaaatcaagagtcctattttgtccagtccagtttgaggtacctattagacttcaaagggatacaccaagaagcatccaagaggcacttcagtcatctttgtttcctgatgcatgaagaacagtaggaaacaatgagataagagactaggtaaggcaataatactagtaaattgaatgtttcccatgcatactttttgcccccatacaaggcttaatttac

SEQ ID NO: 474812 - DNA, 1518 bp, Homo sapiens
agcaccttctccccatctctctttctcctgctgtggccatgtgaagacatgcctgcttcctcctttgccttcaaccatgattgtaaatttcctgaggcctcactagccatgcttcctgtacagcctgcagaactcaagaagacccttgcaaaatgccagaacctcaatcttggacttgcagcctccagaatttacctgagctacatcaatgaacaacaacatcaaaatgactgcctcatagatcttaaattctgtgaggacctctgtggggcagaggagccccacaccatagtcactgctacccctggccatgaggagtactgccagacaatcaccaatgtgcccttaaggccaaggtctcttaagtcagcttgcggtgaatgttgcctggtttgggactcccccttcagggcagtggtctcccttctggcccagggcaggtccagaaatgtcatccaagagtcaagtcctggaattgaggacctcaagagtccactgcaccaccacaaggactgtgttgcgtcagacctgcagccagcacagcaccaggtctcgcccaaggcttgctgtaaccattccctggctacagcctatgttcactcaatgtcctggagctctgctatcaggtggttaagccagtctcacctgtgtccttcccttcagggtggtgacttcccccaggctcctggtgggtcccgaggtgctatctgggatccagggaccagagtcaaaaccttagacgtctacttggtgctctattttactgtggatgagtcagcactcaaaccacaagatgcagttcttcccactcttccgtccccttatccaaaggcacaggaagctcactccatgcaaccgcaggtccatggggcacactgccaggctactgccaatgtttccttaaagcccaggggctctcattcagcttgtgctgtagctggctttagtggcccaaaagctagaactttccctgatatgggcacttctaaatgccagatgccattctggatgatgagggcatagagattaaaacatatggtttctgattacagaaaagtataatacagatttggaaaagagagtcaaatattactagaaagatatttctggagaggagagaggagaggaaaatgaggcaaggatcaaataaaccagttaggattgtggtgtttcttagttaatttcatattttaaaggtctgtaattgtgtctctcttcatattggcctgattttgatagcattaaaaacctgtgtttttcaactttcaaatattaagagctaacaggtaagcccatgcttcttataaatacaactaatcttcactgatattcttctatgaaaatgtttagtctaatatagcaactgtggagcaaaagagatattttgtattaaagcagaattaaagttcttaaataagctaaaattacattttatattatcattttatttaaaccacagggaccagctttggaattatttaaaatctgcattgtagctacagactttctggatagctc

SEQ ID NO: 474813 - DNA, 836 bp, Homo sapiens
gtgtcttgatgtgttctgagcagcaaggacgcagatgacaaacacaaaatgcagaggaaggaggatggaggtggaagagggaagacttcaacagggaagactgactcgcatggggacaagtctggggttatgaaggacttaggaaccttttgcaatagttcagaacgtctggctgccctccgggaaaacccctgtgaggccaggcagaaacaggttactaggggaccgagcgagctcccagggcttttcccactgcttcctctacccctgaatttcactcagctctctaaattgactcagctccagctgcggatgatctctctttcccacttccacagtttgggcactcacagtattcagggtgtctcctgggtcctgcaggagcaacccactcccttcatggggaaaaattcttcagtgttttcttactttcgtgacttagacagctttcaataaacaagtaattctgtagaaatgttcctaattttgatttatgtgatgtttccttgttagattcagattatgtatatttctcaggctatcatagacatgaggctgtgtttttctcattgcattctagttggtggcattcaatttcaatgtgttctattactgatgagataattttgatcacttaaataaggtgaggtctgccaggcgttatgaagtaactttaacttttttgaaatgaataagtatttaataaaagagtcctttgagaccttgtaggtattccttccaactttcagtttttaaatttatttcttaaaagtaatgtggacatacagattcctattttacttgatggattttaagcttttactaacattcctttt

SEQ ID NO: 474814 - DNA, 716 bp, Homo sapiens
aaaattgtaactaaaaggcagaaaatgattaccccaaaagtcagagcaacacattcagccccacttagctctcttcacagccgcagtaggactttggctctgctcccacacacgcccacacgcactgacccgtggccctcaccaggagcctatgaggtcggtgctcctttgtctccgtggaccaatgtcatccagcgagcaaatagtagagccccagctctgctctgccaccaggccttgtcccttttagggtccaaaagagcaggtcctgccctggggccagtcagcatgaaaagggatgaccatctcttcctccagaggacagggactctatgccccaggcactccaaggtcaaacctggctcccactcagactatgaagacagcatccactgggtcagagtcatgaagccacgggtcccaggggacagctcaggcattgcccatcccggaacccagaggttcaccggcacgcagcagatgcttcactgatggctgagtgaggagcctggccttgcgacctgcagtgccacagaggctggagaagcagggcagaggggatcaccccccaccaggccatgctggcgggatgattcctggagctccagttggagcatccagtcggaggcgggcggcagacagggggcagcagggacaaggccacgcatgggcctgggaggcccctggcagggacccgctttgcacaaagctttggg

SEQ ID NO: 474815 - DNA, 772 bp, Homo sapiens
ctgtcacgccatggacttaggggctgatgcttggctgacgccccaaccccaggtgcaccaggaagttccacctagaagtgcaggtgctcaagggattctcaccaggaagtatgggtgcatcaggaagttcacccgtaaatgcagatgcagcagaacatcttacctagaagtgcaggaagtgcaggtgcaccaggaagtctgcatctgggagtgcaggtgcacccggaagtctcatgtggaagtgcaggtgcaccagaaagtctcatctggaagtacaggtgcaccaggaagtctgcatctgggagtggcccccgctgctgcagctgcgttccttgttgttgctgttggcactgtcctatcagaagcacctgggcatacaccacagcaggaaagctggaagtctcatctgggactctcatctgtggctcccaccctggcagagccatctgggctgttctgagcacaggttcacccacaacctaaggaacgggaaactccttacattcgacgcctcttagcttgttttaaacaaggcccacggcttccattttcctacactatggcaggccatgacctttactcatgcctcccacacaacaaaatcaaataaaataaatcctgggtaatttgtggtaaattgtgaacattgataaactgacaaagaagctttattccaagagcttgggttagagttcagtagggactgacagggccttcaggaacacggcagaagtaaacacagatcccttctgtaccacaggacccccagcag

SEQ ID NO: 474816 - DNA, 499 bp, Homo sapiens
ctggaaatctgctttcgctcttgaaagaaggaggaatgcgtgtcctggccctgaactgggctcaccccggggcacgtgggcggaggagagagtgtgcaggcccggggcctgggcctacagaggtggagggttttctactctccccagcaccttcgccattgctgagggaagcagctcgtccccaccagcccccagtccacgaaggagaagcaacaaggggacaccccagacccaacggctccagccagccagcctcccggcgcagcccagataaattactgcattgcgcgccgtcgagatttcacaggtgcttgttggctgcaggggctgactgctatggggccctgcacccagctccagcctcctgggcagcctgcacgtcacagactgctgtctgcccaagtgcccactgcggcctccacttgtccagaaatgttcagtgaatacctcctcactccacatctccctgcccccccgggaggtggggtcagaactcaac

SEQ ID NO: 474817 - DNA, 550 bp, Homo sapiens
cctgagatttccccaggtggctttatgcgtgcctctcttaaagatggtgtatctggagtttgttccttcagatgttcagatgtgtccagagttccttccttccagtgggtttgtggtcttgctgacttcaggagtgaagctacagaccttcacagtgagtgtcacagctcttaaaggtggcacatccagagttgtttgtttctcccggtgggttcatggtctcgctgacttcaggactgaagccgcagaccctcgcggcttcataaaggtagtgcgaacccaaagagtgagcagcagcaagatttattgtgaagagcaaaagaacaaagcttccacagcatggaaggggaccgaagcaggttgccgctgctggctcgggtggccagcttttattcccttatttggccccacccacgtcctgttgattggcccattttacagagcactaattggtccattttacagagttctgattggtgcgtttacaaacctttagctagacacagagcactgattggtgcatttttacagagtgctgattggtgcattt

SEQ ID NO: 474818 - DNA, 844 bp, Homo sapiens
agccagcgagggctgctagcacctcagagtctctcatgatgctgcagacaagctgtcatccgggccacaagtcatctcaaggcttgactggggctgaaacccctcttaccaagttcacccacatggttgttggcagcctcagttcttcaccgtatgggcctctccacatacagcctgagtggcctgcagggcctcctggtgtggctgctgctttcccccagagctatgatccaaaagaaaagcaagagttcaagatagaagtttttattgaaaaaaatgcatataaatggaccagtacaaccttcacaaggggtgtgccctgcattgtcagcatctcccatggcagaggaggtgcattcaatcatggcttgaacacagccaccataccgctagtcctagcccatgagatgatctgctgcctgagaaattgtaacccatcctactttgctatctcttacagatttatgctgtagacattatgaaccataaaccatggacatgttaaacttacaatgcaatcaaggaaaagcctacattatcctggatatgctgaggataaatgcccaagagttcaactgctgggttgtgtagtaattttaattttatagtgatacttgagtttatattaatataaatatagtacagtacatttataactttatagtactgttgaattttataggaatttgccaaactgctttccaaagcagctctaccattttacattcccaccagcaatatgagtgatcctatttccccacaccctctccagcatttggcatttttaattttagccattccgataagtacattaaaaaagagtttttcatgggtatcccttggc

SEQ ID NO: 474819 - DNA, 573 bp, Homo sapiens
cagcagcaaagaccaaagatagataaatccacaaaaatgagaaaaaaacagtacaaaaaggctgaaaattccaaaaaccagaatacctcttctcctcataaggatcacaactccttgcccacaagggaacataactggacagagaaggaatttgatgaattgacagaagctagaccccagggatgcaggatccaggctacccctgaggacccaagctccagacctgctcctgaagacacagtgccagacccacccatatggacaaaagctccagaccttctccaggctgtctttcctgcgaacaacccctcttctgccccctggaactcatttttcttgctgtggtgttctgttgcaaaccacaaggaaatcaattctgccaaaacccaagggaacttggaagtgtatccttctccagccaagcttctatggagactacagccacagacagaacttaaactgcaggctagtaaaaccctaaagaagagaaccagctaagttgtgcccagattttcaacccacagaaattataaaataataaatgcatgtttttttaagtggctaaacttgtga

SEQ ID NO: 474820 - DNA, 1174 bp, Homo sapiens
aggcctctggacctgtgatgggaggcgctgctgcaaggtctctgacatcaatggtcccaagtgggccagtctttgggacttacaagagtgggcacagggcatggcaattttgtctttggagggggcaagattgccagcaaaggtggaccccagatgcaccattggatctagctcaggccatggccctgcagccttctggtgtgggtatggtgggatgagtgaagtgccgcagagatgtggagatgtaggggcaattgggcttttgtggaggatgcactctggcagtggttcttacttcaaaacagtaccatgttgcagtagcctggatcctggggagtgtggggggaacactgtgagttttcctccctggagtaatgcagtcacaaggactctagacagctccctacactggttgagactatcttctctgttttttggaccacgtatcaaagcaaaccccaaatctgtgtgtttcagacccaaaatttctcactggttttggttgtacccagaaacctcacaggcatagattttgtcattccttaaagagagtagaatgaagatttgtttttgatatctagatatttaatctatttggaatttgtttctgaaaattatgtgaagtaatatctaacttagttttttccaaatatacagctgattgcctcaacatctctaatttctcctgttttaaaaaatgctaagcatatagttatatttacatatctttacatatgtgtactatatagttttatatatgtattaaacatatgtcaaataaatatccatgcttacctgtatatatagcatatgtttatataacatacagatgtgtatttatattttgtttcattgatatattgtactttttatgccactaatacattattttaattattatattctagagtatagtttaatataataaaaagtctctatttattatccttttctgatatttttatacatttaattttccacatgcagaattgcaagtttttaatggatcatattaaaaaatagatcttattaagattcattaagaaatctaattgagatttttgtttgcattgaatttacaggtcaattttggaagaatttatgtctttgtaatattgagtcttctcaatgagaaaatcaaaaggtaaaaaacaacagatgttggcaaggctgc

SEQ ID NO: 474821 - DNA, 755 bp, Homo sapiens
tggagatactcatctgcgtgcagaagactatgactagcgtgtcatggaacatttcatcaagttgtacaaaaagaagactgacaaagatgtcaggaaagacgatagggctgtgcagaaactccagctagagattgaagtcacctttgagatagatgtgaatggtattcttcgagtgacagctgaagacaagggtacagggaacaaaaataagatcacaattaccaatgaccagaatcacctgacacctgaagaaatcaaaaggatggttaatgatgctgagaagtttgctgaggaagacacaaagctcaaggagtgcattgatactacaaatgagctggaaagctatggctattctctaaagaatcagattggagataaagaaaagctgggaggtaaactttcctctgaagataaggagaccatggaaaaagctgtagaagaaaagattgaatggctggaaagccaccaagctgctgacattgaagacttcgaagctaacaagaaggaactggaagaaattgttcagccacttatcagcaaactctatggaaatacatattcacatcctatatttttactcaaatcctattcatgataaatatttagtatatcatatgtgttgtaacattgtgtttctattcttatcattgtaattatgactcaggaattgcttttgggacattagtttatctggggaaactagtactagaacacgaccaatggtaaaatatgacaacttaaaatttaataagcct

SEQ ID NO: 474822 - DNA, 1131 bp, Homo sapiens
ctcgctgctagcgcagcagcctgagatcaacccgcgaggctgtagcctggctgggggaggggtgtctgcaattgctgaggcttaagtaggtaaacaaagcggctgggaagctcgaactggggggagcccaccacagctcaggaaggcctactgcctctatagactccacctctgtgggcagggcatagctgaacaaaagccagcagaaacttctgcagacttaaacgtccctgtctgacagctctgaagagagcagttgttctcccagcatggcatttgagctcagagaacagacagactgcctcctcaagtgggtccctgacccctgtgtagcctaactgggagacatctcccagtggcagctgacggacaccacatataggtgcatgcctctgggatgaagcttccagaggaaggatcaggcagcaatatttgccgttctgcaatatttgctgttctacagcctctgctggtgatacccaggcaaacagggtctggagtggacttccagcaaactccaacagacctgcagctgagggatctgactattagaaggaaaactaacaaacagaaaggaatagcagcaacatcaacaaaaaggacattcacaccaaaaccccatctaaaagctgaaaattctaaaaaccagagtgtctcttctcctccaaaggatcgcagctcctcaccagcaacggaacaaagatggatggagaatgactttggcgagttgacagaagtaggcttcagaaggtcggtaataacaaacttctccgagctaaaggagcacgttctaacccatcacaaagaagccaaaaaccttgaaaaaagggtagacgaatggctaactagaataaacagtgtcgagaagactttaaatgacctgattgagctgaaaaccatggcacaagagcttcgtgatacatgcacaagcttcaataggcaattcaatcaagtggaagaaaggatatcagtgattgaagatcaaattaatgaaataaagcgagaagagaagtttagagaaaaaaagaataaaaagaaatgaataaatcctccaagaaatataggactatgtgaaaagacaaaatctacatttgattggtgtacctgaaaatgatggggaaaatggaacca

SEQ ID NO: 474823 - DNA, 945 bp, Homo sapiens
cctgtagctgagggtcctgtctgttagaaggaaaactaacaaacagaaaggaatagcatcaacatcaacaaaaaggacatccacaccaaaaccccatccgtaggtcaccaacatcgaagaccaaaggtagattagaccacaaagatggggagaaaccagagcagaaaggctgaaaattccaaaaaccagaatgcctcttctcctccaaaggaacacaactcctcgccagcaaggaaacaaaactggatggagaatgagtttgacgagttgacagaagtaggcttcagaagatcagtaataacaaacttctccgcgctaaaggagcatgttctaacccatcgcaaggaagctaaaaaccttgaaaaaagattagaggaatggctaactagcataaccagtgtagagaaaagcttaaatgacctgatggagctgaaagccacagtacgagaactgcgtgaagcatacacaagcttcatgagtcaattcgatcaagcggaagaaaggatatcagtgattgaagaccaaattaatgaaataaaatgcactgaggttgaaatgaaggaaaaaatgttaagggcagccagagagaaaggtcggattacccacaaagggaagcccatcagactaacagtggatctcttggcagaaaccctacaagccagaagagagtgggggccaatattcaacattcttaaacaaaagaattttcaatgcagaatttcatatccagccaaactaagcttcataagtgaaggagaaataaaatcctttagagacaagcaaatgctgagagattttgtcaccaccaggcctgccttacaacagctcctgaaggaagcactaaacgtggaaaggaacaaccagtaccagccactgcaaaaacatgccaaattgtaaagaccatcaatgctatgaagaaactgcatcaattaatgggcaaaataa

SEQ ID NO: 474824 - DNA, 922 bp, Homo sapiens
ccagggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaatgtgtcagctcctagaagtgtataacatccatcccggccctattattatttttttgatacatatatgtatatacacgtatatatgtgtatgtatatatatgtgtatatgtgcatgtatatgtaagtatatatgtgtatattaccacatatacatttgtgtatacgtatatgtatatatgtatgtgtatatgtatatacatacacgcatacatacgtatgtgtatatgtatgtatatatttaaagtgtgtgtatgtgtatacacatatgtgtatatgtatatatgtgcatacatatgtataaatgcatg

SEQ ID NO: 474825 - DNA, 1029 bp, Homo sapiens
agtgccgggttacttgccagaatggctgtgcaatctatattcccaagcataaggcttgtgaccaatcctgtgacagttgtggccccagtagccccaggtgtcttacctgtactgagaagacagtgctgcatgatgggaaatgcatgtctgaatgccctggcgggtactatgctgatgccactggcaggtgcaaagtttgtcataactcatgtgccagctgctctgggcccacaccctctcactgtacagcctgcagcccccccaaggctctgcgtcaaggccactgtctgccccgctgtggagagggtttctactctgaccacggagtctgcaaagaagccagaggaaggactgcaagtggagcagctgtctggcgtgggcatcccctctggcgagtgtctagcccagtgtagagcccatttttacttggagagcactggcctatgtgaagtctgcatagttttacacagccttgaactgtgcaccctgaggtttttagtggaaaccacagaggaattagacctccaggaacaccagtctttccaagaattcagagagatgccaacttgccaccagtcctgtttcagatgtgcagggaaaagcccacataactgcacagactgtgggccttcccatgtgctgttggatgggcagtgcctctcccagtgcccagatggctactttcaccaggaaggtagttgcacagcatcccaaagtcgtgggattacaggtgtgggtcactgtatctgactccatttcttttcacataagaaatgaaatttggcaactgggacacttgaggacactagggagatcttttactttctccctcttaatgaggtactgctctggttgtcaattattgcctaataaaccaccctaaatttgtggcttaagacaacaattgttatatttcccagttctgaggattgctgggcagctctttcttcagatcctgcaggtgggctcttcattgacgtctgtcacctgggttggtcaacaatctcttactctatgaggcctcttctc

SEQ ID NO: 474826 - DNA, 692 bp, Homo sapiens
tgttactcatgttgttaagaactgaaaatgtcatccagggcaactcaacatcttcctggcagctagatccctatatagaaggtgattacatcaggatatggatctatggaactttgaacttgagagatgatttagggcatctggtagaagaaatttctaagcagcaaagtagtcaagatttggtctggctgctcctaacagtaaacatttgcgggaagcccctcccatcagaggcccaggggcttatcatattaaaatggtttggtgggccaagcccagggtccagctgccctgtgaagcccggagacatagcgccctgcatcccagccattccagctccagccatacataaaataaggaaaggtacagctcaggccattgcttcagatggtgcaagccccaagtcttggtggctaccacaaggttttggtccttcctccagactgtaccaatctctgcctgttacccggttctaaagtcacttccacatttttgggcattcttacagcagcgcctcactctctgtgtgaggatgaaataaaatattaaatataaatgtcttaattagttccagaaacttaatatatgagaaatattatttattgtaactgtgatgaccatttcttttgcatgctccttatctctctttttgccttataaaaggcaactttatgccaacatttaaaacatat

SEQ ID NO: 474827 - DNA, 518 bp, Homo sapiens
gccactcgccagcaaagccaggctatgctatcatatcttccacatctatcgttgaggctaccactctgcccccctctactacctctcagcaagtcaaattactgcattaatgcctctttaataaaaactctgctcaaggccgctttacttccaaaggaaggtggagtcattcactgcaaagaccatcaaaaggtgtcagatcccattgctgtaggcaaggcttatgctgataaggtggctagacaagcagctagctttccaacttctgtccctcacggccagtttttctccttcatatcagtcactcccatctactcccctgctgaaacttccacctatcaatctcttcccacacaaggcaaatgtttcttagaccaaggaaaatatctccttccagcctcacaggcccattctattctgtcgtcatttcataacctcgtccataattcaggcctgtcctcagaatgctacagggtacagcccatttgagctcctggtacatgtgcacattgtgcagg

SEQ ID NO: 474828 - DNA, 647 bp, Homo sapiens
gcagcagccgatcctgacagcctgccatgccatcatggccacatgtgggtaatgagcacttgaaatgtgcaacactatttgtaatagccaacaggtggaaacagcccaaatatccattaatggatgaatgggaaaaaattggggtacatacatataatggagtattatccattgaaggatgcttgaggctggttctgaaagtgttggaagaaccacaaactggattcaaccactgctgtgggaagatgtcattcactctcagagtttcaattgcccttttattttatgacttgcaaatttttattttcagtccagatctctcttttacatttcagatgttcatgaagtcaagtgttttgaggaaaatgttagtgcagcctgattgctttaacattttcttgcactacagaagaaacaaagcagttattgtatattaataaaagttaaactatttatttacacatgaatagtaccaaatgtggacagtggtcaattttatatttaatctagcagttttatttaaggtattctttttttcactgttaatatgaatataaattcaagtttctcattcaaattgaatcaatctcattctgctagtttcctcattaatgagtcaaataaaattttgacatgtgcccattact

SEQ ID NO: 474829 - DNA, 629 bp, Homo sapiens
cagactgcctcctcaagtgggtccctgacccctgtgtatcctgactgggagatacctcccagtaggggctgacagacacctcagacaggagctctggctggcatctggcaggtgccctgctgggatgaagcttccagaggaaagaacaggcagcaatctttgccgttctgcagcctctgctggtgatacccaggcaaacgggacaccatccgaaggtcaccaacatcaaagaccaaagatggataaattcacaaagatggggagaaaccagcgcaaaaaggctgaaaattccaaaaaccagaacgtctcttctcctccaaaggatcacaactccttgccagcaagagaacaaaactggacagagaatgagtttgacgaactgacagaagtaggctttagaaggtgggtaataacaaactcctctgagctaaaagagcatgttctaacccaatgcaaggaagctaagaaccttgaaaaaaggttagatgaattgctaactagaataaccagtttacagaagaacataaatgacctgacggagctgaaaaacacagcacaagaacttcgtgaagcatacacaagtatcaatagctgaatccatcaagcagaaggaaggatatcaatgattg

SEQ ID NO: 474830 - DNA, 787 bp, Homo sapiens
acatccgagcagctgatacacccagtggagtcggctatgtgcccacactcagaacctgagaaacagccctgcaccctcacatcctcccctaaccccaccacaaacacacccctgggccttcccactggccctgctagccaagcagccaagagcctatgtcccagacctgagaaacagccccatgggctgtccccagtggacatgcccctgagccaacgaagcagccacttgtctgtgcttctggccagtgcccctctgctgcaggtctgctggagtttgctggtggtccactctagactctgtttgtctgggtatcaccagcggaggctgcagaacagccaagattgctgcctgttctttcctctggaagcttcttcccagaggggcacctgccagatgccagctgtagctctcctgtgtgctctgtcccagggagatgggagttttatctataagttcctgactggggctactgcctttctttcagagatgccctacccagaagggaggaatctagagaggcagtctggctacagcagctttgcaaagctgtggaggtttccagaagaaggcattattatcataggagatgacaactccattgttgtgggaagtcagggaccccgaacggagggaccggctggagccacggcagaggaacataaattgtgaagatttcattttaatatggacatttatcagtttccaaataatacttttataatttctcatgcctgtctttacttttatctcttaatcctgttatctttgtaagctgatgatgtac

SEQ ID NO: 474831 - DNA, 632 bp, Homo sapiens
aaccagtcccaatgagatgagctgggtacctcagttggaaatgcagaaatcactgccttctgtattgatcttcctgggagctgcagaccggagctgttcctatttggccattttgccagccacaccaggaccatatcttttgatgccatttaaaaaatctcatgggagtgatgtggagggacgagatggatgctatatgcacagtgggtttgcctgtagccaggtaacactgaatttggggaatccattggttttaaagcaagcagtaagaaaacaagctctttgtcccagagagagacttgacatcatctctctaggttgctctgcaaacatgaccctgagaaatagccccagaaaacagcagtcagtgctttgcattcttgataaacccagtaagacatgtaagagcccaagagactgaggggggactgtctttcccaacaattagcataaattagtatactcatataatgaatgtacagttaatatactcaggagtttgatgtacaactaggtacaacaacagtttttacccactgattttaagttcaaaattctgttcctagatccatgcttacctccatatattaaaaattatttaaaatgacacaagaaactcctgggaagcggta

SEQ ID NO: 474832 - DNA, 1783 bp, Homo sapiens
ccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacaggacagtcacgaagccatttctcccatcagttgcttagacaatggatcctgtgtctggactcacttctgtcttcttacatcactgtcttcattgccagtgcagttcttgcatggtgacaatactaataggcatactaatttttccacgaatgtgggataattttcagggtacagatttaagatctttccaagttt

SEQ ID NO: 474833 - DNA, 776 bp, Homo sapiens
cgaggaacctaaggtgggggtgagagtggctccctgacttgccaattttacaaaccatgaaaaaaatcagggatcaacacagggtttttaaattaaaaactactacccgttactcccatcgtttcataaggccatttaaacatatcaaagagaggcgggacctaccttgcggacgagtaaaaactttttcacagattagcacctatgtcaacagaaatgaaaacgagatgaaggaaagacatcagaaaaatgacccggggactctgactaagggagtgaaagaaaatgtcttcaaagacgactctcaggagggacttgtgcacaaacagcgaacccggaacggcgggctgatgcggaatcttaatggcaataatgtgatttgcaacagcaacagcgaaagattttacatgttctggatagaaaatgcttctatcaccaagggaaacagagcagtcgcctacgcccacatcatggcaccacctgatactcccctgcctgctacctacctattatcaaaaatggcagggaaaatgcaaaagaaggaagacaaaagaaagtattattttacgtgagtttggtcttggtgctaaggggatcctgatgagaaaggggcataaactttttaaataataaatatttagcaggtgagatctttttggtttccttggaattactctggctaaggaatgatcgcgtgtggccactgtttttaagtggtgtgaagagcagcatgaagcggtccctaatactcactgaagacacagtgtcttcataca

SEQ ID NO: 474834 - DNA, 579 bp, Homo sapiens
ctgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggcagccttgatccagtgcagactgttgttgacaacccggcggtagcatttgtagaagccctgaaacggaggttcatagggggccaaagagtgttattcctcactccttccaagccaaggactgcagaatccaaaggggcggaggaaagagaaagggcgccaggcggccagggaggccttgttggagagcagaagtgaatggagaagcgcacgcgcagtgtgtgatggtgccgcaggtcacttgatgtgtatgaatccgaactttgtagaaacgtaaatgggatggactgctagttacagctaatgctgccaccctactgc

SEQ ID NO: 474835 - DNA, 593 bp, Homo sapiens
caccactgcatttccctcatccagacatgggtacctatagcagaagccatgtgcagtacatatggtgcagctgcagccttgcatggacctggcacctgtgccaccacctggatctgtctgccctgctgctctgtgcctggagccattctgtgcctggcttacccttggcaggcatgggatctgggctggtagtaccagccaagtgcagcctgccaggccaagacaaagaggaaatttccaatatttacctcacaggcattcagttgggatggatggaggtggtaaaacactgggaaattggatgtactttcaaggtagaggcaacaggatttgcagaagaatttgatataagatgtgagggaaaaaggaatgaaggtaaattcaaagatttcttccttatcaatagagaatgtgatcctcccactttcaattctataagacaggatttagaagaaaacttttgagtctagtatggaaaatctgaaggaagaaagaagataattagaaaaaatcaacacaaatgtaataaacaaattgatacaaacaggaagcagggaatactgggtagaagagatcagggtccctggtgaggg

SEQ ID NO: 474836 - DNA, 726 bp, Homo sapiens
gctctctctcctctttgagggagcaatgcttacagccaccttggtgcttctccaaagctactttctccatcatgggatatctactggggccgtgtgttttgctggtatagttgttccccttattcatcgtttcactttctacagtttcagttacctgcagtcaaccagggaggagaaattggtgagaaaacctgtcaagttgtgtttgcatattttgactgtttcctgcaggggaacaccagccatgagtgacaaatcttggtacagtgttcaagttaaagatgatggaggaaatgcaacgatgtgcaaatctccctttctaaattcatgcctctggggacaacatgagattcagaaaccggggaaatcacggtttcggattccatcttgtgtccaatttctgctgaagatctctgctaactgtgcatcttgtcttggagatgtcattgcccatgactggaatgccggtgtctatgaagacagtgatattggtgtattactcaagtgaattatcattttggttctgaattgagttgtattctactcatttttatagaagtctgacacaaacatccgtgctttcttttttactgcctggagaaggcaaataccattgacaaaatccttgcctatttacacttactctcatgtgttattttcattattgctttcaaggtgaaacctgatcaagagattaataagtccttgtgaatatgtgaaagaaca

SEQ ID NO: 474837 - DNA, 979 bp, Homo sapiens
cagggtattggtcctatgtaagatgatggtaaagtgggcatcatctaatatgaacgaattaaacacttcagactatgagctgcatgaagttgtacagatcatgtgcaaatatgaggacaatgtcttcaccctcttcatggcaccggcacagaaaaagtccaagccctgtgacactttactagagacttcccatcatgctgaccaggtgttaatagccagttcttactggggctttttgacaaatgcgttccagtatttgtgtaagtgtgtggactacccaatcagtaatagtagtaaaagatcacaagtaagaactgaagaggcaggaaatagaggtgggataaggcgagactggaaactgggctttaggctccaattacataagatattacacaacagtaacattttgggagcagattcttccctagagccttttgaggaaaaccctgcaaagcaacatcatgacttcagccttgtgaaatccaaaatagaggaaccaactgtgtcaacaataaacttcagacctgcagaactgtgagatcatacattcatgttgcttaaaagtgctaaatgtgtgtagcaacaataaaaaacgacaagtaattaatatcattgttaataatttttgtgtaaagtttggttaattttctaggaacactgattattcttaagcttggtcatttaacaaaatcccagacttcttggaggctttgttcatattttcttattcttttttctttgtctttgttggattgggttaactcaaagagcttgtcttcatgctctgaatttctttcttctacttgttcaattctattgctgagactttccagagcattttgcattttgataagtgtgttcattatttcctgaagttatgatattttttatttatgctatctatttccttgaatatttctccctttgattcttgtatcttttttggatttctttgcattgagcttcacctttctctggt

SEQ ID NO: 474838 - DNA, 1466 bp, Homo sapiens
aaactaattctgattggctaatttaaagagactgaggggcggaaaaaatggttatgacagagcaggtaattggaatgagtcagggtggagcagggccatattttcctctttatttgtatgttttgggatcttttgttgtgattttggcatttgacaatacagccatttctcccagtttttatggactgtcttcatacacaggaagacctttatcaatcaacctgcatcaatattctgaagctctgaagctttctcaaatctttttaaaagatatgctttatcttgtcttggggatatttaattttccaattaaagatgttggtatttcttctctggtttccataatttcttatgttatgttccacaatttcttcttgttgtctatctgcaatattactatctctctggtgcttaacaagccacagtgcttgcttttgttctcgaaatcccctaatgatgactaagaactggatgtccaaaccagtgcttctctcagtgctgtcaggacagacagaaatgagtccctcgggcagtccctgaaaagccagaatgtttaatccatggtccgcttctctcttagggggattgactatgtttctttcacttacagtaatgttaagtaccatttaataattcacagctgaaatttcttttaaggtaaatggttgtgaatatcaaaacataattttttaaaacttgtaaagtttacgtgggtatattataggatcttaagtctttatatgtatgctacaattagctgtaattatatattccttgacatcttaaaataacattttttaaaattgatacagaagtgatgtgatcttcaaaatggaaagaacaaaacaaatatatagagcatatcacaggtgaagaaatcatgctaccctgaatgaattcaaaatcaaaggttgaaggaacttagaggagctatgtatgtgaggtgatctgcaagccagctttgatactttataagcaatagtggaaaggaagattttttggaaaactgcaaatggacaaatgctccaaatttacaaaaaaaaaaaaatactctgaccatattctagatgaaataccaaaggaatgatttttaaatttaatttattgaaagagaacacaacggaagacattttaaaccttattggaattggaacatatacctgtgtaaacataattattttacagattatataataacaggtgccaaaattttagtgatttttttctaaaggatttgacaaatcccatttcattattgtatttgaaaattgagtaaaccatgaaaacttcctttgcctcagtttctctctatgtaaaataacattaaactggaatgacatttaaattgtccaccaccaatatcaaaatttatacctgttagtacaaaattttagtttctctttacagctgaaaaaactaagactgtgtctatttgacttgttttgtatctcctaaatatgtcattc

SEQ ID NO: 474839 - DNA, 1515 bp, Homo sapiens
cacagtggcaaggacaaggagatgaatgtagcagccaagtaccgcatggcctccctgtatgtgggtgacttacatgcagatgtcaccgaggacctgctgttcaggaagttcagcactgtggggcctgtgctgtccatccgcatttgcagggaccaggtcacccgccgctctctgggctatgcctacgtgaacttcttgcagctggctgatgcccagaaggcgctggacacaatgaactttgacatcataaaaggcaaatccatccgtctcatgtggtctcagcgcgatgcctacttgaggagatctggaattgggaacgtattcatcaagaatctggacaaatctatcgataacaaaaccctttatgaacatttttcagcttttggaaagatcctttcctccaaggtgatgagtgatgatcaaggctccaagggctatgcatttgtgcactttcagaaccagagtgctgcagacagggccattgaggagatgaatggaaaactactcaagggctgcaaggtgtttgttggcagattcaaaaaccgaaaagatcgtgaagctgaactcagaagcaaagccagtgaattcaccaatgtttacataaaaaactttggaggtgacatggatgatgagagattgaaggacgttttcagcaaatatggcaaaactctgagtgttaaggtgatgacagattccagtgggaaatccaaaggctttggctttgtgagttttgatagccatgaggctgccaagaaagctgttgaagaaatgaatggaagggacataaatgggcagctgatttttgtaggccgggctcaaaagaaagtcgagcgacaggctgagttaaagcaaatgtttgagcagctgaaaagggaacgaattcgtgggtgccagggggtaaaactctatattaagaaccttgatgacaccatcgatgatgaaaaactacgaaacgaattttcttcatttggatcaattagcagagttaaggtaatgcaggaagaggggcagagcaaagggtttggcttgatctgcttctcctctcctgaggatgctactaaagcaatgactgagatgaatggccgcatcttgggctccaaacctcttagcattgccttggcccagagacactaggaaagaaaaacgtacctttccagctagtatctgcagcaggtgggagaatgatagtgatctctgcctgaattgacctcagtaaatttcatattccacatgatgggtgcttagtttagtaaactttatgataaaacgttttttatacaaagccattttttttcttttgtggaaaaatagatggagcttagttcattttacagaggcacattttctaattttaatattgcacatttttcttattttgatatgttcatagcaataagtataaatagatatatttttacatttgaaccaaatgaaatgagaagggatctctctctgcactgggctgcctaaagtttggtaaggggtaatatgagcatcttcatggccaccacagcc

SEQ ID NO: 474840 - DNA, 701 bp, Homo sapiens
ctacgcagccataaaaagaaatgagatcatgtcctttgcagaaacaaagcctaacacccgtgtctttagaccggcagccgtgctagttgcttttaactggctgacagctgcctggtatttagcccccaaattctaaggaaaaataggacagaatagcaagtgaaaggggtctgatagtcctcaccactcagcaatagtcgatgtcccttcatcgtcaccaaaatatgcctggaattcattatttccggtgggttcttggtctcgctgacttcaagaatgaagcctcagacactcacgatgttcagatgtgtctggagtttcttccttctggtgggttcgtggtcttgttgacttcaggagtgaagccacagaccttcacagtgagttttacagctcttaaaggtggcgtttccagagttgttcattcttcccagtgggtttgtggtctcgctgacttcaggaatgaacccacagaccttcacaaagtgaacctgcagacctttgcggtgagtgttacagctcataaaggttttttgcttgccggacacccatggctgcacctggacccaatagctccacctggaccagcctatgcccatagactggtcctgtggtcccacccagaagtgattcagtgggcagaagaatcattttcaacccccacaattgcacctgcaaccaatcagcagcaagcctagcaa

SEQ ID NO: 474841 - DNA, 847 bp, Homo sapiens
tcaagaaagacctggatcctggaacagctcaagatgtcaacctgaagcaaccatttcaaacagaacttaataccagtatgatgtattactatgatgatggtacaggggtacaggtgtatcgtgtggaagaagcattgcttaaagagtgtattaagcgtcaaattgaacattacttcaatgcagaaaattcggaaagagactactttcttcgaggaaagaggggtgaacaagattccttgcctattttcctgattgctggtttccaacgtgttcaggctctcactacaaaccttatcacagaggcactgaaggatagcacagaagtagaaattatgaatgagaaaatgagaaaaaagaaccagaaaaatggccaattccaggccctcctccatgcaaccccaattgatagtggcaagaggcaggcaaattcctgggcagataagcgtaggtccgtggtgaggcccacccttcaagccaggaatagccccaggcctgaaaaacctgcttccagttccaggtggagtccaccaccccaagtgcaaacttccttgatgcctttcagccagtgggatgctttttctgggcccacccatggaccaatcagcatgcacttccttcatttggagcccataaaaaccccagatgcagccaaactcagacacagcttgggactacatgcctataaggaggagctacccacgttgtgtcttctctctgctgagagctgttctgcccctcaataaaaccatctccaccttgctcacccttcagttgttcacataacttcattcttcctggacactggacaagaactggggacctgccaaactgtggtttggaaagggct

SEQ ID NO: 474842 - DNA, 1334 bp, Homo sapiens
tctaaggggcatagcgtctggctaccactatgaaagaggagcaagcagagagatacaatgggggtacagggagtacaggcaaatacagccatttcaaatgggagacaatggccaaaatagagaggctacaggctcatgcaagtccaaaatccagtggggtagtcaaagctcaatgttcagaaatgatctcgtttaactccatgtctcatatccaggtcatgttgatgcaagaggtgggttctcatggtcttgggcagctccatctctgtggctttgcagggacagcccccctcctgtctgcagcttttcaagaagcatggtgtaagctgtcagtggatctaccatgctgggctctggagaatggtggccctcttctcacagctccactaggcagtgccccagcagggactctgtgtgggggctccaacgccacatttccctttctcactgacctagcagaggttctccatgagggccttgtcttgcccctgcagcaaacttctgcctgggcatccaggcctttccatacatcttctgaaatctagagaaatgaaatttccagttgatccatgtgtccagtgcattctctaacggaatccacattctcattcatattcgtaagtactgctcgttccactcatttgcatacagaaactcttccctgagttcacacaggtttacgtacctatatattctacattaataaatatatatttagttgaaaaatcaaagcttttgtggattatattctttaaaacttaaaagcactgaagtatatttatctagcgccctctatggtaaactatatttatatcctgaattagtgcatatttatctatgaaagaatatatagagttgagatagctatttttcaaaatcatttaaggaaagcatatagtactactttaatgtaaattgcattgtctgtgagacagtgccatattttaaattaggccacacaagagcaagattgtaccttctttaattaaaaaataacaaaattaattaatcttaataatgagtaattttagtggtattatataatattttacataacagttaaataactcagtctgaataaaatctatgtgattagacaaaaggattgaaaatatataatacataaaataatattcaagatttttaaaatgtaaaaataggatatatcataacttaatacttaggatttcataaagttttttgttacagaaatttcttcagaaaggttgaaagtgaatgggaactttctgaaagtcatggtgtatttatgatggcagcaatggaaatgaatcaatgaaatatccttaaaaaaaagatttccaaagaaataagat

SEQ ID NO: 474843 - DNA, 1280 bp, Homo sapiens
tataattatgtcttctttgtgagtcaaaataaaaatctttttttttaaacagtttctctttccttgatatgacgttaaaaccagatactgtgattgctcacctgattttaggctcttatgaaggtgcttccttgtatggatggctattcaatgtggtgttcagggggtcacagggagaagttatacacaagatgaatggattaaccactggaagacctgcactactacaaatgttaaagaaagtccttccaagaaagaaaaaaggcaacttaatggaaacttgtgtctaccaaatggaaagaagagcaatgggaatcctaactacagatctgtggagctttgaacatgagaaagatgatttagaatatctggtggaagaaatttatatgcagcaaagtgttcaagaagtgactcgggtgctcttaaaaccattcagttgtatgcattcacaaagatatggtttggaattggaacttatgtttaaaagggaagcagagaataagagttcagaaaatttgcagcctgatgatgcaatagaaaagaaaaatctcattttctggggagaaattcaagcctgctgcagaaatttgcaggatgtatggaaactcttggatgtccaggcagaagagtactacaggggcagagctctccatggagaacatctgctagggcagtgcagagtccccactggggcgctgactagtggagctgtgagaagaaggccaccaacctccagaccccagaatggtagatccaccaacatcttgcatcgtacacctagaaaagtcacagacgctcaacaacacctcatgaaagtagccaggagaggcgctgtatcctgcaaagccacagaggcagagctgcccaaggctgtggtatcccacctcctacatcagtgtgattggatcaaagatactggtggcagtttgccctgctctggagatctatggaactttgaacttgagaaagatgatttaaggcatctggcagaagaaatttctgagcagcaaggcattcaagaggtgaactggctgttctgagcatgtacacatactctcttatttgttataatccatgttatattaattgttagtttacagttggaaaatatgcatctttaacttttctcagtctaaagtttacatacatacatcatctttatgttatcttatgtataaaattgtatatttaaaatgatatcctcttttctgggctccgttagcaattatttttctgtctgcattgtcttctcattcccacaagcttgataatacattcag

SEQ ID NO: 474844 - DNA, 1032 bp, Homo sapiens
ccgcgagggtccgcggcttcattcttgaagtcaagtatccactaagtatatgtggcttttgagcacgtactatgtgtattactccttaaatagttattcctccatccttgttatcatccagaattcctaccgtttatctgtgacttatttttcttcccaaccttcccaacccctgtttgatcatcctgtaattgtccccatctcagtgaagcacatccaaaaagcaaatacatcaaattttccctggctacattttgacctcatctactgctccttgatctactctgtgacagccactttagcttcctcgcacttccaaaacactaagcacacatctacattaaatcctttgcattcattatgcatttgtttactatactcagatttcatgataacagcaaagtgttcccttgtcacctccaataagatagcaatacatatcagtcagagttcatttggaaaagcagagtcaccagggtacatgcactgactcaaatatatacacatccctacaataaaatggttgttacggggatttgggtttgcaggattgtaggatctggttaaccagtttgtgtgaggcttttgcttctgtacctggtgttagattctgaagatagcaaggcagtcagtcagaaaggtaaggtggacgtgaagtgaggcagacaagaaccagttgcaacctgtgaaaatgggcaagaaaccaaaagatagactggaatctatgaagacaaattacaacgtgttttaccacctcctatcttcccactttggaaatgtcagtgtttaacaggaaatactggcacccttcctcaaatagctgaacacaaacctcagccaaaaattgtagaactgaacggggaaaatctgctatgatctgatgttgctgctggagaagctgctatcccacatcaaaagaaacaagttaatgaccatattgcacaggcttcaacaactacttgtgtacatgtaacaagatggctgccgcattcccctaccttcctcatcttgtgtgccatgtctcctgtggcc

SEQ ID NO: 474845 - DNA, 628 bp, Homo sapiens
agaaagaaaaaccaggtctgagggatccaaagccagacaacaggcacaatgtaaatgagcaggacaaattcctgccaactgaaccccaccacatggaaggaggccatgcttcatggcataaacaggctcagggaactcaagatttgcttagcagggagaaagggaagcatgggcaattcagccctttgccgacaatgtagggttgatccagccctcctgtttgttgtctcagggaaggctgcaaggggcaagcccagtgaattaaagatacaaatcccagaggcattctcagcagaggagccatctccctccagtcctgctcctccatgtccaccccgacctccctatccagcttcagcctctcacttgctcccttctagaaaacctcaccccaaacaagccccaatctcactcttgcccctccaacagatgcccagtgaatctgggcccagtaaagtccaggtcccctcctccctacaggacttaaagcaaattaagggggatcttggaaagttttcagatgaccctgatatatagaggttttccagaattttacccaaatatttgaactatcctggagagaggttacgttacttttgaatcagaccctgacagacagagagaaacc

SEQ ID NO: 474846 - DNA, 2305 bp, Homo sapiens
tctcctctacactcatcaggactacctgcctgtggataggagctaccctctttcagtgttctctacacttgtcaagatgagctgcctgcagaaaggagctacccacttgggtctcctgagagctgttctgtcactcaataaagctactctgacttgctcaccctccagttgtccacctaacctcattcttcctgggtgcagaacaagaactcaggacccaacaaataaagggagcaaatggaactgtaacatcttcttgactgacatgcagcctgctgttcacaatgctgagggtgatgagaaggagagaagagctgtggcccttctgggagtccagacctcagtgcttcccagggctgtgacatgctgttacaccctctttgggtctctgcagtttctggtgcctctgagctttcaggagccactgtgttacccattgctcacagtggaaatcacttgtggtatgcccggtctagccacagccttgcatggagtcagtgattgataatgcaaacgtcagtaaattaaacattaacattagaaccattgtgtatatgtacatatgaaacataatttaagaatatgtgtaaatattagaatatccgaataagtataaaacaagattttttatttttgttatttgaaaattatagtaataaaataatgtgcattatatgtgtgatacatatgattttataatgtttgttaaatctgactcaagcatggttattgaggttatgtatattcacacagaaaaatcacttgaataaaaaagaatatgtactttcttacttattgacttgaataaaacttaaaatgtgaattgaaatttttgaaacttatttagagatccataatttaaaaattacaacaggtgatacaaaatattaagattatgtttacattaaaccgatttctctatttattgttgaaacattactgtgtagtatttggaataaaagatttaaattaacttattaaaataaaccataggaagaacgattgttacaattttaacatattttatttgctttgcccttcctatcccagacctacacattcaggtgttttataatctttctgccacgtcttctgattttccagataagcagtagactaaaattaaagttcctcatctaatcgcatagcaaagttctataattgttaatcaaaattaaaataattatcaaacataattttcagcattttgtttttatcatatgaaaaaacccagagtgttctgagagaaaagcaatcatatgttgaatcatataacaaagtattatttcatataacatataacaaagttatatatgatatctatgtcatatataacaaagtattattaatcacataacaaggtattattggttgctcagggagaaaaaaatgaaacaggaaatcatatattaatcatataacagtcaaagtataactgattcctcagaaagaaaaaatatggaaatatttggagtttgtattccttatatacatcaactgaaaattataggagatgtcattttaaccatataaaaaatgcttctgattcaagaccacaaaatgatgagaaatgaagaacacagtaaacaacaagatcatagatctttgaaatgtaagtatagctatagctaacatgctaatcatatctttggaaaatataatatgtatgagtactaaataagaaatctataaagtagtaaaaaatgaaataaaattttgttagtgatgtaaaactaaaaatattaaattatctcaggcactcataaggatatcagtagaaacaggaataaagagtaacctaaatctcttattagtaaaaggtgaggggaagaaagaggacaaaagtcagcatggtcaagatattattttagttgagtagaagatttaaggagaaagtgattattatggtggcaaaacgaagtggttagcttttttaaaataaaataagagactgcctctaattatgagtatgtcaataagataagcattaattgtatagactacatagaattatttttaaataagcaaggtgacaaattggaatgaatagcaacataataaaacttaaaagagaataataaatgtgactatttaatagaaagaataattaaaatgagtagaatatagtcaagtccatcaatcattacaaaaaatgggaataggtggaatttttcagatagtgataatatgaaagtatcagtaattttcttacggaaaacacatttaaggaaataaagtttcaaaacatattgaaagaaatgttaggcaaatgaatatagaaagaaaaagcaggcatgaaaatatc

SEQ ID NO: 474847 - DNA, 2273 bp, Homo sapiens
tcctcagtcttcaggaaagaatacaggcctgtccttagaatgctacaaggcacacaagaagatgggcatggagaggagcagatcagccaaagaagacacgaatggctggatgttgagagggtattgatgggagcacgccggcagaagagcacaccgacagacactggcagaggagagcccaggcctctgagtggctggactccagggaaaaccatctcctttctggctccctcatctgttgagtactacttccactcagtaaaaccttgcactcattttccaagcccacctgtgatccgattcttctggtacaccaaggcaagaacccaggatgcagaaagccttctgttctcccaaaaaggacataactggtgcaagctgactccaagcacatccaggaatgcacttgctcataagatactgaggcaagctgtaccagcagcccctgggaacgcgctcggttgatggtacccaaagcccatgcatttatctctttgtgatagtttaagcccctgcatttggaactgttttttctgtaactgtttctgtaatcatttatctttaactttttgcctgttctgcttctgtaaaattgcttcagctagactccccctcccctttttagaccaaggtataaaaagaaatctagccccttcttcagggccgagagaatttttgagctctagccgtctctcattcgccggcaataaaggactctgaattagtctcagagtgtggcatttctctataactcgctcggttacaacaatataaacaatcataaaaatataccaatactccattgagggtggcaactggaagaagtccatctggacatgtgtaaatggttcattagggagtaggtatatacaatctgaagtgtagattttttttttaggattatgagtttagcaaatcaaatattggttataaactattttagaaatttggactattctattaatttttaatataattgaataattgtgtctgttttatgatgagttgtggaatgtagagtttttaatgatggaagctttaaagacagaaaggacaggtggctatcctggctttttgtgtctctacattgaacattgaatttatacttttatagatatcaattttctttttttaaataatgtgtattattctatttattaagtagatttttataaacaagttgaattgatgtaatcttatgaagttcatttagattgtatatcctaacagttttggtcctagctgatttagcagaaaaatttgttaaagcactttcttgatatttaggctgagttttataggtatgagctttaatctaaataatttgtgatggtaacagaagagtggaaaaaaattatctaacatggtgtctatttctgatggggtatgactagaagggagaagcccttgatgattttatattatgtcaaaatatgttattattctaaaagtatatctgttgtctgtataaatatttattgacttgttcttagttatataacaagctctggagatagcaaaaagcactgtggattgagctgatttaaagaagatttttgtttgcttcattttttcctattagctcattttaggtagtaacattatatcctgcctgatatttctcttttgagtttttggaatagaacctattaacaaaaagtattaactcagtggagtatttcataaaccaacatgagggcccactatttcagatactgtacttacacagctgtggcctttaccctcatcaggcagcggcaatagagtagtagaatcaagtagattgtggcattttagatggagattagaaggagactgagaattttataacatgttagactgcttactgaaaattgttggatatatttggaatttagcagacttttatagtatgtaagattgtaaattcagattatttcacaaaaccagctcagatgaagcttttatcaacttggtgactggtgattgttgttactgttttgaaacaattaggatgtgtcttagttcataggtcttactgcaggctataatatgtaatggacctaggttttcccccaagtttcttgggtaaaaactgttaatgtctgattgttatgtttataaataaacaaggtaaaaggtttagtgtaatttgcaagtgtgaaacccaaaggctgttataagaccaattttatttggctaaaagcctgtttatgattctgtttccaaggccaaagctctaatattctgaatttagtaggttcatataatgacaaacacattaagaaaagttt

SEQ ID NO: 474848 - DNA, 2117 bp, Homo sapiens
atgtggtgttgagtgtgacagcccgtatatggaacattttcatcatcacagaaattcccatgcgagagcatccaaagacttggtgaatgattttgaccaaaatgctgatagtgatatggaccatgaagttcaggctgaagtggtctcagatggaaataagaaacttcttgggaactggaacaaaggtcactggagctatgctttagcaaagagacttgcagcattttgcccctgccctaaagatctgtggaactttgaacttgagagagataatgtgaaattgcaacttatgtttaaaagggaagcagagtataaaagtttgggaaatttgaagtctgatgagaaaaacctattttctgggaagaaattcaagactgctgcagaaaattgcataacttgcaggtcacagaagtcaaaaattgaggtttgggagcctctgcctatgtttccgatgatgtatggaaacacctggatgtccaggatgaagtctgctgcaggggcgaagtcctcatggagaacttctgccatggcagtgcaaacaggaaatgcagagttggagcccacacacagactccccaatggggcactgcctagtggagctgtgagaagagggcctccatcctccagacgccagaattgtagatccaccaacagcttgcactatgcacctgaaaaacctgcagacaccgaacaccagccataagagctgtaccctgcaaagccaccaaggtggagctgtccaagattgtggaagcccaccctttgcatcagcatgacctgggtgagtggaactgctggtcaatagaatatggtcactatttttaacattttttagaactgacaaagtgttttacaaggtggtggcagaatgtaacatttccattaagaatggatgacttcagtttattcacatccttattaaaattagttattttctctcattctgatcataataattttagttggtatgaagtggtatcttgtagttataatttgcacttccatgatgactaacggtattgaacttcttcttgtgcgcttataggcctttggaataatttcttttaataaatttctattcagggtcttatctgtataaaaaattggattatttgactttatcctgttgcgttcaaagattttttaatatattttggatacaagtattttttatcaaatatatagtttgaaaatactttctctcattccatgaattgtcttttgaaactcatagtattgtttacagaatgaagggtataattttgacaaagtctattttgtcttttattgctgtgcttttggagacatagcaaagaaattgttgcctattccaaggttatgaatatttactctatattttcaggactttatttacaactcttacatttccagaaaaacaggactaaaggaatttatcattagtaggcttactcgacaaaatatattaaatggagcttttcaggttaaaatagaaggcacttaatagtaactcctatccttgaaaataaatagcactagcagaggtaactacctaagttggaaaattactttataatcatttatttagtaaagaaaattgagacactttaaaaagcaaaagtgtaggttaatttataaaggtatatttgcatcacaacctcaagaaagcagccacgttttgcaaaaaaaaaaaaaaaagaaataaagaattcctttaatttcacaaagcttatgaacataacactagaatgtaaaaagccaagtaatacatgagttgttttcatgagataattccttacatttcaaatacaaagcaaataaccggtcattgccatcatataaacaataacttaccaataattataattctaatttcgtcctaatttttcttatattatacatctagcaaaaatgtcaaatggctctggtgtcagattacaagttgtcaagtttacctagaagagtttcatctttaaaagttaaactatatcattaatactagtgattttccactaaaatatacatgtatgtgtgtattcatatacatatgtgtaaaatattacgtacattgaaaagataactgaaaggcaaaacaattctgaaataaatgtaacagataagtcttacacagtagcttc

SEQ ID NO: 474849 - DNA, 2570 bp, Homo sapiens
gtagttttctaagtacgtacctgtgtccctgaacaaatacttatctgtacagaataccgcaagatgtgcgtctgcaaatcaggaagaggaccctcaacaggaactgaatcagccagcaccttgatcctgaacttcctgcctttaggactgaaatttctcttgtgtttttgggacttgttacagcagactgcgctgactaaaacaccaccacttcctgtggaaggtggtccctggaaaaattccaactggcctactccctgggatgggaccttgggatattcgagctatttgctcaaacctgagattcatgcagctggtggagaatgtttcagagggaccctgagacatccagaaaagagaggaaaacaggattatttgacctgtttaggtacatgggattgccaaaatgatgtccaatcttctttaagttatatcttggtaaataatgctaatatatctttcaaaattgtatgggatttctatgattctaatgtctaagtatatgctatcaatcataattaaggttgttaagttaagctattgtaaaccacagagataaccaaacatctttgccaatcgtgtttctaactatttatttagtggaattctatgtgagaacatattttatattgcctccaataaaaggcacatatgagtctttatcatattttaatcttttaaaatattattcctttaacattatcacttatgtaccataagaaaacttggacttgctgcaatatagtgaaaatctttgtgggaatcacaaggcaggaggtctgaatcgatttctgatactacaaagcagtatagacaaggaaagttcactcaaacaccccaggtgtcttgcggagttgattggatgatgagtctagttttaatggattatgagctcataattttatattctcattcataattctgaaacagagcagtgaagattttgacttaccacatttttaattctcatttccactataggaaaaaataaaaacccgaaaaatcattgctaatgacactagttactgaaaacatgggagaaggagctgaggtgagaaaagattgacttctcttgggttttcaaaattatgtggtaattatatagatcctgaacctgcttagaggcttcctaatccaaatatattatctctgtcccaattcttgatttgtcatctattaagggaatataacagtattttccattttgttcacagaattaccaatgtaaaataagtcaaatttctgcaataaacatgctttttgaaattttaatatgcagtagaaatatcatattattttaattaatattactaccattattgaaagttaatttagactaatgatagagtagaagtctaacagtctctctgaaagtttctatgtattaccaggctatgtatagttacttcttttcttcagcatttattagttataatgattttgtagttaaaaaattaccaaactgaaaaaaccttttttttcataaacagccctaaactttagctttctttgcttgtaaatagagtaaaacacttcattctaaaactcagtaattttaaattattgatgatttacaaaaagatcttttgaactagacttcaacgtgtttgcttagcaaattttctttttagtggacaattttctataataatattaatgtaaacaagccagaagtgggaaagtgttaatttagtttaggtatttttggacagttaccaagtactgagccttaaaaatcatgcttaacgccaagccctgcttagagaaaagctaacgagtgttaaggaacacagacagaaaacctaaagggctatgggactactctaattttttaactacaaaatcattataactaacaaatgctgaagaaaagaagtaactatacatagcctggtaatacatagaaactttcagagagactgttagacttctactctaacattagtctaaattaaccttcaataaaggtagtaatattaattaaaataacatgatatttctactgcatattaaaatttcaaaaagcatgtttattgcagaaatttgacttctacattggtaattctgtaaaaaaatggaaaatactgttatattcccttaatagatgacagatcaagaattgggacagagataatatatttagattaggaagcctctaagcaggttcaggatctagtttttccatagctcaacttctctactgacaatcagatgctgagcactgaatggtggttgtgaataaaggaaacactaatatatcttaaggacttgtttcataaatgccttttgaaaattctattataaaacaacactgtacaccttcaaaaatcacataatagaataaaaactcaaacatttaaataatttgttaaagtaaatttcaaagatgatagttaacactttttttcactttttattccaaggccccagcattaatattccagaatgtgctagaatttaggtaattttaatagaataagaatgaatgaatgaatgaatgaatgaacaaatgaataaaatatttatgtagaaatgaaacttatatttggagaacacagattttatctatc

SEQ ID NO: 474850 - DNA, 3869 bp, Homo sapiens
gactgggtcagctgctttctctcccgaggaggaaaaaatgttcatacactttaataagatgtcggctttatgcagaatggagaggaaaaagtgtatcagacagaaggaaaagccagatcgaagtcgtaaattaggagaacgctcaacatgcataaagagcagaaaacaaacctttgaggaggagagtagtttaagaaatgaacaaaaagaacaaagctggagacatcatgctacccaacttcaaactatgctaaaaagctacagtaaccaaaacaacacagtactggtacaaaaactgacacatagaccaatggaaataaaagagaactcagaaatgagaccacacgtctacaaccatctgatcttcaacaaacctgacaaaaacaagcaatgggaaaaggattcctcatttaataaatggtgttgggaaaactggctagctatatgcagaaaactgaaagtagacccccttccttacaccttatacaaaaattaactcaagatggattaaagacttcaatgtaaaacccaaaactataaaaaccatatacaaaaattgaggcaataccattcaggacataagtacaggcaaagatttcatgaagaaaacaccaaaagcaattattaaatattatgtcccatcacaagagaaacaataattcattcaacctgtttttacgttttccattatattaagtatgtgcattttccattctcactgtccatttcatttttattccaatataatgatattgaataatcaatagtagtcaggatttaaatcaaaagctgtattttaataagtatataatacattgaccattttaattttgaatccagctccatctctaatcttttttacaaaatgaaaagagcaggaagaagtaaagaaaccagattatcatttaactgttaaaaacacaaataggtttaaaaagtacagaaacaccaaagttaaaaatatttaaatcagaatatacatttcttcttgcatataaatgttctactgcaatgaatttgctttggaaatttttcttcccttgcctcaatataacttacatgtagtcataaattattatcttccttttccaatcctttatggaagaaaatgttcgatgcctcttctctcagatcatataatttcattttgtcctcggttattcacaaaatctcaaaaattgaagtcaagtttatctcttttccttatggataaataaggccttactgatatcatatttggttttggattactgcaaagatggctacataggaatagtaaagaatacattaaactaaaaattataattggaacaattttgtagcaattatttcaacagttatctactcacatgtagatataatatgaatgttctatgtaaatctcaccatagccaacattagtttaataattccaagtcttatgatattgttaaataaaagtttttaaagactttacttgcatttactaacgttttaaattctttgtaacttactaatttatactttgatgttattagcagagtgtagtaaaaaggttttgcacttgagtttagaacttcaagagcctgatactatttcaagctcatgccctactaagaatttgatttgaggcaagtcacttaaattttaaaatcacaatttcttcagccataaaagaaagttgagatatggatttttttgttaattctctgaacaattttatgaactatagaatcctctggtatcagaggattgatgttgaatagtcctattaacactaataagacaattgggtatattacagttaaactcaattttgacactaactgtacagagctactgcagaccctaccaagttaagagtaaagttcttcataagactgccattacttcaaacaccagtcacaagtcttggagatcatctgtactactgactgaccaaccataaatttggagcttatcacaatctgcttaggtttggcaatttgatagaatgacttgtggaatctgacaaaagcacatacttataactgtagttttattataaaggatacatactaggaacaccacatgaagagacatatggggaaggctttcagaaggtggaagtggagcttctatgtcctagcctcataaaatccaggtaagtcatcacccagcacatcagtgtgtttgccaaccagaagggtctactgagcctcagtgttcagagtttttatgaaattttcactagataggtatgcttaacataattattgaccacatgattgaaccaaagcttcagccctgaaggttgggatggtccaaagttccaaccatgtaataacatgattggtctttcttgtgttcatccctgatgaggaaggtatcgaagagttcatcttaaggtacctaattaacataataaagacatttttatcacccaggtattacaagtattttgaaaacttaccaggaactaggaacaattgtaaggatatacatttttacaataggttcctataaaacttgatatccataaactttgtaaatatatttctaactatataactataggcctataaaaggctattcaaacttttttctctttgggttaatttaggtaataaatttgtttgagaacttgtgtttatttcatgtttgtttatattgttctcaaacagttgaaaatttaatcatcgaacttacttttaaaactgtactgactctatagctatgcccctgtttcaattctactattacttataggtcctcctctctttttaatgtactttgggtgaaaaatgtattatattatactttttagagaatgatgtttcacttcatttgatgctctctttattgtcaatttcataattttctggctcatttttacccacacttctaaaatacgttgaaatgatatttctttcttttctaacttcttatattaaacacaggtctttgatttctagcttttctctaatatctgtaaatgtgtttacattttcaataaacttttgcatttgaattattattgggttttgatatgtatcattttaaatagtggtcagttacaattctttaaaaatttccaaaacaatttcttatttgacaccctcattatttaaaaacatgactttaagcatctaaacagggaagctttttttttatttttgaatatacatatgtagacacaattgacaatgaaatttgtaacctctgtagcacacaataatttaatatagcaattataattattactgataacatatactaggttatatcagaattataggagttttacataattttgggacatataccagcacgtttacacaaatatagcccaaagaaagccaaacatcatttcatatttgataatgcttcttacataatttttacaccaaaaaaccaaacacatcatttttggacttcaagggacctaatgtctaaaggatcagttaggtcagaaaatgacatactttataatttgattttggaaagtttgtcaaatatcaaaggcttaaaacactggatatcaccaaatagaatcacaggttattcatttatccaaagtggtaactcaaaatttttaaaggtaaaaatatttactctgaagagaattagctttccaaataagactcaatgaggttagcatgaggccaactgaatacatctcttttctctcctcctttttttcccctgctgtttaccaaaagggcaaacaaaaccttttcattatcttttaatattacatacaaaccttttttaaaagagaaaaccaaatttcatgtttgcattgctgcatctttaatgcttaagctagttttcaaattatattttataaatctatccagttttagtcagtttgaccatgaggtaagattttcataaacttaaaacctttt

SEQ ID NO: 474851 - DNA, 503 bp, Homo sapiens
accaaacagcaggcaggcaccagtgtgcttgtgggggcccatctgctgaatctctacaatgcttaaacaaggtctaccagtgaagaagctcttgtggtggacactgggaagcaccccatttgagcatctgaggctgttctccaaggagccacagaccgaaggctgcactgtcggctttcttacttttgaagatttgggactcagactgacttccctacacctcagctcgcagactgccgattgcgggatttcactttgtgatcgtgtggtttactctacctctattactcacatcacctacatcactccagctacccagaggcctgataatcaacccctatgcctagcccactgctgccacaaccggaatctgagcaagacacaaggagggccaattattcagcccaccactaccactactggggtccaaggaccgacccacctgatgttccggttcccagaaaaatttcaccatagcctcaactaataaccataccttaaac

SEQ ID NO: 474852 - DNA, 1592 bp, Homo sapiens
tcctcactgtaaacaagctccagtctcactcttacccctccaacggatgcccagtgaatttgggcccagtaagatgagaccctgatggacactgagaaacaggccattctgcaagcagcagagacatttggggatgagctttgcatcacaggtagcatcagggaagggggcgaatattttccaactggaagagaagcaataccggtgaatgaccctaaatgggatcccagtgatgagatggaagattggaaaaagagacattttggggtgtgcataatggaaggcttatgtagaactaagaccaagcctctgaattatattaagttgttcatgctcaaccagggatttggtgaaaatcccactgccttcctcgaaaggctaagagagaccttggccacaccccaatcctgtgcctataaaatacctcaagaccatagcaggcagacacaggcggctgaacttccagagctcgtcagcggaggaacacacagacggctggatgttgagagcagcacacctacaggcaccagcacagggcaggccaccgaccagcaaaacactgtggagtctggctggggcagtcggaggaaagcctgggccactaagcagcctgactcctggggaaaaccttcccactccatcccccttttggtttcccccaatctgctgagcgctacctccactcaataaaaccttgcactcattctccaagcccaggtgttatcccattcttccaggacaccaaggcaagaccctgggatacagaaagccccctgtccttgttacaagctcatttcactgtccttctaaaatctgacaacattttcatatagtataacacttgatattcatgtttcaaattgttattctgttgtcttccagaacctgtactcctttacaatgatgttgaaagactcatgccattggtgacaagtggtgaaattaaacacaaaaatagttatctacataattatactctataatactttataaaatgactgttttaatagaaattttactgttgctttgttatgtgaaacatttttctgactttaaggcagttgttatttgacatctgaatattctgttatgccatacatttttaaaagtcaaatttataccactcaagtttatagtgaatagactttaatttagataactataattaaatagtatactaggtggatgtttgctttttcagcgttcattcaattaggaaagatccttatttgctttgtctgcaaaggacaaaaaagactattacttcaagaagtgcactgaaatattttggtgcaaatactgatgcagataacttttaagaaaaagagagaggaaattggtcactggagggtttgctgtgggaaaaaaaatcattctaatgctttctaccaaatggtaatgttttgtttgtctttgcctaagtgaaacatctatgtgatttgaatcagtgttcttaccactttaagcaaaattgaattaaatttgagtcccttagccttaaacacaattccactcttcagtttattaagggtcagaatttgcaccattaggtggtgctatggtttgaatgcattcctgaaagttaatgtgtt

SEQ ID NO: 474853 - DNA, 1333 bp, Homo sapiens
ccgttcagatggtcggtagactaaaatcccagatgttaccactatgcaatatatcaagaagatgtcagtgccttgctccaaaatcctagaggcctccactgtgattcacctatggggctctgccaaagacctcaaccagcatctttatctgccactgacacctcaagcaccagtggatttgctgggtcatatggcccaagtggcagagcagcttgcacagcagcctggacctgttgcagagccttctcttgttctggaccccactcaaaattggcagccttttgagtcactcgataaatgggccagagacagtgaagggatattgctggccttgccaggtgaaggaaaattgcttctggtgggccttatggacatgaatggagaaaaaggcacttgccaaatcaatggctgcataccagctgctaagtatgtctatgccaattattcattctggtactggggaaattactacaggatgagtctggagacccagcggacccactgcagcgggaaaggtgaacccattgggcggttacaactttatccagcaaacttaggagcaaccaaccaacttcattacattccttggttctccacatatggtcaaaggtgcagctggtcctcccacactgggccagataaaacaggaagcatattgccatctgctcttgaaccatcagcaaaagaccttggtgccaggacagctaagacaacttttggtgagaatatttatggtgaactggtcatgcagacacattgtatctatgttcccagtcctaactgttgaacttctccaactccaagtctccatgaaaaccaagtggtaatcataattattattattactaaacaatactgacaaactagaaatcattagtttcatggcttcaaggtttggacaaaatcagtaactctggagaaaagcatgaaatcaatacagggtacccaaaacccatactgtgcaaatgcaaatagaacatagagcatgcataatattttacagttcttccatgcaataccacatttaagcattacacaaataagaggaaggttgttaaatctcctactgggaaaacacaagaaatattaataatttgacaggaactgtcagggttctatggtggtcttatgccaagcaggcttagtgatatttgaaggaaagtaatcataaatacactagagaaaggcctaactagaaaactgttttcattttatagtagctcttttaacaattaaaaacaatatacttgctatcagctaagataataatttttaatacaaaaatactgatgattacgtttcattcaaatggtaatatattaaaattatatac

SEQ ID NO: 474854 - DNA, 701 bp, Homo sapiens
tagcattgggagatatacctaatgctagatgacgagttagtgggtgcagcacaccagcatggcgcatgtatgcgtatgtgtcatttgcaaataccactgcactgcattgaagataggcccagtgaatttgcaggaagtattatatttgacttacaaaatgctgtgacaggaaatggaggccttcactcatgtctgctaagtattggaaactgtcacagagccagctggggcagaacagtgaaagccaagatcaggagtccaactggaagggccttgaagacagtgaatgtctggcaggcacagacccaagcacaggaggagaggtctctgttctttgaattccaggtcaatgagaatgtctggaaaatggattccatctgttcacaagagtacatgaagaggggaaggttgtcattgtgtacagactggagaatcagacctaaacaaaacccagagttaaggaagttcagtgaaggacccggacaagcctaggtaattcattcatttccagacacagtctcctctaatattttcaaataagtgaacgttatgttttttggaacaattactaaattacagtttcatagtgtttctatttgatgagcatttttttcccatggacccaaaaatagttttattgtagaaaataatggagttatgctgcggtctgaaagtctgtgtcctcctaaaattcatatgtc

SEQ ID NO: 474855 - DNA, 1885 bp, Homo sapiens
cgtcttccatcacccccagataggaccatctagttgagggaaaataagctcagggatcccactgattctacgttatggtgagttcatcattgtcagacataaacatcaaggtgatgctggccttggggatgggacaccagttagctcaagcttcaggggctatggctgctattgtgtttcaggactcttggaccctgaatgatggtgaacatgatccaaagggtacagctacacttctgggctgctatgccctggtctacaggggtcagggcactacatgggcttgggtcccaaataggcagttgctctgctggactggggctctgatttcgagggggctaggcactgagctggttcaggcaggaatggggaagcagaagtttgttccttctgatgttcgggtgtgttcagagtttcttccttctggtggttttgtggtcttgctggcttcaggagtgaagctgcagaccttcacgtccccactagactcaggagcccagcaggcttcacctaatggatcccgcacctgggctgcaggcagagctgcccgccagtcccacgccctacgcctgcactcctcagcccttgggcggtcaatgggacagggcaccgcggagcagggggcagcactcactggggaggctctggccatgaaggagcccacagtggtggagggggaggctgaggcatggcaggctgcaggtcctgagccctgcaccatggggaggcagctgacgcctggtgagaattccagtgcagtgccagcgggccggcactgccggaggacccggtgcaccctccgcagctgctgaccctggtgctaagcccctcactgcctgggaccactggcgccagccggctgctccaggtcatttctttactgtgtagtcttagtccccctgatccaggatggctccttgagtttcagatacattgtttgcatttcaggctgcatgagggacaaaatttcaaagaaagccaagcctcttctttataaatgatgtgataaaattgtcatattacattttaaatctcatcagttcctgttacatcctaattgtcagaatttatttttatggctacaataggatgcatgggaatctggaaaaaaggaatttttagtcatgtagctatattcattgtaaagatatgagtgttaataataagagatatagcagcctttttgccaagacccaattggcctactgtacagaaactgtttattaactatggtaattagtatgctatgggatagccttaccttttgtgcttattatttctaatcttaaagcttcagtggagtaggattagtttctaatgttctatgattctttttgcattttagcatatcaactaagagaatgacaacatagaggatttgcttttgtatgctcttatagtattaaaactaaaatatgaataatgtgactagcaaatgaacattcaaagacaaatttatatatcattatgcaaatgtatttacttatcctttttcaaccaaagacatattacaagtagtagagaaaagcaataggataaaattgtttagatataaaggcacgcctctcactgttatccaaaatggaaaatcagtacacttgtaaattctacatgtgcattagactgtctcctttgtttatactttttggaatatcttaatttttctatctcatcccttctctctttctcttttacaatttatttgccaaattaaaataattaataatgaaaatacttcatgcatttatcactaatataatgagaatacaagttatatactaataatcacattaataaatacctagattttagccaggctccttggaaactttttaaaaagtaataatgttaaaaacctatattttccagtttctccatgaaccct

SEQ ID NO: 474856 - DNA, 1604 bp, Homo sapiens
aggccatctgcaagcggaggagccaggaacccagtctgagtctcaaagcctcaaaagtagggaagcccacagtgcagtcttcagtctgtggttgaagatccaggagtcacaaagctgaagaaactggagtccaatgttcaaggacaggaaatatccagcacaggagaaagatggaaaccagaagactcagccgcaaagagactggaagcattctgcgcctgcattagagatctgtgaaactgaacttaagagagatgatttagggtatctggcagaagaaatttccaagcagcaaagcattcaagatgtgacttgggcgctgttaaaagtagaaaaggaaaacctattttctgaggagaaattcaaacaggctgccaaaatttgcataagtaatgaggagccaaatgttaatagccaagacaatggggaaaatgtctccagggcatatcagaggtcttcgtggcagcccctccaatcacaggcctggagacctaaaaggaaaaaatggttgtatgggccaggcccagggccttgcagctttgtgcagtctcaggactcagtgccctgcatcccagctgtggcaaaaatgggccaatgtacagcctgggctgtagcgtcagagggcacaagccccaagccttggcagcttccttgtggtgttcagcctccagccctggtgctacaagaggattgacacaacccctttcttcacaattatatgaatgttattacaacatcagcaaagcagctttggtcacgtgtcaatcaacagaattgcttgcacatatttgaaaattaaacacataaatgtaaaattaagcacattctctgcctagagaaaggtgttgccaactatttattttaattttcaaagaacatatattttctttccctctttgatgatacaccttttgaaaccaatgatcatgtcttaaaaactgtataccttacatttgaaataacattttactatgttatgtcttttacatatatattttaaatattttctctatttgccatttgttttactttacttcatggtgttctctttcagtataattgtagtattctcaatgacttcattttaaatttcaacctttggtaatattacattatttctaaaacagtcaactataatttattgtatattaataatatttatttttatgttacaataagatattgaatctccttaatatatattttactctatgatacaacattaacttaaaacattgctacatgatttttacaaaataatttttctaagatgatatgcatatgtttatatatgtgtgtgtatatatgaatagatatatattcctatacatataaataccttttgtctacttcttgagtcttcaaacagttctgttgatctgtctgtcaattatctcgtctccttgcttactaattttaataatcttaattttataatgccttttaataatgactgaaaattgcttaattgtactttattttcaaaattgttctggatattctagattatgtactctattagacatactttagaacatcattttggacaattatttcaggaccattatttaaaaataacatttttaggaaaaaaattacagaaa

SEQ ID NO: 474857 - DNA, 443 bp, Homo sapiens
gcgatagataatggtccccttgtggtcgccaaaatgtgtccagaattggtttctttcagtgggatcttggtctcgctgacttcaagaatgaagctgtggaccctcgcgatgagtgtaacagctcaaaaaggtggtgcatccagagttgttcattcctcctggtggactgtggtcttgctggcttcaggagtgaagctgcagaccttcatggtgggttttacagctcttaaaggtggcgtggagccaaagattgtcctcctaacagtcaggaccctcagcttcaggtctgttggagtttgccacaggtccgctccataccccgtttgcctgggtatcagcagtggaggctacagaacagtgaatattggtgaacagcaaatgttgctgcctgatcgttcctctggaggttttgtctcagaggagtacccagccgtgtgaggtat

SEQ ID NO: 474858 - DNA, 825 bp, Homo sapiens
ctgagggctttacatgcaccaggtgctgcacaaaataattgaatttaatcctcactccggctctgacaggttcccctacctttatccgggcacttttctcttcagcgtcttcttcaaggtatttccagttgcccaccctggactgtttcagaatgaggaggacacctggaggaatctacaggtgcatagaccaatttgcaaaagaacctgtgagccaacactggctaagttttctggcctccatctttctcccatactggatgctccctgccctcgaacatcagaatccaagttcttcagctttggactcagacttacatcagtgatttgccagcggctcttgggcctttggccacagactgaaggctgtactactggcttccctacttttgaggtctggggactttgggactggcttcctgtctcctcaccttgcagatggcctattgtgggacttcaccttgtggtcctgtgagtcaattcttctaataaactttcctttgtatatgcatctatcccattagttctgtccctccagagaaccctgactaatacagtatggaaatttacatttttggttattattgctaaatgaccataaaaaggtaatatatatttatactcctaccaacaatgtatgagagtttgttatttcacccacatcctctagcctttagcattgtcagactttgaaattgttggcattgctatttcatgtttttaatgaacgtttaaaaaaattatgaatattggtgacaactttagcacatttaaatttaaattatgctgtgtaaaaatttcagaataaagacagagaaattcact

SEQ ID NO: 474859 - DNA, 1214 bp, Homo sapiens
catcaaggaggcgaagaggcgacagcgtgctggcaagccctcacttgctctgcgcgcctcctcggtcttggcgcccatgcttgagaagaatcccttcagcccgccgctgcactgtgggagcccctccctgggccggccgaggccggatcccgccccttccgcttgcgggtaggcgtggagcgaaacgcgccggctgaggccgggatcgggccccttccgcttgagggcaggtgtggagcgaaaggcgagggcgggaaccggggctgcgcgcggcgctcggaggccagcgcaaattccgggtgggcgcgggctcggcgggccccgcgggcccgcactcggagcgcctggccggccggcactgccgaccccgggcagtgaagggctcagcacccgggccaacagctgcggaggatgcaccgggtgccccgcgccgcgcgagaatttgccgggcctcaatcacctccacacggggcagggctcgggacctgcagcctgccatgccctcgctctctcacccgcggtgggctcccgcgcggaccgcgcctcaccgatgagcgcagccccctgctccaaagtgcctggtcccatggaccgcccaatggctgaggactggaggattgtaaatgcaccagtcagcactgtgtctagctcaaagtttgtaaacttaccaatcagcaccctgtcaaaacggaccaatcagctctctgtaaaatggaccaatcagctctctgtaaaatggaccaatcagcagaatgtgggtggggccagacaagggaataaaagcaggctgcccgggttggaagagaaagaagaaactcggagcacgtgtgaacgtcagaaggaacaaactgtggacagggcatctttaagaactgtaacattcactgtgaggacctgcggcttcatttttgaagtcaatgaaaccaagaacccaccaattctggacacaccaggacattctctatttttatttgctgaaactggcaacactaacctggggaagcagccagatctggaacacctccagcaattgccatatccttcagcttcagaaggccgccagcaggggtcagtcaacgtggttgctaccaattatttttgagtgaaccaaaatatcacgggttttcttcactgtggttattaaatccagtgccaagcatatatcaaaacatatttccagagttatttatctctttgctacttttacttttata

SEQ ID NO: 474860 - DNA, 619 bp, Homo sapiens
ctaaacaagaagtgtttatttaattaattaatcaagtatataaatgctattgaacaacaattcagactcctatgggaaatcttccagctataattatgaaaacacaagaaagcatgtacccccaaagcttaagggaaaaccatatttcaagtcaaaccttgagggctacctggccagatacctcacggaaaggattctcaattttgcagttctcccaggacacttcacagatttgcttcgaggacacattgatgttccaattttcaccagcgttcagagttgcccatttctcctggaacagctcagaaatagttccgataatcaaggctccaaaaacctgaaagtcgcgagatgtaaaatgtttcaagcttatccatacaatgtgaagtggccattgctggcagcttctcttccctatattcctaccaatggaagcatttcgaatatattatcacattctctagtggcttgcaaggtttctactgaaaaatctgctgacagtggaattcataaagttccattttttgaggtcagttactagagaattattttattcttttggtggtgttatgtttccttacatttttatttttcttgtgtcctcgtattaatgtctgta

SEQ ID NO: 474861 - DNA, 643 bp, Homo sapiens
tgctcaaggggagtggattatacaaggctccttcaggatttagcttgggcattacctcttttgggatatattccctgatcgacccctattcgtgtctccagaaggatgagattccatggtgcaagtatgcagaacacaagagagtggcatagaaagagccaaaataaggatgtgtttttgtgttgttcatggctgactggagttcaaacctgccaggaccttcagaggtgtcttatcaaacagaggtcagaactatcttccttaaatcagagaaaccttcatgctggaagcaaaagtctgcatgagaccctctccaactgtgcctgcctgaagcccttcaaagcctgcatggaacttgccactcttgcagtgcttggagttagtggtgagattgagggaatgctttctaggaagtattggccactcaacattcctttcctgttccttattacaaagtgttgccagaagcacaaatctgttagggactctgccgcttaccgtctgcttgatactaagggtctccaaatggccccaaaaggtggtggctgtttgcagcactcggacttttgaattgcattaagtaccaatctgaattttctggtctattaaaatgcattaagtaccaatccgaatgtcttcattc

SEQ ID NO: 474862 - DNA, 554 bp, Homo sapiens
caggtcccttgtttcaaagtcacacccggaagctgactgctccacacacggccgaaacatgaggaaactcatcgcgggactcattttccttaaaatttggacttgtacaataaggacttcaactgaccttcctcagactgagaactgtttccagtatatacatgaagtcactgaggtaggacaaaagattgctacggtcctattattttatggttattgtgacacaagtaaggtaatggctaaaacagaagaaagaggggtccccaaaaatgtaaccttaaaatttgatggttgtgctgctattgatagcattgatggaaaaggactagatcctagtgtaagcatcctaatagaaggagaggttcaaaaacgctctccagaaccagtatatcagactttctatgataaactaaatgtgccagtacctgagattccaagaaaaactaaaaatttgtttttgcaattagccgaacacgtagcccagtctctacaagtcacctcatgttatgtttgtagagggaccgtaacaggagatcaatggccataggaagccc

SEQ ID NO: 474863 - DNA, 563 bp, Homo sapiens
gaaacggaccaatcagctctctgtaaaacagatcaatcggctctctgtaaaatggaccaatcagcaggatgtgggtggggccagataaagcaataaaagcaggctgccctgtaacactcaccgcgaaggtctgcagcttcactcttgagccagcaagaccacgaacccaccagaaggaaggaactccaaacacatccgaacatcagaaggaacaaactccagacacgcagcctttaagaactgtaacactcaccacgagggtccacggcttcattcttgaagtcaaacaaaataggcatgtagtcaacaacagtctaccaaagacatacaaccagaaagaggacaacattcatattgtattaggacctactgtagaatcttattttacttcacatacctctttgaaggcattttatccaaatgaaatcacattctgggctactaaaaggacttcaacatacaaatttgaggggacacagttcagcccataccacaactaaagtgtaaaaagctgcaggggtggcatgtggtctccattaatgatctctatttaattcttttgt

SEQ ID NO: 474864 - DNA, 1528 bp, Homo sapiens
cacctcgttgctttcggtctatatgtgtctttactgctaaagtttactttcgagaggtcttcttaccttctgcactctcatcaagctgcatgatatcaacatttctagtgtacttgggctgaagttgtttctctctctctctctctctctctctctctctctctctctctccgtcttgtgctgctcccccttctacccaatatgtggagaagaagaagaggaagaaaaggaagaagaaggatgaagaagaaggaggaagaagaaggaggaagaacaagaaaagaagaagaggaagaggaagagaaagaagaagaagaagaagaagaagaagaagaagaagaagaagaagaagaagaagaagaagaagagccaaatagcttcatcccatactgctcaccttttctagatttttgggcacagtgcaagctgccagtggatctaccattctggggtctggaggatggtggccctcttcttacagttccactaggaagtgctccagtggggactctgtgtgggggctccaaacccagatttctcttctttactgccatagcagaggttcttcatgaaggctctgcccctgcagcaaatttctgcctggacatccaggcatttctacacatcctctgaaatcaagttggaggttcccaaacctcaattcttgacttctgttcactcacaggacaaataccatgtctctaagctcagatatttaaagtgtgcttcctgtagctaacatataattggttctttctttcctcattcaatctaccaatgtttttattaactgctatcttctaaccttttatatttaatattcccctcaacttcaactataacttcccctagtcaagagagacaacttttcttctgaaaagctgattctctagggcatgattcccctctccagttaaggctgctatggtcatgtatttattgtcaaaattgggcagatattttgtggttcctcaaaaagctaaacagaattaccatgtgacccactcctgagtatatacctaaaagatttgaaaatagagactcaaatggatatgcttatgccaatatttatttcagcattattcataatagccaaagggtaaacacaatctgagtgtatgtaaactgattattggagaaataaaatgtactccaaatatacaataaaatattactaaccaataaaaaggatgaagttctgatacatgctacaacatgaatgaatcttaaaaacattatgctaaatgaaataagccaaatacacgaggacaaccattatataatcccaattatataaaatatttagcaaggtggtcttcaaactctgatatcctttcttctgcttggttgatttggctgttgatacttgtgcatgcttcctgaaattcttgtgttgtgtttttcagctccattgggtcctttatgttcctctctaaactggttattctagttagcaattcctctacccttttatcaagattgttagcttttttttgcattagtttagaacatgctcctttagctcagc

SEQ ID NO: 474865 - DNA, 868 bp, Homo sapiens
ttatagctttaagtgttcaggccaggcctagctatgggcacactgcacaagatggctttgcggtgtctcccttctttggacccagtgaaagcatttaacttacttctgagtgacaagaaagaaaagaagcaccacttaaagctgggagtggagcaacacaagcacccctatggtcaccaccactatgagtgtgtgggatcagatctgaagccagcaaaacactgggtctcacccaaggcctgctgttaccattccctggctattgcctatgttttctcaaggccttggggctctacaaccagcaggtggcaaagccacccagatccgaatccttcccttaagaatggtaaaatcctccaggctctcgttgggtccaggagtgccatccaggaatcagagactaaagtcaaaaacttagaaatctacctggtgttctattgtactgaggctgagctgccactccttcccacccttccctcccctttccaaaggcagaggagcttcgccctgtagccaccatcacatcaggccatgaggagtactgccaactgctgccaatgttcccttaaggcccaaagcctcttaggtcagattgtggtgaatgctgcctggcctaagactcaccatttatggcactgggctcccctctggcccttggcaggtccagaaatgccatccaagtgtaaagtcttagaattgggactttacttggtgctctactgcttggtgctctaccctcctgtggctcttctgtcctctgaagccagaaaatctcagaggctcacccaaggccctcgacatagtacatgggtatccctgatggttatttagtgcccaagggctctttaattaccaagtgatgaattcc

SEQ ID NO: 474866 - DNA, 947 bp, Homo sapiens
ctgatgtggccctatatccactaggaagaaggggcacattttcttaatactcaccatgactttgactgcctgcccagccttccaaccatatgcctggctctctccagagaggaagaattttcctgttcagtattcctacggcattattgatgaggatttagtgagagaaatggaattgggtatactttaccctggattctcagtcattctgagcaaacttgtatgggtttcaatgtcctcattttttaaaatgaggagaataatgaaagtctgccatgagacttcaaggaaccaggctgcacagcaggaagtgagtggcgggaaagcaagcaaagcttcacctgtatttacagccgctccccatcactcacattactgtccgatgccgcctcctgtcagatcagcagcagcattagattctcatagtgggggaaaccctgctgtgaactgcacatgcgagggaactaggttgcatgctccttaagagaatctaatgcctgatcatcggtcactatccgccattaactccagatgggaccgtctagttgcaggaaacaaactcaggactcccactgattctatattatgcctattgaaatcagtatcaagttgctatccaagaatgtaataaagaatgtacctcagataaacaaaagcctctccaggttgaatactcgtgtgcagactgagagaaagggctttattaagtgaatgtaggcttttgtacaaatgagtttaaatactgagtcacttgacacaattacatagtcattctggaaatggatatttaagccatgcatatttgggtgtgtttttattaaagcagattcttctttatgaacagtaagttgatgtttgtgcatttttcatacattcttaagttataatagcagcattaaatagtacaatagaaaagattgtccttgatcgcagctctttgaagatat

SEQ ID NO: 474867 - DNA, 1070 bp, Homo sapiens
ctcactgtgagggtccgcagcttcattgttgaagtcagcgagaccaagaacccattggaaggaaccaattctggacagaatgagtcctgtgccttcctactccctgagacacagcaatactgaaattaggagagttgataacctcacaatggcctctaagtgttcaagtgaaaagaagagtcacagctgcccccctccctgcccacctgctacattacagacccagaggcctaggaggaaaaaatggtttcttgagcctgatctagggctcccctgcagcataagcctagggacttggtgctctgtgtcccagatgctccagccatggctaaaaggggccaaagtacagctcaggccatggcttcagagggtgcaagccccaagctctgacaacatccacgtggtgtgtgcttcaggggtgaagccctcatggagagcctctgataaggcagtgcagaaggaaaatgaggggttggagcccccacgcagagtcaccactggggctttgcctagtagagctgtgagaagagggccatcatcctccagaccccagaatggtagatccgctgacagcttgcactgtgcacctgaaaaagcttcagacaatcaacaccaacagtgaaagtagcagtaaggcctcagtgtctattatccccttccttgtgttcatgtatactcaatgtttagcttccacttataaatgagaacatgtggtattcgattttatgttcctgcattagtttatttaggataataacctccagctccattcatgttgctgcaaagaacatgatctccttccagtgttattatgttttaaacacattattttttatattgctgtatttccccagagatttgtaccaagcagtagaattactattataaagtgtttataagttataagacttttagtttatattccttaattacccaacagaaaatataaatttaatttgtaacaaaagaatttttatatatgatcttgggtctttaccaaaataagtatttttcaccaaatctcaaattttttgaaaaaacaagctgatgtctgtttcagtgtaaaatgt

SEQ ID NO: 474868 - DNA, 676 bp, Homo sapiens
tccttgggaacatgacccaatacttcgttttagtctttgccattttacagtgctggctgttttcttgttctgagtcagttcctgggaaacgcatgtttccagtgccaaagaacactctcgccaaaggtgagtttcacaccctcaggcttggaaaagttgaccaggactttgaccaaaatgctgatagtgatatggacaatgaaatcccggttgaggtggtctcagatggagatgggaaatttgttgggaactggaacaaaggtgactcttttcatgttttagcaaagagactggcagcattttgttcctgccctggagatctgtggaactttgaatttgatagagataatttagagcatctggcagaagcaatttctaagcaacaaggcattcaagaagtgatttgggtgctgttaaaagcattcagttttatgtatccacagatatatggatacataaaatttgtatttggaattggaacttatgtttaaaagggtagcagagcataaatgtttgaaaaatttgcagcctgatgaggatgcgatagaaaagaaaatctcattttcagagaagaaactcaaacctgctgcagaaatttgcttaagtaatgaggagccaaatcttaattgccaagacaatgagaaaaatgtctccagggcatgttggagacctaccc

SEQ ID NO: 474869 - DNA, 756 bp, Homo sapiens
aggcctctgggcctgtgatgggaggagctgctgtgaagactttcgacagtccctggagacatttttcacattgtcttgataattaacatttggctccttgttacgtctgcaaatttctgcagcaggcttgaatttctcctcaggaaatgggtttttctttgctgtcacattacctgaactttggagttggtgctttctatggtccccagattgacatgaaccttcacagtgtcccacagtgtgggataatcaagcttgacttacaactgtccctgagatttgactttcagtacaagtggccgacaggagtcctagagtgtccagttattcatcaagcagcgttcaaggcctctcttttcaagatcattaccaaatactgggattttgatgaccaacttcaattaaaactaaatagtattttgaattataagtttttttttttcaaaactgagtctattaaaacatttaagtttttattttattttgttaaaatgacacattacattgcttctattatatgtttctttaagaaagttaatctattcgatttctaatctttttgtgcctgcttatgacacataaagcaaaataatgataacgtcgcatatttctaatgaactaacttacggaaacaattaattttaacaagactttgtttcgttcatttgtgatttcttctctttttcaaatatgtacggaactgcactatattgttctaggcactaggaatttagcaagtggaatttataatctcat

SEQ ID NO: 474870 - DNA, 718 bp, Homo sapiens
ctagcagcctggatttcaggcttcaggctgtcttttggcttgaaggagggggagcgtgcagactggcaggtacatgagctgagacaagtgctctggggctccagccccatggtagcatctagaggtgagtgcctgcgactcccaaagcccacgtggatgtggcctgtcttaaccgtgtgctcttttagctttgccttccacagacggcttaagtgttcaccagctcagtgccctcttggtacccaggtctttgtccgatatccaggaagaatcaggtcacacatgaatgtggagatggaatttggctgtccggtggccgatctcctctctgaccgccaacagccaaactcctctcagcattcagatgctctttctcttctttctgctgagccgctctgctgttctccggctcttctgtttgtctccttctcatctgcttctagagcttggggtctggggtttatgagtttgatttcaattaatgcaagtatcagatgtaaagaagggcaatagcaagtgataaagacttacactcaagtgctactctattatacttggggatgaatatttcatggtcaattctggaaggggttaagtatagaaattgaacagtggtaagtggctgcctcaggagaaaaggtagcagtaattacctctgaagggaagaagattcaataaacaaggatgttggagagctttggaaataagctttacatat

SEQ ID NO: 474871 - DNA, 882 bp, Homo sapiens
ccggtaccaaaatgtcgtgagcaccacagcactgtacaggctatgctcggcttgtgctaccagccagaatcacacacctgccaagggtgcaccaggcacgtagtggagaggagtgtgtgggcaagcaagcgcatggtctggctactgtgcacagcggggtgggaagctacaggtgctggcacaggtaccagttctgtgccaagctgtgccaggaccagatgtattgcacgtggcttccactgtgggcacccatgtctggatgaggagaatgcagtggcacctggaagtttggagatgccaggaactgcagagcccaaagagagtgtcacaggtctagcttggggagctcctaggtataggcaccctgaagggctaaagctcttctctccttctcctcatctacaatgtggcaagcagggggcatgtttcaggcctgtttgtgttacagctcttttagtcctgccatttaggagttcccaagttcttgtcccacatccaggaagaatgagagccatcctcagcacccccttgaccgccctcttgtgcttgtcagtgcccaaattccagagaaagccaaggcagcagggggctggcatgtcagtgcctcctcaagcacacacctggccagatgcacgcactcacaccccacaccaccaccagcaaagcccactctacagccatgggaaggtgagacacaagagctcactttataattttgtgtctgagcgtgggcaaaaccaaagtcactgtgcaacccacaaaataccaaacacaatcctctactggctaatatgactgctctgctttgcaaattgaagctctattttcattctaggcgttcctcttcctagcttatgtcactgtttcttttttgagtgttta

SEQ ID NO: 474872 - DNA, 1176 bp, Homo sapiens
aaacagaaaccattcaaaaacactgtcaccaccagagccaccaccaccatcactgcaacaaccaccaccacgccaccacccccatcaccaccaccaccattaccatgaccaccattaccaccaccaccaacagcaccactgccaccaccactgccaccaccaccacccccatcaccaccaacaccaccaccgtcaccaccactgccaccaccaccaccaccatcaccaccaccgccatcaccaccatcactaccactaccaccaccatcaccatcaccaccatcaccaccaccaccactaccaccaccaccatcaccatcaccaccatcaccactaccaccaccaccatcaccaccatcactaccaccaccaccatcaccgtcaccaccgccaccaccaccccatcaccgccaccgccaccaccactgccaccaccaccatcaccatcaccaccatcaccaccaccaccatcactgccaccgccaccaccgccaacaccatcaccatcaccaccaccaccgccaccatcaccactgccacaaccatcaccaccaccaccgtgccgccaccacaccaccaccatcaccaccaccacaaccaccattgccactatcaccgccactgccaccaccactaccgctgccaccaccttcaccgtgccgccaccgccaccaccaccatcgccaccatcaccaccaccactacaaccatcaccaccaccaccatcaccgccgctgccaccgccaccaccaccaccaccatcgccaccatcctcaccaccgctaccaccactgccattgccaccaacacaatcactgccaccaccaccaccattgccaccatcgccaccatcaccaccactgctgccaccattgctaccaccaccaccattgccaccatcaccaccatcacccacaccaccatcaccaccaccaccgtcaccaccaccaccgccgtcgccaccaccaccaccacaagcaccactacaattgtctccacgcataaatatatatgaagtcacattggagtacggtgtaccctcaatccaatgtgactggtacccttataagaagaggagaggagatacagaggtgagaatgccatgtgaagacaaagagacacataaagggaagaaagccatgtgaatataggagcacagattaaagttaagctgtt

SEQ ID NO: 474873 - DNA, 699 bp, Homo sapiens
tcacttcttttctgattcttcgcttgcttcaggccatctgcatgtatatgtgcaggctagggctcagaggcctcacactcagcaagtacagtggaagctgggattggatagggagatttgtcccattagtatcaactgtgtcctacaggactctattgtttcaagagtcaatcaacacagttcaagttggcattgttcaagggtcaactgtatactgttttaagctgttgaatttatggcattatgttaatcaggttttggtactggaaagtgggctgcaggataatgttagtgactttaatgtaattaatatggtggggttgacaaccaggttaccctgggttgagaaaataggaaatgtgaaaatgggaagtggagatactgaacataacatgatcctttcaagaatcttaaatagaaagagaagtcattaccatcagccagaatgcacaactacccttgcctgttaccacaagcagaaccttgggcccacgggctctctcaaccacagtaagccaaatttcctggaaagggaggagacccctctagaaatctgctttggcttaagcaatagtaaaaaggctgctgtgtacgagactgtgctaagtgtctgactaaacctttgttatttaatttgggcttaatgatcacctttaaaagcagacaagtgtgattgttaattttatgtgttgcttggct

SEQ ID NO: 474874 - DNA, 606 bp, Homo sapiens
tgaaggcttaagctcagaagtgatatgtttactcttccactgcattccaccagccaaagcaattcacaagaccacctcagcctggactttattgtacgtatcactatcagcattttgggcaaagcaattcaacaagtctctgggggagttccagattttactacattttcctgtcttcttctgagccctccaaactgttccaacctctgcctgttacccagttccaaagctggttccacattttcagacaagaacccagacctcgctgagctaaggagcaaaaaatcctgcatcatcgtgacgtggaagggaaagtttttggagatgaagtgcccattgtacctgatggcagctgagataataaatgctgccatctggatgtacatgtgcaagcttgggctcagaggcctgacattcctgtcttcttatattaataagaaaaataaaacaaaatagtggtgaagtgttggggtggtgaaaattttgggggttgtatggagagataatgggcaatgtttctcagggctgcttcgagtgggattaggggtggcgtgggaacttagagtgggagcgattaagcagaaggaagattttgtggtaagaggc

SEQ ID NO: 474875 - DNA, 527 bp, Homo sapiens
tctgtcaccatgagatctgcacacgccaccgcgctccctttcgccttccgcagcctcgagtggaagcagcctgaggccctcaccagatgcagaagtccaatcttgaactttttagccaaaccaccagagtggagcaagaaaaagaaaggcttttctccctgtttgcaagagtttcagtctgaagatgagacattctgccttctggcagttaggagaggttttatgcattacaagtactcaggccgatcaagagaaaaaaatcgaaaaacaaagaaacaggacaatgatgcgtggtttaaggcaaaatttcagcgatcagttttcagaagcagaagcaaagactttagcacagccatttggtggaagaagatttatggaccgaaaaaggaaagtgatatccaaaaaatggaagtgatgtacagaaacagctgaattggttacagctcagtttttgccttatttgaatatgtttcaaacagttggctacatttgactggccgaaactcagtcatttctggaggtgtcag

SEQ ID NO: 474876 - DNA, 644 bp, Homo sapiens
cactgaaggcatctgctacatcgaaccaaggtgcaggccctgctgggtggagatgctccctggtcagcctatttgctgtgaccactctggcatatgtggtggacgatgcctctgcttcctctctagtggctgcagctctctaccaagccctccaccagatctgcagctctctaccaagtcctccactggaccccctcaatttccagcgatgaggcttagggttgaggatagacttgagatgctgggatccaaagaagaagaggttatcatgatggttcggaggcactccaagtccagaaagagagaagtcccgaagagttataaggatttaacgaattggttgctcaaactctttggcagtagaaaggttgtgcaggaatctaaaggcagagagagactgaaactaatgaaagaagtgaaccataaaattttcaaaacgtttgctgctcagtgtgtggactataacttgcagggagtaaatattatctgggaccttccaggaaagatggattcccaggttccagaaagacccacagatgtagaagatggtgtttaaccagaattccccgtgaattgtatagccatttaaataaaattaattaaataaaatcgacatttaaaagcagtactctaaagcacttcag

SEQ ID NO: 474877 - DNA, 700 bp, Homo sapiens
agagcagttgacacagatactacgttctagaagagaattaaatttaaacgtcaagtttaaagggatcataattctgcaggcatgaagttaggaagagcaggaatactgggagtatattgtgagttttactctaggaccaaaagcagctgtggtcaaggaaagaagcctggccctttgctcttgggttgtgacggagccgctgtgtttctccacagcacccttcagtctgtgtgtgcagcaccaagtcggggggaagttagaagaggtgggaagagccaccgagcaggcagctcaggagaagccaaaccttgcacagtggaacggaacgggcagtccatttgtggggaaaacacgagacggaggtccagtgctctgtggggattcagaagggaaggtcacccccgcacatggaagagcagtgatgcgcccatactgcaacgtgctcgggatactgcgggaaagggttccagaaccattccgcctactcaccagctctaggatttggcagccaacaccctcctctgacctccgaggctcggcgttattgactaaccctaacagggatggatcccgccttccctgcctcacagtgacttctgtgagggttaaacgagagccatgaaaaccatgcatgtcaggtaaggtgcaaaaccaccattgtgcggttgtgcaggttcgggggagacagagctcactttgc

SEQ ID NO: 474878 - DNA, 611 bp, Homo sapiens
cgggcagtgatggatgcgataagttatggggaaagcaggaaaaaattagctcccatccaccattttgtacctcccaagatccacagcaggccctctcaatatggggttggagagctattagttagctttgtggaggatcctgcgcccagggttgcctgcagtgccaggcttgctggctgctgcattgtggccggttatctgagtgggtatttccagcagccccctgttctccaaaaggaacaggttccatgcgcagctctggatgggctgagtcaggggagagtcctgcagacatcccaggctggtctgatttgcacgcagagaactgtgttggagcttactgaacgccaagtcctttttaactggggtcagcatctcatgcttcaaaaatgccttgcgaccgcatttccacgaacataaagccgaaataaaagaaccatcttttttattgcaaagtcaggcgacataaggatgttgtactattttggcaataaggctcccttgattttccctttcatgaaaagccaaattcgtaaagaaagtgacaactacagtttatacttcagtcatttaagtcgctgctgtggttgctacactcttcagacttgtgg

SEQ ID NO: 474879 - DNA, 2019 bp, Homo sapiens
ccaaagaagaaaaaaatcaaagcttccaagatggtggcaagcttcttgttctctgaccgggggttcttggcctcacggattccaatgaatggaaccttgggccatgtggagccgtgggtcacggaagagaactgtggaacccagctactagcgttcagctcgattaggacgaaccctgggctcttagccatgcaggaacaatggcaagcctttagcctgattgggagcagcaatgggtggctcgctgggtcaggagcacagcggacaccctgccagatctgcagaggtggaagtcagtggtgggtctgcgatggcggcaaacagcagtggtggacagcgagcgaaagctcagctcgagccataacaaacatagaccagaagagaggaaccatctatcatcctgtcctaaagggagttcctgctgggtctggtcggacctttgtatggtaatgaagatttaaatcccattaggaaacctgctgggttaagggaattttcagtggttaatgttaaatcacctttttctaacagaataaccccatactttaagatttttgagttagtaagctacctttttgcttttttgacttagaataattctgaactgccctttgaaaacttggggccctggcaagggtggtagggaatgggtcccacataactgtccatgttgagagctgtatgcctaaatggggagagataacagggagaagactctctgggttcatagcctaggggcctaaggacacagcatagatcccttccttagatccctctggagatagaacttgctagaggaaatgaaattaaactgtaagtttaaggtaaatattgatattttctaagatataaaagcagtcactcatcacaatgcatttcaacaaaaccaaacagtttggtgatcgagactcacagagatttctcctaattggataaaaagatgaggcctgtgctttttcatttgcttgattaattactgctctgaaacccttgaaaacagacatggtctgtaagtggtatctgttgtttaatcgaggacagatgtttttgaaaaccttttaaataggcctagagagttattgactctgaagtgaatcattgaactgtatgttttttacaagtaacatgccagcaaaaaatgatttttactaatattcaagttatagtcaccataattgtggtttgtcctaaacctaccagcatctagaagcagctgcaagataatggtagtaaatggcatcaccatcgacccaggggactaggctgaaaatccaataatcactcacaacttcttcctgcctgtacttctctccctcattcctgctctgtccaagccccgttgtcattctcaagttcattgcctaagagcagtatctctccaggtgtctcctgtgtctgttcctaccaccgcttatgttaagacaactgtgatatggcttcggtgactggaggagcaccagggtccttagtctcatgctgatttagataaaacaacacggacacatatagagtggttttaaggagcggagagtttaataggtaagaaagaaggaagaagctcccccatacagagactggagggggggctccaagccaagagaggaaaccccatgtgccgcagaaaagtggctgcttatatgagtaggctggaggaggtggtgtctgacttgggtagggctcaggggattggtttgaccaggcatgtcattcacgtagcctatggaaaaactggccctcccaccctagccttttaatatgcaaatgcagggtgccatgatgttctacacacgtggagatatgtgggggtggtcatgttgccaggcacatgtaggggcaagggcaagaggacaagggtgggaattgccatgtttgggtggacccggtttctaatggcctgcatttgcatatcaaagcttgccagcccggctctaagagctggggctttcctgctagacaagaagcatttctggagctgctttaaaagaaacaaaaacttcccaaggaccccttttcctctct

SEQ ID NO: 474880 - DNA, 910 bp, Homo sapiens
aggggctactagccagatggcttgggaaaataggatagccttagacatgatattagcagaaagaggaggagtttgcatcgtgattaaaactcaacgttgtatcttcatcccaaacaacactgcccctgatggaagtataacaaaggcattgcaaggtctgactgctctgtccaatgagttagccaacaactcaggggaaaatgacccctttacaggatggctagaaaagtggtttggtagatggaaaagaataatagcctcgattcttacttccctcgcagccataatgggtgtacttattcttgtcaggtgctgtgtcacaccatgcatctgtgggttggtgcaaaggctcataaaaacggcacttactaaaacctcccttaactatcctccaccttatccagagaagcttcttcttttggaaaatcaagcagaacaactaagccaagacatgttaaagaagtttgaagagaaagcgctataaggaaatgcaagaagacaaattgttagatatgagttctaaatttctcttccaagaaatttgtcagtatgttcaattctttgccttctacttttaaacttaacttcctcgtaaagcaacatttttcgattacctactccaccctgactcattccgattacctgctcattctccaccctgactcattccaatttcctgctctgccataaccagttttcctgccaaaccactcaccccatcactctctttaaatcagccaattggaattagtttgtctgtgcggtctaaccctagccaataggggaatgacacagcagcaggggccatatagcctttgctgtgtaatagatgacttcaaaacttggtagctgaaaatagcaatcatatatctgtgggtcacgtggagttcagctgattaggcagggttgc

SEQ ID NO: 474881 - DNA, 1155 bp, Homo sapiens
catacacttaaagcaattttataggggtgatctgagtctaaggttaggtcaccaggagacctgaagtactctggggatctgctgggcctctgagcttcacagagtcagagtgggttgtggggtatgtctgttgttggtctggtgatgcagtgggtcagcagggaggatccccaggcagagtgtttgcgctgcaggtcttcttccgttatctgtccctggagcaggcctgaccaggcactactctaatggcttcatgtgtatcgcctcagtcaatcctcatagccatcttactagttcggtgcttttattatccctgctctgctgatggcattctcttggtcaaggatgtaagtagtgatgcggacagagccatctgtgctgcgctgcagacccacacagaggtctactggaagggaggagcccgaggcgagtccactgaatgtgggcacttcccatgcatagtcgacctagtaaaatggccacagatatgtgtctggaaaggactgggaaacactcctccttgtcttgtatggaccttccccgagggtccaagcctctccctcagtcaaggcagcacttctgagtttgtgaatttgattgccctggtccagaagccgaagtcaatgatccatggaagatgtacctgctttcccattgccttctgccatgactgtaagtttcctcgggtctccacagccatgctttctgtaaatcctgcagaactttctggcatctctgttgacttaaggaccagtcaacatgagaaaatggagcccactaattttgtaacatattgtaatatctctggaaaaacacaactggtttacgaaagagaccatgtgatttatttgaaaatgaagcagaagcctttacaatgttttactgaaactgccatggggaccagaagtgaatggatcggaggtccaacaaaattcactattgaggcttacacaaataaccacagctgaagatgcaattgtcccagcctattctgtatattcatattcatcttgtatgtttatgatattatttaagctgtgatatttaggttaatatattctttagtactattatgtttaataagtcaactctaaactataatttctactttcatgatttagcaatttgacattagcaatagtaatgataaactgc

SEQ ID NO: 474882 - DNA, 740 bp, Homo sapiens
tatgagtgtcattgcatgtgagatgggtttcttgaagacagctttcacactggtgctgggtggggcactggcaggctctgtgcctgcaaatactccaacagcaatggtggcacagcaggtgaattgggggagggggtgtactcctgccagcagctgtagcatggtgggcagggtgcatgcacacatgcatgctgacaaggaagggaaggcaaggtgcaccagcatgcacacatggtgggagagtaatgtgagggatggccatgtaactaaagtcttctggagaggagtaaagcgagccacaggggatgggtgtcctgggcatgctccactacagatgctcccatgccaaactatttgggctcccaactatctagagttctgtccctactatttttttaagcagctttccctgtcagctcaagtgtctgtgggggttatggagtctcccgctggcaggattccagagatccgtggtgagatttgtgcatatctttaaggtgaatgaagccagtgtcctgtagaaaacatatagtttggtctttttaaatacattcagttactttatgtcttttaatcaaagcatttaatcaatttatattcaaaattattattgatagagaataaagtagcagtcaatgttttaatgaaatgaaaataaagcttcttttccttaccattaagcaatgagaagtttgactggctagccaagtttctgattttactgttatcaagtgtaacta

SEQ ID NO: 474883 - DNA, 609 bp, Homo sapiens
ggtgggagccgccaaccacagctgtatccagttggccattttggcccctccttttgaatacgctttatttctttctcttgcctgattgccccggccagagcttccaatactatgttgaataggactgcggagcttgagcactgtgctgggagatccactgctgtcttcacagccggcaggcaggaatgtgtaagtctgctgaagatgtgcccacagctgtcccttcccccaggtgctctgtcccagggagatgggagttttatctataagcccctgactggggctgctgtctttctttcagagatgccctgtccagagaggaggaatctagagaggcagtctgactacagtgactttgtggagctgcaaagggctctacccagtttgaacttgcagctttgtttacactgtgaggggaaaaccacctactccagcctcagttacggcagatgcccttcaccccaccaagctcaagtgtcccagtgcgcctttctacactgcagaggccgtcgagctaaaatctgcatttcccacatttctggatgtaatgtatgctctgccaaccaaatggcctcacataagacttaaatctagaactgaaataaaaac

SEQ ID NO: 474884 - DNA, 1199 bp, Homo sapiens
ctgacactgtgcaaactaagaacataaggtctctctctctctctctctctctctctctctctctctctctctccctgcacacactgaggaaagggaagcctcttccatcacaggcctggaggtctaggagaaacaaaaatggtttggtttcccgagcagcgcccaagttccctgtgctgtatacagtctagtgatttggtgccctatgtcccagcacctccagccgtggctgaaaggggccaacatagagctcaggcaatggcttcagagggtgcaagccccaagtcttggcagcttccacgtagtgttgaacctgtgggtgaacagaaggcagtgcagaagggaaatgtgggattggagcccccacggagagtccatactggggcgccacctagtggagctatgataaaagggccactgtcctccagaccccagaatggtagatccacctacagcttgcaccgtgtgcctgcaaaagctgcagacaatgctagcacattaaagaagctaggagggagtctgaatctagaaaacattcccaaagataagtttatcaaactgtttaactgtcagcaaacctctttaatttccaataatggcagtagtgcatatgctagaacagaattattagctaataagctgataagtaccaggatctcagactgacttttaatatttattacattatattgaagtagtgcagtggaagattttaataattcaaaaaacaatttttagtgccttttgtcatttaagacatgggtctaaagcagcacaatgttattagttagaaaagctgtaaatacacacatatatattctttctaccatacatttttctcattgttctacaatgacgatgcaaaaattcttaccagtagatacttttgtgacaatgaatataaatttttgttaaaatataaataccttgtcattttaatcaaaattggtgtggcagattagaaaatcaatcccttctaagataataaaggcaagcaacattgtagagactatttgaatgtagactattcaaaacaatgggaagatatgattttgagtatctgggacagccttattaaaatggactggagggttccagtcagaattttctatattagctctccttaatgatgtgtaggccaaatgaagatttatttttctatgattatttaattagtgcactaaatgtcaatcatgatg

SEQ ID NO: 474885 - DNA, 848 bp, Homo sapiens
ctacagacacttctgcagctccactacagacactcctgaaccaaaccctctgggtgccacactggctcaagttctgccccaccacttccttaagcggatctccctggcaactcaagtgtccgtgatgctcaaggggtctccttctactgggaaaccagaggcccacagctgtgtccaatataatgacaagaatcttcataagaggagccaggaaaatctgattcagaaaaggcaagatgatgatagaagcaaagagagagaaagagagagatttgaagatgctagctttggagatggagaagggccatcagccaaggaatccaggcagcctctagaaggaccagggccctgctgtcctgtgcagcatcaagacaatggtctccacatcctagccaatccagctccaactgtggatcaaagaggcccaggtacaactcatgctgccacattcctccatgaggaagcctgccggcagcaccatggggaaatgtggggttggagatcccacagagtccacaatggggaattgtctagtggagctgtgagaaaagagccaccatcctccagaccccagaatggtagacccaccagcagcttccaccctgtgcctgaaagagctgcaggcattcaactccaacctgacatgatcacaagtttaaaatgtgacaaaagaaatgtccatggaagctgtgagtgtaaactctaggaagcgtctttaaaggcaagagcgtacttttcttctgttttgtgttcctgtcaacatcaataggaattttagtaaatggagctagagaagccatttcaggccacctggggatggagagggcacacaagggagaaatgacacc

SEQ ID NO: 474886 - DNA, 744 bp, Homo sapiens
tgcccaatttgccagcagcagagaccaacactgagccttcaatatggcaccattcctcagggtgatcaaccagctccctggtggcacgttaattatattggacctcttccatcatggaaagggcagaagtttatcctcaccggaggagacacttactcctgatatgattttgcctatcctgcttacaatgcttctgccaaggctaccatccatggactcacggaatgccttacccaccgtcatggtataccacacagcattgcatctgactaaggcactcactcactttactgctaaagaagtgtggcaccaggattcacaggtccaggaatcaaaaggtggaagtggaagcagcagcattcgctacacttccagtgattcaaactttttgcttcctattcctgcaacattaagttctgctgtcctagagtctaagaagggagttaccgtgttgtctggggtaattgacctgaattatcaagatgaaatcaatctactactccacattggaggtaaggaagagtatgaatggaatacaggggatccattaggggttctcttagtattgccatgccctgtgattaaagtcaatgggaaactacaacagcccaatccaggcagggctacaaatgacccagacccttcaggaatgaaggtttgggtcactccacaaggaaaacaaaacaaaacaaaaaacatgacctgctgaggtgcttgctgaagccaaatggaatacagtagaag

SEQ ID NO: 474887 - DNA, 860 bp, Homo sapiens
taacacaaacagggctgaaacatgcccaccgctcgccactttgtgggcgacgaggagaaacgaactgctggctgtgacaccctctttggggctccgcagtttctggtgtctccaagcttccgggtgccatcgtatttcccagtgcctgcagtggaagccatttgtggtaacgcctggtccagccagtctcacacggaacccacgcctgtgctggcgcctggagctgcctgcccagtggcagcaagcacgcatggctgtgtgcagtggccagaccccatgcttattaacacaccccttgctactcctcaccaggctcgcccttggcaggtgtgggatccagccaaatacagcctgctggggcgagtgagcagaagaggccagcgggcccgtgtaaaactcaggcaaaggcaccaccagccgcagaggtttccaactgaaaaagtgacacgccatggctccaaggttaggggactcatgggtttgggagaggtcgtggtttatttctcaaagcagctcaacggtgtccactccttgggtaggcgaggactgaggcagccatatctccatctctggggttttctggtagaaatgaatgttgattaccttcatagcaaaagatgccagtgtcctttgtggagcaggccactgaggaccacagtgattcctgctgcatgactgataccaatagcttttgcctttctattttgctcctagctgtctcttggtgtctaagagaacaccatgtttttacaaaagtctttttaatataatttcttaatacacatgtatatttataataatttttattacctagctattgaaacattctatatatgtgagcaactatttggaaaatgtat

SEQ ID NO: 474888 - DNA, 1314 bp, Homo sapiens
accacagtggagaggcggttacgctgatgcaagaggtgggttcctatggtcttgggcagctctgcccctgtggcttttcagggtatagccccactcctggatgccttcatggactggccctgatgtcttttgcaggctcatggtgcaggctgtcagtggatctaccattctgggctctggaggacagtggccctcttctcacagctccactaggcagtgtcccagtagggactctgtgtgggaactccaacaacacaattcccttctgcactgccctagcagaggttctccctgtgattcgtgactacctccagaaccatgaattagaacatgaagaaaagcaagaaaatggtgcttgctatgattgggaaatggaactccaatatgcaagaatctattgcatccatgccacaggagagagtggatttaacaagtatctgcccgacaatgtggatgaggctcacagacacaatgccttttcctgttaacaaatgcagtatatattctttgtggacaatttagaaaattaaatgaaaaggaaaaaaaagttgccattatttctattacccagagataaacattgttaacattttcatagattttctttcatgtttgtaaatgcactatagcttcttgctttaaaagcattgtatttttccatctaatgcgataatttgctatgacatatttttaacagctgtaaattattctagcacatgaagtaattatttaatcagtcactcttattgataggtattgaagttgtttccaggtttctgctacacatacacctttgcatatctctctgataatttcctggaatgcattttacatgtgggatggctacatcaaagagtcagaaacattttcaaggttcctgatgcatattgtaacttgcttttccaaaatatagtgttaactcacattcccttctggagtatatggcactttccttccatagcacttgctctaactctgagcattgttgttttttaacctttgcctatttcatagatgaaaaatggtattttgtttttacttaccgctccttgattagtagtgatgctaaatatatttttctgatattttattattctatagaaaatttggaagtcactattctgaaagagcagagttggagagactgaagtttacactaaacaagcagaaatattagtaacaggaaatatgtatagtgcacattccactgtatacagtgctaccaagcactctacaataatttctgccacagcagagaagcataatatatgaatacctgtaactgatactgtgaacacattggtaataggctac

SEQ ID NO: 474889 - DNA, 582 bp, Homo sapiens
taatatctgagctatgtcttactttggtgctgggacagctgtcagtagagcaccacaggataagaaacataacagtaataaagaaaactttccaggaagaaagtttgcagtgtttgtatgtgatgtggctggttttcataagcatcagaaaaacagggtcattgccctcaagttcaatgtcaacttctgccagaacctaccccaggttgggccatggcactgtgagaagggccacagcttcttccctgggtgccttccaactaattctcccttaccttatatattgagattggttccccaggagacagactctgagatgcagactggcaaggaggatgcttatgagggaccacccttgaaatcaacatctgccaaaaggaagagaagaagcaggaccccagaactgcccaatgagatgattgctaatgctatctccttttactgatgtggaaataagactagacactaagtgggtcccacagctgataagtgcgggaagccaggacttgaaccctaagccctagctctatttgttttagtaagtacctaaaagaatgtttctaggaacttatgtcctgaaat

SEQ ID NO: 474890 - DNA, 650 bp, Homo sapiens
catccactggatgaagccagctgggctcccgagtctgctcagggattgtaaatgcaccaatcagctccctgtcaaaacagaccactgggctctaccaatcagcaggatgtgggtggggccagataaaagaataaaagcaggctgcctgagtcagcagtggcaacccgctcgggtccccttctacaccgtggaagctttgttcttcactcctgaagccacagagaccacaagcccaccgggaggaacgaataattccagacgcgctgccttaagagctgtaacactcaccgcgaaggtctgcagcttcactcctgagccagcgagaccacaaacccaccagaaggaagaaactcccaacacatccgaacatcagaaggaacaaaactccagacgcgccaccttaagagctgtaacactcaccgagaggagtattcgaagaatatggattctagcttcctgaattagttacaatgaaggtttaaactgatattaaaagtcttactaaaacattccagtctaattatttcctgccttagtaaggacaatgcatcaagtaatacttactcttcctttgatggtcaaaggaaggttaacatgcctgagggtcagtattataactattgatcagcactgaccaaaaccacaaatgc

SEQ ID NO: 474891 - DNA, 745 bp, Homo sapiens
actcttagtttttaagacaattaaatttaaaaatttacatggagattgctatggtctgaatgccaaatccatgtgttgcaaccctcatccccaaggtgatggtgttgggaggtggaaactttgggagtctctcatcccacccaacgagaaatgcctacagcaccagttggtgtgggctctgcgaatgcaaactcatttaaacgtcagctggagcaacagagctcagcaaaacaagcaggcaacagaaatagacatgacaatcactggcatcctagactgtcagcaggacttccagaccctcttagcccttcctgggacagaggctaaaactcacatgccaacagcatttgcaaatgagggacgcagccccagcgccattcctcacgtcattgaggggaagaatagtatagtggccatgagcacagactggttttggctagactgggtccaaatcttggctctgccacttaccaaccgcagacctctgaatctcggtttcctcgtcaacaaagggattaataaacagtaaaataaatcattggcaaatagcatatcgataccttctgttcgcttatcctgcagccatgacagacactgctaatcattcaagatattctttctcactgaccctcagaatcttctgtatgtccagagctccaggcagccactcccaataggtaggatttggcatgtgagatgaatcttttttgtcatctcattacgatacctttagagcacagtttct

SEQ ID NO: 474892 - DNA, 802 bp, Homo sapiens
gtgcagcctgaaatgtgtccccggtgctgggtggtcattcctttcttgtgtgtcagcctcacctcaagaactaggagtgtctggagggtaggaagacgctgccacccacttgcatcctctaatcttccacagctgaccccagtgggtgaaggtcagatagctgagttgagcagttacttcatcatctctaccaggaagcattcaagggcgttacaaggtgctcatacccttcagatgtgcttgggacaatggccccagcccctgggcctccctgctaggtcctggttgtgggactggggagaaactggtgggggcaacagagggggtagggtgggagcaagatgtccaggttggaaaacagtggaggcatcttctgtgctgggcgaagtagggtgggccctaaatgggaagattggtcgcacagtagaactggaggcattagaaggtggggctcactcagccaagaggtgcaggatggcctggtctgaggccttagatctttgggaatgtctttgcctgtgtcccaagggtgacactaaggaggtctgagttctcttccattccctctggctggaatgctattaagaaagttctcctctgtgcctcttttgctgagagttaaaaaaaaacatgaataagtattgaattttaatgaatctttgcccatatgtattgattttcattcacatcttcagctgcacctctcgaaagctggaaagtggtatgtggctggtgtcaggccagaggtttcagagggagtcctgcccctgtggagaccggatgtgacggttacaggagggcc

SEQ ID NO: 474893 - DNA, 1237 bp, Homo sapiens
gtggtggagaccaaggattcctcgaactggtctagggtgggcctggaatggggctgggattgggccaggggctagacctaggacagccaaacgccctcctggctctgcacccaaagctactcaaggcctggtggaggctgcagattgtgggagaatacccacggggcctctccctggctgcactggggcagctgctgctggggctgctgctgctgggactgctgctgctgggactgctggtgctggagctgctgctgctggggctgctgctacgggggctggggctgctgctgctgctactggggctgctgctgctactactggggctgctgttgctgctactggggctgctgccgctgctactggggctgctgctgctgggactgctgctgctggagctgctgctgctagagctgctactggggctgctggagctgctactggggctgctgctgctgctgctggagctgctactggggctgctggagctgctactggggctgctgctgctgctgctggagctactgctggggctgctgctgctggagctgctactggagttgctgctgctggggctgctgctgctgctgctagagctgctactggggctgctggtggagctgctgctgctggggctgctgctgctgtggctgctgctggggctgctgctgctggggctgctgctggggctgctgctgctggagctgctgctggggatgctgctgctgaggatgctgctgctgaggatgcttctggagctgctggagctgcttctggaaccaccgctcccgagagcgtttggcccggcgattcttgaaccacacctgcacttggtactccctgagattgagcatctccgccagctcttgcaacccaagccattattacaatacactggacccaaagacaaacgccctgctactccgtcacctgggccatcaagtggccctggttctgccacaaataaaatcatccctcctcccaaataacagctccttagatggcatttttagtcatattttgaatgttggttataatgaaagtaaatgctatttatattaagatccatatttatcttaaagcatgctttgatttcttcagtgtgagtaatttattttgctgtctactcccattaacagtagtatgagcattatattctaagagaagcattcccaacttctaaaacacagagaaactatttttagctattgttaagctaagacttattgcatttaag

SEQ ID NO: 474894 - DNA, 987 bp, Homo sapiens
agcccctcacagatacctgcctggtgctcggctacatagatgactcagaccaagcctccacctcccaggagttcccagtctgcttgaccacacagacacaggcagatagttctgctactctgaggctcgtgctgggatgggaacgcacaggcgcctgtgggagctcagaggaggaccccagtgcggagggttcaaccagaggagaggccttcccagtaggaggaattgctggggcaaagacttcaccgaggtgggagaaggcctggcctgctggaggagtgtccagggctttggcttggcagaggtggtggaggtggtgttggaggtgaaggaggcagaggtggtagtagaaactagtggtggtggagaggtcgaggtggtggtggtggaggtcgaaagggtaattgacgtagttgtggaagttgtggtgcagctggaggacatagtatattcggtggaagaactggaagtggtagaattgatagatgatgtagacatggtggaactgaaagaggcgaaggagatggtggacatggaacaggtgatggagtggattgagttgatggaggtgaaggccagcagctgccagcaaccttgtggtgaaaacccagcaggagtgttggaattgggggtcaaggggaccatcaccatccaaggaccagccaggtgtccaccacagagcctgctggccttcttcaaaatagggaactgctctccctgcttcctgaaggacaagaactatccccatggcaaccaagggatgaagaggccacattaacccttctgagggcaggcctggttgagagcctcttcaccaacccctcctgggtgtggcactatacaggcgacaaggggagtcacatctcccaaaggacatcccccagtctcaccaccattccaagagaaaggcaaggctgagatgttatacacattggatgaagggcaacgttgaggtgaactcagagggacggacagtacaaggacttc

SEQ ID NO: 474895 - DNA, 883 bp, Homo sapiens
gggaaggtggtggaatacaggaagcctgaagacaaggttcaataaagcaagagttgggctgtgccaggacaggacactgtcctggaggccttccttatcctgtctaccctgccttcaaactcggtctcaaatccacccccttctctccccaccatctgtccaggcacctggcctgacatccggtcacaagtacaccccagcattcatgacatgagtgaaactttggtctaggaatgatggtgaatgcagaaaataaaggtcatatttggagattctttggaggtagactgctcagggcttgtgctgacttcatctgagggtggaagaggaggaagaggaggaggaacaatgcaggagggaagaacatggtcaggacagaccttgtgatttcctttaccaaactcttagctcctccaaccatctccagatcattacaagccacctccattcacccaaatactccagccaacatcggggtcacctatcattcctctttctctttctctacccacccccaccgaatcctttcaagtcctgtctgtgcaagacacaggccccgtatcctgggtccttttctcctctctgcaccccacttctacccttattgtcctagttacaactgctgtgtaacaagcatcccctccaaacttagtggcaaaataatcattatattcacaagttatagggctcaggaagttgggcagggtacactggggatactacacggccactgtccaccatgctttagcttggcagacacaaagccagcatgacataatggtggaggtaccttcacccacatttctggcacctgggcaaggtgactccagtgctgaactcacctgggactgtgggctggagcaagcacaggtggcctctgcct

SEQ ID NO: 474896 - DNA, 634 bp, Homo sapiens
gtcctacagaaccattgtctaggtgcacggggctcgggttcaatatgactgctatcctcataaaaagaggaaatgtggacatagaaatgcacacagagggaagacaatgtgaagagatgaagacagagggagaaggaagccttctgccagccaagggttctccctcacggccctcagaaaaaccaaccctgcccaaccttgatttggaacggtggacagtcagggacccagagcccttccttctgtggcttcacagctggcatcccatggcccacatagaacccagtcacatggcccagaataagaggatctgggagtggcaaaaagccagccagactcagccccataaatggctggtggttgtgcagacagagagagctcagatttgggtataggttgaggttgaatcaatgggacttgttgatggatggagtagaggaagacaagacccatgactgactccaggactgcacaactggcagggactgtcctgaccttgggtgggaaaagcctcctcaggactgtgcctgcccttgggtggaaaagcctccccaggactgtcttgacctttggtgggaaaagcctccccaggtctgttctgactcaggtcttgctgaggggctcccttgccaat

SEQ ID NO: 474897 - DNA, 1700 bp, Homo sapiens
cagcccccaagcccacagggaagccaccgctctccccaaatcacagtgaggaaagagcctgagaggggcccagcatggttgaggaagcctcacagccctgggaggcagaacagctcaggaatgaagagtgtagacctaaacctgcccatcaggtccaaatctcacactggttgtgcacccgaagcagcagatggccactgagagattcccctgagagtcgccactgccctggagatggtgaatgggtctttgtgtcaccaccctgcctgttgctgcaggcccccctgctccctccctggctccttcccgaccccgtggcaggaagcatgcctgcttcatccccaagattcagggcacctgtggcaactcagtcaggctgtctgccccacacatccagccccacaagtggcctggcttcccgggcagcagatggacagggatcaggagggggcaggaaccctgagtccccagagaccccaccccatctccccatccccctggcacagccaggctcaagcctgggacaggtgaggtctgctgggctgctgtccagcacccaccagagaatgctccatcctctgctccacacagaccccttcccagtcgggctggtccccactactgggctgatctggagggcagcttgggacccctagagcagagatttcagaggggcctctggggtgcttacaacaagctcacagatggggcattcacaatgcagattcccgggccctattccagacctaccgattccaaatctctggagacaaagttcatgaatctgtattttaaacaagtgaccccgtgcatcctgcagtttgaagagcattgcctaaaataaggcaatgcttctaacactgtagaatatttggcagtttgagaactttgcaataatctgattccccaatctttagaattggggaatattcgatttgggagggaagggagaatgtttggaatccttagaacttccaagtgttttgatttttaaagaatcattcaaactttcaaatgagcagacacttctgagtgaatttctcctgagtcagacacccttacacatcctgcaaaacttctgcccactccacatagaccctactctttttctttcatttttcaattcaatcagataccatttatcttcctttttaatgttttggaataattttagactcacaaggttttcctgtatagtcttgactcagtttcccccatgtttgtatcttgcacaataaagtacaatgattgaaaccaggaaattgtcatgaataaaatcctgttaaccaacataaaaaccttattagaattttgccaattttcccgaaatgtccttcttctggtcccaaatcagatccagatcccatattgcctttagttgtcatgtccctgccaacttgggaccgttcctcagtcgtgattggtcacttatgttttactttatgtttttaaagaacacagctcagttattttgtagagtttggattcggtttggatctgtctgatgtttactcatgatcagaacgaggttatatatttttggcaagaatgtcacagaagtgacatggggtgcttcccaaggccttgcacggggtctacacaatggtgtgtcttactactgcccacctctcctgtcacctatgtctttgcctaaaccaaccctcttcttttaaacttgctgcctgatttaatgtaaccat

SEQ ID NO: 474898 - DNA, 802 bp, Homo sapiens
atcgttgccacagcctctcaattcaccctcctgtgctcccaccaccctcctatgatcccttttcctgatgcagccagaatgcatgcagctaaactggaagtcacggcaccttcctcctctgctccacaccctccatggctcccaccttcctcggaggcagagacaaaaccctccctcaggctgcaggcccacatcatctggcctgaccctctctatctacttcccctggctcactctgcctcaggcccacggcgtcctatttcctgagcacgtgccctctcatcctcacctcagggcctttgcacgggctgctccctcctccggtggtgcctcttctccagatgcttgctccctcacctccttcaggtcctggttcgatgctcctttctcaggggcattcactcgggcctccagcacttcctatttccctgttctacttcatttttcttcgtagttctcacccctaactcaccatatattttactcataactttcttccccacaaggctgtcagctccatgaggtcagaggtttttctctggctggttcactgcggtatgtcctgtcctgtttcttcttgtcatatgtatatgtatatgtgtgtacatatatgtgtatttttatatatgtaaatgctatataaaaatatatataaataaaattttatatatgtaaatacatatatatgtatttttggtatttatcctttttaaaaaaattgagagatattatacaactcaggggcttttagcatattcacaagatcgtgttagcattaccacaaccagaacattgtcatccc

SEQ ID NO: 474899 - DNA, 2994 bp, Homo sapiens
tttgctgagaagatggtttccagcttcatctatgtccctgcaaaggacacgaactcatcctttttatggctgcatagtattccatggtatatatgtgatacattttctttatccagtctatcaatgatgggcatttgggttggttcaaagtctttgctattgtcaacagtgccgcagtaaacatacatgtgcatgtgtctttatagtagaaggatttataatcctttgggtatatacccagtaatgggattgctgggtcaaatggtatttctggttctagatccttgaggaatcaccacactgtcttccacaattgttgaactaatttacgctcccaccaacagtgtaaaagcattcctatttcttcacatcctctccagcatctgttgttccctgactttttaagatcaccattctaactggcatgagatggtatctcattatggttttgatttgcgtttctctaatgaccagtgatgatgagctttttttcatatgtttgttggctgcataaatatcttcttttgagaaatgtctgttcatatcctttgcccacttttttatggggttctttgtttttttctgtaaatttgttcaagttctttgtagattctggatattagtcctttgtcagatggatagatgcaaaaattttctcccgttctgtaggttgcctcatcattctgatgacagtttcttttgctgtgcagaagctctttagtttaattagatcccatttgtcaattttggctcctgtgccattgcttttggtgttttagtcatgaagtttttgcccatgcctatgtcctgagtggtattgcctaggttttcttctagggtttttatggttttaggtcttatgtttaagtctttaatccatcttgagttaatttttgtataaggtgtaagaaaaaggtccagtttcagtttttttgcatatggctagccagttttcccaacgccatttattaaatagggaatcctttccccattgcttgtttttgtcaggtttgtcaaagatcagctggttgtagatttgtggtgttatttctgaggcctctgttctgtcccattggtctatatatctgttttggtaccagtaccatgctgtttttgttcctgtagccttgtagtatagtttgaagtcaggtagggtgatgcttccagctttgttctttttgcctaggattgtctcagcttacaggctcttttttggttctatatgaaatttaaagtagttttttctaattctgtgaagaaagttgacggtagcttgatggggttagcattgaatctataaattactttgggcagtatggctattttcatgatactgattcttcctatccatgagcatggaatgtttttccatttgtttgtgtcccctcttatttccttgagcagtggtttgtagttctccttgaagaggtccttcatatcccttgtaagttgtattcctaggtattttattctttttgtagaaattttgaatgggagttcactcatgatttggctctctgtttgtctattattcgtgtataggaatgcttatgatttttgcacattaattttgtatcctgagactttgctgaagttgcttatcagcataaggagattttgggcttgagacgatggggttttctaaatatacaatcatgtcatctgcaaacagagacagtttgatttcctctcttcctatttgaatacctttatttctttcttttgcctgattgccccggccggaacttgcaatactaggttgaataggcatggtgagagagggcatccttgtcttgtgctggttttcagagggaatgcttccagtttttgcccattcagtatgatattggctcagagcttgaatgctgtgctgggagatctgctgctttcttcagagctgtccggcagggatgtttaagtctgctgaagctgcacccacaggtgtcgtttcccccaggtgctctgtctcagggacatgggggttttatctgactggggctgctgactttttttcagagatgccctgcacagagaggaggaatctagagaggcagtctggctacagcagctttgctgagctgtggagggctctgcccatttggaacctcccagcggctttgtttacactttccaatgagatgaaccaggtaactcagttggaaatggagaaatcacccaccttctgcgttgatctcactgggagatgcagaccggagctggtcctattcagctgtcttgccagcagaaatctcctgtctacttcaaattattaatactggtaaaatataaactctttgttccagcatagctctattttcatatctctcctttgtgctaatatttcaaaacctattatattcatatatgttataaagcaaacaatacagtgttgcaattattgctttatgcaatactatgtattttaaagacgttaaagaaatgagaaatatatatttatagtcttttatattaattaatgtgcaggtataccttgttttattgcactttggagatactgtgttttttgacaaattggaggttagtggcaaccctgtgttgagcaagtctattggcaccatttttccagcagcctgtgtttacttcatgtctctgtgtcaaattttggtaattctcacactatttcaaagtttttcattattttatctgttatggtgactgcaatcagtgatctttgatgttactattgtaattgttttggagtgccacaaactgtgcttatataatacagtgaatttaatcgataaatacgtgtgttctgactgcgcccccaaccacccattctgtgtttctctctctcttctggcctccctattccctgagacacaacaatattaaagttacactaattaataaccctacaatggcctgagagtgttcaagtgaaaggaagagttgtacatctttctctttaaatcaaaaactagaaatgattaagcttagtgaggaaagtatgttgaaagccaagataagcca

SEQ ID NO: 474900 - DNA, 604 bp, Homo sapiens
cggggcttgctaatgaagtgccaggggtgtggcaggctaaggtgagaggcaggaaccgtctgtcctgggacagccatgggtgaggagtggcttccggtttggggagctatggccagccctgctggggatcttctcgtttgtgcctcctgcctggaggacacacgctgtcctgagtggaaactgaggagggagatttctgggtcacagcacgcacatatgttctgttttggtcccttctgccaaacggtttcccacaatggtcgcgccatccgaaactcccgctggcggataaacattccagtggtttcccttctttgtccacagttgttattttctgagtttcttgcctcttccacaattccagtggggtggagccacagcttttccatcctcccgccagccacccttgttcatatttcacagcacaatcccaaaaccatagaccacaaagaaaaatactggtaggtctgtctacatcaaatttttaaaattctatgtgtaaaaaagtatataaccaaagctaaactagaggagtttgcagcatgtgcttggcagacaataggttggcactcctgctatacaaaaaatgcttatcggttactac

SEQ ID NO: 474901 - DNA, 520 bp, Homo sapiens
gtcagctcatgtaaagcactcagaaccatgcccagaagcaagtggtcttgatggcagcccttgctataggcactctaggctggatgcgagggttctgccgcacacagctgcctggtgcgggccagccacgtccactgtctctgcgtaccatgtgcacccacagcaagcctccggaggtgcccccagaggcaggggatgggtcccctgacctcggggaggacccccagccccatcagccgcggaaatggtggacccgcgggccctgggctactgccatgctgcagccctcggaggaactgagcagggacagggccagcctgggtcacccgatgcagctgcacagatgtcaggcccggcatagccgagaagatgaggagaaaagcacagtcggggccgtggtgcacctgttggtggcccctatagtcttcaccagcacacctgggtcacatccttgctaagcgcacagactagcagtggtgttgagcctgacccttgagtgcacatcttctgaatattcttc

SEQ ID NO: 474902 - DNA, 1117 bp, Homo sapiens
ggaagccactcctcacccactgacagtggagatgggcagggcggccgggctgtctgccagcagaagcagccaagggtcttgttaacagagatgcgacgtcagaagcagccaagggtcctgttaacagagatgcgacgtgcagaagcccagatggctgtaagtccacccatcgcagatgtgccgcagcagccaagccccacaccagcagggacgccgtgcccggcaggcagcctgggtcagcccgtgcctgcccaccagactggtgaccctaatcctgtgtgcagacagggccagcccgaaaccctcccttgcacaaaaggcctttgttctgctgcccttcctccctgtcccccatggctgccttttcttcagccagggaggaaggaagctccctgccgagcacaccacctccaggcccggtgccagccatttgagcgcaacaggagaccacatctccctccctccttgctgtgtctccggctcctcaagccccatccagactccaggccctgaccctcaccaagccccgaaccagagccctcctccccgtgtggctggccccgatgacacaggccctgatcacgcggaacactctgaattcttacccaatttatttttcttcccaaccagcagttctcaaatatgttgctctcaggatccctttagtaggatcaccgggtttactacataaataacagtacagaatgcccagttcaatttgaattgcaaataaataacaaataatttttttagaacaactacttcccaaatattgcacaggacacacttccattgtatctggcaagcctattttccatactcttaaaaattatcaaggacttcaaagagctgtagttcatgtgagttatgaaaactgatatttactgtattcaaaactaagacagatgaattattagaatatttatcaaagtataagagaatctttttaaaagaaataatacatgttcacataaagcatttttatgaaaaagctacatttttcaaaacaaagaaatcagtgggaaaagtggtgttgttttgcacttttgcaaatccttttaatgtctgacttaattgaagacagctggattttcatagctgtttcttcattcagttc

SEQ ID NO: 474903 - DNA, 514 bp, Homo sapiens
tggaatattattcagccataaaaaggaatgaaggactgatgagccctaccacgtggatgaaccctggaaacatcatgctgagtgaaagcagccagacacaaaagcccacagagtgtatgcttccatttaagcccacagagtgtatgcttccatttgtctccaatgtccagaatgggaaatccatagagacagaagctagatcagcaggcgcttgtgaggattcggagggggaagcagtccgggctgccacagctcttactgttattgtcgatgttatccttgttgggctgtgcagggaggccctgccaagttctggcagatttcaccctgagttggggccctgctgccatgagacagcagaagatgaggagaaaagcacagtcggggccgtggtgcacctgttggtggcccctatagtcttcaccagcacacctgggtcacatccttgctaagcgcacagactagcagtggtgttgagcctgacccttgagtgcacatcttctgaatattcttc

SEQ ID NO: 474904 - DNA, 577 bp, Homo sapiens
gcactggggctgcaggtggagctgcctgccagtcctgcgccgtgcgctcgcattcctcagcccttgggtggtcgatgggactgggcgctgtggagcagggggtggtgctcgtcggggaggctcgggccacacaggagcccatggagtgggtgggaggctcaggcatggcgggctgcaggtcccgaaccctgccctgcgggaaggcagctaaggctcatacaccctccacagccactggcccgggtgctaagtccctcattgcccggggccagcagggctggctggctgctccaagtgcggggcccaccaagcccacacccacccggaactccagctggcccgcaagcgccgcacgcagccccggttcccgctcgtgcctctccctccacacctccctgcaagctgagggagtgggctccagccttggccagcccagaaaggggctcccacagggcagtggggggctgaagggctcctcaaatgccaccaaagtgggagcccaggcaggggaggcgccgagagcgagcgagggctgtgaggactgccagcacgctgtcacctctcaagaggactaaat

SEQ ID NO: 474905 - DNA, 548 bp, Homo sapiens
gcagccagagaaggcatgcagaagaaaaataaaaatatgatttctttcaaaatactactgctcattgacaatgcacctggccacacaagagctatgatggagatgtacaaggagattaatgttgttttcacacctgttaacacaatatccattctgcagtccatggatcaaggagtaatttttactttcaagtcttattatttaagaaatacattttgtaagactatacctgctatagatagtgactactctgatggacctgggcaaagtaaattgaacaccttctggaaagtattcatcattctggatgccattaaaaacatttatgatcaatgggaggtcaaaatgtcaacattaacaggagtttggaagaagttgattccagtcttcatggatgactttgagggattcaaggcttcagtggaggaagtaactgcagatgtggtggaaataccaagagagctagaattagaagtagagcctgaagatgtgagtgaattgctgcaatctcgtgatcaaacttgaatggatggggagttgctttttac

SEQ ID NO: 474906 - DNA, 723 bp, Homo sapiens
ttgttttttttttttgtttgttttgtttgtttgtttgtttgttttttgcatcgtggttatgtgtttttcattatgacgaagaatgaagaaattgatttggcaggtaacaagtactcaccccggtgggaggctcctcctcgtacagtccttcatcttcatggcagaaaggctgttctgcccctgcgccctccctggcctctctggggatccctgcagctgatgtattgtgatggagcagtggacttggatgctgctggtattgatataatcattgttaacagtagcaacagtgcagggggccctggaaatcctaaaccaaatctaatctttggacccaccaaccaaactgcagcttggaaaaggaagctcctgtttggttggggacaattttccagaggaaggggcagctgtgagtgcttagcagccaccacacagcacctgggagatgggagcgatggtcctttaaagaccatcaacaagagtggtccctacgatgttcttctgctaatctagaagcaaatgatcactgtgttgatttttccatttttgtcatttctttgatactgtggagacacatgcttagcatgtttttctaatttcatgccatgggcctgttgagcagagctcatcacttctcagattaaattatatgtttaagaaatgccttctgcgtcaaccagttattcatcagcctggttgtaagtggctaagcctggctttcag

SEQ ID NO: 474907 - DNA, 622 bp, Homo sapiens
ggctgctttggggacacagggcacaccaccgctgctctagcagctgctcctgcagccagcgtgatagcagtggctgctccgtacggcccgccacggtcatcactattagatgagcgccctctttaaacagaggccaggaaaagggcaaggcttatgtggtgcagaggtcatggagctgggccttggtggtcacacggccttggagtggagccccagcctggtgctgagcctgcggaaggctgagcgacaagaacaagagaaaggccctaagaaatttaagggctcatggtctccttcaaacttcattgtggcctgggacggaaggaaacttaccagggagactttcagcggcttcgccaatgtggcagaggtggaaagcgataacaactgtgtccactctgtttcccatccatcattcattcatccaaggaatattcttaagcactgtcaactgaagaatgatgaggttcacacatgtggaaaggagatctttatttatcataaacagaggcagcctgcaggccagccatcccataggctgggcagcatggcctctggctctgcagagagcaagcagtttgagggaagggtaaagggaacaggaacttatgctgagtgagac

SEQ ID NO: 474908 - DNA, 1698 bp, Homo sapiens
gggtgtataatgatatcatgcaatacagtgcaaataatactgtgagatatgtggggtactggcacgtggaactagtggatgttgagggttactatgttatgtatattcagtcatatttatccatcacagcccctaagtctcagtctgtggttacaacggctattttctcaccctgggatccaggagtagaagcaggagttcatcagggagaccagagagttgaaaagggcacatctggcagagggcaaagtcctctacatcctatattcatggattggaagaggagaagaggggcaatgacagggatgggagtgtgtgagtggggacgggtcctggtgaaagctagagcctgctccaccatccccctccccaccgtaggaacctgttccaaaccctgtacctttctcatcaaataaagaagggcttgaggtgcttattagaatgtaatttctgggcaccagcctagacttcctgcatcagagtgtctgggatggggtctagggatcagctttctgcccagcacactctctgattcttatgtgcactgctgggttaaagctttctttttctgaagatgccgctaaggatttgtgcatggggcttctgggccggtgtttcctggcatggtccttgtaaattcagtctgtgcattttaccctgaagcccctgcaggcctacgaggtcagtgcaggcccttgcctccagaggggttggcagaagatgtggggctaatttctgaagctaaaaacacctttgcaaaaattgtagtagtaagggaaatcgaacatacctgacttcatcttgcttctaccaggctagtttgcttttgctcattcttgtgcggaggccatagcagccccttcctggagctgttcccttctttgtttggaaattgcaatcgtatctgtaaagactaacaaaaggtaacaaggttagaatgatgctagaggcctacaacttcgctaaagaataggttgaactataaccatccattgcttgtttagtttgcttttctatatgttgcttactgccccagagtcacataactggaggtcgtgatatttgtaacttccccaactgctcctatggataacttcactattgtgaaacctaaaagactggtctttgagatgtttttcagatttagcatttcaggagatcaagagatgccacatgatcctgaaatcccctcccaggaactgactcagctgttcaaagacagtttagagacccctgtgattttgtccccagccaatcaattgtttcagtttcccagccctctgcctgctgttttcaagtacacttaaaaaccctagcttctgaattcttggggaggcagatttgaaaaacatctcccatccttttgtttagttaccttgtgataattaaaccctttctctacagcaacactgctgtctcaatgttctggcttcatcttgcagtgggcaagaagaacccctttgggctgtaacaagactccagcaggaaaggggcagaagcccctcatattgatgccatgggcttttcctgatccccctcttgccttaactctgcctggtcttagatctttgccttataccctgtgccatgtttgtgaccatggaggccactgtgctatagtggaaggatctgggctcagggtccagtcctgtgactttcagctctgtggctttgtgagaaagttgttttccctctctg

SEQ ID NO: 474909 - DNA, 1154 bp, Homo sapiens
gagctctgagagctgtctctggtgcagtgagacttcagatagggacactatattgtgaaggcgaggcctgggctcctccaaagccagggctctgggcctgtaagctcatgaatcctgccagggagtttttctgccgccccagagagcctctcattaggctatagccatgccctcctctcagagctttgcacggatgggatggctcccttcatcgttcgggtctctgcgcgcttgtcactgccagccttccctgaacacctttctgacagctgctgcccagactcctgtcctgctacagcccctccaggccgttggtctggtcggcttcctggaggagctgctccctggggctgtgctggcagggcggaaacacaggggtggaggggcagctgcagacacagccaagaccagcatctcccgccaggcccagctgctgtctgctgggcttgaattccaccctttgcagtggccctgcactgtagatgtgtcggccactcctggcttctgccgcaagtgccttggcgataagttccagctcttgagggtcctcagctcagtgccttccatgtgctaggtgctcagtatgtgatgcttcccttctacttcctgccctctcttatggaggcttggctttgtaaagcttaactctcctgtattagactgagacttaagagcatgatctctggatttaggcttcctgtattcaaatcccggctctgggacttactatcgggttgatgttgaataagtcatttagccatttttctgcctctgtttcttcctctataaaatggggataataatggtacccacctaacagtctcatgaggaggactaagcaaatgtatgtatagtcgtggtaaactcccagcacacagtgagtctagagaagggttgctttactctgatcagttcatgcctctccccagccctctgaacacacccatcagaagggtacaaatatcaggcagtcaatgcctgccatgatttgacagatgactttgagagattgtttttcaattcccagggccccctaggtatccttaccagtcatgtatgacttcgaatgagctctcgtcttaccttgacaacccagagaacagatccttttttggggtgggaaggtggataagcagcttagaggatgggagtac

SEQ ID NO: 474910 - DNA, 565 bp, Homo sapiens
gtcctttgggtcttggttcttttgtcggccccatgagtgggttggatctttgtgaccgtgacctgtggcatggatgacacagagcagtgtgtgatgatgcagaggccaggggccagggtctatccacacacagtttcacacatgcatgctcatgccccgtgcacgtgcaagaacatgtgtctgaatgtgtgggcccacgtgtgcatgtgcatgcgttttgctcaacctccagactatggccccacatggcctatgggcgctcagacaatccagccacaactacgattaggcagaggggatccaagagactatggacccagactcccaccttcccccattactgtccctttggtggtgctggtcagccccttgtccttgatgcaaggtggaagagacaaaaataaagtgtataactgtcagaagcattatggaactgtcaaaggtaaatgaagtcattcccgtgaattattaataagtcacgagcctacctattcaatgacagtataaaaaagaaaaaatatttatcaaaaaaattttttaaaaattagggtggacaaagtggctc

SEQ ID NO: 474911 - DNA, 2603 bp, Homo sapiens
gcagtagtaaaaagagctatttcccccaagccattttagcggggaaaaaataggaacatcacagaaatgatgctgtgttctcattgcgtcctagtgggtagcacacaatttctctttgccgcattactggtgcaggaaccttattatatgctcaatttcttagtgattgctttagagcatacaacttataactttgaatttatcacagtctatattcaaggtgaggaactgtgcagggcacccaggtgtgacccaaccatgtccattgttcctctctgtccctttgatggacagcctgtacccacgacactctttccagatgctgcctgcatcctagttccctgtcctatcacctctgcatggaaagatgtggagttggccacattgatcccaacaccaatgggatcacctgaggatggatctggccccatcccagactgcctgagtcactctgggcctgaacccaggaagagttaaccatctggagactgtagattgtaacaatttccttgggtgacttccaggcaggctaaagtgtaagaaagggtgccatgaatcagcaaaacagccagcacttcaacttgcaacctgagcatcccacaggggtcccagccatcgtagtgccagctacatttgctgaagtgtgaggcctggactgcaggcaggctccaggccaacccttccttgcatgacttgctcagggatctgtatgacatgctggtgccattctctccattttacagatgagggaccagaggcccagagcactgaagtacctagctaaaaagctggaacaccatattaccctgcctccctgacagctttcctccatccaagtggcccaactgtggttcagaaaatacagcctcattaaagacaggtgcttgaaaccatggcctggaagtggtaatctggttgagctcactttgctggatggtgaaagagcccagcctgccctgccctgcccttccttctttttccctctcctctcttctcctctcctctcctctcctctcctctcctctcctctcccctcccctctcccctcccctcctttcttttcttctttttcccttcctctcgtctccccctcccctcccctcccctcctgtcccattcccttcccttcctttccctcccctcccctcttctcccctcctttctttccttccttccttcctccctccctctctctctctttcctattttctttctctcgttctttcccgagtcattgattcaacagaacagcccactgtggttattggaatgcactgggagagacacaatgtgcttccagctccaaaggaaagatgagaagaatcagagaacacagaggccagaaaggcctggcgaggagctcaaacagggacctatcagggctggtgtccggtgtgagggggtttgagcctctgagaggtccagacaaagccatcttgcgcctaggcgcttgtctgtaaacgcgggatctttgcttagtggctaagaatgtgcctgctgggctgagtctaagacctggagatgcacccagaaatcagtgtctggttgccctgaaacatgtgttgagaaggagagcctcagggtggcactgatgtttggcggataggttcagagatctgcatgggactcccagttaagcccctttgctgtgtgagcattcatcaacccccagccctctctgagcctcagtgttacctgtgtgatgttggattggaactggttgcttactaagggtcttctagttctagactttaaagtcttaacctcctggcctgacatagggtaggtgcttaataaatacgccatgaagaaatacatttgcttttacacaaggtttctcctcttcctttgctggaactgaggttggtgcagtgttcagctccttctttccataccattccaaccaactatcataccaccaactccgatcaggctctttctctagctcctgtcagcagtctccaccttccaggtacaccacctggctgactgtcccagcctccccctcccccaccctccttcccaacactcagagtcttgtccccttcaatccagcccctgcagtacagccagagggggcttcccaagacataactaaaactacgttcctccctgcaaacctttcccccgcactcctgcgtttggcctaaaccaccctcccagtgctttcccatcattctctccaaagcctggccctgagggttaagttaagaggagcagggcagggtgaggccagaccacctgtgggcccctttctcagccagctcacctctcagcagtgtggagaaaggaggatgcactgggcccacacacatgttgtggacatcagtagccccaccctgcgtgcaggaaatgtcacagtgccataactgactcgaggggagggcagtgggggacaggtgcagggaaggtctttgctcccccttttgtggccaacccgaagacacagtagcctagatcagcaggaagagcaaccagtaggaagctaaaaccctgtttgttgtggccgtgccactgaccagttgtgagctggaatgagccctcagcctctctgaacctcagcttcctcatttgcaaaaggggctggcatcattcacccctct

SEQ ID NO: 474912 - DNA, 1512 bp, Homo sapiens
ggaaatgacgacaaaacccagccatggcgccaggaagaggccccctctgcatacagtctggtgggaacagcatcatcttcagtcctcctccatctgtaccactcttctccacacctctgtgcgaggtcattccttcccccaggggtactattggcaacagaggagatggcagagggtcctcacagcaagcctgtgatgtggctaaataccacttcctttcccctacaaggtggctactcattaatgaagccagatctcaaatccgttccttgggttttcagttccaagctgctctcactgctgtggtagccactctgggtagcgggaagcccactggtatgaagatgttgctatcagctacttcctggcttcatgaggttgggagactggaaaacagtgaaatgttaggccctgataagggggaggttgtgagaagaacaaggagtacccaaaaaagtaaaactgggcctcagtatctgttgtccagttgtcactatgtttcgcagaagtgattgctgttcagtgtttctcagaaactcatggtaggctgtcaactcgtgattaacttgaaaaatctgcttttggcgctatttggagaaatgaactgttgaagtgaacatctagcagtcataatatagaactgggtgaaccatgaaggtgtactaatttggtttggttagtcattcgtgctatagaaatatctccagttccttactctctagccacatgataaattgaattggtttacctcttttgacattagtcatagccacatgccttactttggccaatgagctttgaaaagtgacatgtgtcatttctggatggaagctttaataaccaccatgctgtttgctatttttccccatttcttctcttggcaatcaaggcagcatggagatggaacctccctcagtctggttctctgagtgagaatgacacagggcagagctcacagccaacccatgatggacatgtagcatcagtgagaagtaagcctttgttttaagctatggcacactggtcatgtttgttactgagcataactcagtccattctaacagatgccagtagggcatggactgaaataatcacaacttgtttggagatgtttttgagtcttttcattccttcaagaatgatgccaaaaatgttagtgtttgaggtattacgaacacaaaatgggggagagacacagctctgcaaggtaatggctagtctccctactgtgcatggcatttgttgacttctccagtttcaccctgtcctcatctctccatgctatgcctgacaagtccacaacatctttgaaatgggacacttgtttgcacatctccaggcctttactcatgctctgcctagaatgggacatatcgcaggaaatcatgttatttgttgagtggcttgggtggagacaagcgtgtgggggagaggggagcattgggctttttctgtgaggcacagaaggcagaacacttaggacagagagtgagattcctgtgcaatgtgaac

SEQ ID NO: 474913 - DNA, 1307 bp, Homo sapiens
cgacgaataaagtggttacttaataggtggttatggatttgaagcttctgtggctgcccactgctcccttttgggtgttccccattcctctgttcaccctaccctcactgaggacctactttgtggacctgcctgcccaagcccacctcggggtggagggtgcgcagcaatgcttggattgcacagcagcaaaggcaagcttcatacctggttctgactcctaccaaaaccctcatgtgccccgccacccacaagctccagactactctaaaagaggctcagaatggctaacggtggtagagctcatagaatatatggagatctgcaccaggacccgtctggtcccagcgagcacacttattggcttgacttcagaatacagttttattcctgccgttagatacctgcttttgctggaaaacaagcctcaggcctttgccgtttacagagtgcctcatttgatcctcacagcaaccccagggattaaacagtggggacttagcacacccgttttacagatgaggaaatgttctctgagaagaacctcagagaaggagaacatcatcggtggcctggatttagagagtatctctgatcgccctacattgccaatcatccattcatataacaagtacattctgagcatctactgtgtgcctgaacatcatgaattctctataccaaattgcaaattctcaaagacagggactgggtcagcagagtagttcagtttgcaggctttggagcctgtaggtttgaatactggtttctccatttactagctgcacgacttagagcaagttccttaacattgataagtctcagtttccccctctgttaaatgggcctaataataataggacctgcatcttatagtgtggtgtgaaaattatagtctgaatgtagtagataaccaatcattgttaccaagtagtaagtgcttagtcaatgttacctgttgtgaagtctgtttttcatacttgtatcttgaggaccaaccacagtgcctgcacccagtgggcgttcagtgaatgtttgcatgaacaggaaagccatacatcccagggagctatgctcaggacgaatgtgtaaaaggtttctattaatcaatgagaggatcagtaaccaccaccctggcccttacatttgggggacaccaaaggagacctaatgtcccccgggtcctagcctctgacttgtgtgctgagtatggattcactgttcatcctctggatgaagatgccaaggcatcaggacacgatggcctgcccaaggtcactccactggtgaggaccagagctgacatg

SEQ ID NO: 474914 - DNA, 2263 bp, Homo sapiens
agctcatgcccaactcttcagccacaccaagctactcactgttcctcctcgtaccagtcagactgccatgggactcctcttgatgtcctgccagcctgaggagccctcctcactgcctctagcccctggagggccgtcaatggatgtaagctacaatgtgctcgaatccagcccccagaagccccttctgttggggagtgtatcacagggggcagtcctggagacccaggtggagggtattgcattccttcaggcggatggcgagctggcaaaggaggtggtagcagagggaaggatgtgcaaggtgctagatatagaatctacaggatttgaggccagctccagtgcctgctcctctaggaaccccagctcctgggtctcactccagccagacctctccaggagctctgtccacctttcctgcatcggctttcctaccagaaggctctcctgcctccttccatcatgctgcagcaggggcacaaactccctgggaatctagcttcgtccaggcagcccagatgccgcaaaggcgaggctgcctatttccttgattcacagacactgaatcttctgcctcccttttccacttttaaaggtccttgtattccattggcccacccagatcatccagggtgatctcccctgtcttaaagtcagcggtgagacaccttcactccatctgcaccctcatttccctttgccataagctgacatattcacaggctctgggggtttggatgtgggtgtctttgtgcagccattattctgccttccacacctggaaactgagacatttctgagaggccttgggcaagctgtctcccctttttggacccagttttttctcttctgtgaaatggtgtggctgctttgaaaacaaagtgagaggatgagtgttcaggtgggttacaaagggtcaagcgccatacatggggttaattctttattcctggggtatttctattgccagcaatggcagctggcagcctctcaccgggccctcatgccttcctatgccttgttctgaaaagctgcagcccccacccccgccccactagacccccagaaaacaaacgtgggtctgtgtaccgctcctgctcattataatctcttgcttcttttcacaaaaccccaggggcccctgggatttgggagctgggggatgtcactcaaggatgcctattgagtgctaaacaatggccccctcatgaggtcatagggccgcttagcaaccacccaggcccttagtaacgggcccagaagtgttgatatttacccaacagaaactttggattatctcgataacacccagttccttccagagagctgcaggcactaaaagcaagctccacccactccgagctgctgctctggctcttccaagagcaggcctatggaggggcagggagtcctgggtttcccccccagctctgcaatcctctgagggcctcagtttcccccacaacatggggatcagactaaataagtactaaatatttaagtagtatgactgtatgtccctgctggcccagaacagttccattttatcaagactattaaaagaggcgttttcattctcaagagttggaacatcaaccttctggtcacccacctctaaaaggccacttccagccctcaatcccattgttcttcccctccaccctctttcccagtctgaattaatcctgaatagtttcacctagctttttcaaggtccctctctgtgtcaggcatggaacagggcgctgaggaaactgaggcaaaccagacgtggtccctgctttcaggagcttccagtccgggaaagaacaccgcttaaacactctgcagaaatctaggtctgaatctagaaccttgcaattctcagacttatttgtgttgtcttcactaagctattttagtaaataataatactccatagaattccggtggcattttgcagtttctaaagcatttctgttatgttccctcatttaaccctgacatcatctgaaggtgtgattttaatatattcccattgcacagatggggaactggaggctggaggccatagaggacagagcagttggatgcccttgaggagcaattcaatctctgcctccttgccttcgaaatggagatgttagctcccacttcatagaactgttatggaaagtaaatgagacagcacatagaaagtcctttggaaagtgacagctgcctaaaatgagtgtttctgccctgagctgtctgtggcctcagcagttgcacttcctggatg

SEQ ID NO: 474915 - DNA, 1534 bp, Homo sapiens
gagcatcctttagagagaagatgatgcatctttgttattatataacaaaacaggttgaattccatggtgaaaattccactacctggtttccactgatgggcatgggaagcctttgtcaacccatttcaggaggaggagaggagcgacgtcaccgcctctccctgaggatggcttgtggatggctctcctcaacctccttccccacctatgcctgtcaaaagctgctgggtttagatgctcaagtttctgttctgtattatgggtcatttaatattcaagagatggcattaaataaatatgtgagcaattatgtaatgtgtttggaaacaatctggttcgtcccaaagtgcttgggcaagaaaccaaactttagcgaagcaagaggtctgggtggtgtctgaaggctgaacagggaggcatgtggcccatctgcttgtttgctccctccctgagttgagtctgtggttactcatcttcaggcaggcacaaaggcagtaggaagccagtgatgcttgcttgcacagttagaagctcagggttgcatgctggctgcaaagtttcttctctctgggcatcagttttctcatttgtgaaaagggctaatggcggctactgggaaggtcagatgagatggcaactctaagctctggctccgaggacaagcttgtgcaacaattccctggagattcctctaggtggttgtgtgtaacaagagttcgctcctttttattgttgggtagtattccctacgtggatgcattacaggttgtttaactatcaatcagtgaaaggacatctgtgttactcctagttgtggggtattataaacatttatgtaaggttttttgtgtgaacaaattgttttcatttgtttggaataaatgcccaagagtgcaattgttgggttgtatggcagttgatttttcttttttcttttttttttaagaaactgtcaaactgttttccagtatggtaaatgactgtagcattttacattcccaccagcaatgtacaagtggatccaatttctctgcatcttcatcgacatttggtgttgtcactattttctattttagccattctgataggtgtgtaataatatctaattgagggtttattttgcatttccctaatgactaatgatgttgcacatcttttcacgtgcttatttgtcatctatatatactctttgttgagatgtcttttgcccatttttaaattggatttttaaattgctgagttttgagacttttttgtatatgttagataccagtacctcatcggttttgtggtttgcaaatattttcttctagtccatagcttagctttttatccttgtcacaggattttttttttttttgtctttttatccttgtcacaggatttttttgcctgttttatggatttgctttcctcttcttcttcttctgcttctcttcttcttcttcttcctcttcctgtctttcttcctctccttcctccttcctcctcctcctcctctttctccttctccttcttttcctcctcctcctcc

SEQ ID NO: 474916 - DNA, 746 bp, Homo sapiens
ctcactccactctctgtgccagcactgatgctgcctgccttgcatgtggagacttctggaccaggatacctgcctagcaagtggcaggactgggatcgaatgcaggggtttttctcacatcatacaactgctattggtgggtgcagggacatctgacttcacctcctcataccctttaccatatacatttggctgcagcccagtttttcaggtccccaccctgatccctcatggtcactgggacatgctgctcttcctaaaatcagccctaacagataaaactctattcccaacctcaaaggaagctccaagccatggtttctggattctggaattgaagagagctgatagatgcactggactcttcaaagtgaaggtcacagatgtggatagtgagggtaaagagaggccaagagtgaaaggctcttgagccactgcttgtgcaaacaggtgggctggcagctgctgacagtgacaatggctggtttttattgtttaatcctccacaagtgtcatattccatcctcatcacaagctgtacaaaaaaaaaaaaaaaataaaagaaagtgaactggcaggactagactggagggaatctacaaaccagctacttgtgagagcagcccactgaaaatacatttgtttgttttgctcagagcttaaaataaaattgcattaaatgccaatgtttaaaaatggggggattgtgcataagaatccagatttctgtcttctcttaaaatatc

SEQ ID NO: 474917 - DNA, 1230 bp, Homo sapiens
gccacagctgccagagagccctggacactgtagagggctgtgcacgaaggtgtgattggcatcaggatcaggagccggagcagggtcagagagttccagatatgtggccagagaccacggctggcaggaccaggagggcaagtgaccaggcccgagcaggggccacagctcaggttcctaaagaaacagaggtccctggggcaagcctgcaaagaaggggcagccgggagctctagctcccagcagctggggtgtggaagctgcagaccgaaggtggcctttcagcagagacctgagggagcctcatggctgtttggggcgagggtttcagactaaggaatggccagtgcaaaggccctgacatggggacatgctcagcacacaagacccagactgagccctcaaccagcccctttcacagagggggtctgcgtcagtgcaaaggaaacagcttcagcccatttcacagctgaggaaactgaggctcagcactgtgaaggaatctgcgcagacgtgagctggtacccagatgcagaactaagtgttcaggtcactctctcctgccctggaagtctctggtccctggagatgcctccagagtttccaggaactcagtttttctgcacccctcctggactcatccccagggaccttgggaaacccaaagccagggccagcaccatcacgatgcttcagaccttagacagcaccccgccaatgctgcctgtcacagcagagatggactcagagaggcctagtcgttgctcaagaattaagcccgcagagaattccccagtaagaggcttccaggtagatcgctcatcagactcaggatattctggtttggaaatccaggctgcccctcaggaagggattccagccactcagggccaggagccaggattgccttctgctctcagtgctcggggtgatctggcagcttatggagagaagactgaggcccagataccccaggagggtttggctgtatttgggagtgtggctgggatcaaggtcaaggtcatttatggagcgcctatttggtgctcgacactttcatatgcatcatcttttctaatccagcaacgctgtcggaatacagtagtgatgaaaacgtagacacaggccttagtgaaaggagacagacagtaagtatatatataatatgcataatagctataactgttattttttaaattattgcagagtctgggcctaggaggtggtgat

SEQ ID NO: 474918 - DNA, 1079 bp, Homo sapiens
ccgtgcaagtgattatgatgaaggacgtaactgaacaagcttccctttgccttctctcaacccagaaaacaccaaatcggtaaaatgcaggatggcaatgtggacgccagccagagcaaagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaaggtgagaggggaggagagcaggaccagccggctgatgcagctgcagctgagggcctgggggaatcactggggctggtgctggggttgggagatgaacgaagaagccccatagaccccctaggagcttggaagaagaatgtatgcaggaccccaaaactctgacgctttcatagagtccaggggcctgtagcaaaccagagagccataccctggctgaagaggcagctgttattcagcccagccacacgccgccttgcaggggtgcaggcccagcattgccacattgtcacctttttccaagagaagccagaaatctggacttaatgtagactctcgtgatttttagacattgataatcaactcaaaaattttaaaaaaataataaagacatcaccgtgcaagccagaattcatccttaccccaccaaatttacgtagaagtctggcggtctcagtcgtaggccccgcgggcaactgtagcgcttgtaaaactcatcacagaggtggctccctgaagtgtgaggggtaagccaaaaacaaaaaggaagtctgatttcatagaagcctcctccccttgggaaagagg

SEQ ID NO: 474919 - DNA, 994 bp, Homo sapiens
ggagcagtatgaagaagaggtgagaacgacccccggaccgaccaaagcccgtgcgccgctgtgtcccgcgtccagcacctacgtcccgccgccgtcgccatcgccgcggccaccatgcccaagagaaaggctgaaggagatgctaaaggagataaagccaaggtgaaggacgaaccgcagagaagatccgctaggttgtctgctaaacctgctcctccaaagccagagcccaagcctaaaaaggcctctgcaaagaagggagagaaggtacccaaagggaaaaagggaaaggctgatgctggcaaggaggggaataaccctgcagaaaatggagatgccaaaacagaccagtcacagaaagctgaaggtgctggagatgccaagtttgatctccactttggcacagacatcatcatgctgtatcgtctctcacccagctggctgcacctattccctgactcgctggtccctatggcatcaggcagagctggcaaaggaaacggtacttccttaatccatggatacactgcttcagacaagtttgccctttctcaactctgaaaggaacggaagagagaaggcaggggcccacctagtgtgcctgggaaacacagggatgggtttcctgttcctgcaaatgttcttggcgtgcctttagatcccccatgattcacccactctgccctgcatttccttacttctttggcttaatcatgccagtttctccttctagaatgccgagcctctaatatctttccccccatgtggctgaacatcctcttttctcaccccactctcctctggactccagggcaacttgtaattgaggcgaagccaattagtaattttactccctgcccctgagtcaataactgagggcttagttattgattcagagaggagtgtatgagccaactcagttcaataagagttagtcccaggaattattggtgaggagagactcttagctggggttgttaagctgctttaacat

SEQ ID NO: 474920 - DNA, 729 bp, Homo sapiens
tgcccattttacagaggagaaaagtgaggtgcagcgaggtgaaatgacttgcccagggccacagaaccagtacctggtgtggtcgagaacctgctcctctctcagcctgggtgagcatgctcagggcagtgggggtctgagccaaatttatctgatgtcctccagcaatgtgtgcagcatgggaagggaagggcagccttgctcagacaccatttccctccccactctacccccacaacccccaaacccccggcaggtatctggcttagatttgtcctccctggagccaggaaggcaactcaattacttttcaggggaagataagccccagaggctgatggtgtcacagccatggcactgcagggtgacaaaaggtggacctcgtggaaaatgggaaacacagggggcccctgccacaggagcagaatgcaaaggtggccagcacacagtgggaaagcaaaccctgaggttcacccccttctgcgtggggcaggaagcagaacccaggccacctccacaggctgctgccctgcttccgcactgccctccactacccccaactctgctcattccagcatgcacagggtgctcagtaagtgctcctttctgatcttctcatgctctgattgtgggggttgtgtgccccagttcctggctcttccagagaagtgtggagaggctcttgcccacaaaaggcaaagccaaggactgcaagcattcacagagtag

SEQ ID NO: 474921 - DNA, 822 bp, Homo sapiens
ctgggctcttgacgggcatcatctcttaatcctcagaacatcccagggagaccactttgtctcccatcaatggccctgtcctctccagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaaggtagaaactctgggccttgatagacatgatgcggaacaagagagttcagaggtgcctgagaagtaaagctaccaaagccatgcatcatcttccttccccaaccctgcccagtctgctgtctgctccatcagtgcctccagaca

SEQ ID NO: 474922 - DNA, 2119 bp, Homo sapiens
gcatcccagtccttgctggcacagctccagtgcccctctccattttcctcggccatatccctcttcattgccgtgttgaccagtcccaccaagtatctcgccctcattccaggacaccacagcctcctcgctggtctctgggcctctggcaagctcttctctccctcttgtctccttgacagacttgactcacccttcaaggccctgatctcatgttacctccaccaaagcactctttcagattccccagcagaaagttagtcagtctctcctttgtgctgccacaacactttgatctctctctttcacttcacttatctgatttcttaaaaatttatctgaaaaagagttcatacagacagcagtaaattcaagcaatacaaaaggtaattccctgtcacccgtgacctgaaggctcctaattctctcgagaggcaattgctgtgacctgagacaatctgtgtacgtattctgcaccttctatcttgggaattatttcagattggcttctgtgtgtgtgtcttagttctttttggacctgtctcccttactagagtgtgaagtacaggttttatcttcgttgtactttcttacctacacctgacactgggcttggccttggactagggacttgagagagatataagataggtaagtgaatgaatgaatgaagcatggctggccagtgcttacccactcagggttgggtgccatcttttccacagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagcatccagtctttgaatgtctgttacagtggggaggaaggaaccagtgtgggtgggtccaggtttcttaggggtcaccacactgccctccacagtgtcgacctctgcctaagtactttgaaatgtgctcatcgggactgggggctgcagaaggatgtatatgtatacgcatccaaaaaatctggaagaattgtactaaaaatgtgaacactggttgtctctggttggtgggggcccggctgagagtgttgtgttattcttgcctccctc

SEQ ID NO: 474923 - DNA, 1621 bp, Homo sapiens
ttgatgtcttaaatacactatagcttgagaaccgctgctgcaggccatggggagccagagaaggtttacagcagaggaacaatccaggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccagatgatgatgatggtggtgatgatgttgatgatggtgatgatgatgatgatgataatgatgctggagactacgttgatgccccattgagcatccccgacttcctgactcactctctgaacattgactggagccagtatcaggatgggctcatccacacgtccctgaagcccactgagatcctctacctcactgtggcctatgactggttcctcttcgggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagccactcttgtgtcatcatttggttattgtctttgtggagctactaggaaggttctcattgtccttcctt

SEQ ID NO: 474924 - DNA, 1027 bp, Homo sapiens
ccagcagatcatgcagtgagaacccacttagaggagcagacagcccatcttggtgggtggagcagtatcctagagggagggggtagggcataggctccagtaccataaaggggactgctcagctgggtctagaggacgagctaacttccagataaaaacagccttgagaatgcaaggcatctacagagaaccaaagatgtacctcctggctgcagccaagatctctgatggctcccagtactatgttctgctcatcatcactgatggggtcatctctgacatgacgcagaccaaggaggccatcgtcagcgcctcctcattgcccatgtctatcattatcgtcggtgtaggaccagccatgtttgaggcaatggaagagttggacggtgatgatgtgcgcgtgtcctctaggggacgctacgcagagcgggacatcgttcagcaagccttcaatgccacggctgtggtgcggcacatgaggaaactgcagctgggcaccagccaggaggggcaggggcagacggcgagccatggggagctgctgacaccagtggctgggggtgaggagcgggctctgcagaagggcatgggtggtccacaaaggtgcacccgggctggagtggagggcctgcccctgcggccacctctgttctgtcttcccatgcagggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccatccttagcgctgtctccctcaatatcccccaccccatcttgttgtgcaaactgactgcttgatttgggggtgcctggcctttgag

SEQ ID NO: 474925 - DNA, 1467 bp, Homo sapiens
ggtttgtggtttttaagcagagagagaaaggaaatgtccttgggttccaaatgtggaaagttgtgcagagactctcaaggagaaagaagttttccgctttccaaagctgcatttgtcactcgctgttgtatcgtaactgaaagtaatgaactttccgatgctactgtccagaaggaggaagctaagacctcactgagcctgtggctccggccgctgagtgatggtcccttctgtctgccagggtgggatcgggcactcatccagttgcaggtgcgagcactattgagtagcacagggtctcaagctgtggccatggacttgggcaacaggaaattagaaatatcctctggaaagctggccagatttgcaaatggctctgctgtaatacagtcaggtgacactgcggtaatggccacagccgtcagtaaaacaaaaccttccccttcccagtttatgcctttggtggttgactacggacaaaaggctgctgcagtaggaatgactgatggagaatgtgttgttaacccaacaagaaaagaaatgtcttctagtactttaaatgtagtggttgctggagcacctaaaagtcagactgtcatgttggaagcctctgcagagaacattttacagcaggacttttgccacgctatcaaagtgggagtgaaatatacccagcaaataattcagggcatccagcagctggtaaaagaaattggtgttaccaagaggacacctcagaagttatttaccccttcacaagagattgtgaaacatgctcataaactcactatggagagactctatgcagtttttacagattatgaacatgataaaatttccagagatgaagctgttaacaaaataagattagatacagaggaacaactaaaagaaatatttccagaggtcgatctatatgagataatagaatccttcaatactgttgcaaagaaagtttttagaagtattattttgaatgaatacaaaagatgcgatggtcgggatttgactttacttcggaatataagttgtgaggtagatatgtttaaaacccttcatggatcagaattatttcaaagaggacaaacacagctgctttgtgctgttacatttgattcattagaatccagtattaagttggatcgagttataacaactataaatgggataaaagataaaaatttcatgctgcactatgagtttcctccttatgcaactaatgaaattgtcaaagtcaccggtataaatagaagagaacttgggcctgatgctcttgctgagaaagctttgtatcctgttattcccaaagattttccttttgccataagagttacatctgaagtcctagagtcaaatgggtcatcttctatggcatctgcatgtggtggaagtttagcattaatggattcagggcttccaatttaatctgctgtcacaggtgtagcaatgggattggccaccaaaacc

SEQ ID NO: 474926 - DNA, 1081 bp, Homo sapiens
tggaatcttctctcctccctctttttgtcgtcttttaataagggagtgttctcactcacttccccgtgagggtgatgaatatgttcactttcctgatcatggtgatgacttcatgggtgaatacatattttaaaatacatcaaatgatacacattgcctctgtgcggtctagtgagggtcctgagatggggagagcctcacctctgcctctcaacctgggcatcaactttaaacagattgccagcaagaacaaaagccatggggagtttggaaaaaaacaactgatacctgattcccaaccccaggggttcttgtttaattggtatggagagctgcctggagaggttgaaaagctccccaggtgtcgctcatgtacagcacggttgcagaactctcaagcagtggttctcaaacttccctgggtgcctaaatcgcctggaggtcttgttaagacagtgatttgtgaacgtcccagcagtgttcgtgaatcagtacatctgggggtcaggggttgaggttgagaatttacccttataacgagctcacaggtaatgctggtggtgacccaacgaccacattttaagaactattctatgatcctttactatgtacttaatcagcacatcgaaatagcattttaagtgttccattagtaaaaatatggttttatacttctcccaggttaatgggaaaaatgttctagtgaatctacccatttggggaaattgagccaaattcaagcaaattaaatattacccaacataatcgatgtccagacaatttatcttgcatttcgtagatcaagtctttcaagagccccaattatgtaattatgtgggaacagttgaaaaaaatatttgttattgtatcgtcatacctcggagacatcacagggttggttctagactagtacaataaagtcaatattaccataaaatgagtcatgtgaattttggtttcccagcatatataaaagttatgtttatactatactgtagcctattaagtgtgcagtagcattatgcctaaagtaacaatgtacgtatcttaattaaaaataccttattgctaaaaaatcttc

SEQ ID NO: 474927 - DNA, 1713 bp, Homo sapiens
ctggcacagaaggaagaagcaggtgctatgaccctgggagatgggggtcttatctataagcccctgactggggctgctgcctttttttcagagatgccctgcccagagaggaggaatctagagaggcagtctggccacaaatgccttgctgagctgtggtgggctccacccagttcaaacttccaggcggctttgtttacactattgctgtgctggcagcgagaatttcaagccatacatctcagcttgctgggctccgtgggggtgggacctgctgagccagaccacttggctccctggcttcagccccctttccaagggagtgaaccattccaggtgccactgggttatgaaaaaaaattcccacagctggttcagtgtctgcccaaacggccacccagttttgtgcttgaaacccagggccctggtggtgtaggcaccagagggaatctcctgagccggtagtaattgttttatagatttgggacctccagtgttcagttcatatatatttatgattgtgatcttttcctttgggactagtctttttatcattatataatgtccctgtttgtcttttttaactgttgttgctttaaagtctgttttgtctgatataagagtagctactcctgctcacttttggtgtccatttgcctggaatacctttttccatctttttacctgaagcttatatctataaacgtatgctttgtatatttcagtgttttcatgttgcctgcatatacattgacagttgttatgtcttcttgatgaattgactccttctttgtctcttgtggcactttttgttgtaaagtatattttttcagatattagtgtagctactcctgctcttttttggtttctatttatatgtaatctctttttccatcccttctctttcagtctatgtatgtccttacaggtgaaattagctttgtaggcagaatatagttgggttttgttttgttatttacctagctactctgtgtctttagattagcatacttagtccatttacatttaaagtaataattgataggtaaagatatatactatcgccatcttactaattttttggttgcttttgtagatcctttgtttctttcttcctctcctgctgtcttcctttgtgatttggtgattttctgtagtggtatgcttttattcctttttttttttttttttacttttgtatatgctataggtttttgctttgtggttaccatggtgcttatgcaaaacatcttttggctacacaagaccattttaagctgataacaactctgactgcatacaaagtgcctgcacttttactgctcctccccaattttacatctttgatttcacagtttacatctttttatattgtgtatacattcacaagttaatattaacagttaattttaatgcttttgtcttatgtcttttaacctttatactagagttaaaagtgatttacataccaccatggcagtactagagtattttgaatttcactaaatgtttactggtgagaaaacatactttcatatgttttcatattacttaccagtggtctttcatttcaccttcaataattttctttagcatttcttgtaaagcaagtctggtggtgattaatttcctcagcttctgtttgcctgggaaagtctttatccctcttttctaaagcacaggttttctgggtcaagtattcttggctggcag

SEQ ID NO: 474928 - DNA, 785 bp, Homo sapiens
tttggactggggttgcaatggttgaagtttaaagcaggagatgttgccacattgttccgatgcaggtaggagtgatgtagcagggaaagaaaatgtatctaatgcaggagagaggagtaaaacgatagctagagtgaagttcttgagtgggaagaaggtggaggaggaggagaaagaggaggagaagggcaagcaggaacaaaggaaaagaaaagatctgagtttatactcccatatgacaacagtggatttgaaaagtttacagaacaaagatgaattcaatttggttggcattatagtggtgtttgaggacttgaaagtgatgctaggaacccagatatgggtaaggagagggagcctgaaaaaggtaatgagagaaagtagagggagtaagctggaagtacagggactgcttcctgaggaaagtgaccagtcgtccaaagcacagttgacaaacctaggacccagccaggcaaatgtcaatagccaaggagaggatcccctgccatcaagaaactcagatttaattgacctggggtgagcgccaaagaaccactgacacagaaagtacagtacatgtttccagtttttctgctatatacaaataaaagggcgcattctaggcaacaagcctctaattctgcagccatgaacatcactatggaaatccttaatacacttatttcagagtaaaagggaaagcttattcagagctgtcccaggtgctgattccagccctcacagtgttctctctccaactgcctgagttttttgtcaccctcttc

SEQ ID NO: 474929 - DNA, 1641 bp, Homo sapiens
cagcaggatagcagcagttcctcactgtggatgtccttgtcaaactgatgcaacaggtgggctcccacagccttgggcagctctacccctatggctttgcagggtatagcacccctcctggctgctttcacaggctggcattgagtgtctgtggcttttccaggtgcacagtacaagctgtaggtggatctaccattctgggaaagtgcaagcccacaaaatcacctgaactactcattgtcatccacaatttccacaaggataccattaaagttgctgctgcatatcttgctgaaggccagcagtcccaccctaaaggagtcctctggcccaccagtcatgaacaaaaagggatattaattttttgtgacttatttggagtgaatttagactgcttctcagaccatatgcttttcaaacccagattttgtgagcatttggcaagtattcccaaactacaactacaaaccagtcctcaagaacaccttttatacattttgcagacagtatttcagaatttcacctataactacctgaaatactaaacaaaagaaccctgatccactgtgtagagcatatgagttaagagctggaaattcagactagactgcctatgtttgaatagcagtgcaattttggacaagttacttcatctgtgactcagttttctcatctttgagaaaactcaataaacaggcattattattattgttgttatttttgcattactgttgttaatatagggcaggcaagtgcatcctgaaccaccaatagcttaaatcatggcaattaaacagtcaaacaaaaataagcatcaataaaaaggaactgacatgggagattggcagaagggaatgtatacaggaagatttaaacatctgtgcactatcatttgttacattttgaaatgaaacatattgtaaaacacccttagagcaaatgaaaatcagtctattgcttctatcaaagccaagctgtgaatacatgtttcttctgggttcctaagctcactggatcctactccacatagagtgatgtgacactaatgtcatatccttaccctcttgagtaagaacacctaagaactcagagtttataaaggggatattaactttggtgtaaaagaggttagtgctttagtttaaagaactaagtaaaacaaatggcatccttttcttctttgaacggacttcttcctcaacatgatagcagttatctccaagtgttttgagacatatttcccaccccagatacaactttaaaatcctttttgtccatttcgtacctgtcaaattaacaaagaatttaaaatgatgacaatgcctacaacagtatgaagaaatatttggcaaaatgtttcaataaactcacatatttttaaaccaaagcaattcagcttaaggttatctatcacctttattgcattctatcatttccaaaataatcttgcttaccatgttttacaatgtgtattgtatacagctttgacgaaaataaggcatttataaatgtgctcagaagctaagacccatgattctaatacaagattcaggcaaggttaatgaaaagttcattggcaaatgattttgacaccataacctgatgcttagaacatttagaggagagcttttttaatttccc

SEQ ID NO: 474930 - DNA, 483 bp, Homo sapiens
atcatgtaaacctaccctgacatctccactatgtggaaaagatcaaagaagcgatgctcagctgccacctctgccaagatagaaagcctcttgcggaagctcccaggattggggagtgttcctaatagactcaacccctgtcaggggacagaaatggtttattttgatgacaacagcctcacacgtgtgtctctacatatccaggaccccgactgccatggcggaaggcaaggaggagcaagtcacatcttacatggagggcagcaaagacaggagagagcttgtgcagagaaactctggttttcaaaaccatcagatctggtgagacacattcactatcacaagaacagcatgggaaagacctgcctccgtgattcgattgtctcccactgggcagctcccgcaacacatgagaattatgggtgcagacagggagtcaaaccatatcaaaaagtcttgtgactttcctcattcataattatt

SEQ ID NO: 474931 - DNA, 800 bp, Homo sapiens
cagcgaggagggggtcacgaatactggacagcatatctgagggtgcttttgcatccttaaaatacttgccggtctctggaggcatttctggttataacaactagtagcttctactgacatcttgccaataagcatggctatgatgcacaggactgccacccttcccagtcaaaaaagaattttctggcccctaaatgtagaacctaaattatcaggagacactgctgtgaagaatcctttcagggctctccttacctgcgataatacaactcttattgatcaaaacgtgcttccttgtggagagttgtttgttactcaccaggtgaaagaatccttgtcttttcagcaacgaaagggtttgatatgccttactgccctaggctttgtggttttggaagaaggctaccatatagtccatgcccagttggtcagaggaccatccaagtggaaaggggagagtttgggtttctggcctgcccattgcacaagcataacaatcaattttgttcagtgtgcagacagaatatttaatccattccagccaagcatttgcatcttggtaccctgtttcaatggctaaagtttgctttaaatatttaacttctacaatgtccactttggcttggtgaaagggccatgaagcccattttcagttgtttaccatacacttgagaacccaaataagtcaatgacaccattttgtgcctgcacaccagcaggagtttaacgattttgaatgaactgacaagctaatataaatgaaatgaatcaaaccagttattacttttaatggtaaagcc

SEQ ID NO: 474932 - DNA, 620 bp, Homo sapiens
aggggtgcctcctaaagggagatggagtggagagtgacccagtgcaccatgatctcaggggggcaggctggcgaacccagcaatggctcattaagactggtttcaggtcgccaatctggccctggtttatcaccactcaggaacaatggcagctttagcagttctcctcctggtctaggcttgtgctcaggtggcatcacggtcctactaatatgtgatgtcacccccataggcccagctgtaaaattcctctctttatactctttctctgtatttctcagaccagccaaacacttacagaaaatagaaagaacctacattgaaatattgggggcaggttcctccaataattgtgttcacagtgttctggtggaggctaaggaggctccacgtgggtggttgcttctctttgatcctgaatcctatgatcaatgcatgaggagcagagctgttcctactcaatctgtcctgcatgaattgactggctaacctgcacatatgtgaggaatcaatgtatattctatgctactcagatacagtgattgttttattacacaacattattgtagtaatagagaactgatacaattttcatattggtaaatttcatatggcctctt

SEQ ID NO: 474933 - DNA, 522 bp, Homo sapiens
acagacagctggacagacgtcatgacaacctgcctgcagaaaggagctacccactgcaggtctcctgagagctgttttgtctctcagttaattaagctcctcttctcctttttcaccctccagactgaaagagctgtaacacaaaccgggctgaaacacatcaccctgctcaccatgttgctggcaaggaaaaggagagaagagctgcagcccttcagggagcccacacgtaggggatccctgagccagggctctgacactctctctggggctctgtggttcctggcatctccaagcttccaggctccactgcatcccccctcatccagatgtggtgaccagcagtggaagccacatgcagtacatctggtccagccacagcttcacacggagctggcacctgtgcagatgcctggagctacttgccctggtgcagcagccaaacatggaacttgagtatggactcttgtgtaaatgaatataagtgttattaaagatgttttacttaaaacaattgaaaaa

SEQ ID NO: 474934 - DNA, 1186 bp, Homo sapiens
accccagccttcaggccctccatggtcggaaggtggagcctcgctcaggacccacctccttccacccaggaatccgtctgcttcctgctgcctttcatggcaccgaggctgagttcaggaaaaagagaaagagattcagaaagagctgtcaatgaggtaggaaaaggaggaggaggggaggaggaggaggagctggagggagatactgcagctgtaagggatacaatagacggcaagagcagatacgcagctgtaagggatacgataggcggcaagagcagatactgcagctgtaagggatacaatagacggcaagagcagatacgcagctgtaagggatacaataggcggcaagagcagatactgcagctggatacaatagacggcaagagcagatacgcagctgtaagggatacaatagacggcaagagcagatacgcagctgtaagggatacaatagacggcaagagcagatacgcagctgtaagggatacaataggcggcaagagcagatactgcagctgtaagggatacaatagacggcaagagcagatacgcagctgtaagggatacaatagacggcaagagcagatacgcagctgtaagggatacaatagacggcaagagcagatacgcagctgtaagggatacaatagacggcaagagcagatatgcagctgtaagggatacaatagacggcaagagcagatactgcagctggatacaataggcggcaagagcagatacgcagctgtaagggatacaataggcggcaagagcagatacgcagctgtaagggatacaataggcggcaagagcagatacgcagctgtaagggatacaataggcggcaagagcagatacgcagctgtaagggatacaatagacggcaagagcagatactgcagctgtaagggatacaatagacggcaagagcagatacgcagctgtaagggatacaataggcggcaagagcagatacgcagctgtttatccaaactcttccttcccacacccttgccaaataagtgatagtttgtgtttttgcatgtattactgactcttccaaaaagacatgtctcttagatttcactagtattttagttttgttcccttgctggtgaggagttgtgatcctttggaggagaagaggcattctggtttttggaattttcaggctttttcc

SEQ ID NO: 474935 - DNA, 1212 bp, Homo sapiens
gctcacaggagaaacaagtttgaccactatgctatcatgaagtttcctctgatcactgagttggccataaagaagatagaagacaacaacacacttgtgttcactgtggatgttaaagccaacaagcaccagatcaaacaggctgtgaagaagctctatgacattgatgtggccaaggtcaacaccctgattcgacctgatggagagaagaaggcatatgttcaactggctcctgattatgatgctttggatgctttggtggagcccctgcaattgctggcgccctgctcatgttaccttaggtccacgtggggctttggcggtctgtgctctcatgtcccagaggggcagtctgagccaaagtttaggtcaccaggagacctgcaagtccctggggacctgctgggcggctgtattgtaaatgtgcagctggtgtggcacctgtggtccggggctgttatccaagcagacagctgtggggactgccctgctcgcaccctgttcactgagcccccttccagcattgactccaggagcaggcccaaccagctggacttgagcggccaggcagtcagtctgggagcggcctgtgcacaagggattgtgtggatcggatgcaccctggacctgtgggagaggcagccgtgctctctcctggcccaggagtcagcagggactggagtcactcagagcaagatggagagccttgggagatggtctctggctgccttttgctgcagtcgcactgcacgccaggaaactttctgggctctgccaaggttctggctgtatctctgcctgctctctggtcaattccccctgcaaattcaaaagtctgtggaggtctagggatctcttgtagctaggatcgcagaggtcctagcaggagtgtggtcccctgcagttccttcactcaccccttccttaggacctgttcagtactgagagctggtcctggtgcttggtgactctggagaactacagttgcctattttttaggtcacttaaagttatcccagagttcaataatattctgcttattttttagtttttttttctggtctaatggtctaattctatttccacaagttcatcaacctttcactttcaactccatttctgcagctcagagtgtgtccattgagttctgcattagttctctgcttctccactgctgcctggaagcagtctccatgcagtaagctgctttaa

SEQ ID NO: 474936 - DNA, 953 bp, Homo sapiens
aggaaacggaattccctgaccccttgtgcttcctgtgtgaggcgatgcctcaccctgcttcggctcactctcagtgcactgcacccactgtcctgcacccactgtcccacaagccccaagctcaagctgctactccagagaatgtggaggcctcaactcccacgcacttcagccagccagtgactgaggagagtgagggcaccagtgccagcccattcctgcccagtgaaggattctgcataggtagcttgttcggggatctcgtcattggcttgggagagaagttttcaaacctgagctgtgtcagcttgactggcaccacaatcttcccatgttgtggatttcaaattgtttctatactgtctcaggcatcaaaacagggcttggcagcaccagaatctaacaaaaatgcaattaaaaactacttctcaaagtttccagtgggcacgcggatcatttccaagaaagatgttcagattattgctcaaggcaaaatgacttcagacggtgattttgccattgatctaacaggaaagaattccgcggatctgaacctcgggaaagagattaatagaaataaaagatagctcctaccactaccctttatcgaatgtgatcttaaaaaaaaactattttcatataatgtttggctgatatttcttagttatggtaatggttttatagagattagaatttataactaaatatattaaggtcagaaagggaaaagtaaatgtgcattagctaatatttgtgtcttattttaaaataattttcaaatgataagattgacataatgtacattgttgatatattcttaaacactgtgacatggaaatagatttttttatagttcaaaaattaaacttgaatacatcagaatggggaataggagtatctgtttaggagcttggattttgaaatttggcagtcctgggcttgaatgagaaagc

SEQ ID NO: 474937 - DNA, 548 bp, Homo sapiens
gaaagacaaatggtattccctgctgcctttttcagtatgaagaaaatttccagtgccgaagaacagctaaatgattccttttgtgtttgcctgactgtggacagcagtgaccaaagctgtgaaatcaagtcagagagaaacaggcagactcaccagttttatatcatggaatttctacatgtagtgaatcatcagatagagtcacctttcccactctccctacacattaacccgcaagctgaccctcatgtctccccctacaaccccaaaatgcatatgttcagttcattgctgtgtccaaatggtcccagtctgatcctgagtcaaatgtttcttcctctgggaatacttgttcaaatttccaaggttgagatggtcaccttctcaatctgtgttctcacctctggtttaacaattatcctgcttcaggttaagtcaggtatttaaatactcatttcatctactgcattgatcacgtcacacagatgatgtcacattcccctcaagtacatcatcaaacaaaaaatcctaaagttacaggagcttat

SEQ ID NO: 474938 - DNA, 449 bp, Homo sapiens
tcctccttgcagtcacaaagtaatgactttcggtggtagacagctcttggcctgttactgggctttggttgaaactgaacatttaactatggatcatcaagtcaccatgcaacctgaattgcctatcatgaattggatgctttctgacccatctggccataaagtgggtcacgcacagcagcactggatcatcaaacggaagtggtctatatgtgattgggctcaagcaggccctgaaggaacaagtaagttacataaggaagtggttcaaatactcactgtctccactccagccaccctggcttttctcccccagcatgcactgatggcctcatggggagttccccatgatcagttgacagaggaagagaagactagggcctggttcacaaatggttctgacaatatgcaggcaccacccaaaagtggacagctgcagcactaaagcc

SEQ ID NO: 474939 - DNA, 1193 bp, Homo sapiens
agcccatctgaatgtcattccactacctttccatgcaggggtgttggtttatgcgtgctgcagcagtgggcataatgaatataatttacccagaggacaaagcagcggtaagaggcagaggtccttttaattgggctctctcccagagaaatgcagagccactaccaatgaaagtgatcagcctatgccggggggccctccaattggtagtgggctttcgggggctattactcacaatttcctatagtggaaagcctccccttgctccatgccaatcctgggtgggcaactgtcctatgttgctcctctctgacctgtgtaggtcatattgcttctttgatgaatcccagcatgtctacctgcatatccagctgaagggccagcctttacttgctactctttctcctctgcatgagagtggtgcacatcagctgcttctagtcagccagtcttggcactctcctgtcgcttgtttagacttaagctgacccctttcattattattagtagtaattttgatgaaatacatgttactttaaaagaactgtcttcaaatttagaaactgtttcttctatacaaatcataaatacatatgctgccaaaatggctacaaagaacactagtatcagtcagtttaatgtattaaaggattcttaagtctttcatatattaaaacttattttcattctacaatggttattgttttgtgtttttcttactaaactatatcttaattttatgtcatgtaattgcattaatttttatcaaaaataattactgcagaaaaaagttactataattttaacataattattaaacttcagcttactattttaaaaactacttatttattttgctgtcagacaaaatagcacttcttatttttaggccttagttttttttttaattttattattatgatactttaagttttagggtacatgtgcacaacgtgcagtatagtttctttagaattacaagctttgttttgattaggtttatcatgttccgtaattctactttcagtctttcttatttttgtattaaagacacatctcttatcagcagaacacagttacattttgtttcagtattcaattttaaattgtttgcctacgaattgcaggattttgtccatattaacttaatgtaatagctgaactatttgagtttaaatggactattctatgaa

SEQ ID NO: 474940 - DNA, 896 bp, Homo sapiens
agacactttcgctggatagaagtggccatgagaagaccaatatacacacaaggaaggaacaatgtggcaacgaagaggctggattttgcagcttcaagggacagcaaaggtgtgcagaaaactgccaaaagctatgaagaggcaaggaaggttcctctatatacaccagagggaccattgccctgtcagcaactcgagtcaaggaagggttcctctatatacaccagagggaccattgccctgtcagcaactcgaggcaaggaagggttcctctatatacaccagagggaccattgccctgtcagcaactcgaggcaaggaagggttcctctatatacaccagagggaccattgccctgtcagcaactcgaggcaaggaagggttcctctatatacaccagagggaccattgccctgtcagcaactcgagtcaaggaagggttcctctatatacaccagagggaccattgccctgtcagcaactcgagtcaaggaagggttcctctatatacaccagagggaccattgccctgtcagcaactcgagtcaaggaagggttcctctatatacaccagagggaccattgccctgtcagcaactcgagtcaaggaagggttcctctatatacaccagagggaccattgccctgtcagcaactcgaacttggacttcaggcttccagaacagtgatccaacagcatttctgttgttttaagccactcggtctatggtactttgttatgaccatcctaagactctaatatatatatttaaatgagataatgttttcagtgttctcagtagaaaatttgataccaatgctcaatagacaatttctgcttcatatttgtagctggtatttatttttctctagcatgtgaaacaaaatgaaccag

SEQ ID NO: 474941 - DNA, 644 bp, Homo sapiens
agaaaatttaagatgacatatatggcttacaatcacctccactgggcagtgctgggctcattcaagcatgagaacatcggattccatcataggggtcttggggctcatctggtagcaacagggagtcaccagaaattccagagcaaaggagcaattcagtccgctgaaggtttaggaacaccttcagtggcttcaggttggatccaggaggcaaacctaaccccgctgggccccagacagcaattcctaacagtgtgctcttttataccttccttcaaggctgctgacaggaaaggccgttgccaaggaaacaggctgagccaggaagctgactggagcaaacacagacagtctcacggccgctctgtggacagagcggaccagttggtaaatatttcaccaggcacataccagagacgcaaagcaaacagtgggaattgaacaatgagaacacatggacacaggaaggggaacatcacaccctggggactgttgtggggtggggggagatgggggagggatagcattgggagatatacctaatgctagatgacgagttagtgggtgcagcgcaccagcatggcacatgtatacatatgtaactaacctgcacattgtgcacatgtaccctaaaacttaaagta

SEQ ID NO: 474942 - DNA, 560 bp, Homo sapiens
aactgcccccaaccttcaaagtcagctcaattagacccctgccttatcgcaatgacagagggctttctatatcctgggttctcgccttggtgtaccagaagaatccgatcacacccgggcttggagaatgagtgcaaggttttactgagtggagttcctgtttttcttcttctacttgttcttgttctttttcttcttcctcttcctcctccttcttcttcttcctcttctctcttcttcctcttcttcttctacctcttcttcctccttcttctttcttcttcctcttattccttcttcttccttcttcttcttcttcttcctcctcctccttcttctacttcttcttcttcctcttcttcttctccttcttcctctctttcttctcctcctccttcttcttttcttcttcttcctcttctttctcctcctccttcttcttcttcctcttctttctccccctcctcctcctcctccttcttcttcctcttctttgaaataggattgtctgctgctggcatatagaatgctactgattttttctgttttctaggttatgt

SEQ ID NO: 474943 - DNA, 507 bp, Homo sapiens
ctctcctccagctgcctctggtcaaattcccttaggcaccggtgtcattccaccatcaatggcccgccagttattatgggtgcaggatggggggacttgatgggccaaaaggcaacattttgggcacaaaaaaagaaatgcctgtcctcatttaggtccatgggcacagacctgagggtggagcccttgccagggaccctgccattctctacccagcacttccctgattcacaggtatctctctttgatcagtctgcagctggaggtcaaagagacttggggcttaaggattgtttgtcagattccccaattctcaatgcctggtgttctttgcagagctcagatcatgctgatgtaaattcaccatccccaccagccagcattgagcaggatctgctaccattgccttacactcattacacatcccatctgtctgtgatgcctctttggcagtcaaagagcttaatgcattatgcatttcagaatattagagagattatttaacca

SEQ ID NO: 474944 - DNA, 627 bp, Homo sapiens
taggtagttttggaaaaggcaacatttgattggtaaaatgacattactcagaaagaaccagttgggagagagcaggcaaacagaaatagaagttctcactttgagccacaggtttcaggctacttttgacttgaagatagggttcccaccagaaactgggttcaaatcctgctttacaagttttgtaagctgtttggctagttacttaaactcatatacttttactttcctggtctgtaaaatgaggataatagtttctctctcactgggattttacatcaatagcagacacccaaagtgtaaagtcaattttgttaaagggagatctgagagaacaattcgcaagaaggcaactgctgtggttggaatatgtcccctccaaaatacaggtgttgccaatgtgatagtattaagagaaaacgtgaaagatgctaacaacaacatactgtacgtggaagacgtgcagaataagatatggctgtgcaaaaaagaaaagaaagaaaagaagaccctttatcagacatacagaaaaatatagttctgtgtctgtctcagaaggcatatagttacctgtcactcctttagatagaggtttgtcaaagatcagacagttgtagatatgcggcg

SEQ ID NO: 474945 - DNA, 723 bp, Homo sapiens
tatctgagggtgaccaaacatctgcagtattcaaagaccatcgggtgattacaacatgcagcaacatttaggaaccgttgactatgtctatgatgcaagtaaaaattactccttgactgaagtaatgggggctgtctgtgaagccttgcggcagtacggcccaggttatttgctgagcctaatgggtgtcaggctgctaagccgagaagatctgggaaggagtcagagagccctgggccagagttccaggggctctgggaatggctgccaggaggaatcctgggctgtgggcattccttggcccagtggccagatttccagcacttgtagcaagctcctgggggaggaggttctggaggaacccctggcagctgcagttgaggcgtttggagttcttgtgtgctggagatgtggctggggtttgtctcacagtggaggcaagttattgcaactcaggaatacattgctacttggctgcctctactctattattgtacaccttgaaggtgaggttaattaagtcctgttgtggggtttgagggctggaatttaatttttggagttttatttaatgtcgggagcagattgggtaataaaatgtatattgagaataagacggccttttgaccttttagggtctagggctgtaaagcgtctcagggttgttgccaaacaagtcatgaactgggctgggtttttcatatttgatgaaagagcctaaat

SEQ ID NO: 474946 - DNA, 788 bp, Homo sapiens
agctgagcggctttgctgtcagtttcagtatggtagggaaaggggcctggctctcaggtctgccccatacagaattcccatgtgtcacgggagggacccagggggaggagaaattcaagccagctgcagaaatttgcataagtagcaaggagtctaatattaatccccaagactgtggggaaaatgtctccaggccaagtcagagaccttcacagcagcccctctcatcgcaggcctggagtcccaggaggaaaaagtggtctcatgggccagtcccagggtccctgtgctgtgtgcagcctagaaacttggtgccctgtgtcccagctgctccagatgtggctgaaaggggccaacatagagcttgggctgtggcttcagagtgtgcaaaccccaagccttggcagcttccacatggtgttgagcctgcagtccacagaagtcaagaattgagggaagtgcagaagggaaatgtggggtcggagcccccacacagagtccctactggggcaccgcctagtggagctgtgagaagacggccaccgtcatccagaccccagaatggtagatccacaggcagcttgcactgtgcacctggaaaagccacggacacacaatgcctgcctgtgaaagcagtgggagagaggctgtatcctgcaaagccacaggggtggagctgcccaagaccatgggaacccaccttttgaattagcatgacctggatgtgagacctggagtcaaaggagatcattttggagctttaaaatttgatgacctcactggatttc

SEQ ID NO: 474947 - DNA, 702 bp, Homo sapiens
caaccagacttagtgactcatagatggcctgtgggcagatactgcctgtgttcctcctacagccctttagactttccatcatatttcacagtttgagggatcatacccacagtttcttagaatcttttaaatctgtgatccaaattcaaggacaaaatgcaatccctatgaaaatgctcataagctatttttcagagttagacaagtccttagtaaagcaaacatctacaaataaagaaggaaaacactgtgaaagaaaagctctgagaggagggagatacggatgctgctgtcacaggtggggaacacatgccgagaaccactgttctcgagcattctatgagctgcatttcatacttattggatcagacccaggacagggaagttttgagcagctgaggattgggaaaatctgggccataggttgctacgggaaggctgagtcaggacagcctgctaagggtattggcggtggagcaagaatgaaagggctgttggagacaattgcgtcttatctgtgatgcaaatggggtatattttctctcccttttgcctcaggccctcagggtagttaccagatcctgaaagttctgaaccagagatcttctcaggtcccagatgatatgagggattagttattgggggaaatatcttgagttctatttattcatctttccattatttattaagcaaaggaagtga

SEQ ID NO: 474948 - DNA, 569 bp, Homo sapiens
ggattttctcgtgctatgactaggaggatttgtggctacaaggaaaaaatgctcaatagagctaatcactccggcaagtgggaagcgacccgggagctgcccacaggcacctgcaaaacatgtcaaccaccacgactgacagtaccaccggccagtcatacaaatggcgttgtgtctgagatctccccgcttctcagcccaagtccaccttgtccattctgctctcatcctggccttgctgcaacccatcagatagctcctgcatctttcagtattcagggcatttgcccctcaatgtcctaccctggggcccctgagccagctaagtaccaaacatacggcaagctcccagagactggccaccagccctgcgtacggcagcaagcttctctgccccactcagcacctggatttctgtaacatcatgttgtcccgagggtggtgactgctccctcagtgattcctgtgccgcttcaatgtctgctttttatcttttccgtcttcccacaccatgtaaccaactcccttgattgtttcccctcagctggagatttctggactggttttga

SEQ ID NO: 474949 - DNA, 727 bp, Homo sapiens
gactgtccctttggctgctccagtagattggagagagacaagaccggaaacacgattgggaaggctcccagtatgctaaaggatggtgcccctagctgtcctttcttgacccttcctcgggaatgtgaacttcagatgtttgatgtgcggagaaggattgccttcctggtgtgttctgttcacagtacaccgcagggcattcttgcgggactgcgagcagaggccgctcccctgttcctgctggcttcaaaagagtgcagatggcggctcacttccaccctgcagtttgctttcctgccccccacaatcaacgtccccaccccttctttccatctcaggacggctaagaactgctccttacccctgtcactgaaagtcatggctgcaggtcccagaagaaggaagctaccaggatcagaacctgtggaattcaggtctggggatttcctcaggtctctgaagacgttccttcaaatgctaaggatgttccactatatttcgtgatcattagctgcctgtgaatgtgagagacaggcccgtgccctatgcaaagcaaaacagtcaccaggacttggaaaacattatagtacctgccatcatgagctggtgaaaccaggaacaatgaatacatttaggcattaacaactttatcccgaaagcaaacatatgtgcttacaatatgagcttgtgctcattgagaattaactgcttgacagaagtaaatgta

SEQ ID NO: 474950 - DNA, 902 bp, Homo sapiens
tacgctttgtgagaataggaagctcagggatgcattacaggagggctgatgatatgttctagcatgctgagctatgccttggttagcatagaggttagctcagtgcctggttgccagctttgcggagaaaaatgttgcaattccagtttaaaatatggtttgggaattacagtggaatttatctatacgcttacaattgctgattcctgcatgcagtcaggagatactttgaaagatagtaaaatgattcttaaattactatattttatcattggaattattctcaatttcagtggcaaaactgtctcccaaactaagctaattgtagctatcgcagggactttttcctctaacatgtaccaagttcctctccaccaaagtcaacaaaggttagaggagagctcagcacaacctggttggcaggaccagtgctgctgtttgcacatgctccaaagtctgtgctcaaagctgacaaagataaattccaatgtgtttgagcaaataggctttgctcatcctcagccaataaatatcccatatcctgaacaggctcccagttgacttcttggtacaatttgagttgatgtcatgatcatagttatttatcaagcaacttatgtatcaccacagagttaatccaaatggctagaattgaccgtctatgtatcattcatgggataagctaaatacattcatagaagctgttttgaattaagaaaataattttgatctgaatattgtcttgaataagcatctggattagtggagggttgttcaattgttagaactttttgttttgaaatgaaggcttctcaggtcatgaagattattagtattattgctatcagggagataaatgaccctacagatgatagaatatttcatgtagtgtatgcgtcggg

SEQ ID NO: 474951 - DNA, 798 bp, Homo sapiens
ccgcaccactaggaaaagttgctgtttgttacctaactctggaggcaggacatggaaaagaagtatgcctttatcagcagcatgaaaacatacagcaaattggtcccagtagagtgggatgctgctgaaattatacccgaatacatggaagtgactttggaactggtttcagcaaagaaactggtagcattttgcccctgccatggagatttgtgggacttcaaacttgagagagatgacttagggtatctggtagaagaaatttctaagcagcaaagcattcaagaagtgacttggatgctgtcaaatgcattcagttttataaatgaagcggagcataaaagttcagaaaatttgcagcctgacaataaaatagtaaagaaaatcccattttctgaggggaaattcaagctggctgcagagatttgtataagtaatgaagggctgaatgttcatccccaagacaatggggtaaatgtcttcagggcatgtcagaggtcttcacggcagggcttcccatcacaagcctggaggcctaggaggaaaaaattgttttgtggactgagcccaggctccttctgctgtgtgcagtctagggacttggtgctctctgtcccggccactccagccatgactaaacggggccaaggtacagcttgggccatggcttcagaggatacaagctccaagccttggcatcttccatatggtctagcgtttctagcagcctgcaggtgcacagatgtcaagaactgaggcttggaagcctctgcctagatttcagaggatgtatggtaa

SEQ ID NO: 474952 - DNA, 575 bp, Homo sapiens
ggaaaagggggcactttgaaccgcagaaatggagcctaccccttcagcaattttaaacctcaagaaatcgaaggtgtggaaaggatctcagacaagcgaatccatcactgttactgtacagataagaaatggaggccaaataggattagcaacttgctcaggactccacagggaagagtttcagactacagctgtaacgttgggactcatcaacttcaaatgtaatttagccatgaaactggatactctcacctggaaagtcatgcaatacagagaaggaatccatggattgagctctgggacaatctacagtgtagacatcagggagatgaggaagaaacagcatagtagactgggaagaagaggctatgagatgacaaaaggagaggtgtccttggaggagtggaaaccctgggtgagagaagaggccacactatggagtctaggtgtttttcctgcatgtggaggtatggcacggacagtttagaacaggatagtgaaaccatctgatctcaggaaggtatctctagttccagtttattggctggagtttcagaagagaagatgagtgcagc

SEQ ID NO: 474953 - DNA, 516 bp, Homo sapiens
gtttgcaacgatggcgcttacgtagaaagtcgcctaactgccatctgcttcagtgtcctccccagcacagtaggaaccaccactcaccatgacaggggagcttggactcacagggtctcagctggaagaggtgacccttgctgccctggatgcgttttctgctttctcacttcaaaaagccccgcacagagctcaggagagagctattggagatgttggcctgtttttccagaagtttacagggcccaggggctggtgcttcctagaaaagcttgcatgggcaaagggtgtgctggagttccctaccttagcacaaagaaaagagtactggaatggcagcagctcacactccccaaatatgtcaaggtcaagtggataccatgggaggaggctggatttgttctgccctgagaggaaactgttcaaaaagactccccctctttcagaagctggagactccaatggcaagagccgacatggggtgagccacatgcaaaaaggctgaggaaggggcca

SEQ ID NO: 474954 - DNA, 711 bp, Homo sapiens
tttttttatagtccctttgtaatcatgtatggcagaacttttgtcttggggcctccacccttaccagactctgagccactcaggaattacctctcctccttaatccagacacagtttttcattcgtgaagtaggagatgaggccatgcctatccctgttgacacctccttgtcctctcaacataacttttttgcaggcacagacatgtttatctgcccgaccctcacccaaaggctacaactgaaatggacaggcccctacactgtgatactcagcacgccaactgcagagagagtccaaggactccctaactgggtccatcacaccagggtaaagctcacccccaaggctaccccttcctccaaaacattaacagcgggcccagtcccaaggtgcaagaccacttgcatcagcagcgagcgtcagcaagaagaagcagcaggaagacaggcagctgaaagacaccaccctggccggaagacacgtacccctgaagatctgaagatctagaaagaggccatccagtgttgtcttttactgcatacttataaacttgaaatccaactttataaacatggcttcaactatctaaatatttaacattataaattcagcacttcttaccaaagttctcataaaagttgttaactcattgatgtctatacattacttccatactttccatattgaagaaagccaacaaacttagga

SEQ ID NO: 474955 - DNA, 3857 bp, Homo sapiens
ttaggtccataagaatgaaggagcccttccttgaagataaggagcatagtggctggccatcagaagctgacaacaacaaattgagagcaatcattgaaactgatcctcttacaactatacgagaagttgccaaagaactcaacgttgaccattctatggttgtttggcatttgaagcaaatcggaaaggtgaaaaagctcaataagtgggtgcctcatgagctgactcagtggttggaccaagaagaagttccaaagcatttcccaacaccaaaattgcaccaaaaaaaggtcatgatcactgtttggtggtctgctgccagtgtgatccaccacagctttctgaatcatggcaaaaccattacatctgagaagtatgctcagcaaatcgatgagatgcaccgaaaagtggaatgcctgcagccagcactggtcaacacaaagggcacgattcttctccataacaatacccaaccagatttcgcacaactaatgcttcaaagctacgaagtcttgtctcatccaccttattcacctgacctcttgcctaccaactaccacttcttcaggcatctcgacaactttttgtggggaaaatgattccacagccagcaggatgcagaaaatgctctccaagagtttgtcaaatcccaaagcacagatttttatgctataaaaataaacaaactgatttctcattggcaaaattgtgttgattgtaatggttcctattttgattaataaagatgtgtttgagcctagttataatgatttaaaattcatggtccaaaaccacaagtacctttgtaccaacctaacattttaaaaaattgaggcaaagagtgattaaataatgttatcaatattagaaaaagcaccagtaaggtgctgggctccaaagtctcctttcctaaccatgctattacctctatggttgatggagagagaactttccttattcttgtgtccttaggaattttttaatgttataagataatttatcttagtgaacttctcctggttacaaattcacatatctgatgtctttatttgaaacttatttttacagaatattcttactgggtataaaattttgcactgactttttctaatctctttacagatttttgttgttgttgttgtactctttttattcttgctttagtgattttctctttattattagttttaagcagtttgacaaatatatacctatttctggtattcttatttgtggtattcttttcatttatttctctttggggtaagttgagcttcttgaatggctagatattcttatataggtgaggaattcttactatttgtaaatgggacatcagatttcattatgccacaattatttggtaaggtcaaaaggttctgttcttgctttctaaaactaattatctaaagcataactatgattatcacaataaacattaacactttaaaaagcaatgatttgataatagtctacatttcaaagtaattttaatataaaattgtttaagctaaagaaatatgaatgatcttcagaaatgggttatgattcgtccctcctatatgctctaatagcatcgtgtattaaacaggtcacaccacttatgtgaaaatacattttttgcagttgtctctccatccaattctacctgaaaatagtggtgttcaggaattgtcattgttcttattatatttttagaatatagaatcgaaggaaacattaggcattcaataacaggttgattaaataaatatgtaattgaacgggatatcctaaccctcaaactcataactctataacctaagggtgtgacactgtcaatgtggtaaaatgtacacacacacacacttatatatatttcttggtgtatatatatatatatatatatatatatgcatatacatatatgtataaatgtgtgtgtatgtgtatgtgtgtatgtatatatacacatatacatacaagaaaacaagacatggtccctatttcatgaaagttttttatattttacctttctatcaaggctattatacttttctgttgcttgccaactttgcagaatattttgtctttattttctaatttagctttgtgcaggagaaatgacttggtgcctgactatatttttcttcctatgaaactaaaaaataggtaaccttttataattgttcttgaggactattctttggcactctgggaaggaattggtagcactgtaaacaggtaggttgtggagagggatctctgtaagtcttcaagttattagtaatctacaccatatttaagcaattcacaaatatcttattctcacatgaaggagcttggggttgcatctataaacagtgtagcttaaacacattcccaaccatattgctgccctaaagtcttctttaacctccaaccaataaataaataattactagagcagcttctggcagaaaatgacccacttcttatatgctcaaatttctaagacacgacaaaaccgctttttctctacccataccccaatcattttctgactcctttggaagggatatgggtcaatttcagaatgaaatatgaaagtctaagaggagctcaaaattttggctaaactgactttgttatgaaagtacactaaattaatatacaactgaaccatattaaataagttactgttttttactaaaaagatatgcaattagtgattaatattaattatcttattaattacttagtaacttattaatattgattaatattaatattgactaatattaactaataagttactttttttactaaatggatatacaattagtgattaactctgttatggtttattttgagtttttaatgtattttaaaaaatgattagtagagaaaaccttttttctaaaagaatacagatgctaggtctttatggaaaatagtacagtgttgcagcattaaattaaaaagtgaattagctcaaagagaaattctcaaatgacaatgtctgctttgtatttatatatagataatgatattcagggaaaaaaacttcatacatataaggaactagaaaaatgttaaaaaatttcttacataaattatagaattacatcttccaaaaccaaaactgaaattaaaattttaaataaatgactagatcctaaacataaactgtattttattttcacaaatttaggacagatcacgtcttagaaataaatatgcagcattgtgtggcagatggcttaggaaaatggattaggcaaataccactcattttagccataattaaatggcaaaagctttaaaaatcaggttaaataaaattctgcagtataagttacatgtagttacaagaaagatatggctaaataattttttcttatacatttttgaatatagcttactaatatttttctatttgcctaaaaagcctgaggtgcattcttacagttattttttaaatacccaaaccaaaatgcaatttttggaaaataaactttaaaaaatataatttagaaaaagacatattaaagctattactctttaaaataaaatgctttggaataggtcaatttaatgtgtagatttattttgcaaagcttttattttccaccctaaaagtcacaagaactcagaataaagtaggtggatattcaggaaaaagtaataatcagcccacatctcacaaaagaaagtcattgttattttttaattctctttactatgtcagcatggtatatccctgacatattataaaactactttgtagtttttcatttatttatcactacaaaatgtattttatatgatttataaattatttcaaaacagtattttaatgataaaacttatgttaatgggacatatttagtatgtat

SEQ ID NO: 474956 - DNA, 808 bp, Homo sapiens
cagagattgggatggtgcagtggattagtcactttagacctactcatctcagctgggagggtccagaagatatacccttgaccaatgcttcgcaaaatagatttgtgagggcagcacctgcatctatgaacagccctgaaattgctcttctctgtatgtcagatctaacaatgggaaccatggtcactcaactacaaaatttaaatacaatgggaataattggattccaagatggcaggggccaagtggcagcactcaaacgtcaaaggcaaggagatgtgtatgagttcaagctgacaaggagtggactcctgagggttaatactgattgtcaacttgattggattgaaggatgcaaagtattgatcctgggtgtgtctgtgagggtgtttccagaggagactggcattcaaatcaatatgggaaagaagcagcagttgtgtacatgactgtgtataatgcatattaatgggaccttctaagcaagagccctgagtaacttcactggtctagcacaaaaaaaaaaaaaaaaaaaaaaaaaaaaaaaaaaaaaaaaaagccctattctcagaaaattgtatatcgcatcatgatattcaagaatcaaatatttggtatcatacctcaccccagtctgctcatattcatttataacttactttcaaaatagcagactgtgaaaaatccactggtttgcaaccctccatattatccatgcatcatttatgtaaaagctttactaattctagtttttagtcctagttattgtatttgcagactgttaaaatagcactgagattttaggagt

SEQ ID NO: 474957 - DNA, 1241 bp, Homo sapiens
gccgtgcatgacttggagggtcctacgcccatggagcctcgctcattgctagcacagcagtctgagatcaaactgcaaggcagcagccaggctggtggaggggcgcccgccattgccaaggcttgagtaggtaaacaaagcggccgggaagctcgaactgggtggagcccacggcagctcaaggaggcctgcctgcctctgtagactccacctctgggggcaggacatagccagacaaaaggcagcagaatcctctgcagacttaaatgtccctgtctgacagctttgaagagagtaatggttctcccagcaagcagctggagatctgagaatgggcagactgcctcctcaagtgggtccctgacccccgagtagcctaactgggaggcacccctcagtaggggcagactgacacctcacacggccgggtactcctccgagataaaacttccagaggaacgctcaggcagcaacatttgctgttcaccaatatccgctgttctgcagcctccgctgctgatacccaggcaaacagggtctggagtggacctccagcaaagtccaacagacctgcagctgagggtcctgactgtgagaaggaaaactaacaaacagaaaggacatccacaccaaaaccccatctgtacgtcaccatcatcaaagaccaaaggtagataaaaccacaaagatggggaaaaaacagagcagaaaaactggaaactctgaaaatccaagtgcctctcctcctccaaaggaacgcagctcctcaccaccaatggaacaaagctggatggagaatgactttgatgagttgagagaagaaggcttcaaacgattaaactactctgagtcaaaggatgaagtcctaacccatggcaaagaagtcaaaaactttgaaaaaaaattagatgaatggataactagaataaccaatgcagagaagtccttaaaggacgtgatggagctgaaaaccaagacacgagaactacatgacgaatgcacaagcctcagtagccgattcgatcaagtggaagaaagggtatcagtgatggaagatcaaatgaatgaaaagaagaaatacagagaacgccacaaagatactccttgagaagagcaactccaagacacataattgtcagattcaccaaaattgaaatgaaggaaaaaatgttaagggcacccagagagaaaggtcgggttacccacaaagggaagcccatcagtctaacaatgaatctctc

SEQ ID NO: 474958 - DNA, 4504 bp, Homo sapiens
tgagtttctgatttagtgtgtaattaggtctgaggtcacgctaatgcaagaggtgggttcccatggccttgggcaaatgtgcctctgtggctttgcggggtacagccttccccctggctatcacgggttggcattgagtgtctgtggcttttccaggtgcatgatgcaagctgtagatgaatctaccattctggtgtctggaggactgtggccctcttctcacaggtacactaggcagtgccccaccacggcacgagtggctgagatgcagggcaccaaatccgtagactgcacacagcatggggaccctgagccctacccacaaaatcattttttcctcctagacctctggaacttggaggtgattgcaccagtaaatctgagaaatcacactgccattctaaaaaggataaatgcaattaagaaacaggacaattgccaacatgaacaacggctgaaaagcagccacaccgttgtttaggtagaatagcctgtgtatttctgggaatgtacaatatctatgtcagcagcattggctgagtccgtttgttttccagttgtcttactgattgagtttttctctttattaaaaaaatgaaactgttctcatttggtgctaattaatacatcaaaatataccagggctttctttttcaaattaagtgtgcatgattgcacatggaacaaatattaagatctcaagagtgtgagggctagggaaagggacatggagggattttttacttgacttgaatatgcacctgagggtgctttgtgcaatttattgtacactgaagcatctgatacttttccagttgagtttcaataaattacaattttttaccctccaacgaaaagaaaaagaaaataacacatggatggtagtaaaatattcagctgaatatattttcactacacaccgctattagtatgcaaaatgctttgcaaaatggtatgcaaaatattttactaatgcaccaaaatgcattttggtatgcattaaaatattttactaatagaagtgtttattgaaatcctagtaattgttaaacatagtgatgtaaaaattaacaaaaatgaagaaatattctgtatagaagcttatttttagaacatcaaagacagagaaggaaaacttaagcagttgaatactaaagcaaagcatccctttgtgtcagtcatttagatctggggaaagtcattccttgaattaaagttagggaaaactgagatcggaaggttttcagcattgacaccacatacgggttataaaacaaatcagaaatacttcactatcagcatattatacatgtacttgtaattctttgattataaatcctgagcaatataaaggtagaagaataagaatattgataaattaagtgactgatggttatgtgaacacaaacacgagcaaaacctagaaatcctgggtttctagtaacatagagatctaagtggaaatttcatttctgtaagcctctattcactccatttaaaaatttataaaacttgctcctgtaaaatgcacatgctattttgaagataaattatagagttaatagcctttcataaaattaaatgttctattgagtgtaagatgaaattgttatcaaaaaataggactaaagaaaacagtcttctgtttcagcactagaattgctggatcactcagaatactacatatcctataagaagtgagctctaggaatgagaatatagcaggccacactagagatcttttctatggacagaaattttactctgattttttttatcaataataattactgttgataattatcatggtgatgatgatgggattattataagcaaaatttattaagcatctatactctgtaatgtacagcttcaacccacattgaaagaaaacataaagcatagagagaagaaacacaaattaaagtaaatatgtatataactgtgccagaagtgatgaaaatttatgaagcatactagaattacattttaatttacaagttgtacgaatatctttatttgttcttttcatatgctatagatacatattgtacaccctgaatgtcagagaatatcagagagaagaattctctttgtaattttgttttaagcctaaataattatacaaaaaaattatgatttagaattatcggcacacttcttccttattattgtcctagtaaaatgtgtgagtagaaagacatttccgtgtatctataacaattatatgatcttttgaatgctatatatctttcaatttctatacatgataagattctagagctccttgttatcgttattcattcaatgcaacttattaaaataattatcatatgtgaaacatttacaatattcccttatatattatggttatatatgtttatcttctcttaaataacctgcactattagagtaaaaatatcacattttgttaattttgtatttactgtttgataaatacaattcataatatatgcccaaagaatgtccaataactcatttaaacttgaagtactttacaataataagacagttttacatacagtattgcattagatacacaattctttgaaggaagtagaatgggttaaataaaataataattttagatgtaaagaaatactccatcatgttttattattaatctccatggcctgaatatatgttactggatatgaaagcaaaaaaggagtttactttagcaaatttttaaatattattctagttcatgactcttttgtgaaagacgagcatttatattatactaactctctttgaactgacattctgtaaatatattcagtgaggatagagtcattaggaaatgcaaactgtgttaatttacacatactcgatacattttaagcactatttattattatatatcactaaaaaaatcccatggcagacagtaatgcctttaataaattgagaaaatcataacaaaataacatggtaagttagttattaaaggaaatatgatcaacacttgttgacttttaaatatcctaattaagtatagcctatttgtttttctgagtgacctaattttgatgtttattttaaaagcagaaatacagttttttaaaatcaatttaagcataaactttcccagaacaagctatgaatctaaaccatggctggctaataattgcatcaaagtgttaatgtacagaagaaacaataattttaaaagacagttctcacaaaatttaaaaagaaccaggaacccacactatatggctgtaatattatgtatttctgtttctatccagggtgaaaaagatatatatacagaggatctagaaatatcttaatcaaagttaattcattttttaatatctctaaagtttatttacaaaataaaaacacatacatttaaaatttggggtttggtagtaataatcgctttttgattaaggcattatatagatttcataatttcttgatattaaaatgtattatttttaaatgtgatgctatagacaactgatcatttataccattttaaagatttcattttggtaaaaaagaataaaaagaaaagtttatcagttatcactttatgtacatatatatttgaaacatagttatttggtatttattcccatagtcggggggcataaattcccatatgcccatagaatgtgctcagttgactgttcctttttttatatatttttgacggattcttcgcctggtagcaatgtattgcatactatacatttaatatgaaatatcttacttcactaattcaattttagtatgtttgaaatgaaataatgacatcaattgtttatgtgcattacttcatttttaatataaatatttcaatatgttaataattatttttatatacttattttaatttgccaaattttgagatattttgggttgtagggattattcatttaatcttctcttaaatagattaagatattttgttacagaattgagatataaaataagctgaaaatatgaaaagcaaatctgctcctatgtttcattaaacatttcttttccctttcaatcattatctttatttagaagactgtataaagtttagagaatgttaaaaacaaaaaataattgaattatattaaaatattataaataattcttcacgtatttatttctgtatctatgcaccatagtacttacagccacagggaagattgaattgttacttatgtcaacctaattgacttctatattacaaattatcaagcacctagttagtcttcaaataaaatattttattaacatcatagaatttagagcatgtagaaaacgtatatgttaaataatctattattttcaaagataaaagggaaagaaattaacgagtttttctaaagttagatatcaatgatctaacagaaccaagagtccattgtctttgtttggggtctgatgctttctgccaataagtcactgatactctatttcaacttacctcattctatattatattggacacatatagtactttaattttttaatc

SEQ ID NO: 474959 - DNA, 556 bp, Homo sapiens
ctggagagaccaataggaagtatcacatctcattcagttccactgcccacagcttggccagcgagagcatgtggcacccagcagctttttctcccctgttaaacaagagccagagggaaggtaatagtgttacagctcagcgggttctgggttcttgtcccatgaccacgaagactgagaatttggaagcctgcctgcacccaggtgaaataaacagccatgttgctcacacaaagcctgtttggtggtctcttcacacggacgcgagtgaaatttggtgccatgactcggatcaggggacctcccttgggagatcaatcccctgtcctcctgttctttgctctgtgaaaaagatccacctacgtacgacctcaggtcctcagacccaccagcccaaggaacatctcaccaattttaaatcagagacaaaggagacacgttttatccgtggacccaaaactccggcgctggtcacggactaggaaaggcagccttcccttggtgtttaatcattgcagggatgcctctctgattattcacccaggtttcaaaggtg

SEQ ID NO: 474960 - DNA, 574 bp, Homo sapiens
tgctagcatgttgtcacctctcataaggatcatgaatagccataaatcttcgaaacctaagaaccaaattggaagccagaaaagtcttccaagtacagttggagaattgatgagcagtaattcatggctcagacatacagaggaagtgggatggaggggagctgtggagatagctgactatggagaaagcactggtgcacaacaggacctgaccaggccttgctcggatagtaagggccaatgggagctctccaggactgcaggcaatacatgtatgagcttgaagaggacaatcagggcacttgtacaaatcaggaagcttttgaggcagtttttatatagagagggccacacaaaaggttaccatcagtctatggctgaaagaccacggagggatcatgctctgaacacaggctgggacacacttagcaatagaggagaaatggaaaaggtaaaaagagaatattatcggtgtctacatgccaagaatttttaagcctaaatttaaatgggaaaatgcattttatattaaaagtttgaacagtcctataagtttaataaatttaagcaaagg

SEQ ID NO: 474961 - DNA, 571 bp, Homo sapiens
ggcagagtccatgtctgatcttgagagaccttttcaccatcatgagaacagcaggggaaaaatctgcccccatgatgcaattacctcctaccgggtctctcccacaacacatgggaattatgggagctacagttcaaaatgagatttgggtgtggatacagccaaactatatcattccactgctggcccatcctaaatcttatgtcctcacagttcaaagccaatcatgccttcccaacagtcctgaagagtttatcaatccgagagataagtcagctgacttttcaaaattctactctgacaatcattggctgcaggataagcaaaggaaaggagacagaaaaccagcagtgattcaagtccttttggaagcctgtctagtgaaacaagatagcaatgtgatgactaagaaagcaaaaccatggatgaataaaagaggaaacaagaaacgcatgtttttaaatccaaaacaccaaaaggaggattttatctgtagaccaaatgaaaaaggatgagatgtactgaatcatttgtctcttacatgaagaactcatctgtttagagatacagc

SEQ ID NO: 474962 - DNA, 1745 bp, Homo sapiens
ccgggcaactctgcaaggacatcagagctccagagctccccacagtctgggaacgaatagggaaatgagcgctaaactttccttcaaactccaacaccaggctcatcccaggataatccagcagagccaggcagggacctttaacccccatactcccatccagtacccacagactaagcctcaaggctttctccagagccaggctggattgcacagccttgggttccagacttgccaagcagactcagtttctgaaactggcagcacatgtgaatctagtcttcagaccaggacctgcacacctaaccaccaggctgatagcccttatgaactgaagctcttaggtaactcctgcagatgcaggctctattctatgcaaagatataaggaatttctattagcagctttatcacctatcatcacttcatatgtcatcgagtatgttagaaaaaaaggtattgcagtcagtataatggctctccaaatgtatcaactgcctaatccccagaatgaaagagactttgcatacgtgatgaagattaaggatcttcaaatgagaagactgtcctggcttatccagaaggatatgactggaagacagccacctgcaaaccggaaagagagctgtcaccaagaacctgactgtgctggcaccctgatcttgaactttcagcctccagtactgttagaaatcaatgttgatggtttactctacccagtctatgggatttttgttacagcagcccaaactgattcagatgaggcaacaagatctaacagggagcttcctttccatgatactatgtatccatatactactactgaacattattccaaaaacactaccacctgagaaggggttatatattgtattagataaacaaatagcaagcatattcattcaaatacaaattaatcttcatggattttgaagtaaacatgcaaaaaagacaatgcaactctgacataatttatgttcaagattcaatttcaaaaaaaaccatagtttgtaatttaagaaaagagaaattacttgcaaattataaacttttaacaaaaacttgttattccattttgaaaaacactgtatctgaaaaaaagtttttcatcactcatcaaaacaggaaaatataggaatatttatcaaaatgagaaatgctctcattttgatatgctatatagaacagtgcagtaggtgaatcacaggtaaaaagaaagaataggatttggttttcacagatgaagcataataattcagcaaagatttgtcaagtatgtgctacatgtattccaggtatatagaggggatagagatctaggaaaagaacattctaggcagaagggacaacaaatgcagaggttcttacatttttccttcaggtatagccatctgatttatgtataattatatttgtacaaacataccttaaaaataaatcaatgtgtaagcatttacattgtgaggtgttcttaaaaatgggccaatttattctggaattctaaaatattattcagcagtatctaagattaagaactcaaaaagggtactaactctccctaaattcaaaggccctaacttagctatgagttatatatacatatattaatatgactttcatggaaccattgtacaaattatggttgaaaattatgtcattttattaaagatcatgtttcatgtgctaaacaattcacatatattttatattatcttgcataatatcaaatatagtaattcaattcaa

SEQ ID NO: 474963 - DNA, 3131 bp, Homo sapiens
ttctgctgaaacaaataactaagattgtggaagcatctttgcattactagggacgtaaatgggagactggcatagaaagtggtgaggagccgaagccaagaaattgctttaaacacaagatgaaaatgctctgttctgtgatttttctgggtcactttgccagccggaaatctccagctggtgacgaccctgcccaagccttgccagggctcgaatttgccacaagagataccccgtccactcagcctaccagactgcacctggcctgcgctccagggcgattcccacagctaccccaactgtgtgcccagctccaagcaggatcccactgtctgcagccccacggaccgaggcacattaagagctctgccctttgctccactccagcccatggctctgaggctggcttagccccgccactgcttcccgttgcttggggtggctgccttctgcaggcagagggcagagggccacagtgttacagccttgtttgtacccacatccagtggatcccgagttcttaatgaaatattgttggaatcctgcagtttgcagccctttcaaactggtgtctttcactgagaaatatgcatttaagctccttcatgtattttcatggtttgatagctcattccttttattgctgaaaatattgcattgtatcgatgttccacagtttgtttatctattcacccattcaaggacatcttggttgattccaagttgtgtcgtatatgaataaaactactatagacacttatgtgcagtttcttgtgtttgaaggtgagttgtacattcaaatcttttgtccacttattaattgcattttctgtttcctttttgttgtttttaaaggtcttttgtatttttttgataaacgtcctttatcaaatatgtacttgtaaatattttctctcacttcgtggcttgtcatttcattctctgatcagtgtcttgcagggcacacatttttattctaatttaatgtgtcaattatattgggtctttgcatttccatataaactttagaatcagtttttcaaaattcaccaagtaacttgtgtttgcattgaatctatggatcaaatggtgaagaactgagatggtaacactactgaatttttctattcctgaatatttggtatctttctattatttagaaaagatttctttgatttatttcattagagctttacagttttcatcaaaaagaacttgaacatattttttttagatttaaatttaagttgtttatttttcatgctaatataaatggtgttctgtttaaataatatttcaattgttcattgatgatatatagtaaatcaactgacttttgtatgccaaaattgcattctgcaactttgctataactgcatattagtactaggaggtttttttccaattgtttcagactttataaatagataatcatgtcatctgtcagcagttttatttcttgcttcccaatctttaccttttattttcatgacttgtctttttgcattagctagaaatgatgagtgggcatccttgcctcattttctatcttaaagggaaaacatccagtttctcaccattaggtatgatgttactataggtttcttgtggatattctttatcaagttgagtaagtttctctctattccaagtttgctgagaggttttgtttttaatcatatatgggtattggattttctcaaatgtcttctctgcatctatttgatatactcatataatttttcctctttaacctgttgatgttatggattaaattggtgttcaaatgctgaaacagccttgcatacctggaattatgtatatttgtttttaaatttttcttagttgaattttgtgaactactttaataactgatgtataaaaacttaaatgtttatatggattgttcattatacaatctggattccctgcctcagatggttccagttgaatttaataacacctttgtttagcaaaaaaaaaaaaaattcattgagtatttaaaatatgaagcatggtagtagttactagtaatgcattgtaatgtctccgtccttaaagtttactctgaccaatattaaaataaatgccttaaatttttattggctatggatttcatggaaaaatttttacattaaaactttctaaatactaacagtttgcttatgttgactcttatcaatatacaacattttgaatttttaaatagctgtcctagagtttgcaatgtacatttacaactaataagtccaccttcaattaacactatttattactttatacagttatattttagatcactttgggaatatgatacaataaaaggtattttatctttattcctcctctgatgatttcctttctttagttagcctggaagagtaaaggggtctcaagttgcataaacaccctatccctaagagggataaggctctagtaaagtcttttattctgagaattggccttttataagaggtacattctggacccaattcaaaatggcttgtcatgaggatatctttctaagttcttcactgtgtaagtctggtcagtttgtgaagatttcagagatggtcttcacccacaatctctgtggatcttaaaaagttcagatctttatggatactataaaacaagtcattgacccttaatttgttctgcatttttcttgttgtaaagatgggaatgacaattcccaagttctttatatatttgtgctaaaacagagtgtttttgtagacaatatgaagtaaggttctaattttacttttttgcatataaatctaacagttccagcatttttaaaatgtgtaaaaattaactgaccataggtcaacatttggacttgttatattgtctatttgatttatattttgtagtttatttcagagacagcaataggtcagaaaattattggtttagggaataacataaaatgatgtgatatttattcagaagttaactgagtgttcaaaataaaggaattgtcatgaaattatttattatattctattattcagtatatagtctatgtgcttttaatttctattatgtttaattatgaacactgacatttattttgattgatgtgctgctctacttcacatggctctatttggttttcccagaca

SEQ ID NO: 474964 - DNA, 1479 bp, Homo sapiens
gcgtctttaagatcaagaacagaatagtgagtcatagaggaagctcggcatccttgatggtccagggggcttctgaggtgatcaggcagcatcagtcttcaactgctaagctgaggagatctgggaaggagtcagtcagagagccttgggccagagtcacaggttctctgggagtggctgccaggagagttggacagtccgatttccagtgggttccctcacagttgggacacagcttaggaggaatcccaggttgtgggcattccttggcccagtggccagatttccagcacttgaaacaaaatcctgggggaggcggtcctggaggaacacctggccactgcggtttagacgttttgaagttcttgtgtactggaaatgtggctgggatttctctcacagtggaggcaagtaattgcaattcagaaatatgttgctacttggctgcctctattctattattgtacaccttgaaggcgagttagtacagaaaaacatgagaaatggttggaagttaaatttatctttgtattttgaaatacacatggaaacaagaataacttcttcagtattacttattatgcagattataatttcacagttgttttctcacatctatttcatcgagtctcctaataaaaaataataattctaacacaactctaacagtgactgagctgccaaaaatatcactgccaatgaattaaatcatgttgtttacaataatttgctgactcttaatctgaagaaagtactttgtggaactaatggtgatgctaattgtgcatttctatgctctgaaatgacaatgatatcataacaagttaatctcatttcaatgtgcatttcggatgcaaaccacaaaatatattacaaaagacattttgattaaagtttgctaaaggattcatagttctatgctatcgattgtctaacataaatgaagttgtttttcatatgctttttatcagttttctaattgtttatgagtggaaggatagtccaaaatgcattaaacagttttaatataatttaaaatgaataaggaaattgcattgatgatctatttgggcaaaaaaaaaaaatagaatgtacaaatatagtgtgctctaatcaaatacttttcaaaattcttctttggatttactgttcaaaattatatttgattaagactctaccctcctatgataattgattactgttccattaagtatacaaatttcaacaaatataaaattatcaatatagcattttttttaattttatgagaaatatgtgtagatttggcataacttctatgccaaatttgatagaattcatcagtggtagaaaaaaatctatgcctaaaagtttagtttattattaaattcatttctttaataggtataattaaatttttattttcattcttttaaatactttaaacatttttttcttttgaatttatctgctttaggggttatgtaaaagagtactgtc

SEQ ID NO: 474965 - DNA, 1819 bp, Homo sapiens
gaaaccatttttcctcctacgcctctggacctgtgatggaaggggctgctgcaaagtcatacagtatgtacagtatgtatcagataaaagtaatgaaagtaagatctttactgaatcttcactgtgaaaacctggttgggccacttgaggtaatgccaataacaaatgggtatccctccttcaagaatgggttccccaggggttcatcactcacactagctcacattcagccttcagcaattcgtcaatactgccatttgagtgctcccacaatcgtgacagcacaagttgaaactctaaggctttgctatattcagggtaccactgtggcaaaatacagacaaagtttcctgtttgtgtttggaaagtctgatgcaacatggctctaccatcataaccacaatgtagtgtcctgtggatcaatgactgagccaaaagcaagaatctgtaggctgggtattaatgaggacccccacacatcggaggagaaaatcaaaacacagaaatttaaaggaatcaaaatggatacaatgttaacaagtaaactgggcaactgcctcttctgttgtgtattggaaaaagaggaggcactgatggaattctccatgagttctgctgtacactgcagcttttgaaatctgagtctcacaagaatctttacttttattgaactgcttttgcttataatttcttacatatctgatatgcacttaaagtacattcacatcacccacaattaagcagaattgacagtctaataattatttatttttatattagctttcagacttattccccttttagtcagaatttaaaataaggatcttaatccaatagaatccatatgcttaatctactttgtgaagaaaaatacaagatagtttgttgtgtatttatactaattatttgggttcctcaagcaatcatacagcacagtatgtcccttatgtattgattagtacctcttcccaattttgcatcattgtgtgtttttctgattatgtatagctgattcacagtcatttgttaaacattgcccattctcccttcagttaaaggaattctagtttggaaaacaagccaacaaacaaaatcagatgcattgaattagagtatacagcgataactgaaattctgcatgtaatatcccattaactgcttggattccttccacttatttggttttaggtttataatctgcttatcctgctcatgtatttaacatggcacaaagagattgtacgtttccacatctatttttatactttgccttggttgctctgtggaaggtatgcaaatctaaagtcaaaggtacaagagcttatctaagtgtgaggtcagatatgagtgctttggttactcatatctgagaccacaatcagcttgcatctaattatctcatgaatgatgacagtgtatgtccataattgccttcttcctaagagtgctgctgattcactgactcattaaatatgaccatttactctattttgtattgtggaagggcaatctggcaacagaccactgatgccgaagggcaagaagctaatcctaaccactgtatatgagtgacagagaagtttgtagaacacaaataaaattaatatcatttaaatgaagaggacttgagaaaattcatagaatttactttgaaatgaagcaaatatgaaccaaaatgtcagggtatcatttaaatattttattaattacaatttataacaaaatagtattcagataattgcaataaatatttaagaatcttaaatatgttacccagtaattgactatcttcatacaggaagtaaacttttagcattga

SEQ ID NO: 474966 - DNA, 549 bp, Homo sapiens
ctctggctggcatctggtacataaatccacgaagatgattaaaaaccagtgcaaaaagtctaaaaattccaaaaaccagaatgtctcttctcctccaaaggatcacaactccttgccagcaagagaacaaaaccagagtgagaatgcgtttgacgaattgacagaagtaggcttcagaaggtcagtactaacaaacacctctgagctaaaggagcatattctataccaatgcaaggaagctaagaaccttgataaaaggttacaggaactgctaactagaataaccagtttagagaagaatataaatgagctgatagagctgaaaaacacagcacgagaactttgtgaagcatacgcaagtatcaatagccgaatcaatcaagcggaagaaaggatatcagagattgaagatcaacttaatgaaataaagtatgaagacaagattagagaaaaaatatgaaaaggaatgaacaaagcctccaagaaatatgggactatgtgaaaagaccaaaccgacatttgattggtttacctgaaagtgatggggag

SEQ ID NO: 474967 - DNA, 846 bp, Homo sapiens
gtaggtagttttggaaaaggcaacattcagttggacactttcagtgccgctttgccagccagaaacttctgtggctggtggcccctctgcccgggtttcactccagcccgctcaacctggcaggctgcactcgactcgctccctggcctggatcccgtgaccaccatggctgtgtggtcaccatggtccagcccatggcaggaccagaagtgccacaaggggcttccatgtctgggagccagcattcagacaaggggagcgctgtggcaccccaaaactcggagacaacagtgaccacggaactccaaagaggtgtcacagattctgctcggggagttctgaggtgtgggcccccaggaagtgttacagttctctctcattcccgccatttacagccgagcgaacgagggcgtgtcacaactcattcggtcccgctgcctagatgggcgagccaaccagaagcgtgctgctgcccttttcactgccactatgcggcaggttccaggttcttgttctgtgaccagaagaatgaggtacgtggacaccgtttcatgaccctcagaaaccatacaatactaaatgtttattattcaagctgctaagttttaagtgatttgttatgatagaagagataactaatgtagtaccaagtgcttggttcacttccaatctctctgaaattttaaaaattcatttggaaataaaaatgaaattataactactcataatttgtgggttgcagtggaagccgtgcttgagggaaatatatggcattgaatgtgtatattagataagaagagagatctaaaatcaataccataaatttccaacttaggacactagtat

SEQ ID NO: 474968 - DNA, 559 bp, Homo sapiens
ggcacactgtcccaccttcctcactaggcagtgagtcttgcatttcgtacccactgatggagatccatggaccttatgagaaagtttgggtgatggctgtggtgagggttgaaggggtggaagtagaatccttggaggaaggtttaaatcctcttttaaaaacagagtggtctaacctaacctgtccttttagaaagccgtccgggtctatactcctcttacacaaaacccctaagcccttctgtcttttatgccttaatttcagtcagaccctgtttagagcagtgaaggcccagagtccggctgagtcaaaaattctctttaagcgtctttggagagggagccctgtgaaaattgtgggaacatacttctcatttctggcctctctgaacttgtgtcagctcagtgatttcaggattggaaaggatctagaaatagtaacagaaataataatacccaatatttattgaatatttgctatgtactaggcactgtaaaactacatatgtttaattctcacaatgacccaatgaggtggaggtctcataggtatctcaaa

SEQ ID NO: 474969 - DNA, 583 bp, Homo sapiens
cgggtgacactgagtgcagggaatgtgatgagacatactttcctgagctccagaatgacaatctctgactaccttctgggcatgtccacaggaacatcccatcaccttccacaccaacccctcaactatgtttatgctccaggaccccagaattccctgcccaaacagctccaggcttcttacagggcctatgcaggcctctggcactggtttgtcctctggagggtgccatctgctgcaggggcagttcttagtgtggatggggcattggcggagcttggctgtgcagactggagtgccacttgttgggctcctcatggtgcaggaagacgggtaggctttgggtcactggcctccatggatagtgtggtcccaggtcctggcctgtcaccctgtattatccagctctgtgacatatcatcatcatgtttaaacccctcctgccatcttgatcagatcatcctgattagccagttactaacttctcttgatgccacctccacaacagctcttgggcacactcccttctctccacccacactgcctcggcctctcctctgttctcctgggtaaagcaaaataa

SEQ ID NO: 474970 - DNA, 672 bp, Homo sapiens
ggggcactcaggatggctgagactggcactagggagcctttgctcctccagggagcatgagaaggcacatccaggaggtggatgttgttagtgatgatgatgaagaaaataaagtacagaaaggctcagcaacttgtacaaggacacacatacagtcagcggctgagtcaggatcccagcgcagacaggctggccccagtgcccccgtgcctcccttccctgtcatcaagggctctgggccctttactcccttactccacatgcacctttgggctcctctggcttctttcatggtgaccctttctgcttccctcagtctggattttattccaggacagatttatctctgcaaaggtgggagagcctattccctgggtctgggctgggggcgtgatgtgctttgcaagggcctggttaggttttgcacaagcagtattgtatgcaccctagaagaagaggtgactatgggaaaagctgtcctagagcctgaattccacagcccacatcccttggaaggggattccaaggcccacagcatgactacatggctacgctcctttggagtggtgcaagtgggcccacacactttactatcctccttgcccactcccaaaattgtcccaggtataattaaattagtgaattaaccaaccccaagtccacgagctcatt

SEQ ID NO: 474971 - DNA, 478 bp, Homo sapiens
gattaaagtcctgtctgttatggtcccatctgggagtgatgggagacagtaaaagatcatcaggcattagattctcacaaggagcgcggaacctagatccctcccataggcagttcacaatagggttcgcactcccaagagaatctaacgctgctgctgatctgacaggaggtggagctcaggcggtaatgctcccttgcccactgctcacctcctgctgtgcagcctggttcctaacaggccgtggaccagtgtcagtccgtggcccaggaattggggacccttgccctagagcaactattgtgtttacttgtgtcttctcttctagattcagtttcttaagagcaagaactgagtcacttccgtttgaccagcatgtagcatcatgcctggtctgggtaagagaaataaagattatggataatccaaaagctttcaatctcctttcatgtctttcacaataaacctttgttgaaga

SEQ ID NO: 474972 - DNA, 485 bp, Homo sapiens
cccagggccctgatgttgtatgtacacaagggactctcctggtctattggttgcaaaaactgtgggaaaagcatagtatctgggccaggtagcactgtccctcacagcaaagtccctcatggcttcccttggctagactgcttgtgcttcctggccagcatcaggggctgctcctacatcattccatcattgtctccttgggcaaatttcaacctagttcaaccatccatcaaaatcctctgctgtacttacaatagtggtgccaaatgtctttatcctatgcaggaggatagcaaccaggatgaagaccagcatgagaagctttgcctggtggcccaccttctgccagacatgatattccctgataacctggaggaagttgactatcttgttgggatcatggactgcagcagcccgggagaggaaaggagagataagagcaaggcagcactgggctatgaggttctggagagcaaggcctgact

SEQ ID NO: 474973 - DNA, 1023 bp, Homo sapiens
ttgctctcctcaggctctggatgtatggaaatgcctagacgcctaggcagatgtttgctgcagaggtggggccctcatggagaacctctgctagggcattgtgggccggagaccccacacagagtccctactgggatactgccgagtggagcgttgagaagaggaccactctcctccagaccccagaatggtagatccacctacatcttgcatcatgcacctggaaaagccacagacactcaacaccagccagtgaaagcagccaggagggggactataacctgggaagccatgaaggcagagttgcccaaggccatgggaacccccctcttgtatcactgtgacctgaatgtgagaaatgaagtcaaaggagatcattttgcagcattaagatttgactgccctgctggatttcagactggctttgggcctgtagcccctttattttcaccaatttctcctatttggaatggctgtatttacccaattcctgtacccccattgcatctaggaaaacctctagaggaagtgtggctctgtcaacaccttgattttggcccaatgattccgatttcagacttctcacctgcagaattatggaagaataactttatattgttttaatacaccaaatccattgtaatttcttacagtaaccacagaaaactagtacaaccagaaaaaataaaaatgttgcatattatttcatttgcatatatggttttaatgtttgatgctttgtataataatatatcttgttttgctcaaatcagtcatcacctcaatgcattttattctaccatagccctgaaaaaaatagtaacactataaaagtcatcaaaattatcagaaacaagtctgtgaattaccatattttgaaaacgttttttaagatatagtaatagtatgtgacatcttctataccacacagaaaactgttgacttaaaaaagtttggaagcatttacttaaactaaaggaaatccaaatgtttaccttttatctgaaagaaaacgaaaaactc

SEQ ID NO: 474974 - DNA, 618 bp, Homo sapiens
tccccagagtgtgatgctccccttcctgtgtccatctgttctcattgttcaattcccacctatgaaaggctcacgtgacccacagagagaaagaaaaacagtgtggtgtgacagccgacctgacagccatatgaggaaggggaaccccctactcctggccaagggaggcagtgagtgggcacggtacccagccggggaacctgtgctttttccagggaactgtggaacccacggattggaagattctactcggcctgaagtgaaaccccagaaaactgcagcagacctacagaagacggacctgattattgaaagaaaaacaagcagaaagcgacaacaagagcatcaacaacaaacacaaaaaaggcccccacaaaaaccccagccaaggagtgcctcttctccttcaaatgatcgaaacatctctccatcaagggcccagaactggatggcggatcagatggatgaattttcagaaataggcttcagaagatgggtaatacaaaactatgctgagctaaagtagcatgatctaacccaatacaaagaagctaagagccttgataaaaggaaggaagaattgctaactagaataaccagttagtgaggagtgtaaac

SEQ ID NO: 474975 - DNA, 2115 bp, Homo sapiens
agaatttaatccatgtacattcaggatgatattttttctcattaccgcagggtgcctgcattcttcggcccgtgacccccttgctccaccttcagtcggcaatggtgatttgcgttcttacattgccccactattctcttcttcttcccttgttactttcatggaaactagtgattacattgagttcactaagataatccagtattatctctccatctcaagatccaagtttctaatctacgtcattttctctatctctgaaaaacatcttttaacatttcttgaacgtaccctttgcaatattgtgaaaagctatgcaatgatgtatgaaatcaaaggaacagtgacagagatatgtcaagtggaatggtgtggcaatgattccaagatactacagcaaatgaaaataaaattagaaatcctaaagaaaaacacagaaataaccaaagaaacctctctgatagaaaaattacgcttcaaaaaacggaagatttctctaaatgaatgtttctcctcacaaatataacaaatagaaaaatagctttgtgaactgagagtttaggatgaagacagaaacatttttgaataaaagggaaaatgaaaagaagagcaaaaccgtcccatcatacaattagcaaatgaattagggctatgaggaacaatatacacaggtggaaaccataagtgtaattaaaatcataactcctcatttcatttttgggtttaatgattttttttatcttaagatatgaatctatttccacttctaattattctgtatttttattgaatcttaaatattctgtgattccttttgaaaattcttttcaagaaaatatacaccttctcaagattgattgtcttacctgtaaaaatagtaaaattatataagaatatgaattgactgctgtattttgaagagtaaacaaaacctggaacaaaagaaatggcaataaagtttgtgtgttaactacgtgattatttcataaaatatgtgttttagtaataaaatccaatccaatgtcatttaacaaaatgttttattagccaaagcccatctaagctattctttgatcaactgttttcatcatcacttttgtaaatattttgaaagaaaataaggcagctgaagataaaagccagaggcagggaatgtagtgctgattttgggttaatggtgtcctcaagagttccagaaagtgattttaaaatcctgagaacgaaaggttggtgagtcaggtagtgccacacaaaccattttgtccatgctttctgaccctacatgattaggggtcattctcacatttgtaataaatcatatagattaatttgacacaacacccagtatcttttatcttcctatgcacagagctccattaattgaaaaaaaaaaagtcagaaaaagcccagtaagcaaaataaaaacaccttttttcaaaggtgattattcttattatgatctttcaaatttcagaataagaatgagaaaatcatttatctgaaatgctgtttataccaaaatgaatttgactcagggctatttctaagaaggggcctttctgcaacattctggcacctcttaaagcaataagaaaagccacctttatttcttggccagtggcaatatttggagggtgagttaattttctttaatttttcttataattctgctttgcctacatctcagaccaaaagccgattatattttcatcaacaatggatctagaagaaaaagtaaagtattttatgtctgcagttttcttttatattcatatatttaaagtttaattttgaaatttatttaactcaaagtaattggatattaaagaactatgccagctataaattattctaactgtaaattatttaaacaaataataaaagaaaagctttgtttcattttcttcattattactctatgattgactactaaaccaacttttaaatatttaaaattaattacaagctttatcaacaagttcctcttattttccatcctactgtcagtcttttaaacaataattgtagctttttcaaaaggtaatgtttaagagaagcaagaaacacaaacttgcaaatagcttttcagtagtaatattaaatggttaggtttac

SEQ ID NO: 474976 - DNA, 553 bp, Homo sapiens
cagtagaggagcttttgagccaggatgagccaggagaaggaatttcacaacagaagacaatgtcatcagttaaggcaggaacaggccattttcacttcttctgtggtagaatgtcatcagttaaggcaggaaccagccatctggatgtgtacatgcagagaatcatggcccctcaatcaatttccagacttcaaccagtttacagactcagacacccagaatgaaggagatgccagttttgagtgggatccagaacaggagaaggctctgcaacaggtccaggctactgtgcaagctgctctgccacttgggtcatataacccaacagatccaatggtgtttgaggtgtcagtggcagatgggaatgctatttggagcctttggcaggacccaacagaatccacccccaacaccactgtttgcttctagacctataactagactcaagttttggcaggcccctagaggtgagggtcagagtgtgactcatgaggagaagcactacactctaaaagaactgtttgagttttcaaatttatgtaagcagaaatct

SEQ ID NO: 474977 - DNA, 1401 bp, Homo sapiens
gaccccagaagtatagcaacgtataaaagtatgagatttgggtgggggcacagccagagcatatcagatgcattattattaactaaagacaatactttattgaaatgttttaattttatacccaatatgttcttgggaggaacactacagaattcaagtaatatttcatcctatcatatgaagcgaacatattttcaacataagttaatagtgttaatgttaagcctggtcaccagggtgacacagtgtttgccagacttccacaccagaaatttaattcccctgcccccatctttcatactgtatgatttgaaagtattcactatttgcagcccatatacaaggaagaagagaattatgctccatcttcttgagggtaaattaactatatacattattggaattactttacatcagtgatttatttattttctttcacttattattctattcaattatgtatttgtatcagtatttacacatgaatttttactttgagttataataaaatactactttatttttttactctaattttttcagctttagcctttgggagctatttcagaaggctcctgtgtatttgtgacataccccatgattggcacttttggaagtcttcttttgatgcactaaaggatgctcgagatttatctcatctattttccgtttccatcctagacacagtgatttatccgaagagcactgactccttttacttgaaaatggcattagaagtcaagatctgaatgttatctgtgcttattaaccctggagtattttgaatctagagtctctcagatggcagaacaagtgtatatacatatgtatactaacatatgcacacaaaatatctgtacataattctatacatatccttttgtatctatatcaagttaaacataaatttatatagatagttccgatattaataaattagcacattgatcattctagtcttgtccttacttgtttagcctcagactcccacagtgaaaaacatggatggtattcatcatttacttattctattctagtatacaaggttagtggcttcagaattattaaacaatactctgtaagaaacaaatttataatgtaggatacagtgattatatgacgttctttttacctttagttttatagtctaaacattttcagaattacttaggcctgcactttctccatcaccacttttagtgaatttatttcatacttttgtaacacattttttatcattatttatagtccatttggaattactgaattaccctaaatattttttaaatatttgtatacattaagaatactccttgtgatgaaaagttttatgtaaatttattttacaaacaatttaaaaatagccagcttaatgccaataagtcatattttggaaaccaa

SEQ ID NO: 474978 - DNA, 867 bp, Homo sapiens
tcatcaacagggagtgtgtcaaaaatacacaatttcagttctagaattctgaatggctatcaagaagttaaatgattaaatctaaagttgtaagacaaaacttgatcaatgaaaaatgggacaagaatttgttgaaggattttgaccaaaatgctgatagtgatatgaacaatgaagtccaagctgaagtgctctcagatggagatgagcaacatattgggaaatggagcaaaggtgactccagctatgtgttagcaaagagactggcagcaatgtgtccttgctctaggaatctgtggaactttgaacttgagagagatgatttagggtatctgacagaagaaatttctaagcaaaggcaacagtttgggagcctgcacctggatttcagaggatgtatggaaacacctggatgcccaggcagaagtctgctgcaatggtgtagtcctcatgaagaacttctactagggcagtgtggaaggaaactgtgggattggatcccccacagagtccccactggggaactgcctagtggggctgtgagaagagggctaccatcctccagaccctggaatggtagattatctggcagcttgcaccatgcacctggaaaagccacagacattcagtgccagtccttgaaagcagccatgaatgttgtatcccacaaagccacaagggcagagccgcccaaggcctttggaggccatccagtctcaaatgggtaatttcttagacacattatgtaattgggagaaccctctaattgttctttgcctttgaggataagaactatcattgtgaagactaagtgtaaaactctaaaactgccaccttctatgaggaatgtattttcatgtttctgcc

SEQ ID NO: 474979 - DNA, 808 bp, Homo sapiens
gttttgacagcttcccccatcccggacccccaacctaccatgggaccccatggcaccatgtcagtgacctctagcagcagcatggatcaatgccatttttatcttaggctcatcatgagcctgggttccaaacacaacctctctggcctccaacaggtggctctctatcaaccggcctttgtcagtctgccctctattcttttgggggcttccggcctgcataagatgattgccaaggcctctttcagcaagaaaattctatttggaaaggctacagtacaccacagatcaaggaccaagttttcagactgctccacagaagttaaaggtctccaactttgtttccaagccaaactctatcagctgttatctttattctgccctcccctaatactctctcttttggaagctcctcttgtgcagaagtggtcctcaacatcctacgcctgatcctatctcttctaacagtggtctggccctatgtctaatgtatgaacagtctggtatgcatcctttgaaaatttgttcatgtacatacatatattcacattttaaaacaaaaaatttactcctatactttcttccaagagttttatagttttaactcttacatttaggcctttgatccattttgagttattttctgtgtaggacatgaggaaagggtccaactttattcttttgcatggacttatccagttggcttagcaccatttgttgaaaagattttcctttcccctttggactgtcttggcacccttgttgaaaatcaattgaccataaatgtgaaggtttgtttctggactct

SEQ ID NO: 474980 - DNA, 1226 bp, Homo sapiens
actagaggagaaacttgctgatcgggctgtgaggaccatggaaaagtacattacccagttcagcaaaactaaggagagaattgccaagcggggtggaaactcgtggactgtgacatcatactggctctatgtgaccatcttccagaacatttccaacttgagggatgtcttctacagggaaatgagcaaactgaaccacaatctctccgaggtgatgagcaaactggagaagcaacattccagtaaagtctttgtggtgaagagactatcaagcagcagcaggcgctctttagtcatttctcccccagttcgaacatctacagtctccagtccacttacctcacctactagtccctctacactttcctcgaagagtaagagtgaatctgtctcagcaactgaagatctggcacctgatgcagcccagggggaagacaattctgagatcaaggagctcttagaagatgaggaaatagggaaggaaggatctgaagcaagctcctctgaggaagaagagcctctactaacctgcaacggcccctcccaggcccagccctctcctatcattgagagtgccaggtcccaggaagaagttccccccagctcccctgctctatcaccaggtggagccctaagcccttcaggacaccctttatcatctgccgcagaagtagtcctccgaacccgcaccgcaggtgacaaatctgaacaatcaaagaagagagcctctatccagaggacctcagcaccccctagtaggcctcctccacccagagccactgcaagccccaggccctcctcagggaacataccctccagccctccagcctctggagggggttcacccaccagccctagggcctccttggggactgggactccaagtcctaggacctccctagaggtctctcctaatccagaaccaccagagaagccagtaagaactcctgaggccaaagaaaatgaaaacatccacaatcagaacctcgaagaactttgtacttcccccaccttaatgacatctcacattgcttcagagcctggagaggcaaagaagatggaagacaaggaaaatgataacaagcttgtctcagctgactcctcggagggccaagaccagcttaaagtctccacagtaccagacaagagcaacctcacagcacctgaacctcaagaagaggtatctacaagtgaaaatgcacaactctgaagagaaactgccaaga

SEQ ID NO: 474981 - DNA, 983 bp, Homo sapiens
tgtctggcacaacttctggcctgcaactgtgttcagtgatgatgacgagcaaggtgacaagtttgaatgattctcctgaagaaatttttgacatcgataatgaggctccagttgttcattcaccacctgatggtagaataaccaaaatggttctgaatcaaggtaattgtcataatagtcataaatttgattttgttaacactacagaaaaagtgcctatagacaacatggtgaaaatgtgtgatgggcttattgaaggactagagcagtgtgcattcattcaagaacgagaaatcatgacagtttacaaaatcaaagagacttctgagacagcaaccgttgttaatgaggcagaagagtctagaggaaacatttttaaaagccattcagcagaatgcctcctagtccctagaagacccacttcctggtccttcgacttcttctgatgtttcttctcacctaaaaatataaaacacagtggacagtaaccttttaatcacaacacagcatcataggtggaggctgaaagcctgctgttattcgttgctaccgttgtttagcagctgatgcaggtgttctagtgaagctactgtgctgctgagttatcctgaacatactattttttaactgtattaatgggatgttgtttttttactgttaagtacttatgtgtgaataagtgaaaatgattgttaatttgtagcatataaattcaaagtcaggaatgaggatgatgtcaaacaaccacagattgtccacatgagtggctgagataatgacacctttgccatctgacgattcagtgtacacaactttgtttcatgcgcattattaaaatagtgtattaaatgagcttcaggctgtgtgaataaggtatatacaaaacataagtgcactttgtgtttagtcttgggtctcatatctcattatgtatatgcaataacaaaatcccccaaaatcccaatccaaaactctctgatcag

SEQ ID NO: 474982 - DNA, 1469 bp, Homo sapiens
gtgttctaggttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgtggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggaagacaagaggcgctttcactttacccaaaggagctcgtaatatttctcttgctgaaacaagagaagctaaaaacgtactggctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgttttggtttccagtacactaaatatggatgccgtaggaaaagtgataataaaatggtccatcgcagcttctatttataacatttttgtcatttactttcattctgagatcttaggagggaatggagaatgtgaaccagatttttaactatgtataatagacatgaccaagagagaaggaaaccatagtgaaaacagaaggttatgtaaagaaatcgtaagtgtgtcttagcaaccattagatggattctgttttaaagattcactgtcagatgtttaacaccattaggcaatgtaactgagagtgagttggtgctatccttgaaaactgccttcatgcctgaatctaacagggcaacttt

SEQ ID NO: 474983 - DNA, 704 bp, Homo sapiens
cacaacctgagaaagggcaaagtaatgtggcgttgcgacacctcagggataagggtgtgggtcactccaccagcagaggtgtcagctgcaggaaataagagcaaacctggagaagctgtccccaagctgagtaaagaagatccacgctcaccattgtgggtggacatcaccaatccattgctggcccagatgaagcaaaaaggcagaagaagggcaaattggctctctctacttgagctggaacatcagtcttttcattcccttggacctcagagcttctggttggttcttggacctgcaaactctaggacctacaccattggtttccctggttctcaggcctttgaacttggaccaaaatacaccactggctttcctcgttctccaacttgcagacagcagacaaaggttccatttctccaaggaatcttgacaagaatacttatattagtcattcgttcttcctgcatgaacatgcatctaggtcttgtgggagcactgtaagtaaaatcagaagaaaaaaacccactagtttattaaaactcttgcatgggcagaagctgctttagttctcttcttaaatatgtcctattccattacctttggccccttgagtgttctagtatatgttgagtatcccttatttgaaatgcttgggacaaaaaatgtttcagatttcagatttttcagattttagaatattt

SEQ ID NO: 474984 - DNA, 613 bp, Homo sapiens
cttttctaattatgcctgaaagccccactcccttgttagggagagacattctagcaaaagcaggggccattatacacctgaacataggagaaggaacacccatttgttgtcccctgcttgaggaagaaattaatcctgaagtctgggcaacagaaggacaatatggacaagcaaagaatgcccatcttgttcaagttaaactaaaggattcgacctcctttccctaccaaaagcagtacccccttagacccaaggcccaacaagggctccaaaagattgttaaggacataaaagcccaaggcctagtaaaaccatgcagtagcccctgcaatactccaattttaggagtacagaaacccaacagacagtggagcatactcactgctaaaggagacttgtggctgtcagacaactgtgaggaaagtaactgaaatctaaatccccatggccctcccttatcatatttttctctttactgtcctcttaccccctttcactctcactgtaccccctccatgccactgtacagccagtagttccccttaccaagagtttctatggagaatgcggcttcccagagatattgatgacccatcatataggagtttatcta

SEQ ID NO: 474985 - DNA, 830 bp, Homo sapiens
ttcattgttatcagaagcagagaaatggacacgcatggtgaatctggcccaggctgctccttggttatagagatcccatggaaattgaaggatggtttgatggaaggaagggagggaaggagaaagggaatctctcctgggaaaccaggactccagagaaacatcctggacaagctgcccaagagccatggttttataagctttctggagactttgacatgcttcataaattgctttttctccaaattctcattatttgaacttttgtttttttactctgatagaaaatatgtgtatttgatagctactaatcagaatccttatcaacatagtactctaagcaactactaccaattaattgtggtagatgtcaactgtgatgggccgaaatctaaagatggcccaactgctcttgccctaatcctcaagacaagaaactgtgattgtgatgggatatcatgcccatgattatgttatcttagatggcaaaggcattttgcagatgaaagctctcactctcctaatgtgaatttaagcaccttttctctggtatacatgaattatgcataccagatagcattactttgccaagcctagaaactttttacttttatattctatcatatatcacatgactaaaatgtgatatgattctgtatggatgattctgtatggataaagatctgtccaaggttatagatcatctcactcaaagatttagaataagctcacaacttttaaatgacagcttctcttgcttttatttatgcatacctatttatattatacatacacattcatatttataagcacagaaataatttggaagg

SEQ ID NO: 474986 - DNA, 1001 bp, Homo sapiens
cggtctacagcctgagacccatcaccagagccctcgcttgctcttggcacctcctctgcctgggctcccactttggcggcatttgaggataccttcagcccactactgcactgtgggaacccgtttctgggctggccaaggccggagcccactccctcagcttgcagggaggtgtggagggagaggcgcgagcgggaaccggggctgcgagcggcgcttgcgggccagctggagttccgggtgggtgtgggcttggcgggccctgcactcgcagcagctggccagccctgccggccccgggctatgagggacttaacacccgggccagtggctgcggagggtgtactgggtctcccagcagtgccagcccgccggcgctgcgctcgatttctcaccgggccttagctgccttcccgcggggcagggctcgggacctgcagcctgccacgcctgagccttcccacccactccatgggttcctgtgcgcccctagcctccccgacgagcaccaccccctgctccacggtgcccagtcccatcgaccacccaagggctgaggaatgcgagggcacggcacaggactggcaggcagctccacctgcagccccggtgtgggatccactaggtgaagccagctgggctcctgagtctgctgtaacactcaccacgaagatctgcagcttcactcctgagcccagcgagaccacaagcccacccggaggaatgaacaactccagacgcgctgctttaagagctgtaacactcaccgcgaaggtctgcagcttcactcctgagaccagcgagaccacgaggccaccgggaggagtgaacaactccagacgcgctgccttaagagctgtaacactcaccgcaaaggtctgcagcttcactcctgagccagtgagaccacgaacccaccagaaggaagaaactctgaacacatctgaacatcagcagggacaaactccagacgcaccaccttaagagctgtaacactcatc

SEQ ID NO: 474987 - DNA, 1197 bp, Homo sapiens
gttaagaactaattcattgcaattttcttttttttaataggacataagttgaatttttttcaaaggctttttaagcatctgtggagcatctttcactctcgctgtatctcagtcagggttcaaatgcctctttctgagcaccgcagcagcattcccttggaatcatctcagctttctcttgacattcagcagaattctccacaagctctggaactcttcatggtcctcttgaagaaacccaatgttaactcccttcacaaagtgactttatgtttggcctctgatgaaatgctcgggggaataactctcaatagttcttcctggcatcatttccatcgccagactttcagcgaccccgagctgctggaggtgagggtggggtccctggaccctggctgctcacagctcacactgcacatcgcacccctctgctctgcagtgcatcctgtcctgcgggacgcccttgctagcggggtaccggttggcctctgcctgcgggaagcagtaagtgacaagagcctggaaggcggtcgaagccaaggatgcgcctcctctttcagctcccgcggtggcggaggttccagctgctgaggaggcctatctccagggcctctgatccccgggtttaatgtcctctccttcccgctgctgtgtgctctttcttctcccttctgtgctctcagtcctctgaaacttgttttgaccaattgtttgtgtgaaattgcctgtttcctctatttgaacgaccaggagttttcctgtgcggacactgaccggcataccttcctcgtaaagttcccccaaccctctcacttaatgacgcgcttcaaaacggtgattctccaatttcattcattctacacttactagctggaattgttttgactagaacaactaactgcctcagccactagagctatttggatttggaaggcagggtccattccacagcatcttgcttgataaagagcttcatattggttaatccctttttttcacttaacaataggacatgaacatcactttgtatcatactcatcactccttttgttgtaactcattcctatctagaatgtcagcttgatgacagcagacaccttcatgtgtgcttatattataaatccagcactaacataaagactgatacatggtaatgataataaattgaaattgaataaataataaaggggcaagccc

SEQ ID NO: 474988 - DNA, 636 bp, Homo sapiens
gatggaccgcaggcctgtgttccgctcccacacacactcaagatgcaatttctcctggcccatagaagtgccaatttaggaaacaaagatgacctgcaatattcacttgagccacagccgactcctatgtctttggtgcttcaagctgcatgcctgcaggctacttcatatgttccccctcttggcttagtaggatctctccctttctcctgccccttttcatctggcagcatgagaattttgggaaacaccctcatctccatccagttgggggagtgtttcaccaatgtgtatgaccttgtgggaatatgccgacaaaatagattgttattactgtccatggggcagaagaggagttctcagacgcagctgaaagaaggtagaatttatcctgatgtaatcattggcaaagggaaaactggtgtctttctggagaccaaggtcagtaatagccttatacaacaggtgatgtttgagggcctattactgtcatctctgttttacacctgaaaaaactgaggcttagagaaattaagaaacttcttgagttcatacttgtaaaactctttacctgtatatacatatacatgcatatgtgttgtgtgaatgtatgagaaagtacatgctagacaaaag

SEQ ID NO: 474989 - DNA, 1670 bp, Homo sapiens
ctccgcgaggacacagatctgcgctcccgaggaagtccagccaccccctcgccgcccacccccacctctgcaccagggcacaggaatggtgcagcaagctaggctagagggctcgggaggagtggtcaggaaaggcttctatgaggaccgagtgaagagaagcagagagtcaagtgcaaaccgaggggagattattccaggtacagaaatgagtaagtgcaaaggcacagtgagctcagcaggtcctcgggacaggaaccgggaagaagtgatgggggcagacagaggcacaaagcaggccaagatgcaagttgagcattttgagcagaaatatcagagcagtgattccatgttttcctcattgtgtcccctcaggttgcaaacaaatgcactttgtcccattactggtgatattaaacatgagcactggattaaggtcatatcttccaggttccctcatactcaggattcagcgagctctccaaggagccatgagtcctctcagtggagaatggcatttacagaccacggaaaagatgtgccgactgctcttgaggtgtcacttctctctgactctcagaggacagaactaggaaacagatgaattatattgcatgtaattatagtatctgtttatctctctattgaaatccacacgatatttccatttccagtccaacattaacgggttcatcccagttttctccttttccatattggtgattctcggcaccagagtaccaataaagggaatgtgcttgtgtcagggaaaaaatgtaggaaatgaaaaagttaattcagaatatttaaaataggccaagaatcatcccctgaaagagtacagagctatgcgaatttgattttaattttcccgtagctgacggctttgtgttttctgtattctcacatgtggtggtacccagcacccccacagcctctcccatgtggtggcacctgaacccccacagcctctctcacatgtgatgacactgtcacccccacagcctctctcacatgtgatgacacctgaacccccacagcctctcacacatgtgatgacactgtcacccccacagcctctctcacatgtgatgacactgtcacccccacagcctctctcacatgtgatgacactgtcacccccacagcctgtctcccatgtggtggcacctgaacccccacagcctctctcacatgtgatgacactgtcacccccacagcctctctcacatgtgatgacactgtcacccccacagcctctctcacatgtgatgacacctgaacccccacagcctctcacacatgtgatgacactgtcacccccacagcctctctcacatgtgatgacactgtcacccccacagcctctctcacatgtgatgacactgtcacccccacagcctctctcacatgtgatgacactgtcacccccacagcctctctcacatgtgatgacactgtcacccccacagcctctcacatatgatgacactgtcacccccacagcctctctcacatgtgatgacactgtcacccccacagcctctctcacatgtgatgacacctgcacccccacagcctctctcacatgtgatgacactgtcacccctacagcctcacccagcttgcatccagctgtcaggcaaagctttgaaatgcacttgcatatc

SEQ ID NO: 474990 - DNA, 870 bp, Homo sapiens
aggaagcggattttcctgggactggcacctgagtgtcttgtatcggtcacggaggagtcaggacagaggggtcatggaagaggctggcggggccgggaaggtgctctgcccccgtctcggggtccagggccgtccactccgcccgtggctgccgcccgtggctggctctctgcggagcagccagcgcccggtggaacagggctttctggaaggtggctgctctctgaccatgtcctcggtgccagccgggtcaggggctgctgtccacacttcccacttaagccagtatttaagacagagggagaagggaggagaaatgagggacagaggggagaggtttacatggggcagttgctcccgaggaaaaagaaaaggggtccccaggctgtctcccatggcgtccttcctggtgcccaccctctatgccctacctgcaaccccacgtgcgcatgagaggacggacgtctcttccagcctgaagggaaagtgcagactttccgcatctgccttgcagccagtaccagaaaagtcaacccaacagttttaaacagtggtttttatatactattaaaagctctataataagcaactttgggaatcaggatgaaagctaattatagaacttctttgccatggctgtttctatttacatcttcaaaaccacagaagcaaataatgtaggctttcctaatacgtcagcatcttcttgatttctgagttctttgaagctgccctaaatctttcccttgaaaacacattgtggttgaatattcccagttcaaggacaatttcagattagagtttttagtccaagtatactattctttccttgaaatactgaatctcaggactcagacaaaacatcaaaat

SEQ ID NO: 474991 - DNA, 1713 bp, Homo sapiens
actaagtttgagaaccactttgaggagtgatgccgtatctgatcccctgcaatcacatgatgctgagtcagaggtgggctgtgaaggagagagactgttactctgtttctgcggccaagcttctcgccttgactcctgtctgctgctccagcgggatcactctgacgctggggaaccaagagagggattatattctctggtcaaagtgtatgcatgacacttcagggcctgtggagcggccattccccgaagcgttctccgagtcagcctgcattgtggagtatgggaaagccctggacatcagctacctgcagtacctgtgggaggcccacaccaacatcctccgctgcatgagggactgccgtgtctggtccgccctgtatgatggcgactcccccgaccctgagatgtttctccagagtctgacggaggagggcagtgtgagctcggcctgccctgtgttcgggctcccgcaacaactccccaggaagacaggacctcagctggctcccagaaaggacaagagccagacagagctggaatgggatgacagctatgacactggaatctcctcaggggctgacgtgggctccccagggccttatgatgatctggaggtttcaggccccccagcacccattgatccccccaaacacatccaggagatgaagaagaatgccctcctgctcttcaaagggtcctacatagaagagtcggactttcaggatgatgtgatggtgtacaggctgtgtgctgagaaggactccgaggacatgaaggattctcaggaggaagctgctaggccaccagctgaagcccaggctgaagttcagagtgtccccatcaacaacggccccctcctcagcacccagccagagacagattcagaggaggagtggaatagggacaattcagacccgtttcacagtgagcccaaggagccaaagcaagagagggaacctgaagcagccccagaatccaactcagagttagcatcccctgcccctgaggcagagcacagctctaacctgacagccgcccacccggagagcgaggagctcattgcccagtatgaccaaatcattaaagagctggattccggcgccgagggcttgatggaacagaattaccccacacctgatcccttgcttctcactaaggaggaagaagggaaggaagagagtaaaggagaaaaggagaaggaggggaagaaggagctagaagatgaggaggatgactttgactcttttatagcggagatgcctgctgtagagactgtgccttccccatttgtggggagagatgaggctgcctttgccagtcgccatcccgtgaggactcaaagcaccccattcacaggtgaccatcttaaattgctttgtggtttctgctttcgaaagtacttgtatatattggaacaggaaaggaaggtaggaaaaggtaagggatattatcggtttgtctaacagagggctgcaaatatttttgtaaagatcaaagaggggtggctttatttttatttttccattcttgtaatgattatcttatttatttctcaagctagaggttagattttattacttagtaacttcttttgatatgtcagtgttaaaacagtagggctgattaaaccacacaagaatccagacgtcttatttaatgacttcatttattctagcgtaactaacttatttttctccttagcacttattt

SEQ ID NO: 474992 - DNA, 1192 bp, Homo sapiens
cacccccagccagtggcccttgctaactgaagaaaggtcatgatcgggtccactgttgggagcaagtggggaggggttgccaaaataggccattatttctttgaaatggttgatgacaacaggagactgaggtcaggagttgcagcagagcaagaaccaggtggggaatctatggctcaggaaggagaagaggggagtccagtggcttctgaggcaaaggggcctaaggcagccactgaaaccaggagtgtggattcaggaggacaatgcagggagcaatgggtgagatacacctggggagtggtcaggagcggttaccagagctggcatgttgtctgctgctacttcgcatgcccaacacaggtaggttgcagtgggtctgaaaaagaaataaacaagagcctggggctgaattccatggagcgtggtttttcctccatctgcacgtgggaaattgagcctatgtgagctccagcccttggctgagaagcccatcctctcaccttgaattgaggcaacgttcttgtaggggacatatcctgagacttatccggggcttagatttggttggaagtgggtgacctgaagccaccgttatgttttgattgaaatttttttatataattatagggaaaagtaattttccccattactttttggaaaagataaactcgattttcttttttttattggttaccctttaaagtttaattgtacttaacaaagcctaaagttacttagtatctctactcttttcataaacttttagcacatttaagtctgactacccctcccatcttatatgttatttttgactgctttaaaaaaaatctctaaaattatgcattgttattgtaacttcctacaagtattcatttagatttagctgcatatttgcctattcttagcttacatttcttcttattttttactcctcagctttattaaggtataattgacaaatacaaattgtatatatttaaggtatgcaatgtgatgttttgatatatgtataaattgtgaaatgattaccacaatcaagctaattaacattttcctcacctcacatagttgcctttgtgtatgtgtgtgtggggaatacttaagatgagtcttagcaaatttcaagtatataatacatcctttttaactatggtcaccatacagtacattagggctccaggactttttc

SEQ ID NO: 474993 - DNA, 614 bp, Homo sapiens
tttagataacttgcctagtgaacatggcactgctagtaagggtggagctgggattcaagtccaggttgtctgactccaggatagcaggcctgaagcctgtgagtggaagtggcttttggttgccagaagcatcagctggagacagaggcccatcagtaggaagggctgccgggtgccctgggaagctgctttcaccagagatttcaaagccagggggcctgggaaatatctggggtgatgcagaggggattcctgctggaggggtggggacaggggtgagatacaaggtgaccttgagtttagagaaatcagagagagagactctgacacaggaggaaatcgaatccaattgccttgaggtggtttccttcctccgaattggagaaagtgtgacttggggaaacatgagacacagccagccagtgtgccctggtgatgtgggggagaaacctccccctccccaacttgggactcagcatttccctgccaaattgggctttggcactgctatggacgccttggcaaactttttcgtttcccaagagcaacttcctggttcttaattaggccttttattcctagatgtctatatttaactgtgctccgtaaatgct

SEQ ID NO: 474994 - DNA, 777 bp, Homo sapiens
ccacaagcgccttaacatctgtccagtaatgtttttctttatttttggaaaattctatgccattgtctcttcaaatatttcttctgctttgtccctttcttatcttttgggatttcaattacgggattctacccctcctccctatggcaggcaaactgtgtcctgtgtctttggtgaatcatcctgccctcctccagcagtagaagacctctcacagcattggtgtgtcaagatttattgcccaccttcaggagctcaaggcttttgctcaatggaagtgaaggcttttgcctttcctgcattggcagctgcttcttcctccagatctgctttctcaggtctcccaccattgccccagtcttacctggaagccagtggtttgaatcagactgagtctgaagatctgagaaccaaaatgggagtgggggatgaggggcttctggttgttgaactctggaattctgcaagtgacaaggaagaaatgaacagggcaaaacatctgcagtaattcaataagaatatgatgtgtatatttcatttctcaaattttattttagattcagggtatgcatgtgcttgtttgttacataggtttagaatcctcagagtctattttcttcatctttatgtccatgtgtaccatgtgtttagcttacacttctaagtgagaacgatatgtgcatatttgattaatatagtagcccacccactgcaagtgggtctttaaagagagagagagagagagagagagagagagagagagagagagattgcaca

SEQ ID NO: 474995 - DNA, 717 bp, Homo sapiens
gtgcctgagttaagggctgactttaggcgacactacagcaactcagaggagagtctgggatggaggagagtctgggatggagcaggcttggggttgaatcgcagctctcttcttctcctgttcatgcaacacattttgagtgtttacagaagaccgaacttagtgttgagggacagcctaaagaagacagaagccatagaatctggcctcgagctacttgcaatatgaagaaaaatgcatggcctcagtgcctctttatcagacatcatgagtttggggtcagatatacagatatccgctctgtagctatttcaacatatgaattttggggaaacacaaacattcagaccataacaccaggacgactatgcggagggagagccaagcagagaggaaggaatgttctgggggataaccaggggcagacccagtgccctcctgctgaagtgctggtaaacactgacactctgggaaagcgaatagcctggtgggcagacaaaacacagaaactgcttaacagtgtcgatcagacccttcagggctctgctgtaaacataggggcagctgcaagaaaagctggagcaattgacagcctctctccatcctgccccagtgactttgaagacaaaggtctgatgcatttttctttgagggttgtacctcaaatgagagtatgctcctctcgttcttcagttgattagatgaaagagataaaac

SEQ ID NO: 474996 - DNA, 1778 bp, Homo sapiens
ggcagtggccctcacgccagcagatgcttgtcatgagcctgtgcggctggatttacgctcctcatgtctgccactgccaggacaagaacaagagcagttgctcctgccttttgcatcttgggtcccagaatgaaacacgtggaggaggcctgtccgggctgagccgatgatgtgcagtgagacgcttgctgctgtgtgccactgaacatctgtcgttgccatgcagcaagagctgattgatgcagaatccaaagccttacctcgtggtcctgagtgtcctctctgacagcatttttgtacactctcgccctcatggattgtgctccagcagtgtgttcctgccccagggttttgcctttgttgtgtcctccacttataattttatttccttcaactacctgtttggagctctggtagtgataattgtggtgaagcaggataaggggctaggaggtagagtggtcaattttggcatatcctggaagctggaagtgaggggcttggacagggatggaaagagctgccctcaagacccagaaaaagacagcaaggagcagcccaatctgacagaaggagagaaagcaaaaggagctgtttgcaagaaccagatctcttggagcctggctagtgccaagctcttgtgtgtgggcagagtctgagcggatccgagtgtttcaatgagctaaactagtcagcttcaagctgttccatagacagtaggtgtgaatccaaaatcatttcagacattcagctttataatgtttcttttaagaaaaaaaaaaaaaaacatggaagaagcaccagacccaaatgatcactttttctcttggccagttacctgtacaagtatcaggccagttgtaaaacacaagtctgggtaggttagaaaggcaagttgcagatgcctcttcccttacagcagcattcatgggagagcttctttctttctctctgcctcaaggatactcaccattcttctattccatttttagaaacaggctggcaacacacattctccagtctccacacaactctcctctcctcgctgcactttacaagtcattttttacctgggttatgctccttagctacctcaccttcatgtggaaactgtacaggcccctttctccaagacacgggaaagacctggaaggataatagggtggagagcttgggctgaagaggcattgaaagggaagcttccatgttgaatactccataactctcaataatgctcgcttctttctacctgagtcagtgcatgttttggagtgaatactgtcatgtgcaaagtgccttgctcagtctcttctggatcactttccaaacatctgtacctttatcaatacagaagtctctggggccctgtggcatctgtaagaacaggctccccggctgaggcagccaagtgcaaatccagcacagcacggggatgctatctatcactcagggctttccagggagatcctattcagaagcccaggtgcttaacaggtaaggaacagtgttaataaaagttcttttgacttgaaagggcacagaaaaaaccaataaagctgagcccagctcttaaaaaaaaaaaggttgataaaaccgacaaaaaataaagaagtagtttatcgtggttctaaaagaaaggcgagggtttttctttctcttgtttaaaggcagaattaattaatctaccgctggcttgagctctgaatggaatgttagctgtgactctggggggctgttaagtcctctggaccctggataagctttcattaaagcaacgg

SEQ ID NO: 474997 - DNA, 1165 bp, Homo sapiens
agatcagatccgctgtcaacatgacttgttcctatatccagtctgcagaaaacgtcaccatcacgtggctgggggccactggaaatcacagcctcttccttcagctgagcccttattggcgcttttcatcttctttcctaagccttggtcctcagctgctctcagtctcctccatgactcctgcaacccccaccaggcttctcagctgccatgttgtgagatgctcaagcagctgtatggaggagcccatgtggaaaaaaactgagcacccctcacaaccgatattcccttaccaggagtgtggcaagcctccctggaagcagactcttcagcaccagtcaagctttcagatgctgcagccgtgggcaatgactttgctgcaatcttatgagagactaagccagaaccacccagctaagtggctcccacattcatgactcacgaaaactgtgtgaggacacatggtgaatagagggcttgctggcaattggttcacaagctgaggagggcacaaaggccagatatttcatctgaagagttcacaggctattaaaaacattaacaagattttactgcctcacctaggatggaaataattgctttaaagtgaactggcattaaagtgaacacgtcaagactacctacttggaagctacaggagacagaaacagaaaacacgactcctgaatcatgttccattactttaatcgctaaacactgctccgtttaagctaaagagatataatggtacatttgacagatgccttcacatcaagatgagatagggccctgaaagtcgcatgttgaacctttcttaccttctacgaggatgtcactcaaaatcttttctcaattcctcttcattggctgattacacaatacagagtcattcctagtgcagcccaaccctctccccaggtgaaccttgctttacacaaaacacctgtgtataaataacctggtaatcattcaagttgtattctaaatgcaccacagagatctcactttttaaggaacactgaaataaatgctttagtgaagcagaatagcccttttgtaatgtaaacaatataagcctagataaagcttccaatttacctaagtttagatttttgcatattgggtttcattaaagcagcatatatctgtaaaagaaaatattgta

SEQ ID NO: 474998 - DNA, 1543 bp, Homo sapiens
ctcttaagacctggaaccagaaactggcacagcatagcttctatcctgtttcatttgtcaaagtaggctgcagccacccaaatggtgactgtggattggagcccctgtttgctcttgggaggcctggagccagcaggagtcctgcgttcctgggcacagctgcagctgtccaaatggtggctgcagactcaggcattcctgaacacttgggagcccaggaaggtctctttgccctcacagcctccaaagtgccagcttgcactgcctggctccttcctactgtcagcacccactcctatcctagggtaaagtcagggctgatcccgggcactataaacagaggcaggaggaagacagattcctgggcagaaggcggccagggaggtcctgatgactggagttctggctgccagacccacagactaaagtgggaacttgtggtgccttttgcgagacctgcagagatgtcagaactaccagctgcggagaggagctacccctctccaggacctcctccagggctgagcactcgatgggatgacctgtctacaaagaggagctacccactgcaggtcttctctgagctgagttaagattcaagaaataatcagagattacctaaagcatttctatctaatcatgttacctacagcattattgagaagatttgaaatctatctaaatttttaataataggagactgataatagacatctataatgaataactatgaaacaattatatatcacacagtagcatatgcttaagacaatagttaaatgctcattttaaaaatgttttaaaacttaatttatgaaaatgataatgtatacagtatattttacatatcatactccatgtgcacatgtatcacctttctaaggctttataacaaattaccataaactgtgtggcttaaaccaagaaaaaaatgttttctcatagttcagtggccgggagttcaaaataaatatttggtcttatgtgagggctctgaaggattctctattccttgattcttctagttcctggaggttgggagcattccttggcatccttagttcatagattaactactccaattcttctgtctacatgtggatattttctctgtgtgtgtgtctgtatctttgtttccaaattataaggacagcaatcattgcaattagtgcccataataatctagtataagttaatggtaattatatctgcaaagaccctaatttcaaataaggttacattcacagattttggatgaccatggctttgagggaatactattcaatttagtatcataacatttatacatgcaaacatagattaaagtactgtgtgcatgaaaatatattcttaagtgataaacctcaaaacgttaaatttgcttatctatgagcagtgtcattacaagagatttgtatatttttctgccatactattctgtggcaaatttttgtacattcatttcaaaaaactattttaaaagtatttacattcctgctactgcctctgacaacgtatctgataccagacgtatctgactgtg

SEQ ID NO: 474999 - DNA, 630 bp, Homo sapiens
agggctgaaacatgctccttgctcatcacctttctagcagcacgagggagagaagagctgaagcccttcagggagccaagacgaaagaagtagaatatttgaatatgttgatggtgagaattaaaaggagtctagttacaatccctaaagtttacaatcctaaagattatggaaaatcagtatatgattattttatgacagaacaaaaatgggaggttctaagctatgaccttaaatttcttcctatggcacagggtaagcaacagaataatagaacattacggaaagttcagttcagtttgactgactgcaaagttgtcaatgaaattcaggggatttccgctgtcaagtcatgtgatactgcaggccacactggcatgtatgattgtatgtcctggacatgccagaaagttaacatccctcaagggaacccaagtttaaacagtgcaagtaaagagaatctgttcttgcagttggggagctttcatcagccaaagtagaagtaaaatcttttggacagactagtgaacggtcactgattcagttatagatggtataaggttgaattgtgctactttgacatgtttaattaactaatatagaaaacaatgaaaatttcatctgtatttt

SEQ ID NO: 475000 - DNA, 857 bp, Homo sapiens
gataccagaattctaagtcagatgctactgcttgcacagaaattactctcctctcatactgctataagtttgctgttactgcttcccattcaggtggcccagaggaggaaatcagaacccaagtgtggtggaaagggtgtctgcatggtgtgtagttggtcttgtgtggggtgtagagcctatgcaggtgacccatggagaggcaacatcatgagtaaacacaaagttgagagtatcacacattcagacaataagaagcagttctttttttgctggattacagaaagacagaggggagtgacagaagatatgccatattctacttcatatatcaagaagtgtcagaatgaaaatttctccaaaggctctgtgagaagaaaaacagatgctgacccagagatctgctttcctaatgcaaatgtaaagcaatttgaagacgtccctttagatgtccattttttaaaaaaccttgcagcagctgttagttgtcattagagatttttagggtgagccagttgtgactatcaggaggagtttctgaagaacttctgagtgtttgtcacggacttggtactcagtcaataattatttaacatattactcatatgttacaaatatgtttacagaagtatcacagaaattaacatcatctccagagttttagaaaaatatatttgaatagtaagaatataatgcttcttggtcaaattagaccttttagactaaatgattatgggaagtctaactgaagttttgtcaattttatttaacttttggaaaaaaaaaactactttttgtttcattaacctgtaactttagaagtctatgtacgttccattgtactgtggctaagctgg

SEQ ID NO: 475001 - DNA, 1838 bp, Homo sapiens
ttgagacagtcaggaagccggggtgccataagcctcaacattctgaaagtccaagtaaggctatgacccctgcacctgatgcaagctttcagtgtgctggctcatcttgctggtgtggggaagcagctggacccttaagtaattgggtgtctattccttgcaagcagaagctagagaagctgcaagatctgctgtccaggctggtacagagccagacgctgttgcagtgcacacatacagctgctgatccactgcctcaactcactgtcatgaagcagcagccagacctgcagttcccccagttcccactgggtcatatcattcaattatttccaaactctgagtcagttcagagaggaatgagaaaatgcaactacttttcaatgtctaatcatcactatatttctattgctcaaatgtgcaagaaatactttataaaattttgtggtcacttacacaactccccactactccaaattagctatgattatgattaagtcaacccactggtctttcagctgacataaagttgaataaaaaaatgttgtttttacctaggaattttctttttttcccactgatttatagttattttggcactgaataaattacaagtgaaacaattacatgattcaaaagactagagttaagaaaaattgcatctgcatgaaaaaataacagcaacttgaaagatggtccatcttctcaacatatttaacaatgaaagattattttgggaaggaaagatgcacgttattagttccaatttgaacgcttttctaccaacagaaatgaaatgaggcagaaaagaaaaagtaaaaatttggaagaaatgagaagtattcccttttgatatttgtgtttttgaaatgagattacttttctacctacattaatattggttcccatttgaaataaatgatacaagaacagcaatatgctaatttaaaatatatagagatgattataatgattttaaatttgtgtattattaatatgtttgtatttattcctatacagtccattaagtgaaattgataagagtatatcacaaaaggaaatgctatgaattggaaattcacataaaaatataattaatgtatttattgaatccctatcattaagctaggggtgaagaaaaagaagagataaaaaatataatgaaattattgacatacaggggtatttgtggttggtttttcagacaaaagtaagaaaatcaggtcttgtgtatatgtgggtgtgtgtgcacccccattatagctaaaagtattttgcctaaaattctctgtacataaaataaaaatagtaatatgttatcctttctatttcaggataaatacagtgctctgtgtgaaatcgtgtttcttcattagaagggtaattttatattgtttaatatttctattagctagatgtttcatcataggaaggagtaaaccctcttccatttgtctcagaaagaataaaaaattttctccttctatattatttgtctaataaatatgattgttctggtatagttcattcattttactgaggaaaacaaaacattttaaattgtgttaaaattgcaattcaaaatatcacaaaacttagtacaaagattttaactcgcagcttcattacataacacaagaacaaaagtcaatcaaataaaatgacaattttgccttaagattaaatgaattcctgatattaatctttattactatggctgacggtaaattattaattccaaggactccttttattgggcataattattcagatttaccaggtgtctctaaagaagatgttaacaaataacttgttcaacttcagtgttgtaaatattt

SEQ ID NO: 475002 - DNA, 647 bp, Homo sapiens
ttacaacagaccttgagaacgccctcaatggattggatgattcctgcccacattagttctttactcagtctaatgattaagatgctaatcatctcctctggaattctccttacgtctgccgctgaagccaggaagccaagtggtcttactggcaggtcccactcccataaagccaagcaagctaagaacgactggcttgaaattctcactgccagcagagcagtctggagtctggcttggatgactgagtttggtggagaaagtggcaaccaccattactgtggctttggtaggcaattttcccctgacagtgctaaggagactgggaggtttggactcggcagaattcaccaaagcgtagcaaagcggctgtggccagactgcttctctagattcttcctcattgggcaaggcatctctgcaggaaatccagcagttccagtcaggggcttacagacagaactctcatctccctgggtcagagcacctgggggtagggacagctgcggtttcaggttcaacggatttaatctttgctgcttgccatttctgaagagagtggctgatcctgacgagggggattctcccagcacagagcaccagctctgctaagggactgactgcctcctcaagcaggtatctgaccc

SEQ ID NO: 475003 - DNA, 4205 bp, Homo sapiens
tggatacccttcccctcaaagatttcttgaaaaaacaaggggctgatgtacagtcaccctttgctatgactactgaaatgtcttttccgcgagatcatgaaccctcaagaaggaagaaaccccggacacatctgaaggaacaaattcgggacacaccatctttaagagttgtaacactcaccacgaaggtctgcggcttgattcttgaagtcagcgagaccaagaacccaccggaagaaacaaactccggacatggtagtttgttacgcagaaatacaaaactgatcccttctgagagacagaattcttattactttgagtatataagtgtgccagctcccccttgttcaagtacttatctttattgtgacacagtgaaagctaatgggaatttttcctatatgagtatccagacactgcagagctcatcaggacaggatacttcagggacagcaactgtggcttatgagaaggcattctagcctaaaaatttcaagttcaagtcacaacttaactgcttattagcatgtgactttatctgagttgcatggcttccaagagcctaagtttccacacctatgaaaagcagttatatctcatatgattttcataatatttttcagattcatctgtgttagtgaatcagtagttcattcctgattatttttgggcagtaaatcaagttttgatataacacaatctgtttatctttttatctattgatgcacatttgggaggtttccaatttctggatatttttcaagaaagctgtcttaaacattttgtacaagtatttgtattgacatatttttgaatttttttgggcaaataactaggaatagaattagtgggttacatgttacgtgtatgtttataagaaatttccaggctattttctaaagtgattgtggtcttttatattcccacagacaactaattaaaatgtcaatactaggtattttcagtcttttaatcttaaacattatagtgagtgtttagaagtatctcgttgtttcaacagtagtatttcattgtggttttaatttgcattttactaatgatgaattattgaatacattttcagttgcttattggacatccatttatcttgtattgggaagtatgtcttcaaatattttacctatttttaattgaatttgttgtcattttattactgacaacatcaaatatatgtatgtatttaaaaaatgtatatttgattacccaatggtcacaaaactcgttaactggcaattaagtgaaggaccctttatactcagttgactacacaattttgttagctttttctataatgatcctcatgggttcctctcaagttccattattcagcatgtgatgaccttacctttcctcttgctaaagccatgtctctatcagcatcatgatcctgtgtttaccaggaaagctgtacctggtctgagatcttacactactttccagctatctatttatgtcacagtttcgtgaatgctggcagtaaaaatgagactctagagtcagagtcaaagaaatttactactcacagcaatagcagtaaccagagcatcagatttttcttgtgctggttccctaaactccaatactcacagaaaaacatgaagaggactagatgatagctatacaggcagtaggctgtattacaggcaagggaaactgatactatgtaattgaatattttataatgtaagttagcatgcctacctttgctccagaggaagatattacctttattaaaactggaaaataagtaaactagctttctgcttcagagggagacactattttttaaggctgattgctgcacaaacatttctgtgaagatagtcacaaaaaaggcagtcagtgcttctgtgtgtaaaacattcaaatatgtgagagatccagagagaattatctctcatcataaaattgcatgaatactaattagcaaaatttcagatcagaatgagaaataattagtatatctattaagcattatacctaaaatcacaggatgataataataacattcattcaaaaagatctattagtcagctagcatgtgctgagcattgttataaatgtttcaggttgcaactgatatttgaaaaaaattgtttttcagtattgtctttagatttagacaagaggattgggtttcttagaagtctccacttattacaaagaaataaaaataaatatattaaaaaacaaatgtttaacttttttttttaactcggaatctggagcttatatctggtacagaaaacacttaagactctaaacagctgctctcatcagtaacaatgagtaggcctcagtgaaataattcttcctagctctatccctgtattgtcaaataaaagggtgtgatatggtttggctgtgtccacacgaatatcatcttcagttgtagctcccataattcccacatgtcatgggagggatctggtggggggtaattgaatcatgggggcatgtctttaccatgctgttttcatgatagtgaataagtctcacaagatctgatggttttataaaggggagttcccctgcacatgctctcttacctgctgctatggactactgccttttgctgtttaagacttttgttgcctaagagtactgccttttcatatccattgcatggaataattgatttaatacattttgtatatttttagttatttcaagtgtgaaatatagccagtcccattttttaatgtttaacaaaagtgatagtctataattttaaatatattttaaaaacaattttgtacatactttagtaatgatgcaccaacaggttaaagagtttacacaagattatagggctaaaaagaagttataaggggttcaaacccagggtatctgacttacatttaaaacttgacgttttattttcaaagagtgcagtaagttttagagagtattaaaatgaagattactgacatatatcatggtgctcatttcactagattatatcatgtttatcctctgaaatagcattattagtgtttttaatgacactttaacagaaagatgccatttgataaaattcacctaatatccatagaaggcacaatgctcattcagcactcaaaaatcattattccagctactataattaccatactgtaacagagttttctctggaaattggtataagttaaataactggaccattctctccagtgcttacctgttttcaatctgataaagaaaatcaatagccaggttagtaagcaaatatttggcaagcaatgcatttctaataatgaaactgataattatacttctttcatagagctgtaattgaatgaatttaattgcctcttctgtttaactttaatgctaggtttcaaattgttgtatggacaggaaagtaacattagaaaaattactctactgttgctttcttttctatacagtggtttgaactcaagcaataaagttaaatgaaaaaggctctatactcaattttcaattatagtaaaggcagggagccacaattatccctttcattaccatgatgcttttcattgctgcctaggaaacttcctccctgttgttgtttgatgctgctgtgcttctcaaaatgaagagcacttgaaaatggaaggttaaaagtaaggaaccaaatcaaagggaaaatgtgaaaatgtaaaaattgacattatcaagatgaaatggtgaagaaaaatatgtgaattgataaattgactttcagaaactctatgggggatggagaaactttgaaagatttaaccaatctttatttcaaattttgtgattataatttagctatttaaaattttaaaatcgtcaagcaatatttgttaatttcaattagaatattttcatcagttttcaaatgaacatctagtagttttctacattatggtaatttctcaagaaattaatcccaagagcctttaattaggctttttcttcagtcacttgtttcactgtctagttccatatatttattctgaataatatatggaatatattattatatataatattatataatatatatatattatatatattatataattatataatatatataataatatatattatatatattatatatattatatatattatatattatatattatatatatatattatatatataatatatataataattatatatataatatatataataataataaactgccccc

SEQ ID NO: 475004 - DNA, 713 bp, Homo sapiens
tgacacaagtttacctgtctaaactatactcttgtctcagtcatgattgaatacagacaactacagcaaattcttctaacgacttcattgatcagccactatgtgacttccaaacctaacaggcatgaagtctacatagtgcttggggaaggctggttgtcccgccctaatcttattatgcaagtggactttccagttgattggtgccatcttgtctgcttcttactgtacacttggctaacaaagagaagggaagatggagccgccatcttgaaaacgtctagtccttggttcctgccagcattcactcgtgcaagctcccagcttgcaggctgctctttgctaaaaaatgatttggagctatttttcattaaaaagaaaggccttaccaagtattcccatgcccttgctgtctgcctaagtaattccttcttaactcctatatcatctagttgaaatactttagaaaatattcttaattattcacaaatgttattactattaaagcattcaacatcttcttactgtctttcaagtcattaagcattcttgaggatctcctagctttcacacacaatcttcccaaaacccttccagcctctgctcactgcctagcttgaaagccaatgtcatacatcttaagttactggtgtgtagtacttcacttttatgtaccaaatttctgtttcggttttatattactaagtaataaa

SEQ ID NO: 475005 - DNA, 675 bp, Homo sapiens
ttttcctccttggtctcctgaggtatgcaggggttagcagcagaggccgatccagaacataaggctgtcctcgttccattagaacatgctactcaatttcccataattatgagagcatgctcctctcctctgccagacttctctttggcattgggagaggtgctttggctgattagctttcagtcagctgtcagggttcagcagccatctcaaaatgtatctgtctcatcatttttgtgcttgtcagcagctaccttttccatttcactctgtcataacttttcaggtcctttacagtattatatgaagcatgacgcagagagacagtttcacaatatgagagaagtcctgagacaaaaagttcatggttcaatatgtgacccaaagagagatttgtcccaagctgtcaaacaaacagccttactcggatctaaggcacagggactaaaatgattgaatagtcatgtatgcgtcgatgatggagccaaaagttatgagtaaccccttcgtagaagatgcttctggtgctacaaagtaagtaacctggtgcccaaaagaatatctggtaaattcagataattttgcgtactgtaaatatagaccctgctatggttaataaccttcacctttgctggtaagactaaattctgttctatactcagagatcttcaaaga

SEQ ID NO: 475006 - DNA, 486 bp, Homo sapiens
gagacctgtctcagatactttgagttcacacattcatttgaggccatctcataattcaagctgaaatgctggtggctggtaagaagtggtcagattctggatatgtttttaaagaagagctggcagaagttggtgatgattggatgagggtgaacttgctaggactcaaggaaaaaaggacagggaaggaggctttgaaagaagagaccagggctcatcaacatggccgcagtgcagagcccaaggagagactcagccaggaaacaactcctggatggtcaacaaactctaacagcatggatgcggcccatgcatttttaacaagaacaattgtcaaaagtctagcaactttgaacattcataaatcatttcagttccctgaggcttttataagtcttgattgtgcaaagataagaaagatctggctcaactctagagacatttggtgttttgtattttgttttgtgtctgaatgatagatgtgtg

SEQ ID NO: 475007 - DNA, 903 bp, Homo sapiens
ctgtggctctccctgcctgcctcgctgctgccttgcagtttgatctcagactactgtgctagcagtgagcaaggctccgtgggtgtgggaccctctgagctatgcgcgggatataatctcctggaaagggaatttcctgaccccttgtgcttcctgggtgaggcgatgccccgcccagctccatgggctgcatccactgtctgacaagccccatgattattcctgaaaagtggtttcctgaaaaggtgttgcctgtccacatgttgagtgatagcacactattgcctgttacagaatattttcactttcagacattactaattattaaatttgtgctatggatggctactatccaaaaaacacaggagacaaagagtgttggtgaagatgtggagaaattggaacccttgtgtaccgttggtgggaatgggatcaaaatccatgtgcaagagatgaacatgcagatagatctccagggaatctctcctccaagctttagggagaattctaaaggattcttaaggacaaggccagatcagcctgtggcaaatgttccgacaacatgtgatctactggggtccttgaatttgcaaactgaaagaagagagttgatagcaattttgcacctatctccagatgcatgaaatgtttagttattttaagatatcattagataaagatagaagtctgactttttactaattttagcctaaatgtcattgaaaatagctcttcataaggcaaagagagggagtgtggagggtcttcataaatggtggaggaaacaccagggagaacaggaatattttcagcatcccagctcattaggcagaattcagagctgttcagaagcgtttgcacacactattctttctcttttatttataaaaacagttacaccct

SEQ ID NO: 475008 - DNA, 587 bp, Homo sapiens
agcagccaagtccatgaaccacattctcttcagactgctgcctcttctctgcatgtttacatgttccttattttctggtactacttcaggcccaatttctacattacttgtctcagttctagaattaaccatggccgcaaggagccctgggtccttttactgcaacatgttatcagaagggctcaatgttactggaatcctcctagatgatgagatagatgccattttctgtgctcagcagctcttacctggacttctcttccagatgcagggaggaacctggtgggatgcgattggatcatgggggtggtttcccccatgctattcttgtgatagtgatggagttctcacaagatctgatggtttaaagagtgacacttcctcactctttctctctctcttgcagccatgaagagacgtgccttgctccaccttcaccttcgaccataatttattatttggaaaaaaatcttaactatgtacatatatatttaaaactacctagaatatattttcaacaatagaaaatcaaatgaagtaataaatgctgtggtccgaatatctgtgtcctcttcagatttttatgt

SEQ ID NO: 475009 - DNA, 568 bp, Homo sapiens
aaatcttttccttatcataaagaaaccttcatgaggccgtagataaagagcctagagcagccaattttgagcttgaaaaggcttttaactgctcaagacaatggttagggctaaggacgacatgaatttcaaaattcctgtcctccgggttgcaaagactaagagaaaatactgccagctggtacaagttgggcctttaacccaatcccattctttacctcagtaccccaccagttacccaacatgggacaattggtgctgcagtctatttcctttgggtcaggggtctcctcagtatcatccctttgtagttgcccaggaagatgttacaagaaaagggtccctgtccagaccccaagagagggttcttggatctcgtgcaagaaagaattcaggagttcaggcacaactgaccagtattaacattaaaatagaaatcttcagactgataaaacgggagagacacctggttaacctcaggcattatatggggaaagacacctggctgacaataggcattctaacaggagagacacctggttgacctcaggcattgtatggggaggga

SEQ ID NO: 475010 - DNA, 1421 bp, Homo sapiens
aagatcatcagataagaatctcatgatactcattcgctatcaatgataacagtgcagaaaagacccacccccaaaattcaattacctcctactggtcccttccagaacacatgggaattaggattgtcattgtctctgaagacacagggacacagagaaaaatatgagcaaacaggctttgagctcaataagaagtctgctaaccaagaagaaatgcaggtcccaaataggttactgctctttagcctgcatctcaaaaataagaagacacttttcttagaagatttgaagctgacctgtagcctggagctgaaccatagctattcggcacccaatgtgcgacttgagtaccaaatacacttttgttgcaagtcctctggtacatacaatttgcttgattcaacatgtcccacagttagtaggacaatgtcaacatccattcatacttaaatttatattcttttctcatatcttattttccactgaagattttaaagtctcctaagatattcaagaattattggaaatataactcattcatcatgttgtcccaaatgatagaattttgttatttttaaaggcagaatagtatttgattgtgtagttttgagatctattgcacagcaatacttaataatagttcataatgtatatttcaaaataactaagagagtaaccttcaaatgtatcaccaccaaaatatcaagtgagttgtgccctccaattatgttctcaagctgcaaagaactgcctgtatttttttaaaagttgaaaacagaaactctttgtaataaatgtaaatttatttggtgttaaatggacttgatattagagaaactcaactaacattggtgataataatattttgttcttaatatttaaggattagagaaatgaatttgagtgcaattttttactcattttcatttttaaaccatttgtttattcatgtatttgctttatgctacaaattttaagaattattgcaagcacaaaatatgaccaaaaaattgctaaagaaaattacacatagaaaaaccttaaagattcgaatatataatttatatttattagtggaaaatattccactaagctatattacttgaaaatgtaattaaatatataaaaagactaaaaataggataaaatatatatttagtattagacatatattttattaaaagttattggtttaataggtaattgtttaaatatgtctctcttttaccctaaaataacaatattattgaccaaaagtaataataatgatatacaaaaagtcttttatttgaaaatgtaaatcattaactacattctatttattcatattcatataagatcctatataatttaaatcatgcaacaatttaaaatagctgtgcttatgccttaatcttacaaattccaaatccattaaggtc

SEQ ID NO: 475011 - DNA, 703 bp, Homo sapiens
ggcgggagtcagggcagagcagctggcatcacaatatgctttgcaatggggggcacaggaaaggcattccagggggaaaaaagactttttcttcctaattccagtgtgctcatttgtgcaggcttctgtttacagtttcctccagtaccagtgtccttcagcactcagcttttcacattcctagcttctgaggtgctcagtggctcgcagcaacccagcactcagcagctacgtctggcacttcgttttggacagttttctgccagcacggctagaataaagcaggcaaaagaaggtggaaagagcagactggctgagtcttctggcctccatctttctctcgtgctggatgttcctgtcctcaaacatcagactccaagttcttcagcttttggactcttggacctacaccagtggtttgccaggggctcttgggcctttagccccagactaaagactacattttttttttcggctttcctacttttcagatagtcactagatagcattccattagaaaaaagtcaaatagactaaatatctatataatcatatattcatatagctaatatatataaaatgatatcgaatcataatgccattcattgtcactgatatttaaagacagtgcctttaattacacaattacacttgtgttcaaggtagtttagcatctcatttttacttgtctccctcttgagag

SEQ ID NO: 475012 - DNA, 986 bp, Homo sapiens
gcatacactgactttctaaaagaacgagagagcgagccaaagctgtccgtcttgaaggcgggcagggggaagccaggaaccaggaaagagttaagcttctgacccggaagaaaagggagagctggccgcgcagctgtgcgtggaaatggccggctcaagcagccgagacagagcagagtgtgagagagctaatggaagtaagctgctgaagaaaccgtattcacctgcctatggccctaggcaccagggattgaattttgcagggccgtcagagaagcatgtagaatactccttagaattgcctgcaggccgtggcatttgtccagtggcagcttttccactgaagatgactctacaacagaaatctgaaagtggttggaaaggcgatggcagtggaacactaattttgagggccagtagacaagttccaggctacttatccccagcaggtagtcacacgaccctagaaactcatgacattcaggtccgctacgatcaccagcgtctagaaaatagatattcagctacaatgtataataacgacaatggacttaattatagctgacatggttgtaaagaacagagagaaagctctaaccattctagatgctcatggactttatatctcaagtctgtggattctggcttagtgagctatttgggatagaatcttatttggatagcaatcgtagcagtctcctaattgcgagttagatacacatgaaagcaaacgaaaactatgaccaatcatgaatctcacaaaattcagtgaatgattggattgatctgggtgggggggtgttttgacaaattggtattgacagctaacacatgtataagcttcctatatgacaggtactgttctaagtgttttatctataatatgaggtttaatccttacaacaaacttgtgaagtagttagaattttccccattttacaagtggttgaggcaaatttgataaattctactggaatcatacattc

SEQ ID NO: 475013 - DNA, 565 bp, Homo sapiens
gagccgggtacctcagttggaaatgcagaaatcacctgtcttctgtgttgatcttgctgggagctgcggaccggagctaagtggaagtatttttctttcattttcttttccattctggctaggagtgtttctatataatgttatttttcaggatgttttgatgggaagcatgcaggaaatcatgattttaaaaaatctcttgaacaatttcctttacagcacttgttatatgccaggtactatttttaaacacttcacaaatactaaattatttgtgtctcctcaaaattcatatattgaaatcctaaccctcaatgtgacagtattagtagttggggcctttgggagaatccagatattgctaacaaatatttaccccaaaagaaagggattgcacacaggagtagaaagtctgtcactcaatctcagccaaacagccaaactaggagagggcttttgaagcccctttgtctgtatgagtgcggggagactttgagaagcttgaaaatgctataaatttgaaccctatagagtacctggttaccaatctttatgctataaattc

SEQ ID NO: 475014 - DNA, 669 bp, Homo sapiens
gagaacgggccatgatgacaatggcggctttgtggaatagaaaagggggaaagctttatgtatttaaagctgaggcccagacccaaggatgcaggcagagcctaggagagtggatcacagcccgcagggacagttctctggcaggatccctgggccaggcagaagagaccagacagagagctccacacacagcccctgacatggagtctgagagatactttgctcctatctatacaccaccacctggggaaaagaaaaacagcagatccttgcttccaggtgtgactcacctcactcaagctcagccaatccttcttattttaaagctgttctcttcaaggtgctttcaaattttaatgagatctccagatggatattgcaaaatacctgtgcccctttatacactttcatcattggctcataaacaactcttcttttatcttcaatgttaagctttggtttggaggaatttatttttgtacctgaagtttacatttttgttgattacagagctgacaggtcctgtcagattatagagctgaggattacagagctgaagtttatgtttttgttgattatagagctgacaggtcctatcaaaaataataagctgtcaacctgactaatatttgtctttaagacatgaggctaatcccagtgtattagtcc

SEQ ID NO: 475015 - DNA, 766 bp, Homo sapiens
taaaaatgtgttgtttgtgaacgtactggctgtggcctaggccatgcagcaggataagctcaccttcctggaggagaatgacaaggacctgtacatcctctggagggggccctccttcaatgtgcagatgggtctgaacgagctgttgggccatggcagcggcaagctcttcctgcaggatgaaaaaggagcattcaactttgaccaggagacagtgatcaacccagagactggagagcagattcagagctacaaaagtaaacaggaggctagtgacggactcattaccatcactcccaccacaggctctgatggacacccggatgccagggtccgcctcgactgcagcaagatccggtctgggggcaaacctgccctagagggcttcctgcagagacttcaggtgctgaatgaagtccacagggggatgtggccggagagtgggccatgtacaagcggtatgaggccccttgagtgcttcctcaccctcagggacaaggttctcgattgagtgactcaactggaaagagagaataagttgtatttgcaacatgtattgaacatggtacacaagcatggaaaaataatcaaggagtatcaaaatcaagtcttgggtgggaggttattttatttagattattttgggtcattctacatattttcaatgacaatttactcatttttaatttcttattttaaggtatatggcacatgtatatgaaaattttgcatggaagttaaatgttatgatttacgtggatcagag

SEQ ID NO: 475016 - DNA, 581 bp, Homo sapiens
agaagaaaggatttgaaatgcttccaacacaaataaatgcagtatgaaaacagactactacggtaaattggtacccggagtggggcactgctataaacataacatgaaaatgtggaagcaactttggaactgggtagagactaggagaaacttgcagtccagtgctgcagtaccaggccactcatgttcagggaaagccacacttaatcaccaagacaatggggacaattctccagggcacctcagagaccttcacagcagcagcttctgtcacaggtctggaaacctaggaggaaaaaatggttctgtgggcctggcccaggggccccctgatctgtgcagtctcaggacttgttgccttgtgtctcagctgctccagttccagtcatcactaaaaggggccaatgtacagcttaggcttcagagggcgcaagcccctaggcttggcagcttgcacgtggtgttgagcctgcaggtacacagaagtcaagaactgaggtttgggaacctccacctagatttcagaggaggtatggaaacccccggatgtctagacagaagtcggctgtaggagcagagct

SEQ ID NO: 475017 - DNA, 859 bp, Homo sapiens
ggttttgtcgcatagaaaagggggaaatgtggggaaaagaaagagagatcagattgttactgtgtctgtgtagaaagaagtactgtattcctaggtatttcattttctttatggctattttcttggatggctttgctggattctttggattctttggatttcttgagatggatttcaactttctcctgaatctcaatgtttcctcgccatccatccagactctgaattctatatttgtcatttctgtcacttcagactggttaagaaccactgctatggagctagtatactcgtatgaagaaatacatcagaaaatcaagaatatggaaaaatattcagatttaaaaaggcagacccagaaaaaaaaatatgggaaagtttataagcaatataaaactaaacttcctggtcagttttatacaccaaaatgtatgaattttgaggcttttatatcataattaaagagcgagaattttcataccaagatgaagtaaaaccatgcaaatacacattaaggaacagtgccttattaagcttcatctctgttggttatgctatgaaatatagtaaacatagaatccattgctaattattctagaagacaatgaataatttgttggaataagtaatattttaaactgtaaatgactgtgttgctctgtgaatattttgttttcctcgaatagtattcaatgtgtggttagaaaaatataaacaaaagtttcaaaaaaatagtgtttccaagtataaatttgtcaacagaaatgcatttccatttcaaatataaatgtatgtatattctacttatttttatattcatggaaagtctcacttccatttgtacagataagcaaagctt

SEQ ID NO: 475018 - DNA, 545 bp, Homo sapiens
tccaaaatcaaactgctggcttgtgaggctgggaatgtttagaatcgtgctgctccatgtaacagtcttcattttgtcctggtctatatcataccaaacgaagtgtgctctgcctacaggaagattgctgaggtttgcagggaaccaggagaaatgttcaggtttgaaaagagaaggagtgttggtggaggtcaaagaagaatcccatgagtggccccaccctctacagccaggagaaaacctgctttggtatcttctctacttgtgtttctataatacaagacgtgtttatccagcactgactcctatgtatggtaccaaagatctcactgaggacataaacctagagtcagttatacctcctggcatgttcttaggttacatctggggctgtctgcctcaggcaacttacgtgtctaaaatctgagaggttgttgcacactagtgacaattttctgttgttataaacttcaattatcacatatgggtattgagaaaacttgtaattccatcgggctagtaggctttcagtgttataaagaaag

SEQ ID NO: 475019 - DNA, 504 bp, Homo sapiens
gagggtccgcggcttcatttttgaagtcagtctgagaaacattccttgcctctcccaccatgtggaagggagaaggcactgactgtgaaccagaaagtgggcctaccccatgcaccaaatctgctggtgccttcatcatggacttcccagactccagaaataaatttcagttactcttaaactacccagcccgcccatggactaatcagcattcattctcccattctgagcccatgaaagctccagaatcagcctcacagacacgacagctacgcattttcaggccccctctcagacaaagggctatccacttcaggtcccctctcgttgtcaagagcttctctgtcactgaatataattcttctctgctttgctcactctctggtgtccgtgtacctcattcctcttggtcacagggaaagaaactggaacctgccaaatggcaggtgagaaaagggctgtcaccctttctcctgtttgctgagctatggaagtgaaaaaacc

SEQ ID NO: 475020 - DNA, 1459 bp, Homo sapiens
gaataggaacagctccggtctatagctcccagcgtgagtgaagcagaagacgggtgatttctgcatttccttctgaggtatggggttcatctcactatggactgccagacagtgggcacaggtcagtgggtgcagtgcactgtgtgcgagctgaagcagggcgaggcattgcctcactcaggaagcacaaggggtcagggagttccctttcctagtcaaagaaaggggtggcagacagcacctggaaaatcgggtcactcccacccgaatactgcgcttttctgacaggcttaaaaaacggtgcaccaggagattatatcctgcacctggctcagagggtcctacgcccacggagtaggcgtagctgattgctaccacagcagtctgagatcaaactgcaaggcagcagcgaggctgggggaagggcgcccgccattgcccagccttgcttaggtaaacaaagcagcccagaagctccaactgggtggaacccaccacagcccaaggaggcctgcctgcctctgtaggctccacctctgggggcagggcacagacaaataaaaagacagcagtaacctctgcagacttaaatgtccctgtctgacagctttgaagagagcagtggttctcccagcacgcagctggagatctgagaacgagcagactgcctcctcaagtgggtccctgacccctgactcctgagcagcctaactgggaggcaccccccagtaggggcagactgacacctcacatggctgggtactcctctgagacaaaacttccagaggaacgatcagacagcagcattcatggttcaagaaaaccactcttctgcagacactgctgctgatacccagtcaaacaggatctggagtggacctctagtaaactccaatagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaattctaaaaagcagagcacctctcctcctccaaaggatcgcagaccctcagctgcaggtctgttggagtttgctagaggtccactccagaccctgtttgcctgggtactagcagcggtggctgcagaacagcagattttcgtgaaccgcaaatgctgctatctgatcattcctctggaagttttgtctcagaggagtacccagccatatctccagctgtgtgctgggagaaccattgctctcttcaaagctgtcagacagggacatttaagtctgcagagtttactgctgtctttttatctgtctgtgccctgcccccagaggtggagcctacagaggcaggcaggcctcctcaagctgtggtggggtccacccagttggagcttccgggctgctttgtttacctaagca

SEQ ID NO: 475021 - DNA, 857 bp, Homo sapiens
cggcttcattcttgaagtcaacatgggggtagaggatgaagacacaaggatgaaattgaaactggaaagatatctggagggtggaagccataatcaaaggatgtctgagaaacaaatgggccgggaactgcaaactgttgtacaagacctggatcactatgttccaattcctagtttcatgagagaaaaatcatctccaattttatttaaaccacatttatttgaattattttccaatatgcagctaaactcacactttaaattggaaagagaagcaagtcagaaggttatcaaaatagtccaaacaaaagaagatagtggcttgggcacagtgctgtctatggaggtgctgcagaaaaccacctcacctaatgtcaagccctttctcactgcagcttatatcagtgatgcatctttcagggactgtgaagaccgggccattgtagcccaaccagggacaacgctgcccttttagctctaaaacttcctgaatggttgtccaaggttgtgaggcctgcttcacggctcaattcctctccctatccaatcccccttcctttctttcccttccttacctttaacatgtacatatgaaactccttctcaatgtctgcatctcagagaatccaatcagcaatagaagccatcactgttcttgtagaaatcactgttaatcaaaaaagccaacttctgacaatactgtagaaaacattcaacttaggacttattattttaaggtgctatataacatcaaagctattttttattacatgaaaagctgtaaacaatatatattatcacaattaaaatgtctaaacaaaacattcatactttaaaattcattctgcatctttctc

SEQ ID NO: 475022 - DNA, 799 bp, Homo sapiens
ttcacactcactctctctcctgctgccctgtgaagaggtgccttaggtcatgattttacaacactaacatggaggcgatggcctcattccacgatacaagtgtgcagtggtccccttttgcctttgacatcataggtttggaaaaatttacaatcacatatatctaccattataatatcatacagagtattttcactacactgaaaacccgctatgctctgcctatttgtccctcccttcccctacctctaggaaccactgacctttctactgtatccatagttctgtctttttcagaatgtcatatacaggcagcagagtcaatctctccgagtccagatgcagttgggcctacaggggtcctgggagtgttaaagaaagggaggcatgtggtgacttcagacagcaggaatctagagctggtggccagtagcatttccagtgtcacaaaatgttacggctccctgaagagcatcggtgtagtaattaagctcttagcttctggagttgaaccccctggattcaaagccttgctgcaaacttactgatgtgagtgttatgcaagcaaaacatgcacaaatgacattttacatgacatcttgaagttgaagaggagagaaattagtgctaaagtctgcaagaaaaaattgatactattcttagatttcccagttgcagactgattcctcattttcattagcttcaaatattatttagtgattttagtgtttgccaattcacttgttcttcttttatctgaatcccacaattactccattgacattatgtttacttgatt

SEQ ID NO: 475023 - DNA, 1056 bp, Homo sapiens
cgccgaccccttgcacttcccagaatgctgaacataggcccccaatctcttctggcttcttcattggttagcctatgccctgcagaaaatgcaagttacgttttctacccacagttagcttcaggaaaagaagtattccataagccaattatctatggttccgcaaacactgaaaaaagctttagctggcaaacaaacctgctctgttacttcttctgtgacttcgttgtactctccttcctcctcatcattagtgtgaaaagattccaaggtggaacaaaccaaagcccacagttgtcccattgttaccctgctccccttcttactcaccacggggattgctttaagagtacttggatgtcctccagcttagttccacgttctccaactatttctccagcgacccttcaacctggatttgagccccacatatggacaccacttgccaagaccagctcgggacttcttgaactgctgttgaaaggaggatagtgagaaatgggaatttcttgcagtatctaatccgtattaaaagcaccaagtttccttttgtttctgtccctcagaaaaacactagtgtcccaaggaatcaagggaagggaagacaatgcatatggggtagagagaacactgaacacacaattgataataaataatatgattgattgaactgtccatgcttgccatgaattttgatgcagtctaagacagtttccctgaattactccctcaatgattagccatgattgtcttcagtttctgacattcagaagtatgtgacaaattccactcttttcgcaacttaatgtattcagatgggaaaggatttgaaacttagtttccaatgatgtgtctttcagtataaaatgcccagtaggccaaggtgccatatttggagggatcatgttcttgaacactggcaataatcataataactatgggcagagcctccctaatctgaaaatctaaaatctaaaatgctccaaaatacaaatctttctgagtgccaaaatgacactcaaaggaaatgctcagtggagcatttcagatttcaaa

SEQ ID NO: 475024 - DNA, 476 bp, Homo sapiens
agaaagggacagtaaacaagccatgccgcgactgggacaggccatgtcctgcaagggctggtcagaagcacagtcctcacagccgtggggcgatgtcccacccccaccgccgccctttcctcccggcccagccagggccccccaccggctgtctctcttccaggctctgagcccccagaagcagagctttgttttggaggttctgtctgggtgcctcgagtaccggaagctgctgaccgtcgtggtggatgccttctacgtggaggatggccgactctgcctgcgggttgaccacagccgcttcgaggtgatctgctacctagccacattcctgctggaggaactcggcttccagctattctgtaacatcatcaagtcccagcccgtggataagatgtgcaaggtgagccacccctacctgcccaccaggccacgaggcccacgggtgaggtccgtctgatcctcgcccacctttc

SEQ ID NO: 475025 - DNA, 576 bp, Homo sapiens
gttccctacaaatttttggatattttttccgtttctgtgaagaatgtcattgtggtgtaattcaggatgcgaaccagtagacggcgcttaagactccaaacccctggacagtgtgctcgaatcctgggagttttgggaccacacctacagttttgtctgctgacccctcagggtccagtgctggctgtgcagaaggagccaaactactcccaggcaaccagcaaaacactcaggcaggacaatgaaagctgtgctgtagaacaagatggagagcctggggggaagggtacctatggtcacattttgttgcagctgcagtgtgcacggcaaaaccttctgggatccatgcagacagacctggggaatgcccaaagaagatacttgtgtggaaactccgtacagggctgtgtggaaactctggacaggggttcaagcctagaagactgtcccagtggcccagacaagcatgtctcccagcagatccctgcacaggcaggatggatcctcaattgcaacaaggagaacttggattgagactgggatccctcaggatctgctatgggcaggaaaattgag

SEQ ID NO: 475026 - DNA, 1176 bp, Homo sapiens
tcacctgtcttctgcatcactcatgctgggagcttctctctctctctctctctctctctctctctctctctctgtctctctatctcttgacctgcctggagccagaggtggagtgacacaagcccccctgtggccaccagcactgggactctgctgtgttagatctaaagccagcacagcactaggtctcacccaaggcctgctggaaccactacttgtctaccaccgatgttcactcaagagctgtcaaggagccatggagtgaaatcaaataccttggaaatctacctggtgctctatccttctgcagctcagttggcaatcaaagtacaagataaagttcttcccatctaccctcccctttccaggggcagacaaatctcttcttatggctaccgccagcaccacaggcccacaggacgctatgacctagctttactgcaagagagcctgacaaatgggaatctgacattttcagcctttataatgcgaagtgacctttggcaggaagtaaaaggggaaaaagaaatgtgcaaggcggtccagtgcacccttcatccaacctccttcaatgtcagtactatccacagcttcagtacaatgtcaaaaccaggaaatcaatgttggtataattcatagagtttattcagatgtcaccagtcatacttgtacttagaatgtgtacatgtgtgcatgtgtgtatgtgtgtatgtgctatcacatgtgttgctctatacaatgctatcacatgtgttgctttctgtaattaccaccacaatcatgatacattactgtaccattaccagaggctcccttatgtaacttcttagtagctatacacacaccttcccctaattcctaaccactggtaaccactaatctatttttagcctctataattatgttatttattattataacatattattatcacagatactaggttattctatgtgtttttaacttagtttgaatttatgtgaaagataaaatttaacactgaggaaataagactaaaattctcaaaattatatgtaaatatagcaaaccaattattcttaataactttaacatgttacttacagtttaggtgtaaaatatatcaactgttatatccccaagaagattattttaaaagtcttttaatcaaacaatggtaagttgatcagattttct

SEQ ID NO: 475027 - DNA, 541 bp, Homo sapiens
ggagcccagacctcagggctccctgaaccagggctgtgacatgctgtaacaccctctttggggctatgtggctcctggtgtctctgagatttcgggcaccaacacattctcctcatctaaaggctggtgtccgaagtggaagttgcttgcgtacatctgttccagccacagccttgcacaaagctgacacctgtgccagtgcctggagctacctgtctcaccacagcagccagtgtgcctggctgtatgcagtatctggacccctcctgctggaccaagtgggcgggacgagcccagtgggcacgaacaaaattcaaacagaggtattgctggccacagaggtttctggctggcgtagcaacaccctaaggatcccaatagacagcatagagaagaccttaaatgacatgatggagctgaaaaccgtggcacgggaactacgtgacacatgcacaagcttcagaagccgattcaatcaactggaagaaaaggtatcagtgattgaagatcaaatgaatgaaacaaagcgagaagtttagag

SEQ ID NO: 475028 - DNA, 1598 bp, Homo sapiens
gaaggctttagggctaaaatggtgtgtctggagtttgttccttccgatgttcgggcgagtcccgagtttcttcctcctagtgggttcgtggtctccctgacttcaggagtgaagctgcagaccttcgcggtgagtgttacagttcataaaggtggccgtccggagttggtcattcctcctggtgggtttgtggtcttgctgacttcaggagtgaagctgcagaccttcgcggtgagtgttacagctcataaaggggcgtggacccaaagagtgagcagcagcaagatttattgcgaagagctaaagaaaaaaacccccacaacacggaatgggaccccagcgcgttgccgctgctggcgcgggtggccttttattcccttatctggccccacccacatcctgctgattggtccattttacagagagctgattggtccattttacaaagagctgatttgtccgttttacagagagctgattggtccattttacagagacgatgattttgactatataaggtgaacattatatatttcaaatcaagtattggttatagttggaatgtaccatggtatagttttccttacacaggtcaccacagtgtaattattaatgctaccttttttttttctctccaaaatgtactggtttgaatgacaaattataaaatacaatagttacgtgcaaagattaaattatgtaaaacaaagaaacccaaaaaataaaaaaagttgaaaatgcttacaccagagagtaaaatgtaaaacgtccaaatgtaatactgaatatcatgcgcatcaagccaataacatgtcagaacaataacattaatacaactgcaactataataaagcttaattctgcttatttgacccaacaacatgaaagaaacgaaaaaaatgtgactttcagaatagttcatttcctactcttgtagtgatgctcctaagctatgagacaaaatgcaaaccttaaaaatgcatactgtgttgattattttgattgattactgtttatttttatttgtttgtttaatttggtaatggtaaatatgatacttgatagcaggctcattatatcatgaaaaattataacttttaactttaatgatattttagtgtaatagtacaaaatgtttcataatattgggctcatattggctcctggtataaccatgcaaattatcgataacaatatgcagatacttaaaatcaactttcaaaattactaaagtatgcaacaaaatgaactaaatgataatatttttactttaaaaaatagaactatgcttctgaatctaaaacttttcaatttatatttcttatttcatttggaaaacattaggaaataacatttattttgaccatatttaacatatatattaaatagaaaaaagtaagcacaactatttaaagataataagtcagtaatgcccaacaacctatatgaggcctctaattatttttctattaaaataacatggagtaatattgggctaggtaactctgacaacaaacctgtaaagccaaaaagaaaatctgccacaatatatctatttactaatattcattcaaaatatcaaagacctaatgaaaggg

SEQ ID NO: 475029 - DNA, 807 bp, Homo sapiens
atttgcattgctcctttactctgatatgttcccacaccaagtcctgtgggctctgctgagggtggagtcctgcccttaccatctttctaaacatctctccctgccagctcaagtgtccatggaggtcatggtgtctcctgctgccaagatttccaaagtccatgtcagaaatgggccttcctcatctgttcaactcacacattttccaggagtctcttgggtccaggaacttgtctcagtgcttgtagccccatgcagggttcccggcttcctccctaatcagcctaacatctgtgtcctccctgtgtctactcttgattcctccccttcaaagatctgcttgaagtgtgctagtcttcccaatgtcccggtctctcagtggcagatattactagtgactgcatctagtgagccattttatcttctggttttgatttcagactaagtcttttgtgtgttagtgatggttaccaatggtatttaaaaaaaaaaaaaacctaagtattttagattcctctgcttctctgtgatgtttatgctgagccccaggaaacatatactgatctgcctttctcccttaaagtctcattttgcaccacagagaagagcctgaacagtatgagtttgtgctgaggttcagacagtttaaccaaacccattgatttaaaagatatgtgggctggaataatcaacttatttatttgccaaggaaagccaaatcattatttctaagaccaatattatgagactgtctatactacaaaagcggctgtgggaataataatgtctgtatgaaaatactgtttt

SEQ ID NO: 475030 - DNA, 528 bp, Homo sapiens
cctcctgaggctatgctctggttctttctggaccctgaagtaatctcgtgtccggaatttattccttccagtgggttcttggtctcactgacttcacgaattaatctgtggacctttgcgatttcccgttgggaatatgtgctctcacactttgggaactcacagtgttttgcttgtttggctgaatttgtagcagcctgtggcttctttcaaagaagatgtgaattcttttggttttcttggtatgttcctgtggtggctcttacagcagagaatcccggtgttgagtctccacatgctgttttatctgtccaagttgggagctgcacattagcgctgcacatgggcaacccttctttatctgccattctggggtctgaagacagtgcctttcttctcatagctccactaggcagtggctcagtggagactttatgtggggactccaaccccacatttcccctctgcattgtcctagtagagtttctccatgagggggctccacccctttagcagacttctgcctgg

SEQ ID NO: 475031 - DNA, 1769 bp, Homo sapiens
agttcatgcttctgacttaaatgagtgggtggacggtgacagcgtgcggcagccctcgcagcccttgctcgctctcagtgcctcctcggcctcagcgcccactctggccgcgcttgaggagcccttcagcccgccgctgcactgtgggaaccccttcctgggatggcggaggcccgagccggctccctcagcctgtggggaggtgtggagggagaggcacaggcgggaacccgggctgcgcactgtgcttgcgggccagctagagttccgggtgggcgcgggcttggcgccccagactcggagcagctggccggccccgccagcccccggcagtaaggggcttagcacccgagccagcagctgcagagggtgcgccgcgtcccccagcagtgccggcccactggcgctgcgctcgatttctcctcaggccttagctgcctccccccaacagcccccccgccccgcccgccgagggttcctgcgcggcccgagcctcccagatgagcgccgccgcctgctccactgcgcccagtcccatccaccgcccaagggctgaagagtgcggtggcacggggcgggactggcaggcagctccacctgcggccccagtggacgatccagtggctgtaacattgactgcaaaggtctacagcttcattcctgaagccagcgagaccacaaacctaccaggaggagtgaacaacttcagatgccttgcattaagagctgtaacactcactgcgaaggtttgcagcttcactgctgagccagcgagaccacgaacccaccagaaggaggaaaatccgaacacatccaaacatcagaaggaacaaacggcggactgtaacactcaccgaaagggactcccactgttccagaccctgcaccaagaactgatgaggtaaagatgaaaaaacaactaaaacttgcgatgtgctttgcacaagaaaagcagaaatctttgaggagggaaacaggtaatgcaaagatcacaaacagcaaattcataaaagcagactataaataaatgtgatggaaaatgctactcatattttttagctttttaaataaatgacaggtgatttcacaatcttacttttagacaaaggttacctagtaggaacttactgaaaaaaattatttaaaataactgcaagaaggcttatcaattaaaactaatatattgaaatattatagccagaaaactgttagcaacatcaaaagcatctattacacttggaaaatgcaggtaattttaattcactcagtttatgacatggacatttattagtacatctgtatttgcttcagttggtcatcatgttcaatgttatatttttacttttcaggtattatattaatgagattacttcagtctatggtatatagttatgaataactatgtcaatggttaaatgttaaaatgtttagagcttttaattaaaattgttgtttattcatcttgagaaaccttaaaatatattaataatgtgagtaaaatatggaattaattcttctcacatacctcacacacattctaataattctatcactcccagacctaccccatgtggggaaataattacattttttaacaatttatatataatttctgtaaaggttttcactgtcattaatttagttgtgtatctaaaataactgtaattgtttttaaataacattccacacatattttccagttatttgtctagttttattttatcatgtctttttgatctgtctttccaacttgattggtcataatgacc

SEQ ID NO: 475032 - DNA, 1697 bp, Homo sapiens
tgacagtctgagatggtaggagcagttgtgtgaagatggagtctcccggaggaaatgacaattacctgacaatcacagggccgtcacacctcttcctgtcaggggccgagacattccatacaccaagcttaggtgatgaagaatttgaaatcccacctatctctttggattctgatccctcattggctgtctcagatgtggttgaccactttgatgacctggcagacccttcctcttcacaggatggcagtgcttcagcccagtatggggtccagacattggacatgctctgtgggcatgacccatggcttgatggagcaaggtgggggctcctcagtggaggcttgatcatggacttaaaccactctataggaactcagtatagtgccaacccacctgttacaattgatgtactaatgatagacatgacatctgacttgatggggcatagccagttgaccaccactgatcagtcagaactgagtttccaactgggtttgagcttacggggtggcaccatcctgccacctgcccagtcacctgaagatcgtatttcaaccaccccttcacctactagttcacttcacgaggttggtgttgaggatttctggaggcaaatttccagccagaagacagtggtggtggaagcagggaaaaagcagaagttcccaaagaagagaaaaaagaaagatcctaatgaacctcagaaaccagtttcagcatatgctttattctttcctgatacacgggctgccatcaagggacagaatcctaatgccacttttggtgaggtttcaaaaattgtggcctccatgtgggatagtcttggagaggagcaaaaacagatatataagaggaaaactgaggctgccaagaaagagtatctgaagacactggctgcttacgaagacaaccaggagtgtcaggccactgtggaaacagcggaattggatccagcaccaccatcacaaactccttctccaccttctatggctactgttgacccagcgtctccagcaccagcttcaacagagccccctgtcctgtccccatccattgttgttaactccaccctttcatcctatgtggcaaaccaggcatcttcaggagctgggggtcagcccaatatcaccaagttgattattaccaaacaaacgttgccctcttccattactatgtctcagggagggatggttactgctatcctagccacagtggtgacctcctgggggctccaactagacccaaccagtacagccactatccagcccagtcaacaagcccagattgtcactcggtcagtgttgcaggcagcagcagcagctgctactatcaagagtgtgcctccactcactttgaaaatgcagactaccttagtcccaccaactgtggaaagtagtcctgagcggcctatgaacaatagtcctgaggcccatacagtggaggcaacttctcctgagaccatctgtgagatgatcacagatgtagttcctgaggttgagtcttcttctcagatggatgttgaattggtgagtgggtctcctgtggcactgtcaccccagcctcgatgtgtgatgtctggttgtgagaatcctcccattccagtgaagagttatctgctgggaacatgtctaagagcctgttttggaaacacaagctgggcttctggtagtgcctgatcacagcccatgatgtcc

SEQ ID NO: 475033 - DNA, 1465 bp, Homo sapiens
tcaaagaaaggggtgacagatggcacctggaagatcgggtcactcccaccctaatactgcacttttccaatggtcttagcaaacggcacactaggagattatatctcacgcctggcttggagggtcctacgcccacaaagcctcactcattgctagcacagcagtctgagatcaaactgcaaagtggcagtgaggctgggggagggtccccagccattgctgaggcttgagtaggtaaacagccaggaagctcgaactgggtggagcccacttcagctctaggaggcttgcctgcctctgtagactccacctctagggttaggtcatagccaaacaaaaggcagcagaaatctctgcagacttaaatatccctgaagagagtagtgattctcccagcatgcagctggagatctgagaacaggaggactacctcctccacttggtccctgaaccctgagtagcctaactgggaggcacccacagtaggggcggactgacacctaacatggccgggtaatcctgtgagataaaacttcctgaggaacgatcaagcagcagcatttgcggttcaccaatatccgttgttctgcagccaccgctgctgatacccaggcaaacagggtcaggagtggacctccagcaaactccaacagatcagcagctgagggtcctgactgttagaaggaaaactaaccaacagaaaggacatccacaccaaaaacccatctgtacgtcaccatcttcaaagaccaaaaggagataaaactacaaagatggggaaataacagagcagaaaaactggaaactctaaaaatcagagctcctctcctcctccaaaggaaagcagctcctcaccagcaatggaacatagctggacggagaatgactttgatgaactgagagaaggcttcagacgatcaaactgcaccaagctaaaggagaaagtctgaacccatggcaaagaagttaaaaaccttgaaaaaaaaattagatgaatggctaagtagaataaccaatgcagataagtccttaaaggaccagatggagctgaaaaccatggtacaaaaactacgtgatgaatgcccaagtctcagtagcctattagatcaactggaagaaaggatatcagtgatggaagatgaaatgaatgaaatgaagcaggaagagaagtttagagaaaaaggaataaaaagaaatgaacaaacctccaagaaatatgggactatgagaaaagaccaaatctacctgatctctcagcagaaactctacaagccagaagagagtgggggccaatattcaacattcttaaagaaaataattttcaataattgccagaatttcatatccaggcaaactaagcttcataagtgaaggagaaataaaatactttacagacaagcaaatgctgagagattttgtcaccaccaggcctgccctaaaagagctcctgaaggaagcgctaaac

SEQ ID NO: 475034 - DNA, 1093 bp, Homo sapiens
gctcacgcctgtcatccctgcactttgggaggcttttaatcataaaaaacagcagcagaaggcttgatgagtcttcttcatgaaagggggaaaggttatttagctttgtgctcataccactgcaaagaagctataaatactttgagccatctaccttctcaccactacaatactggttgggtactgtgccaaattggaagggtctattttgaactttcagagtacatgcaagctgaaagaatattctcagaggttagaagggttgagaattatagagtcaaaggcatggaaatctactctacaacattttggcatcttcaaaaagatggtgctctttcagttctgtcaaaagacttaacagacttggataaaaatctgccagaggcctggtgtgctgcagggaactgtttcagtctgcaatgggaacacgatattgcaattaaattcttccagagagctatccaagtagatccaaattatgcttatgcctatactctattagggcgagagtttgtcttaactgaagaattggacaaagcattagcttgtttttgaaatgctatcagagtcaatcctagacatagtaatgcacggtaagtggtaatgaagtgtaaagacaaagtcttgttgatggtgctggtagtcattaatttttcttgttagatagctcttttattatcatgaatttggttactaatatttagggatggtacatactggtcaataacttcaaactaacatgttttcttatgaaatgtgtgtctttaacaaactctcaagttaactaatgataatagaataccagacccttatactcaacagtttcagtcttctaccaaacttttgcagatactgtagttgtgttttgtttgtttgtatgcttgtttagtttagttacttgatttgttactttttcttcgaacagagaaatggtgattgggacaaaactgcttgggaaattggaaaggaatagcataattcacttattggataatagaaaaaaaaaacactgaaaaaattcactagttgttgctttttgacagtgttccaggttattgagttactattaagaacttagtatacccttttattt

SEQ ID NO: 475035 - DNA, 934 bp, Homo sapiens
aggagtgtgccaaacttcccaatgtcccagtcccttgatggtagatgttcctcctctggagccacacctcaaagggccctaggtacagcttgggccgctgctccacagggcataagctataagcctcagcagtttccacatggtgtcagatctgcagatgcacagaatgcaagtataaagaggcttggccacttctccctagatttcagaggatatatggaaaagcctcgatgtccaggcagaagcctgccacaggggcagaaccttcacagaaaaacctctactagggcagtgcagagggaaaatgtggagttggagcccccacacggagtccccaccagggcactgcctggtgttgccagtgttgtggaaatgaggccactgccctccaggccccagaatggtggatttattggcagcttgtaccctgcacctggaaaagccataggcactcagttccaccctgacatcattcttcttggatggaggacaagaacttgggtaaaggtgcagcagacacagaggtttcaagccagaaaaatcgatgccctagagatcttgtaacaatggctttgtttgttactggctttatctaagcataaagttagagttcattctcaatagcttgtcatgtgggggtctccactggacagccaacaacatggcagctttcctcatcaaagccagtaaaggagtcaagacaaattgaaagctctttgttttctccccctcaagaggatagctgtaatttcacaatgacatagtcttaccttatgcctaagccaggtactcaaagggatagaaagtcatataccttccccagatggcctctctcacacattattcacaaataaattccttgtgagcccatattttgtcataattttcatgccaaagacaattctaacatatgtaaatagttcatcgtatgtgt

SEQ ID NO: 475036 - DNA, 2311 bp, Homo sapiens
caaacggaaaaaaacggaattttcgaatggaatcgaagagaatcttcgaacggacccgaatggaatcatctaatggaatggaatggaataatccatggacccgaatgcaatcatcatcgaatggaatcgaatggaatcatcgaatggactcgaatggaataatcattgaacggaatcgaatggaatcgtcatcggatggaaacgaatggaatcatcatcgaatggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcataatcggatggaaatgaatggaatcatcatcgaatggaaatgaaaggagtcatcatctaatggaattgcatggaatcatcataaaatggaatcgaatggaatcaacatcaaatggaatgaaatggaatcattgaacggaattgaatggaatcgtcatggaatgaattgaatgcaatcatcgaatggtctcgaatggaatcatcttcaaatggaatggaatggaatcatcgcatagaatcgaatggaattatcatcgaatggaatcgaatggaatcaacatcaaacggaaaaaaacggaattatcgtatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatagaatcgaatagaattatggaatgaaatccagtgtgatcatcatcgaatggacccgaatggaatcatcatccaacggaagctaatggaatcaacatcgaatgaatgaaatggaaacaccatcgaattgaaacgaatggaattaccatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcatgattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgcatggaattatcgaatgcaatcgaatagaatcatcgaatgtactcgaatggaatcaacgaatggaatggaatggaacagtcaatgaactcgaatggaatcatcattgaatggaatcgaatggaatcatcgagtggaatcgaatggaattatgatcaaatgtaatcgaatggtatcaacaccaaacggaaaaaaacggaattatcgaatggaatcgaagagaatcttcgaacggacccgaatgaaatcatctaatggaatggaatggaataatccatggactggaaggcaagcatcttcgaatggaatcgaatggaatcatcgaatggactcgaatggaataatcattgaacggaatcgaatggaatcgtcatcggatggaaacgaatggaatcatcatcgaatggaaatgaaaggagtcatcatctaatggaattgcatggaatcatcataaaatggaatcgaatggaatcaacatcaaatggaatcaaatggaatcattgaacggaattgaatggaatcgtcatcgaatgaattgaatgcaatcatcgaaaggtctcgaatggaatcatcttcaaatggaatggaatggaatcatcacatagaatcgaatggaattatcatcgaatggaatcgaatggaatcaacatcaaagggaaaaaaacggaattatcgaatggaatcgaagagaatcatcgaatggacccgaatggaatcatctaatggaatggaatggaataatccatggactcgaatgcaatcatcatcgaatggaatcgaatggaatcat

SEQ ID NO: 475037 - DNA, 7475 bp, Homo sapiens
gaattcaaacgaatggaattatcatgaaattgaaatggatggactcatcatcggatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcatcgaatggactcgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaaatcatcgaatggtctcgattggaatcattatcaaatggaatcgaatggaatcaccaaatagaatcgaatggaacaatcatcgaatggactcaagtggaattatcctcaaatggaatcgaatggaattatcgaatgcaatcgaatggaattatcgaatgcaatcgtatagaatcatcgaatggactcgaatggaatcatcgaatggaatggaatggaacaagaatcatcgaacggacccgaatggaatcatctaatggaatggaatggaataatccatggactcgaatgcaatcatcatcgaatggaatcgaatggaatcatcgaatggactcgaatggaataatcattgaacgaaatcgaatggaatcctcatcggatggaaacgaatggaatcatcatcgaatggaaatgaaaggaaatcatcgactggactcgaatggaatcatcgaatggaatggaatggaacagtcaatgaactcgaatggaatcatcattgaatggaatcgaatggaatcatcgagtggaatcgaatggaattatgatcaaatggaatcgaatgggtcatcatctaatggaatcgcatggaatcatcatcaaatggaatcgaatggaatcatcatcaaatggaatctaatggaatcattgaaaagaattgaatggaatcaatcgaatggaattatcatcgaatggaatcgaatggtatcaacaccaaacggaaaaaaacggaattttcgaatggaatcgaagagaatcttcgaacggacccgaatggaattatctaatggaatggaatggaataatccatggactcgaatgcaatcatcatcgaatggaatcgaatggaatcatcgaatggactcgaatggaataatcattgaacggaatcgaatggaatcaccatcggatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaaagaatcatcgaatggactcgaatggaatcatcgaatggaatggaatcgaacagtcaattaactcgaatggaatcatcattgaatggaatcgaatggaatcatcgagtggaatcgaatggaattatgatcaaatggaatcgaatataatcatcatcaaatggaatcaacaacaaccatcatcaattggtattgaatggaattgtcatcaaatggaattcaagggaaacatcatcaaatggaaccgaatggaatcctcattgaatggaaatgaaagggaattcaatggaattatcatcgaatggaatcgaatggaatcaacatcaaacggaaaaaaacggtattatcaaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggaggatcattattgaatggaattgaatggaatcatcgaatggtctcgattggaatcattatcaaatggaatcgaatggaatcaccgaatagagtcgaatggaacaatcatcgaatggactcaaatggaattctcctcaaatggaatcgaatggaattatcgaatgcaatcgcatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattatcgaatggaatcgaagagaatcttcgaacggacccgaatggaatcatctaatggaatggaatggaataatccatggactcgaatgcaatcatcatcgaatggaaacgaatggaatcatcgaatggactcgaatggaataatcattgaacggaatcgaatggaatcatcatcagatggaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaatcgaatggaatcatcgagtggaatcgaatggaattatgatcaaatggaatcgaataatcgaatggaattatcatcgaatggactcgaatgaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaatggaatcgaatggaatcatcatcggatggaaatgaatggaatcatcatcgaatggaaatgaaaggaaatcatcgaatgtactcgaatggaatcatcgaatggaatggaatggaacagtcaatgaactcgaatggaatcatcattgaatggaatcgaatggaatcatcgagtggaatcgaatggaattatgatcaaatggaatcgaatgagtcatcatctgatggaattgcatggaattatcataaaatggaatcgaatggaatcaacatcaaatggaatcaaatggaatcattgaacggaattgaatggaatcaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaaatgaaaggaatggaaatgaatggaatcgtcatagaatggaatcgaatggattcattgaatggaatcagatgcaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatggaatgtactcgaatggaattatcgaatggaatggaatggaacaaatcgaatggaattatcatcgaatggaatcgaatggtatcaacatcaaacggaaaaaaacggaattatcgaatggaatcgaagagaatcttcgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcaatcgaatggaattaacattgaatggactcgagtggaatcaacatcaaacagaatcaagcggaattatcgaatggaatcgaagagaagcatcgaatggactcgaatggaatcatctaatggaatggaatggaataatccacggactcgaatgcaatcatcatcgtatagattcgaatggaatcatcgaataaaattgattgaaatcatcatcaaatggaatcgaatggtatcattgaatggaatcgaatggaatcatcatcagatggaaatgaatggaatcaatcatcgaatggactcgaatggaatcatcgaatggaatggaatggaacagtcaatgaactcgaatggaatcatcattgaatggaatcgaaaggaatcatcgagtggaatcgaatggaattatgatcaaatggaatcgaatgggtcatcatctaatggaatcgcatggaatcatcatcaaatggaatcgaatggaatcatcatcaaatggaatctaatggaatcattgaacagaattgaatggaatgaatcgaatggaattatcatcgaatggaatcgaatggtatcaacaccaaacggaaaaaaaaggaattttcgaatggaatcgaagagaatcttcgaacggacccgaatggaatcatgtaatggaatggaatggaataatccatggactcgaatgcaatcatcatcgaatggaatcgaatggaatcatcgaatggactcgaatggaaaaatcattgaacggaatcgaatggaatcatcatcggatggaaacgaatggaatcatcatcgaatggaaatgaaaggagaatggaatcatcgcatagaatcgaatggaattatcatcgaatggaatcgaatggcatcaacaccaaacggaaaaaaacggaattatcgaacggaatcgaacagaatcttcgaacggaaccgaatggaatcatctaatggaatggaatggaataatccatggactcgaatgcaatcatcatcgaatggaatcgaatggaatcaccgaatagaatcgaatggaacaatcatcgaatggactcaaatggaattatcctcaaatggaatggaatggaattatcgaatgcaatcgaatggaattatcgaatgcaatcgaatagaatcatcgaatggactcgaatggaatcatcgaatggaatggaatggaacagaatggaatcatcgcatagaatcgaatggaattatcatcgaatggaatcgaatggtatcaacaccaaacggaaaaaaaaggaattttcgaatggaatcgaagagaatcttcgaacggacccgaatggaatcatctaatggaatggaatggaataatccatggactggagggcaatcatcatcgaatggaatcgaatggattcatcgaatggactcgaatgcaataatcattgaagggaatcgaatggaatcatcatcggatggaaacgaatggaatcatcatcgaatggaaatgaaaggaatggaaatgaatggaatcgtcatagaatggaatcgaatggattcattgaatggaatcagatggtatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattaacattgaatggactcgagtggaatcaacatcaaacagaatcaagcggaattatcgaatggaatcgaagagaagcatcgaatggactcgaatggaatcatctaatggaatggaatggaataatccacggactcgaatgcaatcatcatcatggaatcatcgaatggactggaatggaatcattgaatggactcgaaagggatcattattgaatggaattgaatggaatcatcgaatgaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaataatcgaatggaattatcatcgaatggaatcgaatggtatcaacatcaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcatcgaatggaatggaatggaaaactcaatgaactcgaatggaatcatcactgaatggaatcgaatggaatcatcgagtggaatcgaatggaattatgatcaaatggaatcgaatgaatggaatcatcgcatagaatcgaatggaattaacattgaatggactcgaatggaatcaatatcaaatggaatcaagcggaattatcgaatgaaatcgaagagaatcatcgaatggactcgaatggaatcatctaatggaatggaatggaataatccacggacacgaatgcaatcatcatcaatcgaatggaattatcatcgaatggaatcgaatggtatcaacatcaaacggaaaaaaacggaattatcgaatggaatcgaagagaatcttcgaacggacccgaatggaatcatctaatggaatggaatggaataatccatggactcgaatgcaatcatcatcgaatggaatcgaatggaatcattgaatggactc

SEQ ID NO: 475038 - DNA, 1617 bp, Homo sapiens
tggaattacaatgaaattgaaatggatggactcatcatcgaatggattcgaatggaatcatcgaataaaattgattgaaatcatcatcaaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgaatggaattatcgaatgcaatcgaatagaatcatcgaatggactcgaatggaatcatcgaatggaatggaatggaacaaatcgaatggaattatcatcgaatggaatcgaatggtatcaacaccaaacggaaaaaaacggaattttcgaatggaatcgaagagaatcttcgaacggacccgaatggaatcatctaatggaatggaatggaataatccatggacccgaatgcaatcatcatcgaatggaatcgaatggaatcatcgaatggactcgaatggaataatcattgaacggaatcgaatggaatcgtcatcggatggaaacgaatggaatcatcatcgaatggaaatgaaaggaagaatcttcgaacggacccgaatggaatcatctaatggaatggaatggaataatccatggactcgaatgcaatcatcatcgaatggaatcgaatggaatcatcgaatggactcgaatggaataatcattgaatggaatcgaatggaatcatcatcggatggaaatgaatggaatcatcatcgaatggaaatgaaaggaaatcatcgaatggactcgaatggaatcatcgaatggaatggaatggaacagtcaatgaactcgaatggaatcatcattgaatggaatcgaatggaatcatcgagtggaatcgaatggaattatgatcaaatggaatcgaatgggtcatcatctaatggaattgcatggaatcatcatcaaatggaatcgaatggaatcaacatcaaatggaatccaatggaatcattgaacgcaattgaatggaatcaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccgtggactcgaatgcaatcatcatcgaatggaatcgaatggaatcatcgaatggactcgaatggaataatcattgaacggaatcgaatggaatcatcatcggatggaaatgaatggaatcatcatcgaatggaatcgaatagaattatggaacgaaatccagtgtgatcatcatcgaatggacccgaatggaatcatcatccaacggaagctaatggaatcgaatggaatcaacatccaacggaaaaaaatggaattat

SEQ ID NO: 475039 - DNA, 1871 bp, Homo sapiens
atcatcatccaacggaagctaatggaatcaacatcgaatgaatgaaatggaaacaccatcgaattgaaacgaatggaattaccatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatgaatcatcgaatggactctaatggaatcatcgaatggaatggaatggaacagtcaatgaactcgaatggaatcatcattgaatggaatcgaatggaatcatcgagtggaatcgaatggaattatgatcaaatggaatcgaatgaatggaatcatcgcatagaatcgaatggaattatcatcgaatggaatcgaatggtatcaacaccaaacggaaaaaaacggaattttcgaatggaatcgaagagaatcttcgaacggacccgaaaggaatcatctaatggaatggaatggaataatccatggacacgaatgcaatcatcatcgaatggaatcgaatggaataatcgaatggactcgaatggaataatcattgaacggaatcgaatggaatcgtcatcggatggaaacgaatggaatcatcatcgaatggaaatgaaaggaaatcatcgaatggactcgaatggaatcatcgaatggaatggaatggaacagtcaatgaactcgaatggaatcatcattgaatggaatcgaaaggaatcatcgagtggaatcgaatggaattatgatcaaatggaatcgaatgaatggaatcatcgcatagaatcgaatggaattatcatcaaatggaatcgaatggtatcaacaccaaaccgaaaaaaacggaattatcgaatggaatcgaagagaatcttcgaacggacccgaatggaatcatctaatggaatggaatggaataatccatggactcgaatgcaatcatcatcgaatggaatcgaatggtatcatcgaatggactcgaatggaataatcattgaacggaatcgaatggaatcatcatcggatggaaatgaatggaatcatcatcgaatggaaatgaaaggagagtcatcatctaatggaattgcatggaatcatcatcaaatggaatcgaatggaatcaacatcaaatggaatcaaatggaatcattgaacggaattaaatggaatcgtcatcgaatgaatgaatgcaatcatcgaatggtctcgaatggaatcatcttcaaatggaatggaatggaatcatcgcatagaatcgaatggaattatcatcgaatggaatcgaatggcatcaacatcaaacggaaaaaaacggaattatcgaatggaatcgaagagaatcatcgaacggacccgaatggaatcatctaatggaatggaatggaataatccacggactcgaatgtaatcatcgtcgaatggaatcgaatggactcatcgaatggactccaatggaataatcattgaacggaatcgaatggaatcatcatcggatggaaatgaatggaatcatcatcgaatggaatcgaatagaattatggaatgaaatccagtgtgatcatcatcgaatggacccgaatggacccatcatccaacggaagctaatggaatcaacatcgaatgaatggaatggaaacaccatcgaattgaaacgaatggaattaccatgaaattgaaatggatggactcatcttc

SEQ ID NO: 475040 - DNA, 1131 bp, Homo sapiens
tggaattaccatgaaattgaaatggatggactcatcatcgaatggattcgaatggaatcatcgaataaaattgattgaaatcatcatcgaatggaatcgaatggtatcattgaatggaatcgaatggaatcatcatcagatggaaatgaatggaatcatcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaaatggaattatcctcaaatggaatcgaatggaattatcgaatgcaatcgcatggaattatcgaatgcaatcgaatagaatcatcgaatggactcgaatggaatcatcgaatggaatggaatggaacaaatcgaatggaattatcatcgaatggaatcgaatggaatcaacatcaaacggaaaaaaacggaattatcgaatggaatcgaagagaatcatcgaacggactcgaatggaatcatctaatggaatggaatggaataatccatggactcgaatgcaatcatcatcgaatggaatcgaatggaatcatcgaatggactcgaatggaataatcattgaacggaatcgaatggaatcatcggatggaaacgaatggaatcatcatcgaatggaaatgaaaggaagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaatgaatggaatcatcatcgaatggaatcggatagaattatggaatgaaatccagtgtgatcatcatcgaatggacccgaattgaatcatcatccaacggaagctaatggaatcaacatcgaatgaatcgaatggaaacaccatcgaattgaaacgaatggaattatcatgaaattgaaatggatggactcatcatc

SEQ ID NO: 475041 - DNA, 1976 bp, Homo sapiens
gaagagaatcttgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggagaatggaatcatcgcatagaatcgagtgtaattaacattgaatggactcgaatggaatcaacatcaaacggaatcaagcggaattatcgaatggaatcgaagagaatcatcgaatggactcgaatggaatcatctaatggaatggaatggaataatccatgtacacgaatgcaatcatcatcgtataaaatcgaatggaatcatcgaatggactcgaatggaataatcattgaacggaatcgaatggaatcatcatcggatgaaaacgaatggaatcatcatcgaatggaaatgaaaggaatggaaatgaatggaatcgtcatagaatggaatcgaatggattcattgaatggaatcagatggaatcatcgaatggactggaatggaatcattgaatggactcgaaagggatcattattgaatggaattgaatggaatcatcgaatggtctcgattggaatcattatcaaatggaatcgaatggaatcaccgaatagaatcgaatggaacaatcatcgaatggactcaagtggaattatcctcaaatggaatcgaatggaattattgaaggcaatcgaatggaattatcgaatgcaatcgaatagaatcatcgaatggactcgaatggaatcatcgaatggaatggaatggaacagaatggaatcatcgcatagaatcgaatggaattatcatcgaatggaatcgaatggaatcaacatcaaacggaaaaaaacggaattatcgaatggaatcgaagagaatcttgaacggacccgaatggaatcatctaatggaatggaatggaataatccatggactggaaggcaatcatcatcgaatggaatcgaatggaatcatcgaatggactcgaatggaataatcattgaacggaatcgaatggaatcatcatcggatggaaacgaatggaatcatcatcgaatggaaatgaaaggagaatggaatcatcgcatagaatcgagtgtaattaacattgaatggactcgaatggaatcaacatcaaacggaatcaagcggaattatcgaatggaatcgaagagaatcatcgaatggactcgaatggaatcatccaatggaatggaatggaataatccatgtacacgaatgcaatcatcatcgtatacaatcgaatggaatcatcgaatggactcgaatggaataatcattgaacggaatcgaatggaatcatcatcggatggaaacgaatggaatcatcatcgaatggaaatgaaaggaagaatcatcgaacggacccgaatggaatcatctaatggaatggaatggaataatccatggactcgaatgcaatcatcatcgaatggaatcgaatggaatcatcgaatggactcgaatggaataatcattgaacggaatcgaatggaatcatcatcggatggaaacgaatggaatcatcatcgaaaggaaatgaaaggaaatcgaatggaattatcatcgaatggaatcgaatggaatcaacatcaaacggaaaaaaacggaattatcgaatggaatcgaagagaatcatcgaatggacccgaatggaatcatctaatggaatggaatggaataatccatggactcgaatgcaatcatcatcgaatggaatcgaatggaatcatcgaatggactcgaatggaataatcattgaacggaatcgaatggaatcatcattggatggaaatgaatggaatcatcatcgaatggaatcgaatagaattatggaatgaaatccagtgtgatcatcatcgaatggaccc

SEQ ID NO: 475042 - DNA, 525 bp, Homo sapiens
accaatttcagtctcaggcgcagccaaaaatctctaaataagccacagcattaggctctcataggaaggtgaaccctgtcatgaactgcacatacgagggatctaggttgtgcgctccttatgagaatctaacgcctgatgatctgaggtggaaaagtttcatcctaaaccatcagcaacatccaccccctcaccccatccatggaaaaattgtctttcacaaaactggtccctgctgccaaaaagaagaagacagaaacatgtggaatagtttggaacttcctagagacttgttgaatggctttgaccaaaatgctgataatgatttggacaatgaaatccacgctgagggggtttcagatggagatgaggaacttgttgggaactgcagcaaaggtgactcttgttatgttttagcaaagagactgatggcattttgcccctgccctagagatctgtggaactttgaacttgggagagatggtttagggtatctggcagaagaaatttttaagcagtgaccag

SEQ ID NO: 475043 - DNA, 673 bp, Homo sapiens
cagcaccctgtcaaaatggaccaatcagctctctgcaaaacagatgaatcagctctctgtaaaatggactaatcagcaggatgtgggtgtaacactcattgcaaaggtgtgcagcttcactcctgcgccagcgagaccacgaacccacaagaaggaagaaactccgaatacatccgaacatcagaaggaacaaactccggacacgcggactttacgaactgtaacactcaccgcgagggatgaccggtttgtacgtgaccgatggcacactacggctctacaatcaccagattattttccacagagtaacttcctcattaaattttttctaaccatttatctgcccctttctctttcagcccccaattcctatcttcctgacatgcattcagactcatctatttcttctccttttcctttgggccgtctaataccatattttaatgcctgtgacttgttttgaagaaatatccatgaacactgaagcttagagagaggaaacaaaatcggaccagagaattgaaatacgcagtttctccactagatagcagactacgacaggtgacttttggaagggtccatctgtatttacccaaagaaagcatccgtttttctccatcagttcatatttttcttttaccacgacaagtgtttttatgtgatcagaccattc

SEQ ID NO: 475044 - DNA, 3100 bp, Homo sapiens
gtgaacgctagactgcacttccctggagcagagtacttccctgcaatgcagctacccctacattcttcaccctttgtgactgaggaggaaggagattacatcccatctgagaagctgaagcttctggctctgcagcggggagaggacccaggaaacttgaatgagtcagaagaggaggaggaggaagacaaccaaggtgatggtgatgaagggggagaaaatgaaggggagagtggttcggaaacggaggaaaaggcctggctggcagcaccggaggagcagagaacggaggggaagaagcccagggtgatagcaggacacgagaagctggagaagcagcagcagctggcccaggaggaggagagcgaggccaggcgcctggccactatgatgatgaagaagccggagaagtacctgtaccagaagatcatgtttgacaaaaggcgaaaaagccaagaggccaaaaagctaccagagtagcagaaagcccatgatgaggcattgtatataattttacccaaaaatatcctggttttcctttattatagtctaccaatgaaattatcaagagtatactggagaggaaagatatagactttgttgaattccagtctaaattatttgcattgtcactttaagttgcctaacatatctagctttcagtttccttaacggtagaatgtgaacagtaatagtaatatttactatgtagtgtactctttctatttcttaagttacgctaatcatttcagaaaattttctcattaaactttcaaacaacatgaagatccagaaccaagcctgctattaaactaaaaaggtgcacactggatgcacatcaatctttactgtcaccttctacaaactatgattgagtaatagatgagtatttgaatacagcactatattccatcgttggcatgtcagctctcagtgctgactaagtgaattgtgttgctctctgattaacttgaaataaagaggatgttcatttccatcaacatttatcagagctttgtggtacaggctaaacagtttgtgccacaactattcttgaagttaagttcagaaattccaatttatcagcagaattagtttcccagattttcagagctgtattcttgagtatattttctgataatttccatagaatattttcagaaaatgaaatacttagggtttcatcaattgttctgtaaagaaaattttgtgttcaaaagtatccaaataatatatgccatgtcagaccgacacaagagacagaccccttattgagcaggggacctatccagaatattcagtcaacatatattttttgtccttactttactcaaaaaacagcattagaaaaaaaacttacatggctttttgtgtctctgtattctgttacagtgctgaatcatctatgcctgcagcaactgtagcaaaactgacttcaaagtgactgttttttagatttaaactaacgagaagtaaaacaaaacttggccgtgatgagccaaacaaagattaatctatgaacttgatataatcacagctaaattttgtgcgttggtgtaaaaaatgtctctaaattaaaacacaagtaatgatagaggaaaccaaatgtcaatcatcattttatataacttttaaaacaatttaaatttacaaattaatgaatcacaaaggaaaacaaagaataatgttgaaggtaaaattaataggaatctagatcttatttttatgtaaactataatttaatattagcatgtttctaaaatacatttacaaattaggtaatatatgtggaagagcatataaaaatataaatatttaatcaaatgtgaaggcttattttgaatccttggttgtaactcagatttggccttcatgtgcgtggaaacgaatcccctgtatctgagttcagagaattttaataaataagattatattaataaaatcctgttttgggaggtccatgtttattagaagcatcatctgctgaaatccacatcaacattcattcaataataatcataaataacataattagttattataaattagttattctaattattggaatatttgtaaaattaatgacagcaaatattcaaggctaaagaataattatttacttagtggggaatcatacctcatcatatgtatactaatcaaatatcaagtctaatctcttttttgtgttttttctgataatcctgcaatcattaggcattttgctcttacagttttggcttttacatgtatcaagacatgtctgagcagtataagctttatccagtttgaaagttcaataatgaacattagattgagaaaaatatattattgcattcagtagtgttctttttatttgctttattttgtggttgtttgtgttgtataaaattgtgttgtacttttcttcttcattcacagaaatacattacttgagtacattgactttatttggcaaacctgtttcatgtaatattaacaaaatgaggaccacttattgttagttgcattaagtccaagcttcttaaatgagtgaatttatgacctttcaacctaccagttaatattatattattattattattttataaatggtgggcacctctaggctgtaataataataaaacaaaaaactatctgaagaaccttagagttaaggaaggtatgcaaccaaaataaaaacatataactaaatgtaataagcattgaggcaaacacacaaaatatttataaaacatgctattggagaacagtggagccgttgtctgttttcctgagagacaaaagtagacttccttgaggaaatggcatttatcctgaaagttaaagcatgaataggaatgccccaaatgggccaaagatagtgctaataaggaagaagctgtgtacaatcacagatatgtgaagcagggtgcagatgactcaaaggtagttgaaaatatatcagccttaaaaaatggaaatcagatgatcattgtcactgtgttatatgcttaagtgtttggagtttagctcatgtatctacctcctacaaccctcacacacaaaacttcttgtctaaacaataagttaataaattatatggaattgtaatagctgtaat

SEQ ID NO: 475045 - DNA, 1471 bp, Homo sapiens
aagaagagcctttcacctcccgccatgattctgaggcctcgccagccatgtggaactcatgaattgctattcataatggacaaggtgcctgcagagctgctgaaggagtgcatgttccagatgcccaaggagctcagcaggcagccctccgggctgatactggaggttgtctgcacagagtcctgtgatgtgaaccatctatgggtctctcagccgtggataccagtgcctgttccagtggaggtggccagtaggggaatacaatggactctctatgaaatggttttatttaagagcgagaactctatagcagtgccgttcaactcctgtgtcaaagcaagccttgtactggtgtatgggaaggggttcaggtatgctgagatattcatcccccaagcctacaggacagcatggtcgcagtcagagctcgtagaccagttgccttgaccaatgaacctttctttccagggctgaaggcagtgagcatactgggctacatttacttcttgctgcttccccaccatgcactcagcacagtgcccgacactccagcacctgggcatcaaaaaatttgttggacaaccatatgctttcaataaatctttttcatgcctttaatcttttccacttgtagcattttctttaaactattattcctttgaaatgtagcaaatatccaaagtaatgatattagctctgaacaaataacacagcactaagatggaaaaactgtattcataagtctttttataaaatacctctatcaaaccatgcctctgtgaactgagaaataaacagtatgttagcttctgtatcacagacagacttgagaataattcactctcttgctgaagattagtgattggaaaaatggtaaaaaaaatagaaattatgttaaaactttttatttcattgcaaatatgataagtaaatgtgaacaaacgtctcagcagtacaaagctttatttcttctcaatgaaatgattataatggcttagagagaaatatctttaaaaatacatccttgaccagggcaaatgagtgcattgagggaaaatatcatgattcctatcaaagctttttctctctagagccttacaccatcatagagaaaaacaaatgtaaatttcttatgaattgcagataaattacatattctatgagtcataaaagaagcaagcaatacgtcattgtttagttgaaattatagactgatcattacaatcttcttcatgcattatactattcagagagataaccatgcttttttttactaaaaaatgtggaacaagacaaaatattaccctctgtgtctatgtaatagttttgccacttttaattaactattgaattcttatttttaaaaatttgttaaatgttttcattccatagttttctatgtacatttggaagttctactaatttctaacatttctttaatgattactacccatttccctatactcattac

SEQ ID NO: 475046 - DNA, 915 bp, Homo sapiens
ctcttttgtctttgtctttattcccaggtttgtcctactttgttcagtccagcaaggcacctcttccaatctttacagactgccttcagcagggaaagcccttcaccactcagcttgaccagagtctgtgtgggctggttggtatggtccatgtgcaggccttgctactaacatcctcaggcaaattagcctggtgccttggtcagtgggtggacttggtgtctgagtccatgggtatggggttggagcctgattctatgggtgcggtcctggatcctgagtttgagggggttggtctggcactgaggaccattgggatgggacttatggctgatttgcaggggtggtcctggagcactggtctgtatagagtcttgggagcctggaaaaactgttgtgaaaatgaggaccgcagactcacagtgtcaatgaaggctccatcttttaccactagttgcacgcaacaggatgaaaataaagctgacttacgcatcctggagcatccaattggcaaagaccaggagaaagtactcaggagtgtaggagctcagagggatgaggagaaaggcagagatggcgactgtgatggggatgttctcctaaggcagaagtcggcagcaatagctaagttggactagcgtgattgctctatggagttactgaggttgaagtaaagaaatagggctacatatcaagttcaaatgccatggcaagccagctatgggatggagctgtctgtgaggggcactgtgttctttatatcagtgcttaaacctactctgaagggcaccattcctctgaattttctaataaggtgggctttattgttgaatatagtttgacacttattcataattgcagttgtgaacaccttaaaggatataatggtatgtgtctctgtgcacactagatttc

SEQ ID NO: 475047 - DNA, 933 bp, Homo sapiens
ctaacaattgaaggatgaggagggtggagaagaattttattgagtgatggaacagctctcagcagaaaggggacattcctcttctctgctgtattatgttttgcattctgaaaaatgggtgtctgtgtcctgggacgttgaaaggggaattttcctgcgtttcggaatagaaatggtaaccaaaagaattgtgatggccgtgaataacccagaccttttgtgtcatgagtatttctggcacaagggccacagaaattctagtcaagatgtgttacttttgccacaatgtcttttaattgtgccctctcctattgtgctggtatcaactcctgcccagtgtcacaaccttgcccacatgggtcagctcttggcggggcacttcctgcacttctcaactggacagtactcgcctgctcagggtgtcctcttccagctcaggtccctgactgagctggcactccttctaccactttaccagtcaaataagaaactgtcattagaaacaggacaagacttattacacaagtcccttctatctctacagaatcccaaggggagtgctccttaatagcaggtgggaaattaatgctactatatttaataaatgattgtgacatatacaagagcccaagaggaaccaggaggttgccagtgcagacaaggaaatagatgtatttgtacctataaaaaattttatgtgctatctatggaagaatatatgcaatttggggcagcaatattaaacaatttcagaaattacataaattttagaatattataggaagaaatatagaaattcaataaattaaatcagacagaatattttctaggcatagataagacatagtaacatcaagcataatttctatttatttatttatttacttatttatttatttgagatggggtcttgctcagtcacctaggctggaa

SEQ ID NO: 475048 - DNA, 862 bp, Homo sapiens
tgagcgagggctgctagcatgttgacaacggagaaaaggcacaggtctagaagggcaaaatggctttgtgagatgggcctggagttccctgtatccatacattgctgctccctggatcctggctgctccagccatggctcaagtgactccaggtgtatcttgtgccgcagctttggagggcacaagcaataagcctccgcagcttccacatccaggtagtgctaattctgcaggtctgcaaaatgcaagagaggtagggatgtggtggtccccacctagacttcaaaggatatatcaacctgcctgggaatccaagcaaaaacttgctccaggggtgaagttgccacaggtagtccctaccatggcaatgtctagtggagtgttggagtgcagccactgctgggttgggccactggcagcatgcaacatccacctggggagctatagacactgggctccaactcatctaagtaaccacctgagctgtgcatccagcacagccctaggagcagatctgcctaaggccttgggggcccaaccccagccccaggtagacagtgaatatcgattgctaagtgggaaatcattgtgctcaaggaaaatgggtatattaggagagccagagaaggatgattgagagtactgagttctacattgtaatggtttttcacatatttcctatgtttgactttacagaaagcaggcagtagaatatagcaaagtttctccagataagatcctgtcaacactcaggtgtcattagccttaagctgcatgaagagtaaggccagtcataccattacactattgcaaggtacaccagtctatgaggggcatcaaaacagtgagaaagcagtaataa

SEQ ID NO: 475049 - DNA, 1383 bp, Homo sapiens
agacttggtggctatgggatggccactgtgtttcaaggcattggcagccactgtcctgttagcagaagatgctaacaagctcaaattgggacaaaggttgataattcgggttccccacacggtcatcaccctgatggagcagagtgggcatcgctggctttctaaccctaggatgttaagatatcaagggcttttgtgtgaaaacccctacataaccttggagattgtgaatactctaaatccagccacactgctgccaatagaatgggtagagcatggaaagcccatgttgtgtggccctgggtatgactgttgtgtggaaatactggatgaggttttctcaagccgaaaagacataaaggaccagcccttaaaagacccagatgtcgaatactttactgatgggagcagcttcatatctgaaggtgtcagatgggctggatatgcagtggtaacactgaattcagtatctgaagcccaccctctgccagtcggaactttagcccaaattgctgagctaatagctctcactagagcgttgctcttggcaaaaggaaaatcagtaaacatctatactgactcaagaggaaacagaaaggtggacagagaagccaaaagagctgcaatgacagaggtaactaagaaggaaaaggaaacccttactatgcctttactggagcttccccttacagaaccccctaactattctgctaatgaaaaggcttggtttgagcagaagaatggaatttaccagaaaggaggttggtggaagttctcagatgggaggctcgccatcccagaagcaatagcacccccaccccagttcataaagcagtttcatcaaggaacgcatatggagaaaactgcgttagagactcttgtaggatggcatttctatgtgccgcgtctaattgccatcactcgaaccatttgtgagccactgcaggggccaacacagcccccggggattcaaaaaactgaagctacaccttgtgaaaacctgcttgtggactttaccaagctgcctcgagttggaggctaccggtacaggaggtttgtctgcactttctcagggtgggtcgagtcatttcccaccgtgacagagaaagcgcgggaagtaaccaggatcttactaaaggacattattcctagatttggactgcctctaactttagaatcagacaatggcccagcatttatggcagaaaatagtacaacagttaatgcagatgttaaaaatcaaatggaaactgcatacagcttatcacccacagagttctgaaaaagctgaaaaaatgaaccagacattcaaacagctgttaaagaagttttgccaagaaactcatctaaggtgggatcaggtgctccccatggtccttctcc

SEQ ID NO: 475050 - DNA, 569 bp, Homo sapiens
tctgttatgatattccttctaaggtgaaggataagttgctgcatttggcccctcctacaaccaagaaagaggcacaatgcctagtgggcctatttggatttttgaggcgacacattcctcatttgggtgtgttactctgacccttttattgagtgacccgaaaggctgccagtttgagtggggtccagaacaaaagaacgctctgcaacagctccaggctgctgtgcaagctgctctgccacttggacaatatgacccagcagattcaatggagtttgaggtggcagtggcagatagggatgctgtttggagcctttggcaggctcccataagtgaatcacagcagaggcctctaggattttggagcaggaccctgccgtcttctgcagataacaactctccttttgagagacagctcttggcctgttactgggctttggtggaaactgaatgtctgactatgggtcatcaagtcaccagatgacctgaactgcctatcatgaactggatgctttctgacccatctacccataaagtgggttgtgcacagcagcattccatcatcaaat

SEQ ID NO: 475051 - DNA, 585 bp, Homo sapiens
gcagagctgcccaataccatgggaacccacctgttgcatcagcatgacctggatgcctgctgtcatccttggctcctgcctatgtttgcttaaggccctgggcctctataatcagcaggtggcaaagccagccaagcctttgtcctttgcttcggagcaacaaactcccctaggtcccaggcaggtccagaggaaggactgccagactactattggtgttccttcaagtcccaaggctcttcagtcagcttttggtaaatgctgcctggcttggtactcacccttcagggcagtggtctttcctttggtcaagagcaggtctagaaatgacatccaagagtcaagtcctggaatcatggatccaaagggctcgccaccacacctgggtattgctactggttattcagggcccaagagctcttcagttagcagcgtaaggaaggagtctcttttggggctgcaagctgtgctgcctggggtaggggaagattgatgccagcactcctttagctaccacagaccacagttggtgtcttagtgttgcagtgtttgtggcctagactgcctttcaagtttatttagagc

SEQ ID NO: 475052 - DNA, 1651 bp, Homo sapiens
gaggcatattatcaatcttagactttgaattcatggctgtggagatcagtggaatggagtatacctatcaagattatgtccatggcagaacgagccccagagcagaattgagcaccaggaattcccagaagattggagaacatgtcagagcatcagtgaagggcttaggggcaatacccctaaaaattgagcaccaggattcagcaccagaattgagcaccaggaattcccagaagattggagaacatgtcagagcatcagtgatgggcttaggggcaatacccctgaaacttacaccaatatctaggactatcttaaagagtaggcccatggacttggacttcttaaaggtgatcttaaacacaaatttatttttcatagttctggagcctgggaagtccaagatcaagctactggcacttctatcgtctggtgagggcctgcttgcatcctcatttgcagatagcagtcttctcactgtatcttcacatggcagagagcacagagaaaggaagcaaactctttcctgtctcttcttacaagggcacactttcatcagtgttttatccttttccttgtagagatctttcacctcctctgttaaatgcattctgtcgtattttacttatttatttttgtgtctgtgtaaattgaattgagttcttgatttagttcttagtttgaatgttattggtatttagaaatgctattgatttatgtatgttaattttgtatgctgaaactttactgaagtcacttattaaatctaagagccttttggaggattctttggggctttcttggtatacaattatgccttcattgaagtgtaaaatgagattgtttatttgagattttttttaatataggcatttattgctataaacttccatcttataactgtctttctgcattccataagtttttggtatgttgtgttttcacttttttttgctttaaggtattttttattttctttataatttcttctttgacccatgattgttaaagagggtttctgaattttcacatatttgtgaattttccaattatcttcctgatattgatttctaatttcagaccattatgctaggaaaataaatttgatataattttaaacttcttaaatttcttaaggcttgttttgtgacccaacatatgacccattctggaggattcttcatgtccacttgagaagaatgtgtagtctgctgctgttggatggaaggttctgtatatgtctgttagatccatttgctccttagtgttatccaagcgtcattctgctctttccttattgatttctgtctggatgacttatctattattgaaagtgatatattgagatccatccattttgtgtttctgtccatttcttccttcagttctgctgatattggttttatatatttaagtgctgcaatagagggtacatatatatttataattgttatattcacttgatgatttttaccttttgtcagtttattataatctttttttgtctcttgtgacagtttcatatagaatcacaaaagaccctgaatagccaaggaaattttgattaaagaaaacaaaactggaggcatattttatctgattaaaaatatattacaaagttacagtaatcacaacagtatagtactgacat

SEQ ID NO: 475053 - DNA, 577 bp, Homo sapiens
agtgtggagggaaaatgtgggattggagcccccacacagaatccccaccagggcactgcctagtggagctgtggaaatggggccaccatcctccagacttgagaatgataggtccactggtagcttgcctccagcatgaagaagccacaggaactcaattccaacccatgagagtagctgcaagagctgaaccttgcaaagccacagtgttggagctgcccaagggcatgggagcctactgcttgcaccagagtgccttgcaggtggaacatggagtcaaaggagaatattttggagctttaagatttagtgactgccctgctgggttttggacttgtgtggggcctactgcccctttcttttgtccaacttttcccctttggagcagtaatgtttaccaaatgtatagctagcaatactatacatgtaatcaatttggaaataaatggtggtggttttatttttgtgccattttaaaatatacttcaaagtggagtttatcattagttgtataatactgttttgaaaataagatgttcaggattatgttttatgtctaaaccattcaaaataaatt

SEQ ID NO: 475054 - DNA, 591 bp, Homo sapiens
tccctgacaatcaacagaacataatggcagctttgcaggggctgtcacaggagattaaagcagttgagaaccttactgacaaccacctacaggcatggttttcagcttctttgcaatggtttcgaacattctcctttagctcagataagtttattattaccaatcgtcggaagccttcttctctcaactcatcaaagtcattctccttccagctttgtttctttgctggaccctcagctgcaggtctgttggtgtttgctggaggtccactccagaccctgtttgcctgggtatcaccagcagaggctgcagagctgcaattattgcagaacggtaaatgttgctgcctgatccttcctttggaagctttgtctcagagggtcatccagctgtatgagagaaatgtcggtcagcccctacttggaggtgtctcccagttaggctacttggggatcagggacccacttgaggaggcaatctgtctgttctcagatctcaaactccatgcttggagaaccactactctcttcaaagtgtcagatagggacgtttaagtttgcagaggtttctgctgcgttttgttcagctatg

SEQ ID NO: 475055 - DNA, 761 bp, Homo sapiens
tttgtttacctactcaagcctcagcaatggtggacgcccctcccccagcctcgctgctgccttgcagtttgatctcagactgctgtgctagcaggccagtaggaaccttggttgataatagcttgaaccaaagcagcagtagtgggaaaggaaggaaggaaatagatataccgatgatccagtctctttccttcataccctgctctaggtaccaggaacctgacttctgtggactgcatcacctgtactctcttgccctctggttggccaatggaggcactagtaggagcttgatggataggaggagaacgaaatccgagttttattttccccaggtgttggtctgtgttcagacagtggctgtgtttctctacttaaagccacagctccttttgcagcagagcctttcccaccattacagcaattgtcaggtttcagggacaacagcatctctttgccgattaccaggatctcaccccagattacagacggtaaaaactccccagattacagacagtaaaaacttctagcttctagagttaataattcttctcctgccctagttggtgtttttaactctcttcacaactctgtaaatagtcccattattaaatggttttacttgtcacttctatgtgtcctgcaaggaccctgactcaaaatgattcatattctcgaaacgtggcatcattaatttttccttgagccagaatttccagtataaagccaaatagaaatggtgagagctgacatctgtgcct

SEQ ID NO: 475056 - DNA, 480 bp, Homo sapiens
catttcctgagatcaacgatcctaagagaattactcataggaaccaggaatgtgtggtggaaacaggcctctcatttttcagttggatatctgcttgtgccgtggattggctgaaccaccagtgccccacctgcaaagccttatggttgaaagaaaattagaaagattagagagaaataatagagcagcctgcacttctacctcatatcagatgagagaatgtgtgagctcccagaagatccacaggattctgcagaagggcagccagagtgcctcattaagtgggtcccagatcccatgcctcctgactggaggagacccccaccacaggggtcgcaagccaccttataaaggagtgttcccactggcatcaggtcagtgtccccctaggacagagatcccaaaggaagaatcaggcagccatctttgctgttctgcagcctgcagacacctccaggtgcaggagaaacccaggtaaat

SEQ ID NO: 475057 - DNA, 617 bp, Homo sapiens
tctggacactctcccttatgatgtatgtgtactattactacttacatctgcaaagtccaggaacatgtttgtgtacatgaacaaatatacacatatagacacaaacatacacatgagcaaaagctcaatgaagagaatgacttagttttgttcactcttgtaccccccaatgatgtagtgccattttggcgactttgtgcacatcaaagatgtgaaggtcatcctaaaatgaggaaaacggcttcaatttcttacctgcatggtcagtatgtcagctctgccgtccagataggtgtttgggcatgtcagtgtatatgtgctttatggtataatatcagggattatagaattgctgaccatatcttaatgttctactcagaaatttcactcaagagagtaaagaatatgaagtattttgaagaaagtgaggacatggagagagtgagcattcagttacatctaaccttggttgggatggaaaagctgttataaatgatgtccatatatttagcaaatatttattgatagcttgctcggtgtcatacattattttagccactatggtatgcgaacactaatctgaatgcctgttcttaagagagtgtttagtgggagag

SEQ ID NO: 475058 - DNA, 760 bp, Homo sapiens
gtgttcgtaagttctcatcatttgcctcccactttcttaaggtagcaagggcagttccactgcagaggcagtgacagagaggctctcagttgcacctagatgctctgtctagagtattgctactggcttgatagctatggttggctggaggcacaggcctggaggacctgtttgttgaggagatatgagaatgagcacctgcataactgtctgaccagttttttggtaggcctgctgctacatgctggggacccgttccagtctctagtcactttggattttccagcacctggaggtatcatcagtaaaggctgtggaacagcaaaaatggcaacccgctctgggagctccatcccaggcagtacagatctgttgctggccctaacacacctgagtatatttgggggtctaactacctgctttgccagagttgcagctacttttgcagagaagcccagaaagcctgggtatctaaggctccctggtccccatgtgtggctggagaagctgctctgctgagactccatgtagttctgtgttagactgaaggccatggtggaatgactttacaagggcatttcctgacccgaaggtttatataaagcacaaccgtttatttacaactgttcagtgtccaaaatagactctaaatattatatataacccaaaccaggaaagcatttttcagagatataaatgtccctctgaaatctttacacgctttaatgaaaattgaatttatttgatgttgcagttcaaa

SEQ ID NO: 475059 - DNA, 916 bp, Homo sapiens
tcctcaaggtccgttaccatccgaggaatcctgggacagcctgtaaccagtaaggaaatgcagcagtccctgcaacatcccaattccaggagtacaaaaaccagtcagtggagagtagtgcaacatcttagactcatcgaggcagtaattcctctatatccagttgtacccaaaccctatactttgctctctcaaataccagaggaaggagaatggttcatggttctggacctcaaggatgccttcttctgtattcccctgcactctgactcccagtttctctttgcctttgaggatcccaaagaccacacgtcccaacttatgtggacggtcttgccccaagggtttagggatagcccttacctgtttggtcaggtactagcccaagatctaggccacttctcaagtccaggggctctggtcctccagtatgtggatgacttacttttggctaccagttcagaagcctcgtgtcagcaggctaccctagatctcttgaactttctagctaatcaagggtgcaatgtgtctaggttgaaggcccagctttgcctacagcaggtcaaatatctaggcctaatcttagccagagggaccagggccctcagcagggaacgaatacaacctatactggcttatcctcgcccgaagacattaaatcagttgcaggggttccttggaatcaccggcttttgcccactatggatccccagatacagtgagatagccaggcccttctatactctaatcaagtaaacccagagggcaaatactcatctagtagaatgggaaccagaggcagaaacagccttcaaaaccttaaagcaggccctagtacaagctccagctttaagccttcccataggacaaaacttttctttatatgtcacagagagaacagggatagctcttggag

SEQ ID NO: 475060 - DNA, 950 bp, Homo sapiens
gtgggtccatggcttcattcttgaagtcaaagccgtgggtcacagaaaagaaccgcgaaacccagcgattagtgttcagctcgattaggacgaacccgggcccttagctgcgcaggaacaaccgcaagcctctagcctgaacgggagcggcaatgggcgcctccctagatcagaaacgcagcagacatcccgccagatccagaggggtggaagtcaacagcgggtctgcaacaatggcgatcagcagtggtggacggcgagcgatagctcagctcaggctggaacaagcagggagcagaagaatgcctgatggcttcctaatcaagagagagaacagagaaaatatcatagacttgattgtgaaagctatgatggtctccctgcacactcttgccctagagtttctgcactcgctgttcctttcatctaaaacattcttccctgaatacctcgtggcttctcatttactacagtacattaacaaaaagattgcaagaggagggaaaacaaatgcaaaacatccatttgatgaattggtggaggaatttcaagatcaagatctgatgatatttgactaatgaaatttttttcttaaaatataaaaaggaacatccaacactttcccataaagttacttgagtagaaagttcataaatcagattttcataatgaattcagtctatcctttcaaccttagcaaggttatatctaattattcctagagtgattatttctttatttttaaagtaattttcaaagttagtttttaatgataataatggtaactaccataataattttctgaatatttaataaataaatcaataaaaatgattattacagtgtctgccatttcataagtggttaataattcattattatttttattaatagtatcattataaacttttcatttctagtttgaccttcattagagcaattcaatactg

SEQ ID NO: 475061 - DNA, 942 bp, Homo sapiens
gacttcactcttgaagtcagcaagaccatgaacccaccagaaggaacaaacaactctggacgcgccacctttaagagctataacactcactgcaaagcgagaccacgaacccaccaggaggaacaaccaactctggacgtaccacctttaagagctgtaacactcactgtgaaggtctgcagcttcactcctgaagtcagcaagaccacgaacccaccaggaggaacaaacaactccagacacaccatctttgagagctgtaacactcaccgcgaggcttccttgcaatgggttcggacatcctcctttagctcagagaagtttgttattacttaccttctgaagctgacttctgtcaatgtgtcaaagtcattctccatccagctttgttccattgctggcaaggagctgcgatcctctggaggagaagaagcttcaggtccctcagctgcaggtctgttggagtttgctggaggtccactccagaccctgtttgcctgggtgtcaccagtggaggctgcagaacagcaaatattgctgcctgatccttcccctggaagcttcatctcagaggggcacccagctgtatgaggtgtcagaacaccaattattcttaggtttggtcatttaacataatcccaaactttttcaaggctttgttcatttttttatttctgttttctttgtatttgttggattgggttaattcaaaacccttgtctttgagccctgaactttttttttctatttgctcaattctatagctgagactgtctggtgcattttgaatttctctaaatgtgtcctttatttccagaagttgtgtttttttaaatttatgctatctatttcactgaagatttttcccttcatatcttgtatcatttttttgatttcattaagttggatttcacctttctctggtgcctccttgattagctt

SEQ ID NO: 475062 - DNA, 897 bp, Homo sapiens
actactctaggtatctcagccatgcacgtgtatgccaccagccctcctgtagctgtgcacgtgcacactacctttcacatgcatctggtccctgcagctgaccatgacagtgcagaagggaactgtggggttggagccctcacacagagtccccactggggcactgccttgtggagctgtgaaaagaggccgccatcctacaaaccccggaatggtagatccactgacagcttgcaccatgcacctggaaaagctgtggacattaaatgtcagcccatgaaagcagccaggagtggggccataccctgcaaagccacagaggcagagctacccaaggccatgagagcccaccttttgcatcagtgtgaccttgatgtgagacatgcagtcaaaggagatcattttggagctttaagatttgactgccccactggatttcggacttacatgaagcctgtatcccctttgttttggctaatttctcctatttcaaatggaaacatctacccaatacctgtaccccactgtatctaggaagtacctaacatgctgttgaatttacaggctcataagtggaagggacttgccttgtctcagatgagactttgaacttagacttttggattaatgctggaatgaattataaattttgggggactattgggaaggcatgattggtttttgaaatgtgaaaagggcatgagatttgggaggggccaggagaagaatgaattttcattttggttagggatcattgctggacagctagtgttatcctttggtggtatcgctacattcagatttttcatggtgccagaattcttgcactgacttctcatctggagacaccagcacttctaattttttgtaattattttcatatgggaaggaatgttt

SEQ ID NO: 475063 - DNA, 1519 bp, Homo sapiens
gagcctccacacgctgctctgtccatctgagtcggagctgcagtctggtcctgccttttggccatgatccacacaactttttcttatctcgaaaaggtacccagtctcaggtatgtctttatcagcagtctgaacgcagaccattacagtaaattggtaccaggagagtggagcactgctgaaaagacacacgaaaatatgaaagcaactttggaactcgccacagctaaaagggcccaaggtacagctcaagctgtggcttcagaatgtgcaagccccaagtcttggcagcttccacatggtgttgagcctgcgagttcacagaagtcaagaattgagggcagtgcagaagggaaatgtggagtgggagtctgcactagagtccctgctggggcactgcctagtggtgctttgagaagaaggctaccatcctccagaccccagaatggtagatccactgacagcttgcactgtgcccctggaaaagccacagagaatgccagctagtgaaagcagccaggagagaggttgtaccctgcaaagccacaggggtggagctgcacaagactacgggaacccacctcttgcattggtgtcagctgaatcttggaattgagatttttttaaatttatgatttatttaacaccagtaaaattaatatcttcgtgtgctctatacactgtgtcaaagtttctatgtatttccttttaatcaatttttagatttgaaattatgctgatcaagtttgatcattttcgtgtccttgataaaattttcatgcttaaatacactcttatatgagatcatccacatatatctattttccttgccacctgtgaaacatagtgctcttattaagagtcattgtacaataacatcaaagaacaaatagacttgaaagaatcaagtacagtatttatattttttcttacccatatcagctattgactataaacaggggcgtttgccagttttccagaatagtaggaatgctttttttactcaaattcttttcattagaatattgaaattaccatatactagtctgagaactttttttttaagtgtctgtcatttctggttatgccttttttgctttacaagaaaaaaggcccatgataaaacttctgcaaatcttgctctgatacacaaaagagcaaatgcttctctttttatgactagtgctaagcaaagcaatatatgtaaaatatttttagctaaatcatcatagaatttctgagaaaaattttagtacatctggaaaaaaaggaaagctcaaataattctaaaaaggttatctgatatgtatcaaatctgtaattgttttgcattgattttaaacatcattggctattcttaaatatatttcaaatttttttaaatggccacaattattctatggaattccttgagattttatttcaaattgtgtttctttttggatgcacagttatttttaaagggttaatcatgcagaaatgtaagctgtgaatcaataataaccatgctggaaattaa

SEQ ID NO: 475064 - DNA, 1105 bp, Homo sapiens
caccacctgcagtccttggcccatggcttctttctcgcatcatttcaacttcttgtttccatgttcacatctcctactggtaactctgatctcctcttataaggatccatttgattatatagaatccaacaagataatgcattataattgccttatctcaagattcttaattgcaacaacgaagttcactttgtcatataaggcaatatttcataggttttggaaaaaaaaggcacggatatgcttctcacatctcctattcaacatcatactggaagtcctagctaatgcaataagacaagaaaagaagtgcctttcacctaccgccatgattctgaggtctctccagccatgtggaactagtctcactccgtcacccaggctagagctcagtggcataatctccattcaccacaatctcccaggggttcaagcaattcccctgccttggcctcctgagaagctgcagacactcaatgccagactgtgaaatcagccaggagggagactgtccctgcaaagcccaggggcagagctgcccaagaccatgggaacccaccatttgcatcagcgtgacctgaatatgagacctagagtcaaaggagatcatttcggagctttaaaatttgactgccctgctggatttcgggcttgcatggaccctataacccatttgttttggccaatttctcccatttggaatagctagatttacccaatacctgtatgcccattgcatctaggaagtaactagcttgctttcgattttacaggcttatatgtggaagggacttgacttttctcaggtgagacttcggactgtagacgtttgggttaatgctgaaaagagttaagactttgtgggacttttggaaaggcatgattggttttgaaatgtgaggacatgagatttgcgggggcgggcaggggcagaatgatatggtttggctgtgtcaccacccaaatgtcatcttgaattgtatctcccagaattcccacatgttgtgagagggtctctaggggaggttgtctaatcatgagggccagtctttctcatgctattctcatgttagtggataagtctcacaagatctgatggatttat

SEQ ID NO: 475065 - DNA, 809 bp, Homo sapiens
cttggacatctcagcctctagaactgcagtgggtctcagcagctcgggcggcgggaggaactgcagcccagcttcgcgaaggctctaggtgcgcccccgtccgcaggatcctggcacatgccctccccgctgccaggatgcccaagaggaaggtcagctctgacaaaggggccgccaaggaagagcccaagaggagatcggagcggttgttagctaaacctgctcctgaaaaagtggaaaagaagctgaaaagggcagcagggaaagatatatcttcagacaaaaagctgagctttcgcttgctgtccaccactgctgtttgctgccgtcgcagacccgcagctgacttctacccctccggatccagcagggtgtctgctgcactcctgatccagagcacagtggacaccctgccagatccagagggatggaagtcagtggcaggtctgccacagcagcaaacagcagtggtggacggcgagcgaaaactcagctcaagccgtaacaaacatggaccagaagagagtgcagctgcaagatttaatagaacgaaaacagagctcccatacaacgagaggggactcaaagaggcctgtacaaatttgctaactctgctgctgcagcagagctctctgaacctcttctggttctgagtgatccctggttcataaattgctctttgctcaaataaacttcattaaatttattttgtctaaagtctttcttttaatgaataccagtggggtagttccaaacattagctgaacataataagacaggaagggacatgttcagtgtggttgaaaaac

SEQ ID NO: 475066 - DNA, 3261 bp, Homo sapiens
agctgctctagcgagtcatccaaactgcagccaaagtggagactggtgttctcaaaaacggtatggcagtcacctttgctccggtcaatgtcacaactgaagtcaagtctgttgaaatgcaccatgaagttttgagtgaagctcttcctggggacaatgtggacttcgatgtcaagaatgtgtctgtcaaggaggttcatcatggcaacgttgctggtgacagcaaaaacgacccaccaatggaagcagctggcttcactgctcatgctggctgtgctcccgtactggattgccacatggctcacattgcatgcaagtttgctaagctgaagaaaaagactggtagcacttctggtaaaaagctggaagatggccctactttcttgaagtctggtgatgctgccatcgttgatatggttcctggcaagcccatgtgtgttgagagcttctcagtctacccacctctgagtcgctttgctgtttgtgatatgagacagacagttgctgtgggtgtcatcgaagcaatggacaagaaggctgctggagctggcaaggtcaccaagtctacccagaaagctcagaaggctaaatgaacattatccctaatacctgtcacccaagtcttaatcagtggtggaagaacagtctcagaactgtttgtttcaattggccatttaagtttaatagtaaatgactggttaatgataacaatgcatcataaaaccttcagaaggaaaggagaatgttttgtggaccactttggtttttgttgttgttttcttttttctttttctttctttttttttatatgtgtgtggccattttaagtcattagtttttaaaattagtactttttaatggaaacaacttgaccaaaaatctgtcacagaattttgagacccattaaaatgaagtttactaagaaatatatataatatatatatgtatttttttttaagaaataatagtaatctcacataagctctccccaagaataggaaataggaaactcttcccaccggggtgaaatctgatgagaaagaatgatgtgagtagatttttaaagtagtttaggggagtacacaccataaactttagaaacaaatataattttataactgttctgattttcaactctaattaaagctcaaaaaatttgcttcttggtgtaactaaatttttactaatagaataaagaaattcatgtatacagtatttgttgaatacctctcttctcccttctttttaacttctcccctgacagtggctgtccctcatgcattaacatgtgcaattgccttccttcctcaaaactctcccttagccctgtcatttcctctgccatctactccctaccttagccatccagacttgaaaaattaactagatttttgtctctaatttttcacttcccattttttcttttagcttcagcaatctgattttggtaattctattcaaaatgctttcagaaaagtcacgaatgaaccccaaattgccaaatgcaacgtgagctttttagtctttgttttgctggacctttctactgcacttaacactgttaatgaggaactgcttcttgaaacttttctccattgacaactttaataataatatctctggctttctaatcattatgtttctgcctctttgggtccttcctcctttgattactttgtatctttccttcaggggcccaagaggtatgaagactatatgagtacagtttcaaaaagtaaacagcctttcagaaaaatttaaatgcaaatttactggttatatacatgaagtagaattgcatgaatatatttctaaataggtgctctattcaactttttaatatatgcaatatttttattcagcaaattaatttatgtatttataattgctctgctaaagctttgaagaaatattttattaagttgattaaatattgcctctcattttctgtgaatttattatgaaaaatgtaaatagtctggaaataatatttaatgctatctgaaattctgatttaattaatttgtctgaatctaagttaatcagaattgcaaccaactctacatttcactgattaaaacattttaaatgcatcatgataagttgtattactatccttaaaataagtaaccatattcagaagaaaaaatagctacacatttaaacttctatcttgctcatctttggaaactttagggatgacccttccttgctttcaagacaaatcagaattttcagcattcagaatataagtgacaaggttgataagacaagacatatattactttctacgaaacctttaaaaggcaaaccagttactcaccagcacagctccatacacaacacagagactgagacaaagtcttcctagaagtacttcacaattggccctttctacaagtgaaataagaacataattgtaatctctacctaatagcctgaagcctttccctggtagtcagtttaaactgaattaaactacacatgaatatacaagtcaacaattaaagggagattgcaaaatatgggccaagagagtcctgactgagatgctagaaaattatgacttgtctaagtaccagaaagtatttatattaacttgcccttttgcaagagaaaaaaaaagtagttgagaagtagttttatcaaacacttttttgaatcagaaaagcaagtgctattcacctcgctgtaactgcgagtacggtttaaagtctaaatgtgtcctcaaaataaggaacacatgcaaataatcatctgtgaacttaatatatatgattctgataaattctctgaaagcagtatctcaagctgggcaaatttacaaaatggtaaaatatatgttgaattcacccaaacaaataatttcagctatttgtctacaaattacaatctcacattggcagttgctcactcatctaataaattatagccttctgattaatgatctagtccacaaaatcagagaaaaccatagaccaaaatttaggatgtttattttcaatttttaaatctttcttaaaacagttttaaaatattgtctaacaaaaaaaagtccttattctttagtttgactttcattctcatacattctttcagggagtaaatataaatcattaaaaaatggaaattttctaagcaggaaaaaatcaatgaaaaggaacttgtgtagtagattattctacttggaaaggtatagctaagttttttaatacattttcatgttttaaagaacatgaaatttttaagttgaaacagaat

SEQ ID NO: 475067 - DNA, 752 bp, Homo sapiens
gtgacttcagactgggcactcatgtgctgagataaacacggccaagccctttaaacaaacattgtggaaatgttaggccgagcggctctgctgctctctgggaaagtgttcggggttaccagtgcctcaggtctctcttctcctcctcctcccacgggccccctatccccaacagctcggacacccactctcaagcggtgcatccctgaggccctttcctctgcaccgatgctcggactctccgtgtgtgccattttgcagtggggtcacgctccacgtgttgttctgccactgcctttggtttctcgacactgcctcgtggacacgcagggagagcttgcagctggtgacaagctctccagcagggctcttaaagcagaccggagtcgcagaaaagggcactggacagagtcagtccacaagtatctgctgaggtcctactatgcgtcagacactgttcaggcacagggttgtgctgaagacgagagcaacaacatcccaaagctctgtcatgttggtggatgtgtcatgctggtgggggaaagacagagaagagtcaggtaaacatgtaagtacctttagacactggtcactgcttacagaaaatacagtcgggtgagatcatggtcccttgaagggcagacagaatcagcagacttggggtccagcttccatccagcaagaactgtgtgacatggaacacgactctcccctctcctggatttcactttcctcagctgcacaaagacagc

SEQ ID NO: 475068 - DNA, 778 bp, Homo sapiens
ccaaagctgcttctctcctgctgctccaccaaccctcaccatgaggcttccacctcattgctttaagatggttgcatgggctccagccattatgtgccagctcgcgctgctgtggttctcatctgtagaggacgtggaccatccagggaatcacctgcagctgacagaggaaactctgaagcccaccaggcctgtacagactggggaaacaccagtgcctgaggatagtccatatggcatctctgggtcattgatgcaatggggcccttctgctgagacaggcatctccgtgttggggccactgctcggcaagcagagcctgggcaccttccaggccctggtaccatggcaaggagcctcgcgtgtgacacacctgctctctgtgtgcagtgcccggccactacctccgctcagcatgagaaacacggcagacaatgctcagcttcaggggccatctttgagaatcctggggaaacagagggaagcagaagactgcagagagacatgatgtgtcctgattttttattttaaaaagctttaaataaagtatattcatacaaaaatacagacaatcatacaatgacatacctgcgtacccaccacccagcttaagacgtaaacatttcagttatttgttgcctgtggcccttctacacccatttccgttgctccctcctcacctccctgcctgtttgtacaattttgccacatctgtgtatattcataaatggcatatcaaatagttgggcaagttttaaaactttatataaatggtact

SEQ ID NO: 475069 - DNA, 805 bp, Homo sapiens
tcatcagttaaggcaggaacaggccatttgcacttcttttgtggtggaatgtcatcagttaaggcaggaaccggccatctggatgtgtacatgcaggtcacaggggatatgatggcttagcttgggctcagaggcctgacagtggagagttctgtagatgtctattaggtctatatggtcgagtgttgaggagaccaagtctcagctcaacaccactgggattcgtacttccattgtggggagttggtatcgggccactagctttgttctctggacccttgagctcaagtgtccatggagatcatgtggtttcctgctgccagaatctcagaggtctgtggcaagagcaggctgctccttaccagttcagctcaccccttccccaggagatactgaaggccaggaaagagtaccagtgtgtgatagcccagtgcaggatccccagcttcccccctttgccctgggtctgtgtcctccttctgtctaccctcagtgccttccctccaaagatctgctcagagtgtgccagtcttcccgatttcttggtctcttgatggcagatgttcctcctggctgcctgtaattttggggtagcagattgtacagaagcctcagttccataactctgtaaatgtgctccaaatgtgttgcagcttctggggagtgagtgagacgttgttgtgcattagtgggaaatgttttcatttttattataaacccctttgtattatcaaatatacaatcatgtatttctgaactttaacttgggaaaggcctaaattcaattgttgagttgtagtacatt

SEQ ID NO: 475070 - DNA, 811 bp, Homo sapiens
gagctataattctatcagctcccctggtgtcagcttgacaaatgcagatcttgggtcttctcaggttacataatttcttctgcttggagaaaccacctttcggtaaccatgtgttgttatgtttggtattggtggagtcaatttgctacatttctatgtggaatttttatagttttttcatgagcaatactgtgtttccaatggtcttcacagggcaattctccagctcagaaaatgttgagacatgggaatacattattaggaaccattttacagaaaataagaatcttagcagcaatatgtcagcacagtgtcactgtgaaacagctgaaaatccatgtgaggataaaactcatctgcaaaccaggaagagggccctcaccaaatgccagacaccttcagctgctgaaaccttgttcttggaattcgcagcctctataactgtgggaattgaacaatgagaacacttggacacagggtggggaacatcacacacaagagtctgtcgtggggtgggggaggggggagagatagcattaagagaaatacctaatgtaaatgagttaatgggtgcagcacaccaacatagcacatgtatacatatgtaacaaacctgcacattttgcacaggtaccctagaacttaaagtataataataaaaaaaaaatgcttggcaagaaactgaatgcagatgtcaacattacagggagcttatgctgtttggaagtaaaggacacaattctcttttcaaacttgctgaaaagaaagctcatagggaaaaaaatgaatgacaataaatataaacttcagg

SEQ ID NO: 475071 - DNA, 761 bp, Homo sapiens
caaccaattgccctcactgtaagaacagaatgttgaatatcggtcctcactctcttctggcttgtagggcttctgccaagagattcactgttagtctgatgggcttcactttgtgggttggggaagttctcctgggtaatatcctgaagagtgttttccagcttggttccattctccctgtcactttcagatggggtgtctgggcagatgtcttttttgatgttgaacttcctggcgcctttgtttacactgtgaggggaaaacctcctactcaagcctcagaaatggcagacacctctcccctcaccaagctcgagcatcctaggtttacatcagactgctgtgctggcagcaagaatttcaagccagtggatcttagcttgctgggctccatgggggtaggacccactgaggtggacgacttggctccctggcttccaccccctttccaggggagtgaacagttctgtctcattggcattccaggagccactgggttatgaaaaaaaactcctgtggctagctcagtgtcagcccaaatggctgccaaatttagtgcttgaaacccaggaccctggtggtgttggaacccgaggcaatctcctggttggttatgtacttttctatactggctattttgtctgtcagttcctgtattattttatggttattcttacctttcttagactgggtttcaattctcctgaatctcaatgatctttatgcctaaccatattctgaattctatttatgtcatttca

SEQ ID NO: 475072 - DNA, 802 bp, Homo sapiens
catccagtaacattgacatgcattctccatttgaagccctaagctccatgggtcagaggaaagtccatagccgacataaggcactgatgaaagccagcaacatactgctgaccttacaaaacttgccatttagctacatggatgacaatagcaacaagacaccttctcagaaggagacacaagatccctcaccagattctgaatttactagtgccttgaatttggactatccaaagtccaaagttctccagaactgtgaaagacgatgcaaaggcaatgggaatgaggacaagctgaagattgtcagtatctggaggagcaaggaggaaagagagaatgagtctgaaatcagtcagtacccttgtcttgcaggactgtgcagggtacttgtgcacaacgtgcaggacacctctgcactgaaatctgtggttgtgctacagcaactggttatgaagggcatcaagaaggctctcagacagtttccagaactaattgattctcagaccgagagctcaatgattgaaaaggacttcaggtcccttgataaagaacccttcaatgccacaacaagtgtttaaaataaatattagcccagttttccctcaaaaagaaactaaaatggttaggttaaagattgatccttatgagtagctaatgtaaagggagaatcttagatctaaataaagaacaaattagctagataggttggtttgaacaaaaaataattctgatacattccaatctgcattacaggtggtcctgaaaaatagtagtaaatagaaatattttcatcagctaattt

SEQ ID NO: 475073 - DNA, 703 bp, Homo sapiens
cctgactattagaagcaaaactaacaaacagaaagcaataacatcaacctcaacaaaaaggacagccatgcaaaaactcgatctgaagaacgcctcttctcctgtaaaggatcacaactcctcactagcaaggggacaaaattggatggggaatgagtttgatgaagtgacagaagtaggcttcagaaggtggataataaactcctccaagctaaaggaggatgttctaacccagtgcaaggaagctaagaatcttgagaagaacttaaatgaccaaatggagctgaaaaacatagctcaagaatgccatgaagcatacacaagtatcaacagccaaatcgatcaagtggaagaaaggatatcagtgattgaagatcaacttaatgaaataaaatgtgaagacaagattagaggaaaaacaatgaaaagaaatgaacaaagcctccaagaaatatggcattatgtaaaaagaccaaacttacatttcactggtgtaactgaaagtgacaaggagaatggaaccaagttggataacactattcaggatattatccgggagaacttccccaacctagcaagagaggccaacattcaaattcaggaaatgcagagaacaccaccaagatactcctcgagaggggcaatcccaagacacacaatcgtcagattcaccaaggttgaaatgaaggaaaaatgttaaggg

SEQ ID NO: 475074 - DNA, 788 bp, Homo sapiens
acttatcacaccgcattatggtaacagaacaatatttcgagatattaacggaggattccccccaccccaacccacccccaccctaccctgcctccaccctcatcccagccaccaactccaacaacaacacacctacaaggcatccccatatcctaaggccctgggccatctgggagcctcaaagagtaggtgacaccacaaatcacagtggggaagagcatgaagtatgtcaaaaacccatgattaagcagattccagaccctacaaccgggttacagccgcctcagccaccccgttctgcccaacactcagatctgaacccccagttgaatctaccacaggggctatgttggggtcacagaccccttttactaatcattcacagtgatgattatcaaaggcctgcaacccactcatgctaccccaccagctcctgagttaagaattcctagattaaacattcaagttaacaagtattttatttttaaaagccaggggctttagggaacaatccatggctctcagtaattttgttagtgagagattagttccactctgttagctttcctcccgagtctggttgacatctgagcctgcactcaaatgatgggaattctgttagggggctggtgggttaagtgaacagtttcaggctgtggagcagtgggaggaggaaggcttggcttggggggccagtattttaaggcagtgggaaggtactttacatgaagcaagagaggagaagagctcttggagatgaaatgccaagaatagatttcatctctttc

SEQ ID NO: 475075 - DNA, 720 bp, Homo sapiens
aggaaaaccagagacctttgttcacttgtttatctgctgaccttccctccactattatcatgagatatcggagacagacagatgtaggttctatgactacaggaatcaccttcacaggacgaaaccagctattgggaaacacctgtgacaccaactggagtcagccccatcagaacgttaatgctgcaggaagaagccctcaaccaatgatgggtgcggagttggtaggtgactattccagtgatgaccccatagattatgtcactcacatggccttccgattacagcttcatggagctccctccaagatgtctccagagttcttactgccccagggtctcagcatcactcttgtgggtagtctttcatccatagtaaacctaagagtaccactgagtttagaatcaagatacttttcccatgtattttacagaatagtgacattgattgtggttctccgtcgggatgagtaagcattcaaaggaacaaataatttgattacaggagtaagtatgtgagagctatgcctgattctggatctctgctgttagatttgataatctgaaaattcaagtcagtgatcactttgctgggagaaagtattcattcgaatgaagaaacagaactcattgaaatagactgttagaattactattagaaacataaacagaattcagatgtcaagaactggggagagtttgagactttactatacttgca

SEQ ID NO: 475076 - DNA, 610 bp, Homo sapiens
cagacaagacttgcggagaaactcaagttccatctgctgagatgagcaactctcctctggctagggttggtccaaatgctctctccatgcacgggcactggctgagcccagaagggcaagtcttactcaggttattgcgtccaagttcaatgccaccaggtcgcattagaccgaaaagggaagccatgataactgtacaatactctatccctcaccctagtcccccagtcagccctcagtatgtcttctggaagaaagtaacagaagataagcggggtgagagtgctggagcagtcaaggaggacgctgctaatgaatatcatttgaacagagacatgaagaaaagagggagacgcacagaaagatgggggcatacgcagaaggctgagcaagtgcaaaggcccctcaggcttgttatgtttgaggaacagcaaaaagattggcctggcataggacagtaaaccaggagggaaagctattgctggtttgtcagggagtcatggatatgtacgggctaccgtctgcctgcagaactataggcatagatcagtgaagcaccagacattctctgccttcaaggaacttctcctcgtatggtgagtctaggcac

SEQ ID NO: 475077 - DNA, 667 bp, Homo sapiens
ccgcgagggtccgcggcttcattcttgaagtcaaagacaataggaagatgtgggaaagtttggaactccctagaggcatgttgaatggttttgaccaaaatgctgatagtgatatagacaatgaagttctggctgaagttgtctcagatggaaataataaatttattgagaaccggagtaaaggtcattcttgctatgctttagcaaaaagatttcagaggatgtatggaaatgcctggatgtccaggcagaagtttgctgcagggacggatccttcatggagaacctctggtggggcagggcagaagggaaatatggggttagagccctcacacaaagtccccactggggcactgcctggtggagctgtgagaagagggccaccatcctccagaccacaaaatggtagatccactgacagcttgcaccatacatttggaaaaacctcaggcactcaatgccagcccataaaggcagctgtgggggttgtaccatgcaaagccacaggggtggagctgcccaaaaccatgagagcccaccccttgcatcagtgtgccatgggtgttacaggtggagtcaaaaaaattttggagctttaagatttactgactgccagctggatttggactgggtttggacttccatgaggcctgaagcacctttgttt

SEQ ID NO: 475078 - DNA, 590 bp, Homo sapiens
gtttaggctggcatgtgtctgatgagctccagaaacagcaaagaggttaatgtggttgagcagagtgtcagcatgagtgtaccttttttcaccgggcctttcctttccaagcaatctaacaatagcctcccttcagtcttcataacatcaccctttttacatttgtttcagaattctcacaactacaatcatcctaccaatatgcttgctaatgtgtctgcttctgtagctttccgttctcctctccaaacctacgtgaatgcagaatgttcccacagggccctctttgttccttatggaaaagggcacaaagtttctttgtcctggaagcttatacaaaatcagaggattcaaagaaaaaatacaagagaggaaaaagagagattatttcatgagataagaaaaggtctcatctcatcacagaaggaatggtaccagctcctccttgtacctctggtagaattcggctgtgagtccatctggtcctggactctttttggttggtaagctatcgattattgccacaatttcagagcctgttattggtctattcagagattcaacttcttcctggtttagtcttgggaggg

SEQ ID NO: 475079 - DNA, 586 bp, Homo sapiens
tatattataatgagagattttttctcactcagcaagggtccctgtctggagccttatgtctggctcctctatggtaccagaacagagctcatgccagtcagcagcatggggtttaaagatttctttatattggaactctgcaagcttgaatgaagagaaggacacagaaggcttcagaaatgaagacccaaagaaacagggaaacctgtgtatttctatgctgtttgataaagttgatagttgtggagaagtatgcgaggacaagtatgatctaatggccactaaggaagtgagtgcaaacactgttgtggaagcacatctggcaagtctgagaaggaataagatgcccagcagggcaggagcacagggaattgagtttatagaagataaagtcagagagttaacaggcagccacacatcctatagggacttacaggccattattgtaaaaaccttggttcttaaaatgagtgagatggtagatattggagagttttgagcagaagagtgatatgatctgactgaatagttgaagtttgaggttggaacatgtatatacttataaagcttcctagatcatttggat

SEQ ID NO: 475080 - DNA, 524 bp, Homo sapiens
gggtatcttttcagcaacaccccgctctactgtgagttaacaaatcgagtgtgtactcatgctaaagggtaggagcaccggaagctgttcagggcactggcggtatgcaggctctgcatccctagtctgcaccctcaggcacatgtatcccctgtgcaccccttcattccttcagccacaaattagtattattatgcaaatggccaactccaagatgtggctaccctttaacagattaattcagatatgtctgaattttacttgggcccaaagtcagacaccagctaaagtgctctgtaatcccactaaatctgaagtctcatacaacgttcaaagacacaggaatgtgaaacatcgcgttatgctcagggaaatccttgtgagtggagcatcgatgaatgagttaagaagcagtgggaggtcgggccagaaatgttggaaaggcaacaatcagtgtggcttcgtgtacaggaaactcatggctgggtttgatttctcataacagagccacaaatgggctgtgt

SEQ ID NO: 475081 - DNA, 609 bp, Homo sapiens
gaatacatcctgggggaagagtgaccagatgccccatgaaacatgaagagatccaaggcagagagaactcatgtcctgttcttcatctggatatttgatgtctgtttggagaaggccaacaggaaaatggtaactgagagagaaagagaggagcagtgctgctccaggattgcttgggtcaaagtgaagatccaagaagtaggagacctggattacgagacttgtgtcagtgatgggagaaagttgcggctgcagtcttggaggcatcctcagctccgtggtgctaagtgggagcagaatggacactcatatgaagatgggctctcaccatctgtaggattgtatgttcatcatcgtactgcaaacaatggcaaagacgtggaatcaacccaggtgcctatcaatggtggattggataaagaaaatgtggatgctagagctaatgatgatcagttggatttatcattttattctagatctttatcctagataattaccttttcatttcttccatatcatttttaattttcatttattatttatttaactgctatatttgcatatgtttaaaattcttacatccaggtagaaggaggtgcattttaaggt

SEQ ID NO: 475082 - DNA, 971 bp, Homo sapiens
ccttaagtaggccccagcgtctgttgtttccgtttttgtgtttatgacagccccttatctgctccaacaagatgaaagaaatgatcatgaaccaggaaaactcgccaaactgcaggcacaagtgcgcattggtgggaaaggaactgctcacagaaagaagaaggtcttccatagaacagccacagccgatgataaaaagcttcaattctccttaaagaagttacaggtaaacaatatctctggtattgaaaaggtgaatatgtttacaaaccaaggaacagtgatccactttaacaaccctaaatttcaggcatcgctggcagtgaacactttcaccataacaggtcatgctgaggcaaagcaggtgacagaaatgctacccagtgtcttaagccagcttggtgcagacagtctgactagtttaaggagactggctgaagttctgcccaaacaacctgtggatggaaaagcaccacttgctactggaggggatgatgatgatggagttccagaattgtggagaattttgatgaggcttccaggaatgaggcaagctgaattgagtcgacttctgaagaagataaaacttgaagaagttactgggagctgctattttctattatgactgctttttaagaaatttttgttcatggatctgataaaatctagatctctatacttctaagcccaagccccttggacactgtagcactttttagttttcgcttatacataatcattctttttagctaattaagctgcagaagctgggaaataaagttcgaaacaaaggttaataaagttctttgcctagtaaaaaattaaaaagtaaaaataaatttgaaagaccatttatatattttaataggcatttttcacatgttgcaaagattttccctagtgtttcgtttatcttgtatttttttgtgtgttgaaaacttcaagtaaagcccgaaagggtcttccactgc

SEQ ID NO: 475083 - DNA, 1166 bp, Homo sapiens
gatggccgaataggaagagctccagtctacagctcccagcatgagcgacgcagaagacgggtgatttctgcatttccaacaaaggtaccgggttcatctcactggggagtgtcggaaagtgggtgcaggacagtgggtgcagcgcaccaagcgtgagccgaagcagggcaaggcatcgcctcaccagggaagtacaaggggtcagggaattccctttcctagtcaaagaaagggatgacagacggcacctggaaaatcgggtcactcccaccctaatactgtgcttttccaacggtcttagcaaacggcacaccaggagattatatcctgcacctggctcggagggtcctacacccacggagcctctctcattgctagcacggcagtatgagatcaaactgcaaggcagcagcaaggctgggggaggggcacccgccattgccgaggcttgagtaggtaaacaaagcggtggggaagctccaactgggtggagcccaccacagctcaaggaggcctgcctgcctctctagactccacctctgggggcagggtacagccaaacaaaaggcagcagaatcctctgcagaattaaatgtctctgtctgacagctttgaagagagtagtggttctcccaccaggtactcctctgagacaaaacttccagaggaacgatcaggcagcaacatttgctgctcaccaatatctgctgttctgcagcctccgctgctgatacccaggaaaacagggtctggagtggaccttcagcaaactccaacagacctgcagctgagggtcctgactgttagaaggaaaactaacaaacagaaaggacatccacaccaaaaccccatctgtataaaaactggaaatgctaaaaatcagagtgcctctcctcctccaaaggaacgaagctcttcaccagcaatggaacaaagctggacggagaatgactttgatgagttgagagaagaaggcttcaggcaatcaagctactctgagctaaaggaggaagtttgaaccaatgttaaagaagttaaaaaccttgaaaaaaaattagacgaatggctaactagaataactgatgcagagaagttcttaaaggacctgacggagctgaaaaccaaggcacaagaactacgtgacacatgcacaagcttcaacagcc

SEQ ID NO: 475084 - DNA, 1148 bp, Homo sapiens
aaatccactcttctacttattagtagaatgttgaatattggcccccaatctcttctggcttatagagtttctgctgctatgttgtctgttagtctgatgggcttccctttgtggtcaggccactcttccatacagctgatgcagtttgctggtggtcaggtccagaccctagttgccttagtttttcctgtacctggaagtatcactggtgaaggctgtgaaacagcaaagatggcagcttgtttcttcttctggaagctctgtctcaaggagaaccactttccaaatcacaaatccagggatttccctaccccatggaggactcgggccccagacatacctctctattatggccctgaccagaataacacaagaaccttgggtgggtgggacattttcctatttggagctaaaagctctttcctgagcagctatgtgcctctgccagcagaagagaggctttgcaatctctggagaagtgctcctgctgatgccctcctcctccttggatctgtaagccaaactgaatcacagtgaaacacattccccagtcctcactgatgaacaatgtggtagaagatgcattttgtatagaaaagaagcctgaatgaaaagcttcttatgaaatgatggcagactcctttctcacaaaatgcattattcactaaaaaccaaatcatgttgttttggcctttcttgagacatacatatttattggcctttcttgagacatatttatttgacctttattgagacacgtttataaaaaactagatcaagcatcagctgttattagtaagttatatagggatctatacaagtatacctagtgatattaaaacccagaacagtgttatgtttaagcaaaataagttgcattagcttattattgcatttagagttaattttttccaacatgacaatctgaatatttgcaaaggttagcagttatgtttaatcagtaaaattaatcagtattagtgcatactttatagtgatcaatcacattcaattttaggaacagagttgatcacattagaatgtattagtgattattcagacactgaaaaaaataggccgttagctttcattttatgtcactaatattatatattactaatacttatttgaatactttgaatattttt

SEQ ID NO: 475085 - DNA, 708 bp, Homo sapiens
tgggaggtcaatgggactgggcgccacggagcaggggacggcgctcatcggggaagctctggctgcatgcagaagcccatggcgtaagggaggctcaggcaaggcaggctgcaggtcccgagccctgccccgcagggaggcagctgagacccggagagaatttgagcgcagcaccagtgggctggcactgctgggggacctggtgcaccctccacagctgctggcctgggtgctaagcccctcactgcccagggccagcaatgccagctggccgctccaagtgtggagcccgccaagcccatgcccacccggaactcgcactggtctgccagagggagccagctctggcctcggccagcccagagaggggctcccacagtgcagcagcaggctgaagggctcctcaaacgcggccagtgtgggcaccgagggcgaggaggcaacaagagtgagcgagggctgccagcacagtgtcacctctcacaaacataaataatcattgtctgagtagtgaaaatatagatttacttttcttctgtttgcataactaattgttgtaaagtgacaaatttaactgagaacctacttttatttttaaattagtaattttagtttcttttaaaagaaatttaaatttatattagagaaatttgttatgtaaaattggtacaaaaacaaatcttaaaatctaaattaaagacatgtatt

SEQ ID NO: 475086 - DNA, 1743 bp, Homo sapiens
ataaaactgaatgtcttaagcatcacgcaagtcacctcttgaatgctttgctgtttagaaatttcttccgtcagataccctaaatcatctctgtcaaattcaaagttgcacaaatctctagggcagagcatagaaaattcaacgtttttatatggagaactagatcctatacatgttactagttatgtggttgagctccttgacctatttatcattttgaaagaaactgaaatgactctgtcaggtgtagaatgtgcccagatcaacacaatgctcagcccctgtgctgtgatgaagagcaatatatttaagcatctaatatttatattcacttcaacttgtttgttcatttttcattgccttcatacaacttgcttaagtgacagcagtgacagcagtgaacttcgcatggagatcttgcttttaaagattttgcaggaaggaccagagcatcacttagtctgggtttaattcttctcattattaaggcaaaaacattttgaaaagtttcttcactaccctgaaaattatgaggtatactactgtgactattgggaacaggttctattctctgctctatatgagggagcttccagtatttttacctcttacttatattattctgtctctgttcttgtgtagttcatacctcacattgtttcacatcatcactgagaaaaaaattcaaacacattgaaacaaaactctgcaatagacatctgagaatttggacacttagtatcggtattttgaagtgtttcattaatatcttaagacaagtgtatcaaaaccattggcatattttaatttcaaatcaccaaatttgtttttactaacatgacaaactaaggattcactgtcaatgctacatctgcttaatttgacttgagtttacagggaaggacatctaaaagtcatgactttgagaaagtcgtaatttagtcatttttatgtattgtggacccacagatagctagctgagctctagaaattatgaggggaaatcaaggagatataaaatactttccaatattctaaaataatacacatatacttcagaaccaacaaaataaatttaaagaaaatacagataaacatttatggaaaaacatataaatacatattaacatactttaaaatgtctatgtggtttcaattttattaaaaattaaaatatataaaaatagtacatttgatattttaaatatatggttattaattatggaccctcataggatataactggattcaataatgaataaaaacatctctataaagtggtagctttgctaaattagaacagttaatctctagcctattagtctcctacatgctgaggcagccatggaaataaaaatgtgtaatagaattacacttgttattaaatatgggaatttctcttaagacctctattgacaggaaatgtttcttactacattcgattttaagttcagagaggtccagatacatgtttgtatggccttacttagggctgccatttcaacagagccagtattcctttatttttctctaccctcccagataagatgagataactaagagagaaaaagaggttacttgtagagacagtggagtattcataaaaagagggaagagatacctcacagaaattgctcataatgctagaaatgaaatagcatatggtgtaagttggtattaccactctttgcctgagtttttgataccaggaagcatggagatttgaatttaaatgtgcctatc

SEQ ID NO: 475087 - DNA, 1988 bp, Homo sapiens
gttctgctcttagacgccaacactccccacacccaatctaccacaaaatagaacaacagaatcagccaaacgccctctccacggaggcgaaggacacagggtcagccaaaccccctctccaccgaggagaaggacacaggatcagccaaaccccctctccaccgaggagaaggacacaggatcagccaaaccccctctccagcgaggagaaggacacaggatcagccaaaccccctctccagcgaggagaaggacacaggatcagccaaaccccctctccacagagacaaaggacacagaatcagccaaactccctctccacggaggcgaaggacacagaatcagccaaactccctctccacggaggcgaaggacacagaatcagccaaactccctctccacagagacaaaggacacagaatcagccacatcccctctccgtggaggcgaaggacacagaatcagccaaactccctctccgtggaggcgaaggagctgctgcaactgacggagggaccgtccaattgcttggaggaactgtgctcatcggctacataacccctgagaaaaggttaatatatccccttaaacattcttaagtgccaaatctctcctattccatgagcttaaaaccatatcagaccacaactactagcaaagcgactgggggtccacagtcatgcaggggaaagcacaggacttggagaagtggtggccaaatgactaactcaaggctggtggcccacaaatctgtcttcaaatccatgacagggacccttaaggggaagagaaaagacaattgtcaatgagagttgtatgcctatcccccagcaccctgtggacttgctgagaacaagggccttgttttcctcgccctttgtggctgacacggtgctggacacagctgcagcctataacttaggtcccaatcaacaacccttgaagcttcagcagacactatgtcaaaggctgcttagagaagacatccaggagacactatgtcagaggctgctcagagaagacacccagcagacactatgtcagaggatgttcagaggagacacccagcagacactatgtcagaggctgttcagagaagacacccaggagacactatgtcagaggctgttcagaggagacacccagcagacactatgtcagagcctgttcagaggagacacccagcagacactatgtcagaggctgttcagagaagacacccaggagacactatgtcagaggctgttcagaggagacacccagcagacactatgtcagagcctgctcagaggagacacccagcagacactatgtcagaggctgctcagagaagacacccagcagacactacgtcagaggctgctcagaggagacacccagcagacactatgtcagagcctgttcagaggagacacccagcagacactatgtcagaggctgctcagagaagacacccagcagacactatgtcagaggctgttcagaggagacacccagcagacactatgtcagaggctgctcagagaagacacccagcagacactatgtcagaggctgttcagagaagggacccagcagacactatgtcagaggctgttcagagaagggacccagcagacactatgtcagaggctgttcagagaagacacccagcagacactatgtcagaggctgctcagagaagggacccagcagacactatgtcagaggctgctcagagaagagacccagcagacactatatcagaggctgctcagagaagggacccagcagacactatgtcagaggctgctcagagaagggacccagcagacactatgtcagaggctgctcagagaagacacccagcagacactacgtcagaggctgctcagagaagacacccagcagacactacgtcagaggctgttcagaggagacacccagcagaccctatgtcagaggctgctcagagaagagacctagcagacactatgtcagaggctgct

SEQ ID NO: 475088 - DNA, 709 bp, Homo sapiens
aagaaaggctgaggaggtgcctctgctgacagtaatgcagagctaccaccaagatacaagccctgtctactgtgtcactttctcctgtccctgcagtgccaccacaaaagcccagccagctgatggctttagccaatgtggcagcagggagtgtgaggcttctggctttgctaggactcaggccagctgtctccgtcactgggctcagggtgctccctttagttacaaaatcagaccccgtgttgtggagcctagtccacttcaccctcctgccgcctccaccagagcaggtgctggtatccatggctgggagacccacagatgtttcacatcacaggactctgcagacaaccctctttaccagcccatagcctggcagacttgctgggtggctagacccagaagagaaaaaacaatcactgcagttcggctctcaagaagccacatccctaggaaaagggggagagtactacatcaagggaacacccatgggacaaaagactctgaacaacagccttcagccccagaccttccctctgacacagcctacacaaatgagaaggaaccagaaaaccaactctggtaatatgacaaaacaagtttctttaacaccccccaaaatcacactagctcaccagcaatggatccaaaccaagaagaaatccctgattaacctgaaaagaattcagaaggttagttattaagctaa

SEQ ID NO: 475089 - DNA, 496 bp, Homo sapiens
gcccccttcactatgaactttctgccccagagtggtaggcctcgctgtttccctgaaatcgccagtggccgcacattggaagcgcaggtctgggttgatggcctgggcaatctcgtgctccaggcgctggaaggtcagcttgtgcagaagcagctgtgtggacttctggtacctcctggttttgtgcagcgccagggtgccaagcctgtgccggtgaggcttcttgatccctcgtgtagccaggaccctcttgccggtgactttggtggccaggggcttcctgggggcctgccaggcggtggctttgtggtcagtctgcctaatgcgagccatggtgtagggctgtggcctctgccttgtcactgggctgaacctggtgaactggaagcagtgctggtaccagacagcaatggtggtgaggctgtgggcaggattcagagagtctgtgtgttgggatctatgcagaagatgctgccatacacttagccccttccaa

SEQ ID NO: 475090 - DNA, 989 bp, Homo sapiens
cgccggtcagctttcccaagagcacgcattgcgggtctgatgcggtctatcactggcagttcggtgtctgagaacgcggccattgccatggctggaatagccaaggtctttgttggagaggtggtggaagaggccctggacatgtgtgagatgtggggagagacgcccccgctgcagcccaagcatttaagggaggctgttcacaggttaaagcccaagggcctcttccccaacagcaactacaaaagagtcatgcaaacaggtgtgtctgctgagatgttcgccataccccgaggtctgaagggctgcaacgaggatggaatccctgaggccctagatgggaacttggaagaacccagggctcaggaatgtgagctcaggagtgaggatgtcatggacctcacagtagttgacaatgaggcctcagcctcagctcctcctgcagccaaaagacagaaaacagataccaaaggccagaaggagaggaagcccagtgtggatgcagaggaggctcagaggatgacaaccctgctgtctgccatgtctgaggagcagctgtcccgctatgaagtgtgtcgccagttagctttcccaaaagcacttgttgcacgtctgatgtggtctatcactgggagatcggtgcctgagaacatggccattgccatggctggaatagccaaggtctttgttggagaggtggtggaagaggccctggacatgtgtgagatgtggggagaaatgcccccattgcagcccatggatttaagggaggctgtttgcaggttaaagcccaagggcctcttccccaacaactataaaaaagtcatgttctaggcccaaggccagagggaagggtctgtttttgcaggagtaagtactgcattcatcttccaatgacaggactgtgtttgctggagcttctgcctctcagtctaccctgtatttacccatgatcatagtgtcttaaaatgtgaagttggccttacctg
